United States Patent 10,724,096 (METHODS AND COMPOSITIONS FOR INHIBITING AND TREATING NEUROLOGICAL CONDITIONS) - sequence listing, part 41

SEQ ID NO: 843 - DNA, 152118 bp, Homo sapiens
tgctttacgaaaccttacttcttaaaaactgttatcatcactccacatttctcaaaggaataaatccaagcctttacccatatttctctagaatcatatttacaaaatgatattaatattaaaaaaaggagattgcaagacagagaaatggcattaaaacatggaacatttgtccatctttctacctgtggtaacatttaaaagcctgcgtattacaaaggctgaaagcattggcccagagacaggcggcttggggagtacccaggtctgagtccctgattagacccataacattgtaaaagctactcaaccagtcagccctcatctataaaaaaacgggttaagcatagagcatgcaaagtgtgtgggaagttgcctgccccagatgcgttcactaagttagctaccactgattttatttaaattatagaacggataagtgaatatgactgcagttatgagaaaaagccataacatccttttctttttttttctgaataactatttgagcacaaactaatatcttgttccagatattacatagtggtggacagcctggaaggcaggatattataagggcttaatttaaagtcatctcagtcaagtaaattaacatattctaataacttcctacatcatagaaataagcctgaagctgttccagaatgtgtaggctgaggtgaggaggcagcccaggaggaaactagataaagtgtaaacaaattcaaagattataggcagttaatggaatggtgagaatgagattgtatcttcaatttacagggacatcatgagataatttaggtaaattagacagttaaaaactatgtccagataacgggaaacatactggattactgttattatcccaagttttcttttctattgttcagcagcatctacacagtaatcatcaaagaatgtagctgtgtgtataatttgcaagaagacctaaaattttctttattgcaaagacaacctgattgcctcactatctaaaaggaacaactaacataaattatagctagaaaattgcctcactaatgtagtcccaaattaacctctgtaaatactttcatatgttcaggcatcaccagagacataattctaaaaacatttaaatgtattactgcaacccaactagtggatgaaaatatgttgtttggcctggtattagaaaagctgaaaagtctttcaagtattgtcatcactcttactattcattatctttacatatctctctttaaatggatgtgttatatccagtgtctttctactcacttctagtaaagaatgatcatgcaaaaattttaaaatataaagaataaagatttcaatagccatagctctaagtatcaatgttttccttcaagactttttatgcatctttatcttaaaattgctcatgttccaaaaggggtataaaattgcgtctaaatctgtaatatcttttcctaaaccatgatatgaactattaatattttaaaccaagtttgtgtgtgtggggggggggtgtttttagcatattaggacaagttagtaatcgagcaagtattctgcttttatgttatagcaatttgttttgtgtgtaagtgctcctaaaacaagcatcactcttttgtagaatacggttttagattataaatatgcccaaaggctcagcaaagggaatctgactataaatttagcagaaataataaatgtactagtttccactgctttcccagaaaatcagaatgtctcctttttaatgttactggattcatgtgtgctcagaagcaggccaaagcaccttaactgtttcttgttttctccttcctcttttccttctttttcttcttcttcatctttttttggtgggggagggtaacaggggtaaaaatattgcctgaatatgcgtttctctagaagggaaattaaactgctatttaacttgatccgatcattccagtcttgaattgtttcttctcttctgttgctatattttaggttcagagttcaattagcaaaattatagtttcgtttttcccctggtgagtgtcttttaaacaaaatgatttaagcaagaaactgctttgtgagtgattacatttatctcagcatgcattctatttctctctggtttggccaattagagatataacaaaggcctacgacttctatcacatctacaaactatactgtttggtgttacattaaaacctcaaacctaatctctaaataacttaatctctaaatactggaatctctaaagagttcaactctctgtatactacttatagatatgagatccatctaatttaaaagacggagtttatgaatattagttcccttaggctactgtgactacttccctaggagacactgtgcttagtttaatgataaattttaaaaatgaaaatgaatatattcatgaatatcagatgttataaggtcaacaattgatttgacttggaaagaaattgattttattccgatttaatgacttttgtgcccttttagtcttaaaatattatttctatcattaaataatagtggtaacagtgaatagttccctcactaatgtgtattatgatgaattggaaacaaaatttttaaaaatgttttcattattatttatgatttgtatgtgttttaaatccatccctttatttttttatattgttgttctgatgaaaattccagacttggatgacatgattggaagtttaaactgaacataccctaattttcttttcttttcttttttatttcattgttttcaaatcaaccttattttaaactccctcttacacagagacacactacacaatacagtgttagagcagaaaataaattatttacaaaaatcatttagagtaaaatcacatttttatttcaacaaatatatcagattaattgtatctttatgatcatttgttgctgtcagtctattcatactgggaaaactgtcacattaaaaatcctcaaaatagttttagcacaggtcaaatcttattttgctaagcccctgagctcttcgaagaggctgaccttatgcattgacctcttccccagctaccctggtctcttctctccagaatgccttgctacatgctctggcctcaaagctacttttttccccgctcacattaactctaggtgaacatttaatgatatcacctttttagccaacgatgctctgcagaaaccatgtagcttctctgacaagtagacttagagtccctgccccaaataggacctcataccattttcctgatgcttactgacaaggaagaggatccagatgagggtacattttgggtatccttcttattattcataaaattgccaataatggtcaatcttctaacatctccaagcttcatgtctcagataatcattcaaacattggatggcaaagaggtcgtcgatgtcaagcttattggcaaacaagtggtgcttgcacagcatccatttcaagtcaccagctctgaaaatgcacaccaagtgcacgtggtccccatcgtagggtgggtagggagcatcctcagaaacatcaccctccaagtactgccacttgacaaacctggcgactgcatgcgtgtcagacaagtcatacttatggcttgtagagagtgagccggggacttcaggaatactctggatggtggctcagagatgctcatcagggctgtatgtgtcttgtgctcactccataaacttttggatttttttaatcctgaagtacataccccacatactccctactgaccacaaaataggcacagcctgaacaaagaagtgtttcaagtggaggaggcattttaacattccctgtgtttgtcagctttccaaaaacctcatactgctttttccacctttctcctttattggatagcatcctctccatttcgaggttgttttctcccattaacaacttgatcttattaacaacattatgttatcattgctatgttttagcaaagagactggcggcattttgcccatggcctagagatttgtggaactttgaacttgagagagatgatttaggatatctggtggaagaaatttctaagcagcaaagcaatcaagagttgacttgggtgctgttaaaggcatttggttttatcaaaggaccagactttataaaactttagaaaatttgcagtgatacaatgcaatagaaaaaaaatcccattttctggggagaaatttaaaccagctgcagaaatttgcatatgtcacaaggagtcaaatatgaatccccaagacaatggggaaaatgtttccagggcatgtcagaggtcttcactgcagcccctcccatcacaggcctgaaggcctaggaggaataagtggttttgtgggccaggcccagggtccctgtgctgtgtgcagcctacagactaaatgccctgagtcccaactgctccagccatggctgaaaggggccaatatagagcttgggctgtggcttcagacagtgcaagtctcaagccttggcagctttgggaacctctgcctagatttcagaggatatttggaaatgtctgaatgcccaggcagaagtttgctgcagaggtttccatacatcctctgaaatctaggcagaggttcccaaagctcaattcttgacttttctgcactggcaggctcaaaaccacatggaagttgccaaggcttgaggcttgctagggcaatgtggaaggaaaatgtggggtcagggccccacacagagtacctactgggacactgcctagtggaactgtgagaagagggccaccatcctccagacaccagaataaaagatccactgacagcttacacatgagcctggaaaaactgcagacactcaatgacagcccgtgaaggcagctgggctcttaatctgataggttttcctttatatgttacctgatgcttttgcctcatagctcttaagtttctttgctttgcctgaccacatttttaacttttcttaccaaatcctggctaaaaaaaaattacagcctgaaaacatttctatgaaaaaataggggtaagggaagagttctaacaagaacttttatctcctgaactcgcctatcttttcatcataatctttctgagaacattgtaactcacggcacattttatgagagtaagggtagaggtagtatgtatgtgcagattaaagattaaaaaaaacaatatgtttgtctaccctctggccccaaatcaaataccctcatatgtcagactttgggagcatcctgtataatcctcctgttgctcccaaagaatacttatgccctcaccatcattagctcagtgttgatgttttatattattttatcctgtatgtatgttttcctaaatttataaccatatgaattcaccttaatatagatgacatactattttatctatgcttttttggcctttcttttcatcacctgcatgtggcaatgcatccacagtgacatatgcagcaataattcatttatgaatatgtcaaaattaattcatccctttgtatgttaatggtcatttgggtcatttctacttttttcctcccacttaaaataatgctgtaaactttcttgtatatgcttcctggtgagtgtatgagtaatttcattactggatagcatgggatctattaattcaactttaccaaataatcctaaattgttcccacaggagtacctgagagcctccactgcccaacatctttagtattatttgtcataatcaatttctaaaatgtatatattagtgagaaacattattgtcaaaccatgtcatgtttttaatttgcatttccttaattatcaatgtcatttctttgtaagtataattactatgtaacacattaggcaaagaattactgagcatactactgaatcctgagtcaaaaaagtttactgcaattgtatcatgttttcatgaaagatgggatggtcaaaacgtcatctgaatttgtcaaactagaggcaaaggagctgggggtttgtactcttgaatgtggttatggactttggccagcactatagggggattgatataaaccctcacatgtttctggctctctattcaggcaatgaaacccctgctgctaaagggtcatctaccatagaagagtaacaactgggccagtagagagaaaagcgcactttgaagcaagcagagaggtacgcagaaatagtaacaaatttcagggcactcatctacacagagtaccaacagcatcctctctaggagaatcttggtagtttggtaaacggaaaaggggttcttaccaaagtgttcaacttagaaggatttctcaatagctatctttaaggactgttctatacccagttgtcagcaatgtgttgaccagtcacatcagtgaagacatagaaactatgtatatcagatatgaagataatttcaaactaggaaaataacaaacacaaaatgagtcaaattaagttttaaaatgctgttaataggcatgattagcagacatgaagaagacaaatttaaaatattttatttatattttaaaattcacttatttacatacagaaaagagaaccaatttagaaattgatagttttttattgaccacatgcctaggtaagttaacgactatggtgaatttgctaaaataagataatgaaataacataatcctttaatggaaggaaaccgtcttaatcaatttagatatgttctgtttgtaacacatgtagaggttatttgccttggaatgccatgatttttaagagataatgtaaaacaaaagtcagaacaaaaaggaacatgaggatgaagatgggattttgaaaggagaataaaagtcacagatctgggggatattgaatctggaaaagagatttttaagaaagaacactcatccatagtttcctaaaacttttcacaggcttttttcttaaaatgaaatcaataaagataatatagtgtcttcattgtgaaatttaacaagtataataaatcaaacaccctatgcaactaatttattattcatgaaataaactatgattagctcctataaaagaaacaaatgtatctcttcccaatcagaattgcctctttctgaataaagtgaatcttagtatttactttttccccctggttctgcactaatgtatccatcaaactattatctagttgcttttttttgcttttgaatttttttaaggggaatcatctatattgtttgcggaatttatttatttatttatttatttatttattatttttgagacggagtcttgctctgtcgccaggctggagtgcagtggcacgatctctgctcactgcaacctccacctcctgtgttcaagggattctcctgcctcagcctcccaagtagctgggactacaggcatgcattatcacacccagctaacttttgtacttttagcagagacggggtttcaccatgttgatcaggctggcctcaaactcctgacctcaggtgatccatctgcctcggcttcccgaagtgctgggattataggtgtgagccactgctcctggaaggaatttattttttttaattctgtgtttttaagatttttattttagtgaaactataatttattcatttttattgtttgccatttaaaaaatataacacaatttaactatgtatattactatggattagcatttgagttgttttgaatttttttgtgtgttacaaacaatgctgcaattgatatttctgtgcatatgtgcattgaattctttagcatatatttctagaaatagtaatggcaggtcatctcactttggttttctgctggctgtgatatttctcttagctcatttcttccttctttttatgttctgattactttttgtcattccatcctttctttctctataagttataggctcttactatctattgaaataggtagcctaaaaataaaatacatatactgaacttatcatagcttactgtgttcatcgtcatttttacccttctgacaggcatcacaaattaccttgaactctttaacaccatttctttcactcttttgccttacaagatactgccataatatttatcttaaaaaaatttactactaaaaaaaaccttgtaaggataaattattactgtttaataagctagctttcagttcagttacatttatcactcacttcctttaaacatcttagacctctctcctattcagtataattttacttgcctaaattattttcaaaagttagaatcttctggtagaatatacttctgttattgttttttctgaaagtaacgttgtttttgaaagagtttgacatgtacggaattctacattagagaatattttcttccagcaccctgcctatttaattccactatgtcttccattgttgctgctggggtgtaaaagatcagcgtaaccgccacttgcttgaagaaactctcttttcttgctatttaaaagattttctttttgtctttgatttcctgcagtttcacaatgatttctttaggcatagagctcttttttttacctatactgtttgagatttgtggagcttcacgaatctatggatctgtatctttaaacacttcaggacaatttttagtaatgatattgtaaacactgcctgtgccttattcttccctcctcttatcttcttcgggaaaatcccctccctactcaaatcacatgttacatattctcattctaatctctatgtctcttaactttgtcaacattcaatgtttttgtctctctgtgttcatttttgatactttcttctgaaggatctttcagtttaccaactgtcttgtcaatcaggaaaaacctgcccttaaacccgtccagtgacattttactacattttttttttaaagtttaattttgttattttcagagctgcttttttacttttttggagctttatggtttctaggtcgttctttcaaaattgcccttagaattatttattttaaaacttgatcttttggcttaagattgacttggcaataggaacaattttacactgttggtgggactgttaactagttcaaccattgtggaagacagtgtggcgattcctcagggatctagaactagaaataccatgtgactcagcaatcccattactgggtatatacccaaaggaatatatatcatgctgctataaagacacatgcacacgtatgtttattgtggcactattcagaatagcaaagacttggaaccaacccaaatgtccaacaatgatagactggattaagaaaatgtggcacatatataccatggaatactatgcagccataaaaaatgatgagttcatgtcctttgtagggacatggatgaagctggaaaccatcattctcagcaaactcgcaaggacaaaaaaccaaacaccgcatgctctcactcacaggtgggaattgaacaatgagaacacttggacacgggaaggggaacatcacacactggggcctgttgtggggtggggggagtgaggagggatagcattaggagacatacctaatgtaaatgatgagttaatgggtgcagcacaccaacatggcacatgtatacatatgtaactaacctgcacattgtgcacatgtaccctagaacttaaagtataataaaatatatatatatataaataaaaataaaacttgaagtaaaatatttctgcaaaagagatatggggatttagaaaaaattattgaaaatcaaatgatatcctataattacataaagatgaataaacattttgaagcttgctctgctgaatttttctcattttctccttcacaccagttttcacaatttttaatcctgatttgaaatatattttttactgtatcaatggggttatagattcactgaattccactgtgtttgtccatttggaggctctggaaggagctaacagaatgcaatggtttgaaggtggaaacataatccccaatgcaacagagtttagaggaggattttttttttttttttttttttggagaagacagagttttgctcttcttgctcaggctggagtgcaatggtgtggtctcgggtcactgcaacctccgcctcctgggttcaagtgattctcgtatctcagccttccaagtagctgagattataccacgcctggctaatttttgtatttttaatagagatggggtttcaccatgttgaccaggctggtctcgaactcctgacctcaggcgatctgcccgtcttggcctcccaaagtgctgggattacagtcgtgagccattgcgcacagcctagaagtggacttttaagaggtaattagatcgtgagggctctgttctcatgaatggattaatgctgttattgcaggagtgggttagttacataggagtatgatggggtattcacttgcccctttcactttccaccatggaaaggtgcagaaagaaggtcctcactagatccagtcacctcgaccttggccttcccagaacaccataagaataaacctccgttctttataattacctagtctctggagttcttttatagcagcacaaaatggacaaatacagaagacaagatgagagtgagaagaaactattcatgttcctgggtctttcatttaatttcatcaagggctagctgtgtcactcggatgaaggccaaccctcctgttcaacagcctatgctacagctatagtgtctaggatatgctggcagctaaattatttgcctcattagaccaagtggtgataccagctcccttactgcaagtcactaacactgcactagtatgtgttggttgaccttacctctacacatacctttataacaactaacaactgtccctttattaaacttaccaataatctgttcctctttactaaccattttctgttgagaccccgaattatatggacctagaatggcacattacttttctatgaatcaacattcaatagatagatactaaagcattttatagagaacttttttggtggagatatatatatatatatacatatatagcacacatatataaatccacatatatattgtgtgtgatatatataatatatatagatttatatatatattatccaccaaatatatccatattatatatataatctccatacatatatatgtgtgtctatatacctaccaaatatatccatattatatatatacacacatatatatgtgtgtatacaattttatcatatgcaataaatacatacatgtatatgtatatatgtgtgtatatatacataatattttactcaaggaccatttattctattaggttaaattataaatatacataattacaattagttgccaaactaatgtgtagaaatggaatagacaggaaattgtaatacttaaaacacaatgttaaaaattaacaaatctaaatcacatactaaatatcatgttaaagcacaggaggaataatgtaaacttgaaattttaggccacatagactagtaaattggaagtcattttatgttaaacatgaatagaagagacaaagatatatttcttaattaattttcatacgccatttgtagagttagcaaaatttgccactgaagttaccgagcaatacgacctgcaagggtagaacataaatgaggcagatctgggcctgaggtactggtttgggattaatttgcataggttaatggttgaagttgcaacatgagtaatatccgtacaataaactgttaagagaattgccacaaatacatatttttgggaaaaaaacattatttatgagcaggagaaacaaatatccagtcaataaaatagataaaaagaaatgtaagggatttaattagataagaataatgctatcagctcactgtcaaatctactaatctgctggtaccttactcacactctctgtcttctctcctgtcacagtgtgttaaatgctcctgctcccacccaaacccagtcctttatattctggaccacattcctttttactgccctgaataagccctgcccctgcagttatcacctttttctcttgcattgtaattttttcttttctttgtaagatcactcttataggctataaccacgccattatactatctttaaaaaatagttcacctgatataacagccctgtgttagatttgattatatttttcatacaagtctttcatacctttctctagattttgtggtgtatatttcccagccctgttcatattgggaacaggcttggctgttcccaatatgggcttggctgcatcattgattgcctgatggaatgtcattggatgtgacatgagcagaggcttgatgatcacttctgttattttttctgctctcttgaattcctacaatgtgcatgagaagcacagaagacatgtaactgctggcccttcagcctgtgccctagaatgaagacacgaggaacaaaactggacccaactgtaagcctggagtgtcatcaggtcaagaccaatccagtggagatcagccaaacagagccaatcttcaaacaagggagcataaaaatcaatgtttgatgttgtaatccatcaagattttgaggcccatggctcctcaagctaaacctgtcacgttgttctctattcttgctttcacttcactttccttttttgttgagaattatgtccatgtcatttcatgaaacttgttacgttgaggtaatcaaagattgctagtctgacaaatcctgacaaatctgaaggtcactccttagccttcttttaatgcatttaacatatttgtccacttcctccttagaacacttttcctcggcttctggaacatcccactcacgtgattctcctccttcactgtcacttatttttagttttcctctttctcttcctggcatttcagtgttagagcacctgaagatgtggttctcagttcttttttcctttccatatatactcacatttctcttctgtacataacttacatcctagagtattttatgtcatctcctgatattacctatcatttttttgtaatgactaacaaatttatatctaatgtaagcctctcctttgggttctaacccactattatccaacttcacttgagattctaacagaatcctcaaatttaccatacgcttcattatttaagacaaaggcagcatactatgtaagacgtcgatatatgggagcctgaggttggtatatatgggagctctttgtactatctcgacaattttctgtaaatctgagactattataaaataaaaatattatgttttaaaatatgagaccccttttggataatgtacctaaatgataatttgacttaacagtggtagggaatgcagttacattagtcttcaggtagcagaataggccatctcgttaaatatgcactctttctctcttttgagtgacagaatctaaagatcatgagcctcaaaaatgaaagcaaaaagaaaaagagagaacatttttaaaagtacaaaccttatacacctagtatatctatattggtatgaattatacaatgacacatggaattaccacttgatatatcctatgattaaaaaaacatgtaaagtctggatcttttaattattgtgatcttctttcacaaaataagcaaatatttaatataaaactgattatacagttgaaattgctaatcactgcattacagagatttttctttcctcattaaatactctttagtaatttttaagaaatccaacataaacaaaggtaaagcttaatttctaaaattcattccaactagtaagaattcaaaagatctaatatacttatttatgtgacaagaatgcaaattaaattactgttgtcttattctaaaaacaatatttgcaggttgttttcaatagcaattaaaccctgttttaattttagtatggcatctccatttgctccgagtattacaccccagtcagggcctatttgcaggtctgttctattgcacaggctgtatgtttcctcctattttctttctctgtttcaactaagtctcccttttgtctcatacatttctcttgacactaaagctatgtattttatgctattggcggcttgtcctgaagatagttgtaaaatctgtctttttccaattatgagaggtgttccataaattctttggggaatattcattttgagatgtgcgcctgtaactcccattaatgttgcccatttaaacttgatttattgctttccttttctgtctaagtgactccagcctccccgttaatgcagtttgtttataatctccaaactcccccttacctaaatgcagtctctcacaaatgctttgcatgtaggtcatttattaaattgtaaaccaaagtaatataaaatcaactagttttttgaaaggctgaattttattcttttttggatgcctcctgccatgatataaaatacaatatttgagcttggtcaactgagaaagagtaaccttgcactaaaataagcctagctataaaaataacttgcttggattgatcaatgaaacaatgacctgaaaaaattaatatcacagaaattatagactagataatattttttaaaatggcatgtttgtaattttacagttgaggttgtattactagtctgtaaatccatttatagctgtgaatatgtagttgaaatattgtaaatacatattctcctgaaagtagccagtctgtaaaacaagttcctgtttttttatcatttcatctcattttcttcaacttttattttccaacttccaaaatgcctcatactactaagttgactcattcagtatcttagtttccagaacatcactgccctattggagtcactgtccccagctgtccccaagtcataccaaagagtttcagttctctttcagttgagttttccataacacatatagttttatagatattgtatattattatctatgtgcacatacatcatggaccttgtcatcacccaggatatacagtttttaaaactgtatgttggcattacattttctttactgccctatgattaatgttctagctaaactttgtcctttgatgaactattctcccaggttattgcttccttgagatatcatttaacaagttatttggcttgaatcttgtgaccaccatgtgaaccctaagtcatgccttttactatcagcttgcatttatttgctactttaatgttttaccatagtcatgcagtcaatataaaccttgggtacccctaagcatttcacttcttggattctgcaataggtagctcatagacaggctgcaaggctccagtgcatgtagatttacagctttcccaggaaacttagttacatttatgaattaaaaataaaatctctgatcaactcatctgggcctttttctcttctgaataatcactgttgtgaacataattctcaagctcctctttccacaggctgtactttcggcatgttgcccagccttctccttcaccaaagtgcaaacagtaatgttttcttctttcctctcttctctcaaaactaaatttcatctgcactttctcttcctgccagggtcaggtgaaactacccccatctatacccaaggttgccatcttctccttcttctagaatcatacaaaattagtttacttatctcttgtgcttttagtttttctaaattatgtctcctcttccttcgttttctctttctcctcctattgccataaattcataaaatatttttcagtgtttttagtatttttaaacctttctctagcatgccttcctttagtatcgccaggtttaatgaaaaagacaattcacctttattgcttcatttttaaacagctctccccctccaccccccaccacctccacccaatccactgcaatttgatgattgcagtcaccattttaccagtcttgaaaatgttgatggtggccaggcatggtagctcacgcgtgtaatcccagcactttgggagcggatcacctgagatcaggtgttcacgaccagcctgtccaacatggtgaaaccctgtctctactaaaaatacaaaaattagccaggtgtggtggcatgcgcctgtagtcccagctactagggaggcagaggtaggagaatcgctggaacccaggaggcggaggttgcaatgagccgagatctcacgactgcactgtagcctgagtgacagagagagactccatctcaaaaaagaaaaaaaaaaaaaaaaggaaaaggaaaagaaaatgttgatggcatttaacatgcaagattcagcgatcttgtactaaccctcattggtttaaagtttgcacttgattttataatgatctcaatccctttctatgggacaccgtctactcttgatttctgagacatgagtacatttgatgtgcctccaagcattctgtctctctctctctctcaaccatgttaacaaatcctaaatttgtatatttggcctaatttttctcctgagttacagagctatatttctaatatttgctaaaattaattctaataagggaccaaaaccctaaggttccaaaacaaaactatcactgattagctacccagaaacgttaccttctttctcctgttttccctgttttacttaatctttagagtaataatgtattcttctttttgttacctttcaaattttcttatccttccaattttacatctcaactctctgctctcatttattttcctagtacaggtcctctcatctcatgttttaaaaaattacatgactgtattttaattatctctttttgtaacatttaaaaaattagttacaactattttggttgaaaatggtcaaaacctaactccaagtggttattaaaaataaaagaatagtaaataccagtaaggaccaaatgactgaaaactcagaagacattttagctttaggcatgactagctccaagtgtacagataatatatgcaggtatttgttcctctttatgcttcctgtttgcttacctttttgttgcctacaataagggttcttactctttgttctcataatgctgcttttagctacattctatcagtatgatcacgggataaatataaaatgtctattaactgatagttacaaataactgattatctatatatacttgatttactatttgccttattaaagagatgaaaggaaggaatgcttgaattggccaggtctgagatacaagcccattcaacaatgagaagggtgttcaaacccatgtggtctaaaagactgagactaaagagggcctgatacccaaaaaggaaaatgcttgacaagctaaataacagatccctgttatattctaatgcacaaatctgatatttggcaggtagagccctaaattttgagcctggcattaaggcccttcacatactccccgcttcctagctttcaacagcacaatcttagccacactgggacttgggcttctcaaagacagcatgcctgtgatgggtatggctcacattgttccctgaaaacccccttgtgttctccattgaatggcagtgcctcctctatcctacaaagtggagcccatatcctattttgctgtctttctccaaagagacgtactcatctccatccaggtgggaattagttcctacagtgaacatagtagcaaacgccctacaccgacctccctatatccttcctttgctgcttgaagtagggatcatatattgcttgccttttgatccccagccttaggcataatgctgagaagaatatacttggaagaattcctgacatagagtataagctcagtaaatatttgttaactcaagtctctacaaacagctgaactagcgcaagaagtagctgaaatgagcattttaacttatggatgccaatttgggttggaaacaactatgtatttatattaacttaaactttatggggacgaaatgatttgtttattgcatcttgatatttgaagttcatttcaggaacatactgctgaggggaaaaaatacaaggactggctgttctctgttcaccaaatgtttcagaaatttagtgcaaaatgtatgcttctattagccttccttcaattagtgattcatagctatcttggatttacttctcagtgtaacactcggcacagttttcagttattcagaacataataatgtccccaaacattaaataattatttccaccatcttttacacaaacagctttgttctccctaattttaactgatgctcaaactctcaaacaaatgtggcctttaaattttaatggaagtccatacaaaaaaagacataaaatgatatactattaaatataaacatatttaaacaaaattgttattcctttatacactatattttatatggtgttggttctctctgatgctggaaattcatctttatgatcaattaatgcaagatgtaaaattgaatatagtacttgacttatgaacccagaaaacactaagagcatatctgacccatcctgtgcatctattcacaggtcatagccaagtcaaacacagacacaaagttattttggcatatgatttcaaggaaaatgcctggaattgcaataactattctattacaaaaattgatatgcaaggtcatgatatgcctgagaacaatttgatcattatagtaatgtttacatttacgtattcattcattcaaagacatctagataaatagggaggctaaataagagctatataagtatggttatttcatattcactgtaaatttttgctagaaagtaaactcattaagggaatgaaccatttctcttccacacatctcctatgcctaacccaacacctaacacatacaagaggttggttggttggttgtagttattgtaacagtagtcttcatcttcaatatccaccactacatttaaactgtgaatcccataccctacaaattcaataattgttagtaacaagaaaaatgtttctgaaaagccaggcatttgggccgggcaccgtggctcacacctgtaatcctagcactttgggaggccagaggcgggtggatcacaaggtcaggagctcgagaccatcctggctaacacggtgaaaccccgtctctactaaaaataaataaataaataaaaataaataaaaaaaattaaaaaaattagcctggcgtggtggtgggcacctgtagtcccagctactcaggaggctgaggtaggagaatggcacgaacccaggaggcagagcttgcagtgagccgagatcacgccactgcactccagcctgggcgacagagcgtgactccgtctcaaaaaaaataaaaaaataaaaaataaaaataataataataaataaaaagccaggcatggtggctcatgtctgtaatcccagcattctgggaggccgagactggatggatcacctgaggccaggattttaagaccagcctggccaacatgaggaaaccccatctctacgaaaaatacaaaaaaaattagctgggtgtggtggcggacagctataatcccagctactctggaggctgaggcaggagaatctcttgaacccaggaggcagaggctgtagtgagccaagatggcgccactgcactccagcctgggcaacaagagtgaaactccatctcaaagaaaaaaaatatatacacaaaaacaatctgtctcagtagagaaagaaaataaaatctgaaagttaggatgtgaatgagcaaaatgtgctggatacaggaaaaagataatctgagttcatcaaatgactcaggattgactaataatgttggccagaaaccatgactggtatttaaaagtccagggaagtgtgattcattgcctcactgactttttcttatttaatattttaacacatgatcttagcaaacctgggattcagtgttaacagtgtgtggaatttactaatttacaggcttctgttttcaataactactctcatcttaccagtcatctatcacgagcatctcttcttctgaaacaatagatcagacatgtcatctgtaatttatatatatcttccaccagaactgttactcttatttcagttgacaagagttatctgcttattgcaaaactttggtacaattaaaaccacattgaaatggatgaaatatccagggccaaagcctgttaatttaggataaaacacgggcctctatttttaccaatttcattatgattatgatcctcaccaaggttggagaatcgctggattactctttctattaaaataaatttaaacaaaagaaaataaaataacaggcacctctctctccacccaattaatcaagttcaggtaaaaattctttgtcctaaaaacttacatatccagcaaccaaacttgccctctgttcagcaatactctcccatttttacatattttcttcctcattatattacatatttccacagtttaaacagtttggataaaaatataacaactaatttttttaaagaaattcagcttaaattaactaatttgaaatatgtaacttgtagataaataagctacagctttcaaattttaaccaggctccacatatcatatgcacagatgagaagtttgtgctttaataggtcaggctttcttacagtacatgaatgagaaacctaactccactgcataccttatatctaaatctttgcatctctgtttcctctgcctggactcatcttccttccccaccagatcattttatgactgattcctcattattcatacctcaactcaaaagattgattatcttcagagcatttattaatatctgaaatttcctaatctgtttgtttcacttatattttgttcatctcttatctccagagtatttgttgtcaaacatctagaagtgtgccttacctataacaggtgctcaataaatatttattaaataaataagcaaatacaaggctaaatgagtaaaaaaatgtatgaatgctttgtctattaggagttatctttcataattaatgtggacttccataatattgttcaagtattttaatgtgcaggtattcaagtaaattggtattttatctcaaatatagaaaattatatatgtcttccattaaagtaactttacaaaataaaaatatactacaaaatatcaaagatataggtaatatttgatgagttaattgaatcaattggtcaggaatggaaaatattctgaagaactgtctctactcccaatcagttgactcattttagcactaaactgaaaattagaagacctgaattctaattgtatcaataatctaaactaagtttgtggtttgggtttgtataaaactaagtgctcagatgatgtaatgctgaagttccatttccatttcaactttaagattctgtgaatgaaatggaaatgagaaggtaaagataacttcagcattctccagtaaatacaaaaataaacatattgatatggttaggctgtgtccttacccaaatctcaccttgaattgtaataattcccatgtgtcaagggcaggaccaaatgaaggtgattggatcatgggggcagtttcccgagtgctgttctcctgataataagtgagttcgcatgagatctgatggttttataaggagttttctccttcactcggcgctcactctctatcctgcagccctgtgatgaggtgccttccaccatgattacaagtttcatgaggcctccccagacatctggatctgtgagtcaattaaacctctttcctttataaattacccagtttggggtatttcttcatagcagcatgataacaaactaatacacatatgttgcccaaagaattaataaatcctcagagtttttacaaaactgataaagcttgcttataatctacattctgtaagaattatagtaaagcctcttgtttgttttacactttggttacaatttagaatttatttaataatttacaaagtactttcacctacattatcttaattgatgctggcaactatacacatatgcacacagccctgtgtatgatcagagatggtatcattcctaccatccccctccttgtatctcccaaaataaggtaatcaatgtttctagaagtaagtggttccctgacatgtgcacagctggaagtcattggcatttttgactgagtcagtattctaagtgataatattgctattacctcctgcatgctggatctgtttgcagccgtattgcatgccttattagctctcacttgtgtttaaacatggtcgccaaaaatcagagccttatgtttgatgcctttctcatgagatgtaggcccacacatccaacagcctgctagatattgccaattgcatatcctacacctatatatggttcagcatctctgaacatgtctctcttaaagcagttcttcaatcctgtcccctgatacagaaaattgcactattcattattcagcggtctgaactaaaacctcagaagtcttccttgacagaagaatactgggctggtgataagattcgggaataggcaacactggtagtaaaaaataccaaagtgactacttgagggagtggaaaatacaacaaaaggaatagcctaggtgactttacattcactgggcttaaatctagcctagaaataatgccctctggccactgccccagtgcattcttatagtgcacgctgataaatcatagtaaaaatatatcctcccttttgaaacttgcctacagttcttatcattgaagttttatgtccttggatatagaaggtattttcattttcaccaactctgtaaaaaaaaaaactacttctggattatataaatactatgaaaatgtatcagtttagagtcaaacaccaatggtattatatgaaatatttgatggaactatcctataaggaagcttccaatttagacaaggtgaacgttagtttattatttaagtagatattagtaaatatacttatttatgtatcaaattgaaagatgtgtataatttccttatgaataatatatttataatgcacatcatcttttgcctttaatctgcaaagatatcctaataaattcatatattgtacatcctttgctcaaagaagaacactttggaaaatggccattgctgtgattattgtggatttatgtagcttccagccacatactgcatgtttgtttctggctaaaatctattttttctaatgagcacactattaaaatacttaaaatattattcacagattgtctcaatggggaaaaaaagacatgcagactctggagataaacacctccagttaaatctgggctctggggttatacctgtgtgctgttgggcaggtccttttacttgctttatttgcatgatgggggtgatagcatacaggcacctgttgtataagattattataagcattaaataagttactatatgtgaagcatttgaaacagcatctggcacacaatgctattcgtgtctcctcttagttttgatgttgctgttacatatccctgaatactattgtccagttccttccatttgattccactctgccctgaaaggtaactactgtactaaattccatttaaaattttgtgttcatttgtagagttttagtacgtatgtatctctagttttagcaagtatatgtgtatttattacattttaagatctttatggagctttactgtatataaaattggtgctttgctgtactgtaataatgcttttttctacccaatactggttctaatgttatctatagtgttgcatagagttgttatttattcttttttatatccctatgctaccttatgtgtaactatactagaaattaattttccctcctcttataaatatgtatttggtattattgatttttgaataatttttaataatgccagatttttcctttggtactatttagtatagtttatctttttttcacctgtctactgtcatcctttacgtaattttacatatataatcgaatggaataagctgagggtccattttggcttgacatatttggaaaacacaccccaaaaaatgtgtgacttacagtaattcaagtatttcaattctagtagattcagtacaatgacaattatatgtttaataggcaaagtcttccctttaataaaataaagcatgtagaactgttaataacacctatgatgtggttatttatatttaacacttgtaaatgaagctattatcagggtagaactggccactgaagaatttttattgcacacttgacattgtgccagaaatttttatgggcagatattgttaagtgatatatttcttttaatatatttgaacacatttaaactaacattaagaaaaacaaaccaacataaattttatttatttttttaaccatatgatcctatgttttcttaaaaattttaagttcaagggtacatgtgcagttttgttatacaggtaactcatgtcatgaaggtttgtggtacagattattttgtcaccgggtattaagcctagtacacattagttatcagaaaaccgaattccacatgttctcacttacaagtgggagctaaatgattagaatgcatggacacatagaaggaacaacagacactgggattagaaaaaaataacataaattttagtctaaatgagtgtgcagaactcatagaaaattaagaagtgacactaaagtacacatgtaataaactatgaaatagtagacagaaacaatctctcgtggcatgccaaggggttgaactaatcacacatcacagagcttcagtaaccaaaatattttacttagttttggagaaatttcctttcatctgaaaggaagatgattatctttagacagtcaattatttttaagttatcgactgggtactttctttacgtgtgtaatttaatccttacatctcccagatgcgatgttactccattttacagctgtgaaaaatcaaatgaatctagaggccctagatgaacctttcaaaggggtagattttaggaaacaaggatggggtgcaaatgcaggatgatttcactgcagtctcattttcacctttgaaaggaagaaactggatatactacactgaagaacagtgctgtctctattactagaagctttctcaaaaatttagatggcaatcatacaacaattggataatcagtatacaagacatgtaagacacattcaaagggaataactatatatgaaaatcaaccattaagtaaagatttaaagtacttattttccttttaatattagcaattgaatgagatggtcatttaaaataattatttccaattattaaagaattcataatttactgatgcatatcaaaataattagctgtcaattagctgtcagaaaagagaaaagcttgtgaaattctgtaaaagggcgagacttctctcacctatgacttccttggattatgttgattcaataaatgccacggagttttattcaaccaagaatttatgcctctcattactaccaagtgacagactcagtgtttggcttaatcttgatattctattgagtttaaccacgtgaaataaaataaacctggcatttcagaataatccagcaattaaggaaaactatcattagcttataaataactaaaacaagtacaaacaaaaggaaagcaagtaagtacaaaatgaagcttgcttgttgttttatcatttcctccaggttcaaggtaatcttgtcaactattcattgttttcctaaagtaataatcaagcctcgtatagaatgaaaccataaaattcatgcagaagattcaagaaaagacatgagtgagagaatactgtaaataaataattgtcaattaggaattaatatagaatactatatatttcccacaaaacatactcttccttatgagatgacaggtgatacactcttatgtcaataactatgcattacagttacttctagctaacaccatgtttcacttatgatacactatattatatttggcattttgtgatgccagttcctttgggattacaaaaaataataccctcattaacagaattataaatatttgaatgctgtgccaacatttaactcatatctgccaatcaaaaagggaaaatgttctttattgattggaaaatggatcttgtttgaagataattgactctgagtctttcattgacataataccacctccagaagaaacatacactcaacttagaaaacaaagcttagatgtaagaggctgatcactttctccttactcaagcacagttcctattgactagatgaatattctgtctgcccatgaattaaaggattatagatcatctagtccattttggaagtttaaaaatgtctttaaataagaagcttacccagaaacagggcacaagaaatacagaaaaccataaatctctcatagaaaaagatgtggatggggtaatcaacaaaacagcaactattgaaaaaaaataaaaataaatgcatgcataaataagtattttaccacactaaaatagttactgctaagatgttggtaaaaatgagatgttgagtttgggaaatgttaagtttcagataagcaaccaatacaacatccaagtaaaaatgtccagtggcagtagattaaaagaatctgctatttagtattgaggtagagagtggtagcatacagccatacctacatatatgtacacacacgtagctgaagaagagaagcctggtgctgaagcaccaggggattacagccctaaatatcagggaaataagacgtggcagtaatgaaaactgagaaacaataagaagtgaggtaaaagataggcaagtgtggttactcagaaggcaaggaaagaaatggtccaagggggagggagaaatctactctttaaatattcttggaggtcaaataatttgatctcagaacggaccttgtggtttacgacaggacttcaataaaaccagattgggggagttataggtatgaaaataggattttatagggttcaaaagagaaaaagagatgaaccattatagatattaggtatggacatcacttttaaggagctttcctgtaaaatggaaaaagaattgaattgttggtccaaagagaattggcttcaccaagagtgatttcatgctaatgggaataatccagaagaggagtgatgctagtgaggccagagagagagaagcatatgcaaacatgaggtctgtagtgggcgacagccaagggaatctagttcacaggtggagggtctggtctctcttaggaacacagacaattcactatagcaatgagatggaaggaagaatatgtcagccatgtttcagaatataggaaatccagagtgtgtggactggacacagagtaacatccatccaggctactgtgaaaatgacaatgatcataaagttattgttaggtggtaagttttcacaggtagtaaatatcagctatttctggggggtggggtattgaggcatatgctatttattgggttctcccatgcccagcacttgtgactatcagaacagaattgacagagttatgttcatgatcacaaagctgtgattcttaacaccaaacattccttatccagaactgagaaacagtaaactgtcccaagccacacatgcagctacagagaatcttgacctttcagaaatgactgaggctcacctttctcagatgagcaatcagctcactttaatagtctaggcatcaatcaatacactttaaaagggaaggatattatcccctcccttaaagtcttaagagagaaatcagcatcactaaaactaaagtgtcacaaatgtataaaataaagtattcagtgaaaatattgcatctaaaaaaaccttcattaaagataaaagcaccaaccaacatgctctcatgttgtgggccaaggggtctgctgccttggcctgtagtcctctggggagccatgtggcagagaggtctgggcactgttgtgctcacccacctggtgacacagttgcaaatgtaacagaaggcacactttgggctctcacttgctccaaagtaagagagatatgccagcaatgaaaactgagaaataatgaaatactcccacatccaagatggccattgaccctagagggcaccccttcaccatcagctctggtcagtgacactcatgggagtggctgcaatgagacttccctctctcttctgggctccttgatcacccacaggtgatggttaattttatgtatcaacttggacattgtttttggatgagattagcatttaaatcagtgatctttcagtaaagactaccctctataatttgataattttatgggcttcattcagtcagttgaaggtctgaatagaaggaaaagttgtgcctacgggagcaagaagaaagcatccatcaggctggctttggacctcagctgtactgtgcactccgaggcgtggagcctgcctgtccacactgcagatttggactttccagtcttcttaattgcatgagccaatgtttcataataaatctctttctctatatacattctattagttctacttctctggaggatcctgactgaagcacctatgagaagctgaagggccttccatcagtccctcatgagaggcagagaaggaaaatgtctgtagcctaagggtaatgttctcagacgatagcacaacctcactccctgccccttctcccctgaactcaaagctgaagggctcccttagaattctgtttcccttcctcattcccacctcccacctctgaaggttgggctaatcccaagagacaagtggggaagtgtggtggccaacatgaaggcctggtccagggtctgctgacctcaggtgcatcccatccccagctgggcacatggagggcacaccgacagcttgtcccttattccccacaggccttgcctgtgtaggggaaagtcaggccatcgctccaccagcccataggctgctagctatagctgcacttgggctctttcctgcacagctctagcagtactttggtgtgcttgttttccatcttgctcttgggcattcggaagcaaaggagccagcccatgaggtccttgtgcaggcaagcattagccatgggtcatctgcatctccatctccagttgtgctcttaaccagtaggctgacctgcaagagcagcatctctgttggggtggccatgggcaagtgctgctgagctgtagggcaactagtagagcatttccagctcaaaaaccagctggatactgtcctccattattgtccagaggcagaaggaagggcacctctgtggcctcaaagttgaggaaggaaccccaccactggccccaagccatcagcagtcaggcaagcagcttgttgttcctgttccacatccttagtcccagcatccaggagtaccagatctttgaatttagggacaggatctggccctcctggtcatacactcacaggattcagttgatcatgtgctgtgaagcaacatgagatgttcaggagctctgtgtacctgtagtaccaactccctgtgccatctcatgggtgtcactgctttctaggatgtagccacaactgtactgatatggtttagctccgtgtccccacaaaaatctcaccttgaattgtaataatccccacatgtcaaggggattatcctagtggagataattgaatcatgggagcagttttctgctatgctgttctcatgatagtgagtgagttctcacgagatctgatggttttataaagggctccctccttcactccacactcattctctctcctgcagccctgtgaagaggtgccttctgtcatgactgtaagtttcatgaggcctccccagccatgtggatctgtgagtcaattaaacctctttcctttataaattacccagtcttgggcagttctttatatcagcatgaaaatggactaatacattaaattggtaccaggagagtggggcactgctataaagatacccaaaaatatggaagcaactttggaactgagtaacaggtagaatttggaacagtttgggtgtctcaaaaggagacaggaagatgtgggaatgttttgaacttcctagaggcttgttgaatagttttgaccaaaatgccaataataatatggacaatgaagcccaggctgaggtggtctcagatggagattaggaatttcttggaaactggagaaaagataactcttgctttgctttagcaaacaggctagtggctttttgcccctaccctaaagatctgtggaactttgaacttgagagagataatttagtgtatctgatgaaagaaatttctaagcagcaaagctttcaagaggaagaagagcataaacgtttggaaaatttgctgtctgaccgtgaggtagaaaagaaaaacctattttctggggagaaattcaagctgtctgcagaaatttgcataagtaatgaggagctgaatgttaatcaccaaaacaatgaggaatatgtctctagggcatgtcagagaccttcgcagcagctccttccatcacaggctgtattagtccatttcacactgctgataaagacatacccaacactgggaagaaaaagagttttaattggacttacagttccacatgcccggggaggcctcagaatcatggcaagaggcaaaaggcactgcttccatagcagcagcaagagaaaatgaggaagaagcaaaagcggagacccctgataaatccatcagattgtctgaaacttactcactatcacgagactagcatggaaacgaatggcccccatgattcaattacctccccatgggtccctcccacaacacgtgggcattctggaagatacaattcaagttgagatttggtggggacacagctaaccatatcacaggcccggaggcctaggagggaaaaatggtttcatgggctgggcccaggaccttctgctgtgtgcagcctccagacttggtgcactgcatcctagctgctccagctatggctcaaagaggccaacgtacagctcaggccattgcttcagagggtgcaagccccaagccttggcagcttccatgtggtgttgagcctaagggtgcatagaagtcaagaattggggtttgaaaaccttcacctagatttcagtggatgtatgggaacacctggaagtccaggcagaaattttctgcaagggaagagccctcatggagaacctccgctagagtagtgcagaagggaaatgtggggttggagccccacacagagtccccaactgaggcattgcctagtggagctatgagaagtgagccaccatcctccagaccccagaatggtagatccactgaaagcttgcaccatgtgcctgtaaaagctgcagacactcaatgccagcccataaaagcagccaggaggtggtgaggggggctattccctgcaaagccacagggttggagctgcccaaggctgtgggagcacacctcttgcatcagcaatgacctggatataagacatggagtgaaaggagattattttgtaactttaatgtttaatgaccactctattggacttcagaattggatggggcctgtatcctcttcattttgatcgatttctcccatttggaacaggtgcatttacccaatgcctgtaccctgttgtatctaggaagtaactaacttgcttttgattttacaggctcataggtggaagggacttgccttgtctcagataagctattggccttggacttctgggaagttaagactttaggggactgttgcaagggcatgattgtgttttgaaatgtgaggacatgagattttggaagggccaaaggtaaaatgatatggtttggctctgtgtccccacacaaatctcactttgaattgtaacaattcccatgtgtcatgggtgggagcatgtggagataactggatcagggagcagtttcccccattctgtgcttgtgatagtgagtgagttttcgtgagatctgatggttttataagtggcttcctctttattcagcactcattttctctcctgaagaggtgccttccaccatgattctaagtttcctgaggcctccccagccacgtggaactgtgagtcaattaaatctctttcctttataaatttcccagtctcaggcagttctttatagtggtgtgaggacagactaatacacataccaaagcagggaacaagggaacctggaagggcattgctacatgaccacaatggatagccaggccttccaaatcctgaaggaaccacccagattgtgtgcatgcatgtgttgaggtaaggggcatattgggagtgggtgaccccctattttgagaatgcatccatctaccctttactttctccaaggcatcaaatcggcttttttataatggtctttagagtctcatctcagtaaggaatgcaatggaacccaatgtaatccaggccctctcaactacttgtttatacttatgtacataatgtattttaatgtgtcactcatgtcactgcttaagctgggaaagcactttttctttggcatcctagggaatctctactaatatatatgttctctctttgtattctttcagcactcatcacacacttacaacactcactatataatctgaagtttctggcctaagtgtttgcctttcctagtaggatctaagaatagctattatgtcttaagtatctttatatctccaattcttagctcagtgctcagaatataaatgttcacaaattcctgcaaaattgttcatgtgtaaaaatatatatgtatgcagtcacacatatacagagaagagaaatgctcattctaagcaactgaaatcaattcctttcaagaagagaactgcctttgtttagaaaaatgctttgataagctgttttttaatgcatggtttgatattaagggtaggaagaaaaaaacgtatagctaattacttcaactctaaaaaaacatgaaggaaattccttaagtcttcggtaaagtgtgtcatctactcaatgctgtctgtttgtatttttgattgttgtttattccattctgtgttagagtaagtcaaataaagtagcaaaattaaatgtagttaaaagaggtaaagcccatgctagtgtataagctgatttacaaactgattaacacattagtgaaagatatttgaaaacaagtgagcttccccagttccacctgtgttagacattgattgctgcttactaatttcattttctcttctgcctgggcaaattgctaaactacaactgcaaacactccctatatagttgttcatgtgactaagttctatacaaaataatggagtttccaaacctgttttgttcaatggaaacttctcatggtgactatatattctccttgcttttactgatgacttgatacagacaagcaaagaaaacttgaaaagtatgcaaaaagctacaagatggaaggagactaggttcttatatcatgtcttggaagataggctcttaccaaatggaacatccattttggacttcagatgagcatgaagtaaatttttattccattgagtcttcacatatttataatatttaggaagtttagcagatttctgcattaatgcatataaataaaatattcaattaacatgcaaaaataaaaccgatctagtaaaaatgtattagattctgcagatgtaggataatgcagtttttatattacttccatacttcagttatgtcaataattctcagttggttttctcttatactttgtagaatctcaaaaaatctgatacatgttgattcaagtgaaaagaataaagcttcctatttactgtggtaaatactgaataaaatctctctcatttttataattgtattcagctcaattatgaaacattagattcttaatcttctattttaatatcttattttactcttcattgtagtcttcacatatttttgctatgctaatatatcaaatatacatttattaaactttacttaaaaatatctaattatccttcaatattaaagaagataaatattttgatcactttctatatatgttggttatggtggaaaataattgtataaacaatatcatattaatattacaattctacatgatatactctttgatagatgaggatgtatacgaggcattaataactaatttgcccaacatgacactgaattcaaacatactactatgacttcatccccaaactgttactttaatctgtggtattcatcagtattattatcttcaactactgtattacgcatatcatcactggaatttttattgtcctcctaacttatgctatatgctcatgatgtgaaaacctatatttttatcctagatatttcttgtatatttcagacacatatttatttcttctagatattagtatatggaggaaattatggcacttctgacttatcccaaaactgaaccaattttatacacacttaaactttcccctctttctacacttaaacttcagtcaattgaaaaaccatttattttgacaattaagtcatagacttgatgaacactctgaattcattcttctgttttgctccccatattcagtaagtaagcaaatttagtcaattctggctcttagatccttcttagcatcaccctgttatcttggtctttgtatggatcagggtgacagtgaacaacaaatggttctcccagtctctaagtttgagaagtttaacaaagggaaaggtttagggaaaccagcaggaacaatgcagtacccctgggctattgatgttagagtagcctttagcctgtctcagcttgaaagatagagagcagtaaccagaaaccagagtattattcatatagagatggtgctatttatcaagagatacagtctttggaaagaataaggccaaataaataattacactcagctgactgcatgcctatcacccagtctcctgctcctatgtcctgttggctgaacccagaatctaattggaaactagagaacaacagagtgcagttggtttagctcagccttcaagggcaaagattaggacacagaagagtgcagagtggatctggaggggcaaatggaagatgagcctttgtttggattctcatcatcccttttcctagcttctaccctatcctctaatttgctttccaatttaaaccaatgtattctttcaaaatagggaatttgatttttcctcttcatggcattgaattctgaatggaattcgggcatattcaaagataattaaaaacatttggtaatgtataaaatactttaatatttggcccttacttattggttatatgcctcactcatggtctaaagacttgctaatttaaatagccatgtttttataaatgatctttcaatacgctggtgagctctctttcttccttcaataacttgctcaaaatttatttatcagtggaacctccattagttttcttcaaaaaataatgctcatcatttacacttctgtaaatctttatacaggttaacacttgtcttaggtagtgtaaacatgtgtatacatatctggggaagctatactttttgtgctgtggatttggaaacactgtttatctttgtgcagatatcttatatttactacataatatcactttagaaatatgatggttggataatactaggaaaagaaagattttgtggcaatgacggatgattctctatctttctaaatatcttaattttacttaacaaatttatgtctcccttttattattttctttttatcatcgaattatgttatttgagatgtagatgcagatataaatatgatctggtggagcctcctcattccgtactgtaaagataaggtgctgtgaatgtcaatgtgatgcatcatttggtatttaaattgacagttaactcagtatttttgactgtctggtgtgttctccactacatcttattatctaactagatctctttcctttttagcccttctcccctgcttatgtgtgagatttttcagtgaaactcagtaacattcatagccttttctggactaattcagggcataaaattaactcctcaaccctaacatagttcctaaagattgtatttaaaggattaggtgaccaaaatattggccagattaagacagaggaataacttggaagaagtgaaatttgaaaaatctacagataatgaagatggagtgtagcagagcacaaatgtttccttattcactttatctggaaattctgccgtatcattcatattcctgaatatgaggtgtaggtgaggtaaagaagaagtgagtgataagcatcttaatgtgatgacatccataaaatctacatgtcacatttcatccaagagcagattttccatttgaattatgaacctctgcaaataggagacagaaatggaaaacctggaacatttatcactctgggccctggcagattgaaatgtgatgacttcaaaaaaaagtaagttttggttaagttctgaacagaattatcagaaaaagagaagataatttttataaatgtagtgaatacaaatatagatattgactttaatgtgtccttatttaatcttatgatatgtacagaaatatacgtaaatattatttttagatgattgtaatcttgtgcaactgtacagtgggcatactctgcaggctttcggagctacattgaaagtcaaaatgttcaagtgccctgacaaagttgtgatgatttatgagacacgactctctttcagtacagtgtaagtaagccagtgctttaacctatatatttgaaaatattcagtacagattttcgactgccaaaacatctttacgtgctgtttccaaagtgttatgtatgtatttatgcacatcgtgacttgttccagaaaggattaaatgtgaccaaaatacatacacggcaaaataaaatctaacttggcaaggaagagagtgaatgcagtgctgagtgatatagagaagcgattgctttgattgggggtaaaagaagatgttggctaaatatcttcttttatttcactgggaatcatgtgtatcacgtttatgaaaataaatagattcccaaatgctagattgtagctaaaaaaatgtttaagttaacaacttttattagatttattttatatttttcatttcaattacaaaatgaatatatttcctgcttaaaagaaagtctaaagcagacatatatgaagtgacagtctggctcctgtcttcttcttcacatattttgctatgcacatatatctcattttttaaagtacaaaatttacttataaagtacatggaatcattttatgaagtataaaatatagagcaagagtcaatatagacgctcttagtagacatggaagatcagatttcatttatgtatttgacgcacatttattacatatctatgataaaccaagctctcatttggacttgttgcaaaacaatgagggcgagatatcaacacatcctgccttctgagaagtgatggctaaatgggaaaagcagacatacattattcagatgcacacaaaactatacaattgcacgctctgggtaaatgccttgcaggagaattgtggacaggaataaagctagggaacctcacctacctgaaggatcaggaaatgtttccctctttgttgttatcttgagctgagctatcatgaatgagcagataaactggataaagaagttgcaggattgcaatggtcgtaaggtgctcatgtggaaagagatgagttaatttgtggaaacacaattggaaaaagactagttaatttaaggaaatataaaacatgtcaacgtgtttcaagtgtgaaggacagcattatgaaaaggagttgacatagatatagcaaaggaccaaatcatgcagcatgagatagtgtggtgggggcttttggtgtttccatctccttttccaactaatccattacagtattttccccttatccatggggaatatgttccaatatccccagtggatgcctaaaatcttggatagcactgaaccctatacatatgtactatgcattaatttcttttttattcttcacaatttcacagatagaccattcacactgtcgtactgtgacagttaatctgatcacagagacggttaccaagcaactcatgggtagggaggtttgacagcatggatacactggacaaagggaagattcatgtcatccagggtggggaagagtgtgtcggtgtaagatttcatcaagctactcagaacaacttaaaatgcaaaaattatttactctggaattttccatttaacatttttggatcatgattgaccatgggtaacaaactacagaaatcataactgcagataagggtgtagtactgtatagaacttcatttagataagatgtaaaaatgagactctaatcacgtgtaatgacaacaattccagggcttcttattgcttttcttttgtttgattaagtcctcacattaaagtcttggatgtgtctcaagtaaggtaatcacagttgttattttttcaaccattattactcactgaaataatatattttttattctttccttctgttaggctcagatgaaatgctgctatgtggtactaaattgttactctctctacctaaaggaaataattaatagaatataaaaagttaccaataacatttctcactttaatatttggaaatattgtgaaaagcaagttttacagttctgggaaattttaggtcctagcagggagtttataaatggaggctgctcttcaagatccctgtcaaatgaaacttgtatctttgtaagatttaaagggaaagtgaggccaacaaaacaaaagccaaggaaagcaaaataaatcaaaataagctaaccagagaggaaacaaaacacaattagaggtaattattttgtttatttctgtattctaaaaatttgtaaatgaaaataatttttccttttcagtacaagctacactgccaattaatcaaagagtctcatgcatgaggagaatttcttctttacagaaggataccagataatgaatgtatggtgaatggcagggttgggaataaatgtgtaagctttgagggggtagatcatccacagacactgaaatctttgggtaaaggattaatggagaaccaaatattcccatgctatctaactatcaccctatatattatttgccttttgagaggcaaggctttaagaaagatagatctgcttctcactgccttaaactgatgattcgtcctggcaacattaggataggaggaccagaattttgagtgcttggtgatttgcaataatattcagtgcacagtttcacccataagataaaattgtcaaagacatataaactctattgagtcaaacatctacctgtcaactgtactgttcatttcaacaagtcaatgtcatggaaaataaaggagagagagagaattaggagacatagcaaaaaatgtaatctgtaattctcaattgtttcttctttgaaggaagcatatatacaaataggtatgagaaaagctatgaattaggtagcaatagaaaattagtattaagtgctaaaatataactgtaaaatgcaggaaaccattctcatttttagatgtgtgaatttgagtatttgagggtaaaatatcaagatatatatgattgcatttaaaattccttaggaaaaatttatgaagtatatccagcaaacatttggaaattatttgaaatatacctatatatagtttctacatttatttctctgcttttctctgttggaggtatttaaaaattaaatacatacatacacaaaattaaacatgtacatgcatgtgtgtatacatacatataatctccaaagcatatcaacagtaaaactacttgatatgatgaaaagaaagaaagtaggaaaggggagggtaaaggagggaggggatggatggtgagtgctatgatctgaatgtctgtgtccttctaaaattcttatgttgaaacctaacccccaatgtgatggtattaggaggtaggacacttgagagttggttagatcacgaaggcagagcctttgtgaatggaatttgtgccaattttcacttttttttttcttaccatggggtccccctctgcctctcatgctgaagtgtagtggtgtgatcacagctcactgtaaccttgaactcctgggctcaagtaatcctcctgcctcaacttcctgagtagccgggactagaggtgtgtgccaccacagacagctaattttttgtgtttttaattttttttgtacagacaaggtctcattatgttacccaggctggtctcaaacccctggtttcaagtgaggctcccacctagcctcctaaagtgctgggattaaagaaatgagccaccatgcctggctggattaacacccttaagaaagaggccccagagagctgccttgtgccttccacaatgcagtaacatagaaaaaaggtgccacttaggaatgaggaactgtgccctcaccagatatggaattggcctgcaccttgatgttagacttcccagcctctgagaaataaatttttgttgtttacagtgacccaatctataagattctatataacagcctaaatgaattaagaaggataggaaagggagggtaataaagcagaggggagatcatatgtttaggaaaaacttcacattgccttaaaatatctagctttattcatgaggtttccatccataaatgttaagtatctttggattcaaagtctgtccattacaaaaatgtccatgcaaatttcaaatttgtgcctatgttttaactatttctcaatcctgttaaacattctcagctccagttattttcagaacttccagttttcaatttcttaacctgatattgactaacatccaggttctacatggtacctgattctgctcttgttttcttccatctgaacatagaaactaacttgttttgtgcaaagagaataatggagagaagtaacttattccaatccaattataatataacttgaaaacccagttgtaatatgagttttctaaagacttctgctgcccaatggtatgattttacacccacaggaaatccatcttattatttcccataaattgctataagcagaacttagaggtaataacaataactaatattcataaacaattgatattattgatgttaaactgaatacataagataaattatgcccatttgacagatgcagaaactgagaatcggaagtcaaccagtctctccagtttgctataaagaatctgagctagtttttttttcagcttttaatgcctccaaaattaatgcacttttcttcatgacatagactctttttaagacaatatttagtttgcagatgtcaaaattataaattgtttttcattcaaataatgactgcaatatgatttccaggacacacatgaatccactgtgagatacagcattttactttttctctgctatgaccacaagttgagaattgctacattttcaggctactgtgggcatttatcagcatgtttccagatgcctgggcaccagggctagggatcctctaggatcaacattacaaggacctacagtagctttaatcagatatacgcaatggcagcaattgccgatgtagtcttgggttcacacttgggagctcaaagaagcttctgtcaatacccagggtatactttagaaagctcttgttgcactgtgcctgaactttggattgtgtgctgaccttaattagcagcaatactgaacactgagctcgttactgtctgaatatcaccctaagtattgagaaagtcttacatttcctgtatatctaagtcaggtgtcagtaactgaggatatattcttgcctctataaattattcaaaggtgtgttttaaaaatatcttgggcatgaaattctaaagtccttctgatttggtttggctgtgtcttcatgctaatctcatctggaatataatctcccataattcccatgtgtcatgggagggacctagtaggaggtaattgaatcatgggggtgggtatttccatgctgctctcatgatagtgagtaagtctcacgagatctgatggttttataaagggaggtttctctaggcaaactcccttgcctgctgccatgtcagacgtccctttgctttttcttcatcttcctccatcattgtgagacctccccagccatgtggaactgtgagttcattaaacccctttcctctataaattacccagtctcaagtatgtctttattagtagcataagaacagatgaatacaccttcttaccttctattatttatttttcctatttgtgtgagccccatttctaatagtaggctcagaacagttccatttatatccatgaggacttttgttcatttgttttggtccctatatctttccatactatactgcttttggggtgaacaaaggtcgtgtattttacttggtgaatatttccagaaaactcagcataattattttaaaaagaggcacaatcctgtgagaacttatctgagccaattgccaggaccacacagcaagttctgttactttgatccaaaaggaggtcagttcctgctgattttatagtaaactagtaaacactgactagagtcctgactatatgggctttttaatttaacttttatgatattgtctctgaattctgaatacatatttctggttataattttgtaactcgtattacctgagatttgtgcaatccttttgttggttttttgaaatcttttatttttttaaatctattttatgataagacataaaactcatttgccttgtctaaaaatatcaaaatggtaacctattttctataattctcatgaaaacctgagctcccattctccttctgaatgaggcttctcttgatacattgagccctactgcaagttaattttatattttctaaacaaaaaaaaaaagtctccactgtttactggtactatgcttcccccagcgaatgtgtacaggattgcttatcaacattgtaaattcatccttgcttgtattgtatgatgtacaagtaaggcatgatgtgtaagcaagaaagcattttttagtctcagaaactcagtgtcaattaaaattattattttttgctttattgtttacattcaaaatgaaaaaaatccttttcatgtggtcatttctcaatacagatattgaatgcctttaagtagagagctcaggaaattatcattttacctccaatgatattttaaaactttgtcaatatcttggtcaataaaaaagctagtttttgtttatgttttgttcatttttgcttttaatcatagctaagtttagaaaaatgaaatcaatgtgtattgtcagaatgcaagtcacaaataagagttttcatttcttcagtatggaaaactggatacccccaatggccactccacatgaaattaaatattaaatattgaaatataagaaatgactcttaaatgtatggtgaagttctaatgacagaatggtgatgaagaattgtagtaagaaaaataatgaagggaaaataaagagagttggtgtataatggttataattttaatttattaggaaggtacaacagttctaaatgtgtttgaagttaatcatagtctgaaaatagaggtgactcacaaacaaaacactacacatggaaaagaattataatatatggaagagattagtgcactctctgaccaattgtttgagcaaaaataccattaaaaaataaagatatagaaaatagaaaaagcaaaaattaagaacttgatgtacttatagttcatatatttctttcttcctattttagggttcattattctgtatatgcccagtagatcatgcgtgagatcaataataaatgatcaaatgctaggctgcctgtgtcatagaattagtgtcatatagaccacattactgaaacataatctaattatggtagaaaaatgtcattcatttggacattaaatcacacagataaaataaacatctaaacacttgttgtgaaaagaaaacattataatggatattccaaaatatttctaggtgataaaatttgtaaaaccataaaagttttagatgcgacaaatgaaatgcattcatttcctttgctgctgtaagaaaattaccataaacttagcatcttcaacaacagaaatgccttcacagagttctggagatcagaattctgaaattggctttaataaaatagaagcaaagtatttgcggacttgcatttacttctagaggttctaagagaacatctttttccttgactttgccagtttctagagaccacctgtattacttggcttctagcctctttgttcatcttcaaagccagcagcatagcatctaccaatctctccgagtctgcttctgtctttcacttatagcacctttgcccttagactgggccaaccaggaaattctgaaagatctttccagcacgagttctgtaagctaatcaatcacacctgtgaagttccttttgttgtgtaagaatgtattcacaggtaggaggcattaggatatgcacatattttgggtgctgttgttctgcctagcaagaacaatattcaaaggactattagacttataaatgccttatactagaaggtaaaaaagcctcaaagttagtgaactgagcttccaacctgaaaaatcttagaaaaaaattctcagaataaaacaaagtaaattagtggggatgaattactagtaaaaaatattataaaagaaattataacagcaaagaaagctcaacaatggtaaatatttctctatatatactaataaaatggataattctctggcaatattaatcaagaaaataagaaatgtgttcattgataacattagaaataataaatactacagttgttggagtttatgccaataaacaaacttataacactaaatttgaaattttaaatgccatttatatatttctcaaatatccttaccaaaattgactgaatattaattataaattgtgaatgattctatagctggtaaataaaaaaaatcgataattcagtgccacccccactgtaaaaacacaaaaaactaggctctggtacaatcattttcaatggaattttaccaaatatttaatgtttaaataatctgtcttacataataattctatagaaaagaaaaagagtgattaatcccctagtcattagctgtgttaggtttaaaaataaaaattgatacacatttcttaagaaagctaaactgtaggcaaatctcagccaattatacatttattaaggtttttatatctattacaaatcaatctgaaaatatatttggaaaaatattaaggaaattagcaaaagctaaaaaatgatgagatgatggacttactagacaaagttataaataagctgttataaataagctattactaatatgtccaaagaactaaagagaacttgaaaatggctgactagatgcaaccgagaggaacatcccctactgaaaaatagggacatcaggaagattggcatgtcttcagagagaaggcactgagagtggaaaaagggaagacgcagacactggactaaatgaggaggaagctgggaaccctgcacagggcagcaaaacactgggacctgctcctgattcccagtgactccccagatacatgcaataaaaaaatgataaagaggatatcaccaccgatcccacagaaatacaaactaccatcagagaatactataaacatctcaactcaaataaactagaaaatctagaagaaatggatgaattcctggacacatacaccctcccaagaataaaccaggaagaagttgaatccctgaatagaccaataacaggctctgaaattgaggcaataattagtagcctaccaccaaaaaaagtccaggaccagatggattcacaactgaattctaccagaggtacaaggaggagttggtaccattccctctgaaactattccgatcaatagaaaagagggaatcctccctaattcattttatgaggccagcatcatcctgataccaaagcctggcagaggcacaacaaaaaaagagaattttagaccaatatccctgatgaacatcgatgcaaaaatcctcaataaaatactggcaaaccaaatccagcagcacatcaaaaagcttatccatcatgatcaagtgggcttcatccctgggatgcaagactggttcaacatacgcaaatcaataaacgtaatcagcatataaacagaaccaaagacaaaaaccacatgattatctcaatagatgcagaaaaggccttcaacaaaattcaacagccattcatgctaaaaactctcaataaattaggtattgatgggacgtatctcaaaacaataagagctatttatgacaaacccacagccaatatcatactgaatgggcaaaaactggaagcattccctttgaaaactggcacaagacaaggctctctcaccactcctattcaacatagtgttgcaagttctggtcagggcaatcaggcaggagaaagaaataaaagtatccagttaggaaaagaggaagtcaaattgtccctgtttgcagatggtatgattgtatatttagaaaaccccacagtctcaacccaaaatctccttaagctgataagcaaattcagcaaagtctcaggatagaaaatcaatgtgcaaaaatcacaagcattcctatacaccaataacagacaaacagagagccaaatcatgagtgaactcccattcacaattgcttcaaagagaatcaaatacctaggaatccaacttacaagggacatgaaggacctcttcaaggagaactacaaaccactgctcaatgaaataaaagaggacacaaacaaatggaagaacattccatgctcataaataggaagaatcaatatcatgaaaatggccatactgcccaaggtaatttatagattcaataccatacccatcaagctaccaatgactttcttcacagaattggaaaaaactactttaaagttcatatggaaccaaaaaagagcccgcattgccaagacaatcctaagccaaaagaacaaagttgaaggtatcacgctacctgacttcaaattatactacaaggctacagtaaacaaaacagcatggtactggtaccaaaacagagatgtagaccaatggaacagaacagagccctcagaaataataccacacatctacaaccatctgatctttgacaaacctgacaaaaccaagaaatggggaaaggattccctatttaataaatggtactgggaaaactggctagccatatgtagaaagctgaaactggatcccttccttacaccttatacaaaaattcaagatggattaaagacttaaatgttagacctaaaaccataaaaaccctagaagaaaacctaggcaataccattcaggacgtaggcatgggcaagtatttcatgtctaaaacaccaaaagcaaaggtaacgaaagccaaaattgacaaatgggatctaattaaactaaagagctgcacagcagaagaaactaccatcggagtgaacaggcaacctacagaatgggagaaaatttttgcaatctactcatctgacaaagggctaatatccagaatctacaaagaactcaaacaaatttacaagaaaaaaacaaacaacctccatcaaaatgtggatgaaggatatgaacagacacttctcaaaagaagacatttatgtagccaacagacacatgaaaaaatgctcatcatcactggccatcagagaaatgcaaatcaaaaccacaacgagataccatctcacaccagttagaatggcgatcattaaaaagtcaggaaacaataggtgctggagaggatgtggagaaacaggaacacttttacacagttggtgggattgtaaactagttcaactattgtggaagacagtgtggcgattcctcaaggatctagaactagaaataccatttgacacagcaattccattactgggtatatacccaaaggattataaatcatgctgctataaagacacatgcacacgtatgtttattgtggcactattcacaatagcaaagacttggaaccaacccaaatgtccatcaatgatagactggattaagaaaatgtggcacatatacaccatggaatactatgcagccataaaaaagggtgagttcatgtcctttgtagggacacggatgaagctagaaactatcattctcagcaaactatcacaatgacaaaaaaccaaacaccacatgttctcactcacaggtgggaaatgaacaatgagaacacttggacacaggaaggggaacatcacacaccggggcctgtcttgggttgtggggagcggggagggatagaattaggagatatacctaatataaatgatgagtttatgcaggacaccaacatggcacatgtatacatatataacaaacctgcacattgtgcacatgtaccctagaacttaaagtataataatgaatatatgaataaataaataagttcaatgataggaaaaaaaagaaagaggcaagttgaacatgtgaggagtggccaacactaaccacagacctctggaattctggtgcacaacccacgatcccatggacacttaagctagcaggaagagttggttgggaaggtggcaggggaaggatgccagcctgtatggagcccaaagaatttggttcaggaagggttgtagtggagtatggccagggaggctcatcctccaaggcttgccaagctcctttagctggctttagcttttgggtagtgttagacctggacagagcatggccgtcttgcccaggggataaggcctgtcctatctgagtggccccctgtctgctggcctttcctggggccccaacctgcccacgcatgcttgcagggcatatttgaatgcccaagcagggtgcttcctggaggccctcatcatagctcctttcctggcagaccacacctgaccatcagagaggtcagcaaactgacctttgttgactcaaccagcccactttcagcatcccccccacagtagccttccccttttgccttgccggcacacacttgcccactttcttgaaatcccatcactttgtcagtatacacacttgggtggaccttgcctcccctcctccaatggcatgtgtgcaccctgctcccccactgtactggcagtgtcagtgcatgccgccatccagatgtcaccaccaccagcatgctaaccccatggaggcacaggcagccagccatggtgttcccgccactactaccagtacaagtgcatgcatacatgttggcaccctaccccccccaacatgtgggcactctgcctcaccattgttgcaggcataagcatgtgcatgaaggcctctgccccattcctgccagtgccctgcccccagctgacagagcgcaccctgatgcatcactgcagcttctgacacatgcgggcaaacacagattccactgccaccacccctacagagcattttggccagcacacctcatcagaatgttggggctagtggactggaatcatctcaacctcttaaatgcagtaggttcataactttgagcagttagggaataaagctggggcctggtaccagatcccagtgatagagcacatagcccaagagtgcagagctgaggcttagccccctgaaatcttccagaatcaaagctagttgacctaacatcccttataccagaatcaaacccctaagggcatcaaagaagataccagcaagaaaactaaataaaaagaacagaaatatcaaagagtaaaggaataacagtctatacagataataaagaaccagcacaagaactctggcaactcaaaaagccagaatgtcttcttacctctgaatgaccacactagctcccccagcaatggttcttacacaggctgaaatggctaaaatgacagacatagaattcagaatatggatgggaatgaagatcattgagattcaggagaaagttgaagcccaatttaaagaatctgaggaatatgataaaatgatacaggaatgaaaagacaaaataactatttttaagaaagaaccaaactgatgtgagagaacttaaaaaaaacactgtaagaatttcataatacaattgcaagtattaacagcagaatagaccatgtagaggaaagaatcttggagcttagacactggttgtccaaattaactcagtcaaacaaaaacgaacaagaaaaacaaaacctctgagaaatgtgggattatgtaaagagacaatatctacgactcattggtatccctaaaagagagggagatgaagcaaacaacttgaaaaacatatttgaggatattacccacaaatatttcccaaacttcactagagaagccaatatgcaaattcagcaaatccagagaacctctgtgaaatactatacaggatgattatccccaagacacgtagtcatcagattctccaaggtcgatataaaagaaaaatatattaaaaacagccagagcaaagggcaatgtcacctacaaaaggaacccatcaggctaacatcagatgtttcagcagaaatcttacaatccaggagggattgtgtgcctatattcactattattaaaaaaaaaaaaagaaactctgatcaaggatttcatatccagccaaactaagttttataaatgaaatagaaataagatcctttacagacaagcaaatgttaggagaattccttgccactttacaagaggtccttaagggtgtgcaaaacaggaaaatgaaagaccattaccaaccaccacaaaaacacacttaagtacgtagaccattgacacaataaagcaactacaccattaagtatgcataataaccagataactacttactgacaggtccaattctgcacatatcaatattacccttgaatgtgaatgagctaaatgtcccaattaaaagacacagaggggcaagttggataaagaagcaagacccaactgtatgttgtcttcaagacacccatctcacatgcaattgacacccacaggctaaaagtaaaaggatggaggaaaatcttccaagaaaatggaaaacagaaaaaaaaagtaaggattaatattttaatttcagacataacagactttaatccaacaaagattaaattaaaaagaaaaaacacaaagaagggtattacataatggtaaagggctcaactcaacaagaagacttaactatcctaaatatacatatgcacccaacaaaggagcaccaagattcataaaagcaagttcttacaaatctatgaagaaacttaggtaaccacaaaataataatgagagacttcaacactccacagacattattagatcaaccatcaaggcataaaactagatattcaggactcaaactcgacacttgaccatatagacctaacagacatctaaagaactctccatccaaaacaacagaatatacattcttcttgtctgcgcatgaactatgctataaagttgactacacaatcagctgcaaaacaattctcagcaaattcaaaaaaaccaaaatcatacctaccacacttttgtaccacatgcaataaaaatacacatcaatactaaggagattgctcaaaaccataccattacatggaaattaaacaatctgctcctgaatgacttttgcataaacaatgaaattaagccagtaatgaataagttctttgaaactaatgacaacaaagacacaacataccaggatctctgggacacagccaaggcagtgttaacagggaagtttatagcgctaaacaccagtgtcataaagttagaaagatctcaaatgaacaacataacattacacttagagaagctagagaaacaagaataaaccaatgtcaaagctagcagaggacaagaaatatccaaaatcaaatctgaactgaaggaaattgagatgtaaaaaacttacaaaagatcgatgaatccagaagttgatgttttgaaagaataaataagattgatagactgctagctagactaataaagaaaaaagagagaatatccaaatgaatacaatcagaaatgacaatggggacattaccactgacccctcagaaataaaaaaaaaaaatctctcagacactatcatgaaaaactctatgcacataaactagaaaatctacaagaaatggaaaagaatctggaagcataaactcccaagattgaacctggaataaatttaaatcttgaacagaaaaataatgagttacaaaagtgaatcagtaataaaaaggctgccaaccaggaaaaggccagtactagatggatgcacagccaggttattccagacatataaaaagagctggtatcatttctactaaaactatttcaaaagactgaatcagaggatctcctaccctaactcattctctgaggtcaccatctttctgataccaaaacctgacagagacacacacgcataaacacaaacacacacaaaaactgcaggccaaaattcttgatgaacatagaagaaaaattctcaacaaaatactagcaaactgaatccagcagaacatcaaaatcgaatccacctagattaagtaggcttcattctggaatgcaagattttttcaacatattcaaatctataaatctgatttattacataaacagaactaaaaacaaaaccacacgatcatctcaatagatatagaaaatgcttatgataagattcgacataccttcatgttaacaaccttcaaccaactgggcattgaaagaacatactttacaataattagattcatctatggcaaacccacagccaacatcataatgaatgagcaaaaggtggaagcattactcttgagaactggaacaagacaaggatacccacccttactactattgtttaatgtagtactggaaatcctagtcagagtaattaggtaagagaaagaaataaatggcatccaaataggaagggaagtcacactagctgtgtctgcagacaacataatattttagctagaaaaccccatagtctctgcctaaaagctcctaggtctgataaaaaaacctcagcaaaatttcagaatacaaaatcaatatacaaaaattagtaggtttctgtacaccaaaaatgtccatgctgagtgccaaatcaagaacacaatcgtatttacaataatcaaaataaaataaaatacctaggaatacagctaagcaggaaggtgaaagatctctacaatgagaattataacacactgctcaaagaaatcagagataatacaaacaaatggaaaaacattcagtgctcatggataggtagaagcaatattgttaaaatggccatactctccaaagcaatttacacatttgttgatattcctatgaaactaccaacatcattcatcacagaattagaaaaaaagaaactattctaaaattcatatggaaccaaaaaagggcccaaatagccaaagcaatcctaagtaaaaggaacaaaactggaggtatcatattaccccacttgaacaaaactggaggtaccacattatccaacttcgaactaagctaaaactattctaaaacaaaacagcatggtactggtatgaaaacagtcatatagacccacggaactgaatagagaactaataaataaaatctccacctacaagcatctgatcttcaacggttggccaaaacaagcaacggtgaaagaactacctattcaataagtgctactgggataattggctagctatatgcagaagattgaaactggaccactttcttatgccacatacaaaaatcagctcaagacaggttaaaaaacttaaaacctgtaactatcaaaatccttgaagatattctaggaaatgccattctggacataggccctgtcaaagatttcatgacaaagatcccaaaagctattgcaacaaaaataagaatttaaaaatgagatttaagtaaactaaagaggttctgcacaacaaaggaaactatcaagagagtaaacagacaacctatagaatggaagaaaatatttgcaaattatgcatccaacaaaggtatagtgtccagaatctataaggaacttaaacaaattagcaagcaaaaaaacaaacaatcccatgaaattgtgggaaaagtgcatggacagacacctctgaaaagaagatacatgcagacatcgagcatatgaaaaaatgctgaacattacttaattagagaaatgaaaatcaaaacaacaatgagataccagctcacaccagttagaatggttattactaaaaagtcaaaaaataacagacgctattgaggttttagagaaaagggaatgcttatacactgctggtgggaatgtagattagtttagccattgtggaaagcagtttggcaactcctcaaagaacttaaaacagaattaccattcgactcagcaatcccaatattgggtatatacccaaaggaagataaataattctgtcataaagacacatgcatgtatatgcgtactgcagcactattcacaatattagagacacagaatcaacctaaatgtttatcattgctagactggataaataaaaagtggtttatatacaccatagaatactttgcagccttaaaaaaaatgagattatgtcatttgcagcaacatggatggagctggaggccattatcttaagtgaaccggtgcagggacagaaacccaaatactgcaggttctcacttgcaagtgggacctaaacatcgagtatccatggacacaaatgtattagcgcattctcacattgctacaaggaactcctgagactgggtaacttataaaaagaagaggtttaaatgtctcattgttctgcaggctgtataggaagcatgattctggcatctgcttctggcattctgcttcttgcctcaggaaacttaacaatcctggtggaaggcaaaggtagagccagcactttacatgactggagcaggacaaagagaggaatcgagaggtgctaaacacatttaaataaccagatcttgtgagaactctatcacaagacagcaccaaggggtcggtgttaaaccatttatgaaggatgtaaccccacgatccaatcacctcccaccaggccctacctgcaacaatggggattgcaatttgacatgtgatctaggtggagacacaaatccaaataacatcaacaaagaagggaacaccagacatcaggatgtagcagagggtagaggttgggaggagggtgaggatcttaaaactacctgttgggagtgtgcttattacctgggtgacaaaataatctgtacaccaaacccccatggcacacaatttgcctgtataacaaacctacacatacacctctgatactaaaaaagcagaatgccagaagcagatgccagaatcatgcttcctatacagcctgcagaacaatgagacatttaaacctcttctttttataagttacccagtctcaggagttccttgtagcaatgtgagaatgcgctaatacattaaataaatacaaataaattaagtaattaaaaaaagaactgaaaaattgtttaaactttttaaaaaatctttatagataatgtatcaccaaatacagagcaacaataaagagatatgaattatttaaacaaaagaggggtgaaataaaattctggaattaagaagaataataattacattaaaattcactgaagatgttcaaaagttatttggagctggcagaagaaagaatccatgaacatgaagataggacagttgagataatccataataatatgcagaaagaaaaataactgtaaaggtgaacagcacctcagagatttgtagggcaccatcaactgtactaacaaacgcataataggaatctcagcttgtaaggagagagagaaataaataatatgtggatacattatggctgaaaacatcctaaatgtgatgaaaaatattaatctctgccaccaagactcttgataaattcaaaataggataaactcaaagagatccacccctagatatagacacatcatattcaagctgctgaaagccaaaactaaaagaagaacctcaaaagcagaaaaaaaaagaacaaaaacaaagcaggataaatataaattctaaactggtcacatacagggaatcctcaatgaaattaacagctgactttccatcagaaacaatggatgccaggaggcagtcttaaaacacactcaaagggaatgaaacagtcaaccaacaatgttatatccagtaaaatgaacctttcaaaataaaaaacaaattaagaaattattaaattaaaaaagagagttcattgctagtagaatacccacaaaaaccatctaatgggagtcattcaattttaaattaaaagtcactgaataataacatgaataaacaaaagataataaagaatcaggtgaaggcaaaggtaataactcaggtaaggcaactataaaagttatatgaaagtgaatataaaagtgcaatggattcttgtttatatatcttttcttctcatattattttaaaatattatataatgcaatggttataaacttatttgaataatgtgatggttagttttatatgtcaactttactgggtcacaggattctcagctggttaaacattatctctgagtgtgtctatgagggtgcatctagaggacactaacatttgaattggtggacagagtaaagtagatggacctctccagttgtggtgggcctcatcccatttcttcagggctcaaatagaatgaaaaggtggaggaatgttaaactaatggccagactgtttgaggtatgacagtgatcttctcctgctctgagaactcctgattctcaggccttcaaatctaggctagaatctgtataatcttctctctggttctcaggctttgaaccagctttcctggatctccagctcacagaaggcagattctgggacttctcaacttctacaattgcatgaaccaatagcttataagaaacctctttatatattcagtagaagatacacatctcctattaattctctttatctacagagctacgactaatacggatgggattataatatattagcacgtaaatgaacaattataatgtataagaagaggaaaggaaaggaccatattgctataaagcttttgtatagtattgaaatgaagtttacaagatttgaacaagattattctaaattaagatggtagtgataatccgtaggcaaaccactaagacaattaacttaaaaacaataaaattgaatcaaaatgatatactagaatttatatatttagcataaaaggcagtaatgagaaatataaaaataaacacatgaaaatatagactatagactataaatagcaacaagacaaaagtaattacattatatgttaattgattaaaacttccaaccaaaagcagagaggcagaaattaacagatttaagaaatgatcctactatatgttgtatgttctctacaaaagataaaaattaggttgcaagacacaaataggttcaaagtaaccaaatggaaaaaagtaccaggtcaacaataaccaaaagagcaaaagagtaatagtggttatactaataaagacaaaatatcctttaagacaaaaattgttatggagacaaatatgaacatattataatgataacattttcaatgcatcagaaaaacacaagtattatgaatgtatttggtgttacaacacaacttgttaatacatgaagcaaaaatgggcataaatcaaaggaaaaatatacaattcaagatcaccgctgaatactttcatatcccactttcagtaatggatgtatcaatgtgcaaaaatcaattgaatactagcaatgaataatctgaaaatgtaattaagaacatttaatttacagtaaaattaagaaaaaataaattccttgggaataaacttatcaaaataagtgaaatattcattcactgtgaaattcaaaatataatttaattatattacagaggacataagtaaatctaaagttgtctcttcatcatagatcagatgatttgttattgttaagatgacaatactccccaaattgaaccacatatttaacacaatctctaccaaaatcacagttggatttttttttttttggcagaaattgtcaagatgatcacataatgcaaggaacttagaatagacaaaacctcttgagaaggagaaacaaatttagaggattcacatttccaatttcacaatttacttcttagtgcagtaatcaagacagcatggtctaagcataagaatagacatagagaacaaaggaataaaattgagagtctagaaataagcccatacttttatgtttatccaattttgacaagattgccaagaaaattcaatggggacacaattttcttttcgacagtgagtgctgggacgaacagatacacacatgcaaaagaatgaagtcagacttcattctcaacctagattcaagaattcatacaaaatttatcatggacaaaatagaagagctaaaattataaacttataaaagaaaggtaggattaaatctctgtgagcctgaattaggcaatggtttcttagataggacaccaaaacctaagaaacaaaaaaagttggtaatttggatttcaccaatgataaaacttttgtgtttcaaaggacatcatgaagtaagtgaaaagtcaacccacagaatggaagaaaatgtcttcaaattatatatctgaaaaggagattttatctagaataaatatacaaatattttccagtctgggcgcggtggctcaagcctgtaataccagcactttaggaggctgaggcaggcggatcacgaggtcaggagatcgaaaccggcctgaccaacatggtgaaacctcgtctctactgaaaatacaaaaattagctgggcgtagtggcatgcgcctgtaatcccagctactcaggaggatgaggcaggagaactgcttgaacccggaaggctgaagttgcagtcagaggagattgtgcccactgctccagcctgggccacagaatgagactccatctcaaaaaataaaataaaataaaataaaaaattccaactcaataataaaaagaaatattatacagtaatattatataaaattaagaaaatcattaagaaaactaagaaaaggattaccaaataatgttagtagacatttatccaaagaaaatatataaattatcaataagcatatgaaaatgtgctcaacatcattaattaggtaaccccaatcaaaaccacaatgagataccattgcactcattaagatggctataattcaaaaagaaaaataataaacagtggtggagttatacatgtccagtgggaatataaaataatgtagttgttttgaaaaatggtttgaagttttctcagcttcttaaacatagttgcctatcatataaccaattattttcacccctaagtgtacatgcaagagacatgcaaacatatgtccaaacaaaaacttgaagtgaatattcatattggcattatttataataattaaaatgtggaaactacccaaatgtctggaaacttatgagtagataaatgcaatattgtatatccaaacaatggcgtattctttagtaataaaaatgaagtattattaatatatgcctcagtatagatgtacaatgaaaatgttatactaagtgaaagaagctagttatttaaaaaatgacacgttgttgaagtagatctatataaaaatgtctagaataggcaaatctataagaagataaataattgtgaatgacaatgtctgagggagggtcaatggggaatgatggctaatggttactttggcagaggaaagggtgatgaaaatatttttaacttagtttttgcttacggttgtacaactgtgtatatactaaaaaccattacattttatactttaactggttgaagccattttatggcttgtgaattatatctcaataaaatgtcttaaaaagtaaataagtaaatgcagtggtactctgtggaacattgaagaggacaagttgtatacaggggaacagttggatgaacaggtcagtaatttcatatcggttttatttaggctgttgatgttaggatggtaatggtgattttaagaaaagacttaatgttatctatagtacatgactagctgtggggatgaagttcactaaggtggttaccccaatagctctgatagtttttaatgctactctgacaggcagaaatcatacattcattaataaacacattagtaaatcctttaatgtattatattcatacatacaatttcagctatatacacaaaatatattctttagcttttcagcaatattaaaatcgcacaatgtaaggctacaattattccaaaagagcccttaaaacatttttactactggtaataagtcagcttttctgtaaagttataccctatggaaaacatgtgaagaaaattctctgtgctaacctcatctccaggcaatagtaactatccacttccctttcagcagctacaaggtaaccctgaaaagtccttccttacacgggtgatgatcactttaaagaaaggagaaaaggaaaaagaaactaaaacattttctctaacaagcaccagatgctacaaagtgctgcataagcacaggacaaaagtactccttttcacaggcagggaataaaatacagtaaattgcccagacagaacagcaaaatggcgcagattgcgcttcctctcttaggatcatcagatgattagggagcatggtctcattagagtctcttggaacaaattgacaaactggtgtgttttccttcatttagtggacataaacgttgtttatcttcctaaatgcaatggttaaaagtctcaatcatcaaagcatattgagtgtatcaatgaaaatttattcctctttggtcagttactatgaaattcagtgagaaaaaaataagttagtaatgtctacttatagtagagattctgtatagtacaacttcttcagcttcaaattgttactgctattgttgctgtttctttttcttggcaattcatctgacaggaaattttacattttaagcaagaagaacccaagaatgaaccaaaatatagggctcagattaattcactcatacaagcacacacacaataacaataatcataaatcattgatcatttcctatgtgttaagttctggattgagaacagccaatacaacactcatctagaaactgagagtttaatgagggaactcatgtattagacttctctagagggacaggaatattaggatagatgtatatatgaactggagttaattaaggagttttgactcaaaggatcacaaggtgaagtcccacaataggccagtctgcaaactgaggagcaagaaagccaggcagcatcccaaaacctcaaaagtagggaagctgacagtgcaccttcagtctgtggccaaaggcccaagagcctctggcaaaccactggtgtaggtcccagagtccgaaagctgaaaaacttggagtctgatgtttgagggcggcaagcatccagcacgggagaaagatggaggctggaagagtcagctggtctagtccttccaagttcccccgcctgctttcattctagctgtctgaagctgattatatggtgcccacccagattgagggtgggtctgcctctcccagtccactgactccaatgttaatctcctttggcaacaccctcacagacacccccaggaacaatactttgcatcctccaattcaaacaagttgacactaagtgttaaccgtcatagctcaatacataaataaaataacataccttgatggtagaggtatgctcaggagttacacaaggacaggctgtgagcactttctctgtcaggagtggtcgtcaggtaagaatgcctggagaatgtaatcccagcacttcgggaggccgaggtaggcatatcacgaggtcaggagattgagaccatcctggctaacaaggtgaaaccccgtctctattaaaaatacaaaaaaattagccgggcgtgatggcgggcgcctgtagtcccagctactctggaggctgaggcaggagaatggcgtgaacccgggaggcggagcttgcagtgagccgagatcccgccagggcactccagcgtgggcgtcagagtgagagtccgcctcaaaaaaaaaaaaaaaaaaaaaaaaaaaaaaaaaaaaaagaatgcctggagaagcagacgttttggctaaattgccagtgaactgaatagtagttagctatgaagaggattagtggaaaggatacttcagggactgaggatagcatgaagcaaattagaaggctgtgaagtagtgtcgtgtgtgtggagaggaattacaagcaatccagaatcatggcacggagcagagaggagtgcaagcagtaaaggttaagctaattcaaacttccaagttatatagagctatataagctaagtcctagttccaatattttcaataaccactaatgtggctgggcaagtttttaaatctttctgggatgatatttaagcttttcttcttcttttttttttttttttttcaaattttcattaattgatctgcaaatctttatctgcaattggccgtcttgacactgaccacagccaacatgaggcaattgccgactgctctaaactgaattggaaccaagagggacccagactcttggttgggccatcaagagttctgaacgtgctagtttacgagacttggaaataacatttttactttccagtttccaaaggcttaagtccttgtaaaggagcaaatcgttttatttttacctggtaaactcagtttgctgattctctccccactaattagccccattctgcttaggtctctggtgctcaggatgagtgcctcagagtagaacatgaaacatttttaatatgatccaccccaatacagttgaatcagaaattcaagagggagtgctcaaaacacatactgtttcaggcccgagtgacttacagtcaacctattaatcaggaagatttaactgaggactgtcttttatgtaatttctgcaaataaaatcttttgtttctctttattcattcttttcagaaaaaaataatgaatttaacaaatacattgaataacaaccatatgcagggagaggagcagagagaaaaaataaacaataaagaaagtggtaacaaaatatccctaattttgatgatttgcagccaacagtcatgcagtgaaaccatatcttcatttctctgatatggatccactctattaaattttgccctgaagttcatgatagttttgccagcctccatgacaaattttcttttgctcaccttcattgagagagacgatattacttttttgcttcagctcatggtgagaaccaatgtgatagtatatacaaaatacctttgaaaatagcaagtgatttcagaaaatctaacactattttgtcatgtattactttaataatcttaaaacacatatctcctatatttctgtttcctataggatatgtccaaacttcttaacacaatcctactctgtttacgttatcttgtttttctaattctcctctacttctttgccctaatcgcaccaaagcacccataattatttgatcatgatatctacatcattggctcattcccattcatataatttaacatctaattttttggctgctgctgaatttccactggtccagttgtcatgttctctgggagctgtgtttttattttcttcatatagcattaattgtccctttcttataataccaccaacctgaaaaaatatcatatgactttttaaaacttttcctttaccttacaaacctacatcttctcaatgagcacaacatgcaaaacccatcactttccaatgtatatcattatccacgcattgttatgtcttgcttggaaaatggaagagtttccctgcttattctctggtcactattcatacgattctctaccagccaccaaaatcatctttggaaaatacaagccaatcattttattccctattttaaagtattttaagagcctccacttgaagttgtattaacattttcaagctttctgatgtgccttctgccaacttcccccacttcacttcaccctcacctgctatattagttagggttctctagagagattgaccaatacgatagatagacacatacgtacatacatagatgtagacacatgagaggatatttagggaaattgactcacttgattatggaggctgagaagtcctacaaaaggctgtctgcaaactgaagcccctgggatgctgcgggtgtggcttagtccaattccaaaggtctcagaaccggggaagctgatggtgtgcctttcagtccaaggccaaagtcctgagaatcagaatgggtttgagggggtactagtgcaaaccctaaagtcttggagttctgacatccgaggatggagaataagattgtctcagctccaatagagagagaggaaatcacattttctctgccttttttgtctatttggggccccaagtggttgatggtgcctgtcctcatagagagcagatcttccccacttggtctgctgaatcacacaccaatctcctccagagtcaccctcacaggcccacccagagcagcactttaccggttcgctagctattccttaactcaagtttacacctaaaactgaccatcatacctgctctgcccaagccacacagaatcccttctttgaatatgctggattttttcttgccttaggccctttgcactaaccaaggcttctgctagggtgctctgctcactgatcgttacttggccaactctttcttgctattcaaatatcaatgagtggcttatactaaaaagatatcttaaaatttttatgtttatttcctcacactaaaatataatccctggagagggcctttctcaggcttctttattgctatatttctagtgtcttgaataatgcctaataatgaagcaactcaatgcatgtttttggtgagtgaatggatgttagttgtttatatagcaatttcccctgctaggctgggaacaaatgtggcctccatttttgtaggccaagctcaatgcacagaaactgagatgcaatgagatctcaaatatttgccaggtaaatatttaagtaaattcactgtttataagacgaaaagacaatgtagcacttaggaatatacatcagtaatagagtggaataatgccaataatagagcagaataatttcaaatacttttcgacagaagtgatcatttgtagttctacttcccctcattcataactaaaataatatatgaaaattatgtaagttaacattctgggtagcaagattagctgtcttgagctaaattatatagagacatttgatgtccttaggctactagaataacacaatttgctcattggcataaggataaattatttgaggcagtttctttagaagtcatgaactctaagtctttctgcttcatttggtctgattggctgtgattcataaatattcccttccccataaccttgagatgacattcatttgaaaaagagttaaatggtattaggggtgaagtccatggccttgatattaaagaaaggtagctgggccataaaagaataaattgtattacacttacggagcccagttaatcttatgactgatcatgatagttatgaaaatcagaatgccagaaatctaagtcgaggccatagggagtttaacaaaaatacatagtcgacaatttgaccattttgttatattttattttttaaaaattggaataaatgtagatactaagatttacataatcagagtaacacctttataggatcactatgaaacatcgatttactaaagttttcaaagttaaagtgaaacaattatataaacattagtatagataaaaatctatagataataattctacattgaaagggataatttaatggttacacgcaattcaatttcgtccttactttactattctggtttttgtctctagaattgacttgacttttcgttactgtgcaagtgaatggggttctcattggaatttatgtccaggatgctccataattcccagaggtaataatgaaaaaaataaatcactttacttcacaatgtgcctatgaagcttttgtattgatgcttaaatcaaatcaaagtaaggtcacagagatacctgactctcctagcattaaaataaaaagtgcaagctatattgaaagagactgcaaatatttaataacattaaggcttcgtgaaatagatctagcatttaatgggaactcccaatcgttttctcagcccataagtctgtattgtaataatttcaattgtttgctctgggtagtcagctggtttcacattaatgtcgacttactattgtgatttactttctttaggtcccaactgagctcctgaaatttgtgtgatttgcctatcattgattacaaagaaagtttctgtttgcttcaaacatgatatttctatgaataaataaaatagctcatatgaagggaaaatagaattactttaaatctattctagcctctttcataaacacactttttggatactaatatgtgaatatacaagaattctcagttctatttggcaagaaatttttggcaatatcacgcctacaacttactcagcatattcttggtgatgttgtaaacaaacaagttaaagctaaactcttgccaaaagaatttaaagttgagcacattaagcagtctaagaattgaaatagcttacataaacttgtaaaagaaaacacaggcacagctcattttattgcgcttttggattttaaggtatctttttttttttttttttttttttttttccacaaattgatggtttgtggcagccctgcattgagcaagtctatcagtaccatttttccaacggcatgtgcttacttcatgttcatctgtcacatttggtaattctcataatgtttcaaacattttcactatgatattatctattattgtgatctatgatcaatgacctttgaggttactattgtgattggtttgggggttgtatgaacagtgaccacataagatgatgaacttaattaataaatgtctgttctctgtctgctcttctccctgttctaaccacaagccattccctgtccttcttcctctcctcggtgctccgtattccctgagacacagcaatactgaaattgagccaattaacaacccttaaatggcctttacatgttcaagtgaaaagtcccacaactctcacttaaatcaaaagctaaaaatggtgaagcatagtgaagaaggcttgccgaaagctgagacagtctgctaggaccctcgcaataacagtgagcaaagttgtgaatgcaaaagaaaagttattgaaaaaatttaaaatgctactctagtgaacacatgagtaataagaatgcaaaacagccttattgctaatacggaaaaaatttcagtgagttagattgaagatcaaaccagctacaacattctcttaagccaaagtttaatccagagcaaggcccaaactctaactctcttcaattctatgaaggttgagagaagtgagaagctatagaaaaaagacagataaataaaaatttttaaaaaatgaagctagcacaggttggttcatgaggtttgagaagagaagccctcttcataacatgaaagtgcaagataaggcagtaagtgcttatatagaagctgcagtatgttatccaaaaaatttagctatactagatgacagattttcaatgtagatgaactagcctgctggtggaagaagatgccttttaggattttaatagaaaggaaaagtcaaagcctggattcagagcttcaaaggacagggtgactctcttgttggaggttaatgcagctggtgactaaattgaagccagtgatcatttactattctgaaaatcctagggcctttaagaactattttaattctactctgtgctctataaatggaacaacaaagccgagatgacagctcatctgtttacagcctgatttactaaatattttaagcccattgttgagaactgttgctcagaaaacaagatatttttccaaaatattactgctgatacacaaggacattaatgctgtttctatgcttgctaagtcagcatttattctgcagcccatagttcaagagtaatcttcactttcaagtagtattatttaagaaatacattttgtaaagcaatagttgccatagacagtgattattctaatggatctgggcaaaatcaattgaaaaccttttggaaaagattcaccattctaaatgccatcaagaatattcatgatccatgaaaagaggtcaaaatatcaacatcaacaggagtttagaagaaattaattccaactcttctgtatgactttgaggggttcaagacttccgtggaggaagtaactgcagatgtggtagaaactgcaagaaaactgtaattagaagtgaagctgaatgtggggctagattgctgaaatctgctgataaaacttgaacagataaagagttgctttttatggattagcaaataaaatggtttcttgtgaaggaatctacttctggtaaagatgctatgaacattggtgaaatcacaatacaggagttagaatagttcataaacttagtggacaaagcaatagtcaagtttgagaagattgatttcaatttggaaaaaattcgaatttagatcaaatttcatcaaatagcatcatatgctacagaggaatctttcatgaaaggaagagttgatcaatgtggccaactttattgttttcttattttaacaaattgccacagccagctttcagcaatcaccactttgatcagtcagcatccatcaacaatgagtcaagaacctctaccaacaaaaagatcacaactcattgaaggtttagatgctcattagcatttatattacatatatattgtatgtacatttttagacataatactattgcatacataataaattacagtataatataaacataattttatctgtgggaaacaaaaaggatttttttgtgctcaccttattgggatatttgttttatttcagtggtctggatctgatctctcaatatttctgaaatatgcctatgaatccaataaataaacaaactaaaaaagactcctggatataaaggaaacaataggctgccctaccaaaaaagacacattttgggacaaagtcaaggagatgatgcacttatctttatagactcattgataataagaaaatataatgaattacagaagtagaaacattttacctaaattaaggacccctccttcttgacttttctttcagagaagaggaatggttaagtggaaatcaactactggaaaaccatctatcaattaatcaatcaatcatgctgtcatttcttataagtgccctaaaaattaaatggtggatcagcactcaggcatgaattggttatgttttcaattactgaagaagcaccaaatgaacaaaagaaaatttctgaattataatcatcctctgacaatgtaactaagggaactcaatattcatttgtgcctcacctttctccttcctgaaggagaggattaactatttgatttaaaaagtatgtcccaaacataacactaaaatttatggaaataattgtttttctctttagattcccaacacagtggcaataaacaaagcaaatattagtgcaagattatagataaaaacaacaacaacaccaacaatgaaatgcttacacatggggctcagatcacaggaacaattagtgagaagaatgcaggacaattcaaatcttccaatttctagttagattactttataccacactaacatttaagaaacaccatttatttgccaactgcattgagagaacactgcttatgaaattacaaaagcacccataacctaggttagtttatgttcttaatcaaaaatataaattttgaaaactagtcacacatttaatttgatatttcaaataagtgatcacttagaagtaaagaaactcattttcttatatggctcataaactactctagttttctttttaattaagccaagagatgattccaaaaattatttcaagtgaaagaagcattactgggggatagtttcataatgtgaacaatataaagacccacattcactctaagcatgcaaaattggatagaaacctagatttctgagccaaagtgcctaatatagaaccttagttcaacacatcccacaatgtgcaactcactttggacaagttagttgtcttctctgtatctcaggttctttagcaggaaagggaggaaggtaatggtgttaccttaggtaggtaaggactggctcattgttaaaattcattaatggtacatagtattaatatttaaattctataacactttccagcataaaatatttttattttattctctatatattataatttagttctatattagtaagcttggtatgccataacaaaatacagaacaacataaatttatttctcatgtttctggaggctgggaagttcaacatcaagttgacagtatgttctgtttctgctgagggctctcttccttgcttataggtgatttccttctcgctgtgtcctcactggtcacagagagagaaagcactctgttttttccttctcctcttgtaaggactttgatctcatagaattagttttccatccttatgacttcatttaactttaataacctcttaaaggccatatttcaaatatagtcacactagagcttaggacttcaacatatgaattttaggggacacaatagcaagttcctactaatttttctattgcagatattagtttttactctgattacaatatttatttttgaactatgtcaaaactaatattccattaaaattcacttttatgcaatccctgaactcacatttccatggaaagtatcaatattgtcttataaatgtttcctttcttccaagttgaaagtgagctaacagtaatatatatgtttttgaaaaatatactttaagtacattgcaatatcttattaatcagcttttggaacggttgttactaactgtgaattcttaactaaatatttgtgaattgccagtaattcactttgttatgatttagagtggttcttaataagcttattttacctgccaaccttacatatatacagaagataaattttgacaaaggctgatgcaagttttttttgatcctccaaaagcactccctccacaagcgttggcaattccaacacatctaatttgaatattttctatgcaagtcttcatacagtgattgcttcagccactttttaatcatcccactctcttctactatttcatagagtacagccttgacatcctcaagaccacagaacagtatctactactataatttacagattgagtagataagttcttatataattctttgccaactgctttcttatacctaaataggtattgaagaaactggacagatctgactgagcaacttcactcaaccccaatgtctgttttgaaattctcttgagctcactgtattgggcttaggaaaatatggttgcagtattttctaggagatatctaagttctctaccgatatcccttccatgacccttcctacctgtttttcacatacacgcaggtttaaataaaacttaaaagttaaatatatttcttatagacacaggtacagatatatgatttggatcaaacatatgttcattatattcacaggcagtttataatttggagttgtttctttaggacctgattttatgtaccatttaatagattgcttattatttatgcaatcacaaagggtaaatcttaacaactttttttcaccactttctcaaagtgacataaatgacaacatattcatgatattttttctcagtttaagcagagaattatttttcttgccaattactttaagcttaacaaaatatctactgtgaacaggataagatggacaaatgtgataatattggaatttagtctgcaaaactgtagttcaaagaaatgctaattatgaatatatgacattttaaaatatccaaagtgaaaaatgtactgaattacaaagtatgtgtagagggataaaatcaagctggttaatgaaaacagatgtagagaaatgatactgtcaaaaaaggtaggagggtgaaatgaggactaaggtcttggatgtgaagtctctgtaataaaaatattatctgccttttattaactgcctgaaatgtaccaggcactctgccaggcttgtgaatacaatatttccattgtttgcaacagcgattattatgaataggctttgttatttacccttacttttccttttgtgaactgtgtgagctaatgaaaacttaggtgacttgcccaaggctaggcagaactctgactcagatgaatgctttcctttccaaggccatatttctttctatgcattgtggtaccacacacaggagagtgggagagcaagagactcatatttttcacatactaatgcaaggggaacactaggcaagaagagaagaggacagcagaaagaacagagttgagttttatttaagtgactgtcaatttagcatttggaaaacataggatttcaaagataagaaatgctataccgcattaggtaatttgacatttggtggcataatgtgatacgagctttcttaaacaaacaaaaatgcctatccttatttgaaaatgagatggcaatgccaaggtataaagactggcatacactttgcattgctaatagtatgagttttctataatcgcttcagaaaagcttttttgcatgagctagtaaatctaaaggggaatcatatgataaaatccagatatccattattagagaacctcaattctatacaaaaaacatgcacaacattcacaacaccatctatggcagcactgcttgatgtgtaaagttacatatatatataaaattatagagattaacaaatacaaattatatgcttacacattcatttattttaccgaatagttatatgtatatttttgtgcacatgtgcatgggtgtctatataacataaatgtctaaattaaatgggtgcaaaattaaatcataaaataatacacttagtctggctgtaattatgtaaaggctaaaaccagaaaaaggaaacaaattattgcttgaggatacatatgcctatataacaaaattgtaaataagtgctagaaaatgattagtaaaacattcatgattagtggctatcatagagagtggacagagaggcaaaatctttgggaagatgcacacaggaaacttcagagggagggtttgtttcatttcctaagcttggtgatagatataggcttgctcttcttagttttattttttgtttagttatggaaaccatatctagtctttgaccacttagttagtgattgcattgtataaacaaacaataaagcagtacttggaaatattagagatttaaactgtgtccttagagagtaaccacagttccctttgtaagggcaagtgtctattaattctttactcccttagcaatgttctttcaacacaaaatcatatgtacacacttgcaagagaataattagaaagagaacataattgctgtaggcatttagaagttagaaggaaaagaattctctgctcattatgcactgcactgtgtctaccacggtggtttgagcctgttaacccctttcatcttgtgcacttcatccatgagaaagagataacaagtgcaaaatgatattgggtaatgaagcatcactctctgcatgctacccatcacagggacacgtgtacaacatcaatatcagaaactactaagaagggaaatggcaggctcttatctgccactgcaagtgggtttacaagcagaactagcattttgacattagcctatttgatggggaatctttacactgtgtggtgggagtctttcttggaaacaaacgagaggcgataactgttaatatccatgttgtaggtttttattgttactattcctattaatattagtagttagtgtatttccatgtttaatatcagaaaagtctttcttgagcagagatttccaattataagataacttactcaaagtataggtagagggaattagtccatttatatcatcaagaggccccatatccaaaatatattttaaagtcacagccagcttgcctgtttgaccttaacttaaatgttaccttctcagacttctctagctactttataaatgcaaactacctcttccctccccaaacccacacttctatatccattctctgctctatttttcttctatttaaaatatcagatggctgatatattagtccattttcacactgctctaaagaactccccaagattgggcaatttaaaaaggaagggggaggcttaatagactcacagttcagcatggctggggaggcctcaggaaacttacagtgatgtcagaaggtgaagcagaagtaaggaaacttcttcacaaggtgatagaaaggataatgaatgcaggagaactaccaaacacctataaaaccatcagatgtcatgagaatttactcactatcatgagaccagcatgggggaaaccacttccatgatcaaattaccaccacctggtctctctcccttgacacatggggattatgaggattacaattcaagataagatttgggtggagacacaaagcctaaccatatcagctaaggagtagttgataggatggtggttttttttttttcagagtaataaaatgttctaaaattgattgtcatgatggatgcacaaagatgcccaaatctgaataaaaagccaatgaattgtacgcttttcaatggttgaattttatggtctgtgaattatatcttaatatatctgttttttaaaaaaagattataaaggagcaaatcttttcaagttctaagttccaagttctagggaatcacaggaaaacccccctcggacactgaagcattagaattgtaaaaataaataccaagtagacctacaacagtggaagtgagatacagtccaaatgtgatagatggttaaaacgtaggttcagaataattactgaatacttctaggatagaattcatacatatagtaaccatgaaatggaaaaagattaaaatgtgaagtatggtcaagattatgaagacaggctataacagacattttgggtcaagagggtaacagtgtaacagtgtagtgaggacttagggggaacagattaattaattcattatgtaaatgatctcctgcacagcacttaagagacaatactaacatatgaccacagagcacaatggtaatcaacactaggggtttccagagttaaaattacatgtgatatatttaaaaaggagccttgttcttgacattctgtagccctctgttatcaaggacttagcatgtcaccagaagcatcaatcaaaattgattacatactctagaaccaggtcttgaatgacagggtactgttttcagtagcttcatttcagatcgattccatttgaacaacttcaaacaattacattaaatgtcctttagttatttccttgtttactattttccataatttcattttggccttaacccctaaatgcattgaagaatgcagttacaattaaattttatcagatttaatttttagactttatatgtcaattgcagagcagatatcaaatatagacttttacaagtacaaattagaaaaaatcatttaattagtcaaaatatttgaaatgtacaagaaattctcacaagtgtatgtgtttgcaagaaataattagataaacttcttcagaggggaaaaaggatttcaagggagttagatagtaaaagatgatcatctgcaaagaaacagtaagaaatttgaatctccatagaagcctctctatgtgaaagcattgagactggttatttcatggtagaagagataacattgattggctaaataactgtatgcccaaataaacaaaagagtggaatcacatattaaatattttatgggggaacactaaacacttgtaatatactcactttctgtaagcccataaacatccaccaaatgggacttaatcaaagataccagaaagagtgatatgtcttagtcatatagcccatttattaatatatcctatcaataataagtagcattgtcataatcatcatcattctcttcaccacagcttggcatggctattcccttctctaaatacatttattacctgggtcaccttgcccagacccatgactttaaacaactcctaaatgtggttcctaattaataccttcagccttgagctcttcattaagtaacagatttatatagtcatttctccttttaacatcttcacttaagtgaaacataggaagataaatattaaatgcttgattacactgctcttccaaacagccctgctcttcctaaggcccacgacggagccatcgtttgtgtactagctcagatcaaaaaggaaaaaaaaaaaacagaattgctgttgggttctattttttccacaaatgccacaatatatctaccagtgagttctgttggctctacctttataatgtattctgactctcatatcatacctgctgcatgcaaatcctttgcttccattgtcatctcacccctggggtacagcaatagtctcctaacatagcggcccactggtaatgcagcctgagccagaattactgtttaaaaatgcaaattagatcttgtcagaagcctgcttctaatcctccaatagcttcccataacatcctctggataaaatccaaaattcataccgtggtccacacgtagctatgtgatcatgtcgcattctacttattgaagcttttggcccattttacacatggtatttcattcagatattgctttttcttcaagtctccgagcttatccctaccctagtgtcatcatctactaaatacatacatacataaaatctctcctgggcacttttatctattctcatggcttgaaatgttataaatatttcccttccttccttccttccttccctgtccttcccattccttctcccttccccttccttccttccttccctgtccttcccgttccttctcccttccccttcctttcttccttccttccttccctgtccttcccgttccttctcccttccccttcctttctttcttccttccttccctcccttccttcctttcttctttctttctttctttcttttctttctttctttctttttgtttctttgtttctttgtttctttctttctttctctttcttgctttctttcttttacgtatttctttctttctttcttctttcctttttgacagagtctcgctcttgtcacccaggctggagtgcaatggtgcaatctcagctcactgcaacctctgactcccaggttcaagcgattctcctgcctcagcctcccaagtagctgggattacaggcacctgcctccaccgccggctaattgtggtatttttagtagagacagggtttcacaatgttagccaggctggtctcgaactcctaaccttagatgatctgcctgcctcggcctcccaaagtgctgggattacaggcatgagccaccacatccggcctcgatgtattctttctagattttttgtttgtttgcttgttttttttttgttgttgttgttgttttgagacagtttcgctcttgttgcctaggctggagtgcaatgtctccatctcggctcactgcaacccctgcgtccgggttcaagcggttctcttgcctcagcctcccaagtacctttacaggcatgcaccaccaagctgggctaatttttgtatttttagtagagatggtgtttctccatgttggtcaggctggtctcgaactcccgacctcaggtgatctgcctgcctcagcctctcaacgtgctgggaatacaggcatgagccactgtgccgtgcctctttctaagcttttatttctatctgatacctctcagaatccagaccacaatattcagttttctaataggcaaccgtccttaaaagctctaaaaatctaacttatctaccctcacttcccttatcgtgacaaaaattctttgtttttatttactggaacttccattaatccagatgcttatgtcaattgaccctatcaatcatgaagcattgtgaattttaactcataaatacatcttaactcaatctagctctttccattttaactggcaatgccctggactgactcaatattatctcttgtttagacgatggcaacatcttcctcactggtactcctacccaagatctgctatcatccaagccatgcaatatgatcattctaaaaggcaatgcagatactgtaactttcttgtgaaagaagcttcggtgtcctcctttacattcacttccttctttaaaaaaatcaaatacacttagcatagcactcaaaatattcattatttaatacatgattacttcacttgtaatctccacaccatcttctattaatatcttgatatactgtattatctacatttctacaagcaagcaagatccattttgcatttgtatatgttgccttttctttgaagaaggacctacaattttaaattattcctgcatttagaacataacattattttaaatacccttttttgtgggttacatgatcaccatgatctgcctggaggacaatgaatgcccttttgcagggaagttagagtgcctgcattcccttttagaataattacattgggatttgcctttgtttatgctgtcgcatctctcaccacaattcccttcctccagccacactgatatctttaaacatgctccccatatgggaatcagaattttaactaagtctgaccataagtgtgtattcttcatatgacttaattaaacttaattacttctatacagaacattatagtgatgatgaatatatcaatcatggagacacagagcatcactttagaagtctctcaagtgttgctgtggtggaagagaagtcaaacaaatgccgatttgggactaccactgagacctcaatcaaagtaaaatttatttatttatttttgttgttaaatgttggggcttagtgtaagccctcttctgagggatttgtatatatatgtgattattttcgtagtccatggctcttttagattttatggattttttgtgataaggtggttatatttcaagagtttgttacattataataatcaaattgttacattttacacacatgttctgcattattttgtgctaagattctggattttataaggtcttgcaatttggaggcaagaaagctggttcagattgaatatttatctttaaaaaggtgttcaagccactcactttaaaaatatgcaaaagacatgaatagacatttacaattgaaaatttccaaatggctagtaagaatatgaatatgtgacttacatcattgaaacatcaagagaacacaaattaagacaaaaaggagatatcactgtatgagcatagacatagtggagatacaaattatttaaaatggcagtcaacatcaaatgttaggaaatatatgagtggctgtaacttgaacaaattgatagtggatatgtaaattgatttaaaaaaatttcttagtgaaaatatttggcagtgtctaccaaagttaatcatatgtctaccttgtggacttagtaatttcactcttagtacaaactcaggagtattactcatgtatgtgccacaaaaagacatattaaaatgtccataaatgttttctttataattatcaaaactagaaacaataaaaaatatccattaatagtagacagaataaatacatttttatcttctttgtgtgtgtgttggagagagagaaagagagagacagggccttgctctgttgctcaggctggagtgtgtgacacgaacacagctcagtgcagccttgacctcctgggttcatgtgatcctcctgcctcagcctcctgagtagctgggatcataggcacgagattcttccacctcagtctcccaaaatgctggctttacaggtatgagccaccatgcctgcccacatttttatattcagaaatgatgcattactacctagggttaaaataattgaactatttctagatgaaacaatgtagattaaactattaagtgaaattgccagagaaaaaagatgatgttctcaggattctatttacgtgaaatgcacaaacgtgacaaaaaacaaaatcataatagtggtattgggaggaaggggatgtgtaagcattgattggaaatgggtacgaggatgcttcgcttcagagatgtagtagctcttgtcgcaatctggaggctgattatgtgagtatatacttagacaaaaatcatcagggcttcatttaggatatatgcaatttattatttataaattaaactttgataatattttacattaaaacaaaacaaaacaaaacaaaaaacaaagctcttctaaggcacagaaatcattggtttttcttacgacacacaatttacattacttactactgaagccctccgtggcttccagttaattaccacaggtgcatgaatttttattactctattattcacagtattatgatttagctagtccacatttttagaactaatttgatagggaaatatttctatggtgacatttatcactaacaaatgaattataattcaaaatttatacctaattctttataacagaatttcccaaagtataaactcacgtgctttcaaaataaggcaaatttaaaatgaggcggaaagaaaataataatttgggcatgaagagtaatgacaattgaagtaaaagaaagtaagaagctttatgtccaatttttcttttaacttctccatcaagtacaatccataaagtacaataacatttctatttaaaagagaggacattgattaaacataactcagaagagtatgtattacttacaaattagaaaagcaatcaataaaagctcatgatggctaaggagttaaacaaagatgcggcttcattaaatatattcaaatctcctggtctgaaaatgaaaataacaaagaaaacacctagtatttcagtgtagtgatagcttttgcatatgaatcacctgatctgtcactgagttaagtagtaatttgtgggcaaagtttttgttttatgaattatgctagttttccatggctatcataacaaattaccataagcctggtgacaacaatgcaaatttattgtctaaacattctggaggggaaaagaccaaaatggatcttacagtgttcatataaaatacccatatatacacaattctacacctgtaaattaggtgttttgaacgactgtgataaagcaaacataacttatctgtatattcattctgcatacataattttagtttataattctaatgtataaaggtatatattttcttctatgctatgtgcataaaagttgatctattatagatatttatttaaattaaatttaaattacaagtctgactaaaagggagcttgataagaaatcacctctattagaagaagggcttttattctggaacaaataaagaattcctcaccaatcctacattttactttttgcttgtcttgggggtaatacaaaggcaacaaataaaataatcccagctgatcattgtctgaagaaagaagacaccctcctacataagaaataaccatcacgtttcaagaggtcgagtgactctttatcgcccaacctcttaataaaattccttccatgctctgtcaagatctggtgaataagtcagaggcagagataaaccaaacaaaatcttgcaatgtagcaaaagtgagaactgcttttctccataaattaggtacatttcactgaaggaaatagtcttccatcatactactactttcgtcaaggcaaaggcttatagggggggatgtattttatttttcatttagagttcaacagtacaaatttatctctatcaataaaattgtcaattgcagtaacaagtaaatttatctagctgttttagtacccaatgggaccattttcatgttaaggcctggaattaaaacagcagtagaaataaaaacaagatgatggatttaaagaaagatctaaatctgttgaattttctttgtgtccattaagaaacagatgttttccatatgttgaatagaagaaacctcagccacattttaattatattgtttgaagtagaagtttgatagtatttatacatggaaaataaaaaaaacagggtttgggaatgtgattttgtacctagtcttcccctgctgcttagagaaattacctctatctcgaagcttggattactatatgcagttaggagatataatacctgtctcagtgttgtatgaaaaatatttagcaaataaaataatactgtgataatgtggattttatatagtgttaatgaaatcaatttttatacttgggaaatttttcctgttagatttggtatctatttgcatacattatatgaatcactcagctagaatcaaagtcatacctatgtactgtgcacatatatataattctttataatttaaaaaataaacaaaaacattgcttgaatggagaaaaacacttgaataccactttatcactttgagcattttcatcaaatgctaacatttgagtgcaatttgttttatcatagtttttttctctctctctcgtgcatacatacacacatatacatatataggtacacacacatctgatccctgtatatatacacacatacatatgtctatacacatacacacagttttatagaattactaaaatttaagttgcagccatttttctcttttatttctaagtatttcaatgaattttctaaaaatagaattattttatatcaacaaaatggatttatgaaaatcaggaaatttaacatatatagaatatgactatctaagtcaaaatcaatattgaaattttatcatatgttcaatcatgttcttataatactttattactggctaggatctagtccagtataaatgtgaaaaaaatgcattggagttgaatgcattcacatttcatttctttcatgctttcaaggaaaataattaaaatattaaatacatttttgaaagcattgaaaagcatggagatatttggagtttattttataaccactcacaccaaaactggatgaacaaagcaagcatgtatttatatgcaaacacacatatgctagaaacccaaaacacactcaaaatatattctgggaattttctctatttcaaggttactctaactacaacttggcttagacccagttagttatgactatgcattggttattaaatgatagtgcatgctatataacaggacaagaatttatatgcctcactacattaaaattccaacgtgaagagattaatacctgactgacaataattactacgtttaatctctcttatcggtctgtgttgaaaattatacatattagctccactacatattcaccaagtttgtcctcctggactcgagggatcctctcgtctcagcccccggagtagctgtgactacaggcatgcatcaccacgcccagctaatttttcattttttaatctttgtaaagatgaagtctcaccatgttgcacaggctggtcttgaagttctgggctcaagtaatctccctgcctccacctcccaaaatgctgggattacaggcatgagccactgcctggcccagggttttattcatgactttaattttgaaacatattttgtgcttcatttactcaataatttaaatacaatatttccatctagatattttttaattgtgagtttttaaagaattcatgatttgcaatgattttagcccttaaaaattaaatataatattgatgtagtaataactatttaacattcattgattaaaaacactttgctttttcagggtgagaacaaacccacaaacaaaaaacaaacagctcaaagttttcattagattaaggacttgaggaatctgagatgggtaactttctaaattctttgtaattacatctctgtagatcttgcattagaatgtggatttcggcttcccagtagagcctgatacttctaatgtgcaattagaggaagcaaagaaaccttatttatacaaatagaaagctaatgagatggtacaatcaatgagaatacttgatcatttcagagcttcaaccacagagtcttccaccacttaatctaacacctaacaaagaattagctgcagccaagtgaatatcctgaacaaaattagcttctctcttgtttgtctttatgatctgggttgaatacaagaacctcattatcagtgcctagcccttttgaaaaatcctttgttttgttttctttaaataatttagcaggaattattctatttagcactactccaatgcagacgttttagaaaattctcaaataaacatattctttctgcgtacagagactattttttaggaaatattatatttcattgtaaattattgaccttaaaaaggtaaactttttattagtaagctttttaaccttaaaatttatttcagatagattttgcttttaagtttcttaccttaaaatttttcaatggtaagatttttaccataaaaataatcctgaaagattttgctttacatatgccctagtcatcaatttaagattgttaaataaatttcagaaatcatgtaacaccattcctcaatttacagatcaaagaaacaagatatttaggccactctgccatttactgtaagaaagctggccagaaattagattcgtagactcttaggacaggctcttccacaaaagcatgctacctcccctcacatctttccctaaacacaattactagtattagtaaattgcttgaatgtatacaaataagaaataagcatttttaaaaattatatttaataagaatcattaattcacaattaaagggtgaatataccataattctttgtttctttgtttctacacatgagtttatttagattgatcctttgtataggttttgaaaaaacttgaaaagcaccacagaatcaagtgtgcactgaactctaagtagcaacatgactagagaactcgcagtgaggatactacctaatcataccaaaaagttccattattgtctgcagtatgcactcctctggtttaagaaatgagatattaccttttaaatattaaaacttatgttcaaggaatgtgaaacctaaaccattatttttacctagaaggaaattttcatttaggctcagggaaaatcagaccccaaggaagttatggcatatatataacaaagtttaattgagaaaagataaattcaggtctaggaagtggagtggaggctgcctggacaacttcatatgaaagaatcatgcagataaaggaaactgggaaatgtggtttggtagcaatggaagatgcagtcaaggagtcatacggaacaaaaaggaagatggacattaacacatatgcaatgagtcccatcaaaagaaacagcaacagattttggccaacactttgttaaaaaataagccaaactgccataaacaggaaaaataaacacaatcacttatctacattaacacttcatttgtatggcaacggcataaagccaggatataaatagattacttgaatgctgtcaattagtagtaagccttaaaaaatttttttgatgaaatttgttgtcagctgttgcattccctaaagatgtagttctggcacaggattttaacatcgtttcagtgggaagtatttgctaatatattgcaagtggcttgctgggcaaagaagggaaaacaaccctgattgctgacaatatttacataattataactagtcagccagtcactcctccccaacagtgaaggctgaggttctaaaactctttgcaagggcaaggaaaacaacaacaactcattttctctgctctaaattttaccaattatagatccctctcccattaataaataacatggagtttataataatattaactatcctaacatatttgtaaacctggctttaggggtttactctgtaaatctagccagagaaattataaatatagaaatgttttatgcaaatatatgctcatttcaactttatgataatgaaaagctgaagataaaactaaaccaaaaattgtagcatatttaaactatgagaaccagttaaaagacaaatgtaagaaatgaaaggaaatgatgtctctcaaaggatcataaatattccagataccttttatctaatcatttatcttgtgcaacaaaatctcacatcatgctcccgaggaggactaccttagtattagtcattccattttacaaatgaagcagctagttctcacagcaatcaaagataaaaatcattcaaccaggagtgatggaaaaccgtttatagcctaaaaacccacacatcattatttttgcagtttactttcatattgctgaatattgtttatcatctatttaaacatcctttatgttgccataggctattatgaaaaatagaaaataattcacatactttagtttgtaaattactctttacaaacaaaagtacttatcttgaaaatgacttcagtgcctcatgtgagctgaatgtaataatgcttcattacattttaataaacttggctgatttaaaatattcagtaaaatgacagtttatcacccactttaatgtcataaaatctttgtagctttctttaaactttagtacatagttctgttaaagtgttcatttcatttatgcagatttttggatgatacataatgagccatgatataagaattattttacaataacaattatatataaaatctcaaagtaattgattagttactctttttggtcaaattttgacttttttaaccactttttttttaactaagggaatttctttcacatggctttatgaacttgtataagtcacacaaatttcctggtgttagatatttttatttttgaaaaggaggtagaactctagtacataaagtccttttattatgcagattaccgtgtattaacataatggtaaaagatatttaaatataattcaaatatttaatggattatcaaatgtcaacaataggtcttttgttttgaattcacataatacatctctaacatacacagcatgactgtagcatttgtttcgtaaacaagaagcaattattaataacagagatagcaatgttgtattagtccatctgaatactgttatacagaattgcccgatactgggtaatttataaaggaaagaggtttaaatgactcacattcagcatggctggggatacctcaggaaacttactatctaggaagaaggtgaaggggaagcaaggtacctttttcacaaggcagcaggaaggagaagtgccaagcgaaggggagaaaagccccttttaaactatcagatcttgcgagaattcactcactgtcacgagaagagcatggggaaaactgcccctgtgattcaattatctccacctgatctcacccttgactcgtagggattatggggattgcaattcaaggtgagctttgggtgaggacacaaagcctaactatatcaaatgtttataagcaaatactgtatatttcttacaatactagtagtaatagtaattaggtgtttcctgtgttcacttaaattctctgttaaaccatcacaataactacgtaaggttgttatacccattctacatatgggaaaatcaagtaacggacaggttaagtaatttgtccaaggttatagacgtagatttcaaaaccaggcagctcaaatcagtattgtacacatactactatgaattcagcaacaatttattatatttcatttgaatttgaatttgatttcaatgtagcaaaatgtctctgctacattgaaatgccaatataattcaaataatagttttaggttttgtttgtttatttgttttatgaatggggtctcactatattgcccaggagtgcagtggctattcacaggcatgatcataaattactatggtctcaaactcctggactcaagtaatcctccctcctcagcctcttgagtatctggaattataggtgtgcaccaatgtgctcagcagaacagtgtttttgaactcaaaatccttcagtgaaactatggacaatagtatagaatcgctaaaaataaaccatggcctgcttcccatcaccatcttctaccagcacagctcctggcctcacaaagaggatgcctttgtatgttctcaatatattgattgtatatgttttcatcaagcatctcataggaatgcaattttctagctgaaattttttttcccaaaatctatgggagaaggatttaagagacttaaggggagcaaaaactggaggaaagtgaattatatcaaataggatgcagatggcatactaatcacagaaggaaaacaaagtaataatattgcagagaaagaaatatctaatgagcttcacagttgtttgtgtgtgccatgctatatacatggttttccacttattacagaatcattcttgagagcatttctaatgtttaaaccttcctcatcttagtaaaaactttcttatattcttattgaatatcttcttttcagatacatctccctcggcctccatcccactgataaatgacttcttcacatgaaggcaactttttaattcaaattcctgaatttcataaacatattttactttatttcattcatcttccatctttattggtagctgttgaccatccaaattatttcctttccacaaactatttgtctctggcccaacagtgctatctttcagaaagccctttcccagtcttcactcctttttcttcttccaagcagttatttaatgttgagatttctcatggtgaaatgttgaagctatttctttttttttcttatgcaatctccttaggtaatagcatcttcccacttgactcaatgttaaacctccagcccagacgctttctgcctcatatatccaattgcatacttcacattcctactccgatgtcttaaagatacctcaagggcaacatctcaagaataaccccatatcaatcctgccaaacatgttatttattcactcttatttacctcagtaaatggacccaattccaatgcagttgacaaatctcacacttgagactaatttgaacacccttttttaagtcaccacctatgtctaatctattctcacagtctggcaattttatgtttgtgtaagattatgggatttctgtatctctctatctttttttttttttttttttgtttttgagacggagtctgtctctgacgcccaggctggagtgcagtggcacgatctcggctcactgcaagctccgcctcccgggttcacgccattctcctgcctcagcctcccgagtagctgggactacaggcgcccgccactacgcccggctaatttttgtatttttttagtagagacggggtttcaccgtgttagccagggtggtctcgatctcctgacctcgtgatccgcccacctcggcctcccaaagtgctgggattacaggcttgagccaccgcgcccggccctctctatcttaccagtcccattcttagctaacatcaaccattttttaattaacctactgcaagagtcccgtaatttggttctttcttaattgattcttacttaccttcaatgtattcaacaaacgccaccaagggtgacatttttatgacattgtgtccataaaaactacctataatccttcaatggcaaattaatattatgtgcattatagctgtatatatgtgtatgcaaactaaattgatgttttataaaagttataaaaacaatctgtggttttctctagttcttaaagagagaaaatagaatgcataatataacctataagaccttgcatattttgttcttatatctgactctaactccctctgaacttctaccccaatttgcgctttggctaatatccattctgttcagtggctttgctatgcccctcctctattcctatatcaggatccttgcacacattagtccttctacacagaatgtgtaagaggtacttaagaattaagtaatgagcactttctttgtgaacacagacttttgcatttgtgaattcagaataaattatggtccccaaatttcttcttttttcttctttaatttctgcattctagtctttgtgtgttgagagctgaaagttataaccacctaattatttagtgtccagctcttggtagagatggtagtccctctctgcagctggttgtcccgtcatttcctcagatctcagcagagatggtagctccttcttgctagacaggtcaccccagtgagtgtccagctctccacagacagggtagaatattagaattgtattctaagtcaaatcagtgacttgggtgaggggctcaatgtgagactctttggaaatcaaatttacaccataaatagtatggaatgagcagcctgctggcctgggcactggacctcctttggtctacttcctgacactggaggctgtgtgtgttcagacttatttattctgatttgcactactatggattctgctttaaaagtctaagtgatactaaacaattaggtggttataaatagttaccttcttagctggatgagtgctaggatgtccagaatgaatagatttttatccagccctccagtgtaatggttaaaagcttcatggaattttaagaatctattcacttatttgctctgaagatttgaagtatgttgtaaggataaatatgccccatgtctgatttacatattgacaataatcactgccagtaattcacttcatttgctttggcttttattcccacttaaatgtacctttaggtcgtatcaagaaattggaaataaatgtgcttaatatcaaagtgatgatttcactctttgtattataaggagggaaaaaacatttagatcatataaagaaaagaaaaacataattcctcaaatcatccatgattttataaaagccataatggctcagcaaatatgaaaacaccactttgtcattttttcaataaaaattgaacatttccctctgtattcctcatttaaattgtgctacttagtctttctaatttattttattatcagcttatactttttattatagaaaaaggaaatcttctaatctttctaactctagttctataattaaagttttataaaaatctcattgaagaaacaatgtccactatttgggtgatgggtacactagaagcccaaccccaccatacacatgtaataagtaacaaaaaagcacatgtgcacctgaatctaaaataaaaaattaaaaggaattactttctctttttttaaatctcttttgttatgtggtcataatgtgttttccattgcttataatagaatacctgaaactggataaagaaaaggaatttatttctcataattatggaggctgagaagtccaaggttgaggatctgcatctggtgggggccttcctgctgatggagactctctgcagagttctgaggtggtgcagggcatcatgtggtgagggtggttgagtgtgctagtttggatctctcttcctcttcttttaaagtcatcagtctctctcttatggtaacccattaatccagtaacccattaatctgtgaatgtgagcagagccttcatgatttaacccaacctctcaatactgccacattggggaataagtttcaacatgagctttgaaagggacattcaaatcatagcagctgtgtctgttgatttatctgtctttttctattggtcatctcagctgtatctccacccttttatctcttctcctccctcctcctctcctcttttttcaactcctctctctttatctctcttggtctctctcttctctctctctctctcttatagtttgattttgtattcaggtttaagttacctccatatttttcaatactgcaagtatttactttcacttgaggcaccaggattcattactggtataggtcttcaaatgtgttatcataacacttgctcttttcctctggctgatgaaaataaaattacatttttttttcctttagccatttttcatcaaaaatccattctcaaatacagcatactaatatactttctccttaaacagatctgtggatgggtcaaaacacagttaattttgcagcctgtaatatgaaacttcaacccaggaactgttgctagaagaataaagaaaaattgtttattttctcatttgaagctgaaggaaacactaacagttttaaaagattaaacatacatatccaaattcaaaattagagatactgtaagtgtagaactggccagcgagatgacttctgggaaaagagaaagaatatgtatttgtggcagacacagctagttgcccatccaatacatattctccccttcttgcttaataaggaaggacaggcgtggtaacatatgcaaccaaaaggctacgtttcctggcttttcttgcaactaaaggtggccatgtgacctagatttgaccaatgaaatgtaagcagaagtcactgggtcttgttctgtctaaatggcagacttggtctgcatgaacttttgtcatttgtcccttgtatcacctgcagatatatggcaatgaagatttcataccgtggaactaactttaaggaaaaactttgctggtccttcattttaatgtgtagcccagcaccaaaactggatcaccacacacttccaaatttctgcttatatgagcaaaatacattctctattgtttcagcaactgtgatttctgtttcatgttatgagcagctgagcttatttctaactttcagtaattatgctatggcacagaaataggtcaaaactatgaagtagtgagtagactgtacattataaatctggttatatcacttccataatattttcatgcattgattttcactcttaattaagccatttttcttagtctttttttattatgaccaccagccaaaatgtatgtaacaggagttaagcaaaaggaaaaaaggttgaaaagaaaggagacattggtgggtggccctgatagaaaagtccaggagtgcttttctaagatgccatactttaagactttaatcaagatgtagacccagcagctttttgtttatttgtttgtttgtttgttttagagagagagacttgctatgttgttgcccaggctggtctcaaactcctggcctcaagcattcccactacctcagcctcccaaagcactgggattacaagtgtgatccaccatgcccagacccagtagttctttaaagcctgttttcatcggaataagattttatgattacaaaagtatcatatttttaaataacattaagaatatagagataagaataaaacagaaagctgcctctaccacctgcagataaccactgttctcttcttagattataaattccttctagctcacttctatatatttctatatattataatgtgccatttaaaaataccaataacatttaatagtggaaattacttaatcatattgatatataccacaggaggttattaaactcttatattttcagaaattacatgctttactggctatttctataataaatattactaaggcagagttcataagtatttccttggtataaattccatgtgaactatacatattttaaaggtttttatatattttaaaaataaactctagactttttatttgcactttcctcagtaacgtaggtgtttggttcctcccatttttcatttcagcagattaggtgtcgttcaaaatgaaaattgccaatcttactaataaaatgtaatctttattttgcatcgtagcaggttttattttttttcttttaaaaattcttctggtcaccttccactacaggaattataatactgaaatgcatatctaaaattaatgtacttatttctctattagttaagatagggttactactataatatgaaatatatgtgtgcatatatatatatatataatgacaaaactataacagaactttagtttttattcacaaataatttcttttttataactttactgaggaaaaattgatacaaataagtgcatatatttaatgtatacaatttcactagtttggacatactaatacacccatgacaccaccaccataatcaatgtaataaacacattcaacattcctcaaaatttccttttatctctttgctctgtgtgtgtgtgtagagtagtaaccttcccttgagatctaactgcttaaatttttaagtgtacaaggctgtattgcactatgctgaacagcagatctccagaactaatttgttctaaacaccaaatatacagacagtagatggaaaatacagtaggtcagagattctcaccctcagtactactggcacttggaatagggtattctttcttgtggggatagtcctgcttagtgtaaaatatttagcagcatcactgacttctactaaatgcaagtagtttactccccaacatgaaaatccaaaatttctttggatgttgccatgtatcccacagggaacaaaattgctggaacaagtggttccagcaattgggaaccacttggacagaagaaagtgtttataggccaagattggaaacagtgcttatcattcagcttagaatccactggctaaaattcagccatgcagccacatcaacataaagagatgctgggaaagataagccaactgtgaacaaagggaacagtggaaaagtggccaataacaaatactctaggcaactattacacaactttattacttttctcattttttttttcctttttgggggtggggtaactgttgacatttcttaggaatagaaacatattttctgctttgttttaattttgccagaatcattacctcagtcacctttaaaggctccacctaaaatactttctctatattataccatctttactgaagcatttatatatatgaaatatatataaatatacgtaaaatatatataataaatatatatatttattctttatatataatataaataattatatataatatattattatatataaatatatattattttatatataaatatatatttattatatatattatatatatgtataggatatttatataggaagtgccatctctttgtctcccaacaaacaaagctagcaaatcaactactgttgagttttaaaattttcatgctatcaactgttggccattaatctgcatattatcataaccaagagtataaatgtagggctttggtttgaatgtgtcctccagaggtttgtgtgctggaaagttaattgctgttgtaatagtattaagaggtaggattgtaaagagatgattaggccaggatgactttgctctcatgaagggattaatgccattatggggagttggttagttatcttgggactagatttacgataagaggatgaatccaacttgatgttctctttttgtctcctgtgcttgcttccaccatccacccttctgccatgggatgattctccctggatgctgtccccatgctcttggacttctcagcctccagaattgtgagcaaaatagacttattttctttataaattacctagtctgtggtattttgttaaagcatcagaaaattaaataagataggtggataaagtttctcagtcacatgttggaagccagatgcatgagaatggaaatgatccaatcaaagtcaagtttaaattggcagtgtttgaattttgcatattcctctattctcttattgaaatacaatgtaattgtatgttctatttctaagcatatgaataaagtctaaatttattttcctagttatttaagtgttcaaataccttgcatcatattttatgcctaatgtcattgctgagcgctgcctaaactccttacctttaatttcttaattgctgtaatctctatctttctgatttggggcatttttcttttcattttttttctcttttggatctttcatatttaatatactccttgtaacaaaagtcaattatcagtactccaactcttattgtgatacctccagtctttctgaagtcataagtgtatttacagtgcattatgaaacacataattgattttatactgtcagttggatgattactttttaagaacatttcatagagtttgcattaaaacaaacttgattattttttaaacaaacatgattatattgttcccaaatgcctattacaattttaagtagagtaaccacttttggcaaaacaaaggttcttcctggaatacttaatgaatataaactatttgcacttaattattttcttggtttgtaaaagattgtggtcttaaatagcttgtcctggttaatatacttcctgtgctgttgcttgcttgattaatgttaactttgcatcttttcatttcttcattgtataatggtaaattttgtatcctggagcaatcttaacacagattttttattaatgtacttttaattaaattgattttactacaataataggtcttgcatagtttttgcttatttctaatgataaggatatttacctaagctcactagttctcctcataccacagataattaagtgtatttatatgtggtgccttcaaaaataatttatgtaagtgaatatgaactcagtcttcagagttcttgcatcacctccctatcaatgaacttgagtgcttactcataaagataattttaaagattaatggtaataaggaaaaatagttactgtatacttacattctagtgaaactgatgacaaaaaggtcaattacattttagataactctaaatagtacacttaattgagcaagtaagttcacaaaaaataaagaaaaatctaagatcttttagagtagaatctccttatgcaataccaagtctgtgacaacacgtctaggtaacagatgactattttgagaagttttctccttgtagaggcactacaaaaataacagaacaattctgtgtgcttataagatccagaactgttataagggccagaacacacagaggcccttatctgtagactagtaaaagcttatttccttgtaataaaatagtcttaatgctaaaattcaaataagacttcatatggtttggctatgcctccacccaaatctcatcttgaattctgatgttgtgggagggatctggtgggaggtaattgaatcataggggcaggtcttttccgtgctgttctcattatagtgaataagtcttgggagatctgatgattttaaaaagaggagtttcccttcacaagctctcttctcttgtctgccaccatgtgagacatacctttcactttctgccatgattgtgaggcctcctcagccatgtggaacggtaagtccattaaacctctttcttttgtaaattgcccagtctcacgtatgtctttatcagcagcatgaaaatagactaatatagtatactggcaccaggagtggggtgctgctgaaaagatacctgaaaatgtggaagtgactttagaactgggtaacaggcagaagttggaacagtttggagggctcagaagaagagagaaaaatgtgggaaagtttggaactccctagagacttgttgaatggctttgacaaaaattctgataacgatatggacaaagagttccaggctgaggtggtctcagatggagattaggaacttgttgggaactggagcaaaggtgacttttgttatgttttagcaaacagactggtagcattttgcccctgccctagagatttgtggaactttgaagttgagagacatgatttagggtatctggcagaagaaatttctcagcagcaaagcattcaagaggtgacttgggtgctgttaaaggcattctgttttaaaagggaaacagagcataaaagtttggaaaatttgcagcctgacaatgctatagaaaagaaaatcccattttctgaggagaaattcaagctggatacagaaatttgcataagtaacaaggagtcaagtgttaatcaccaagacaatggggaaaatgtctccaggttatgttaacagaagagacctttgaggaagcccttcccgtcacaggcccagaagtttaggaggaaaacatggtttcgtgggccaggcccagttttcctgtgctgggcgcagtctagggacttggtgtcttgcttcccagctgttccagccatgactaaaagggccaacgtatagagcttgggctgttgcttcagagggtggaagccccaagccttggcagcttccaagtggtgttgagcctgtgggtgcacagaagtcaagaattgaggtttgggaacatctgcctagatttcagaggatgtatggaaatgcctgaatgcccaagaagacatttgctgcagggctggggccctcatggaggagcaactaacttgcttttgattctacaggctcatagacagaagggacttgccttgtctcagatgagactttggactgtggacttttgagttaatgctgaaatgagttaagactctaggggactattgggaaggcataattggtttttaaatgtgagaacatgagatttaggaggggccaggggagtttccctgcacaagctctcttcttttgtctgccaccatgtgagacatgcctttcaccttccaccatgattgtggagcctccccagccatgtggaactcttaagtccattaaacctctttttttgtaaattgcccagtcttaggtatgtctttatcagcagtgtgaaaatgaactaatacaaactttaaatacatatttgtatatatttatacttttgtatctcatatatatatatatatacttttgtttatatgctttggggatattgaaactgaagtattttaattttactggattttacattttataactttagaaatatcttcagatccattaaggaacacagaaagcagtaaagcagtataggatatcaaaagcactgagaaaactaatttaaaaataactatttacatgaattattttacacaaacttgaattgataattattctcaaattcacacactaataaaataatacattcctcatcagtactagtcgtttttattctcattgttgtaacagtaagcatgcaattttctaatatttgataaataaggtaatgcaatatggccaataaatattattgaggcaaaagtcaccagaaaattaaactactgtaagcaatatgtttgctattgacaggaaattattagtttacagccctaaatatcctgtcatgaattttgcttatggcacaaagtagcttttgttcagagaccttataactctaattttccacttatttgcaggactttttgattgccttttatgtgctccaccagccgtaggccatgggccatatcagtttgcttaacatctattacctgagcagcatcttacccagatttgtcacacagagcgtgcttactcaataaagaacatcttattgaatgaggattctggtcagacacatgctgtttttaacatcaacatttcaacaaaggcatgtaattctaatgtattgtcaagtattcttgtaagtactaaaaatatagagaagataatacagaatatcttcaaattaagaccttgctccagaccctaggtggtaagcaagccacataagtattcacagtgtggtaagttctacaatggataagtgcatattatgttttatatcacagatttaatatttttctttgaaaaaatatggagaataaaaatgcatgacttctttgagggggaaaacaactaaattctattagtagttaagtgtatatttttgttctaataattacaaatagtagtatttctctcattgagagactagactgcatcagtggtatgcttagcaatacaatctgtttcatatcctaatatagattagacaatcaatatatcttagtttcttctactttaataattttgaagtgtctccagacactagttaaaaatagaaattctgacaaaaaaagtgcataaatggcagctgagtgctgctggctgatacaaacacaaaagcacaaattagattggatgacacatatatattgatttgtgcattggttttattgatgccactgaccctgacccctaatcataaatgcctgaaccaaaagttcacacactctgtctcaaggtaagtgccttagtctgattaggctagtataagagaataccttagattggataatttgtaagcaccagaaatttattgcgcacagttacagagcctgggaagtcaaagatcaagaagtcaacagacgtcttgatttcaaaatgtaaaattttgaaattcagtatttgctgatgacccattcctcagagacagcgctttccagttgtccttaaatggtcaaaggatcaaaccagtttcctcaagcctcacttataagggcactaatcccattcatgagagcagagtcctcatgaccaaatcacctctcaaagccctcacctcctaatattatcacaatggggattgaatgtcaacatatgaatttttgacgagacacaaacattcagaacatggcactaggatagagactggaaaaactttaatggaggcacacagataataagggagagagcaggataaagatggcctatgaagctgttcctcccaaaggctgcttgtataactctcccttcattcttgtaaactgcctgcacattattgtttgtcttagtttgggatgcccacaattccatagactgagtggcttagacaattcaaattccttcacactctgggaagtctgagatcagggtgccaacgtggttaggttctagtgaaggacctcttcctggtgatgtcctcagatgatctttgttggaagtagagagtgtgtgtatgtctccctttttataagaacaataatccatcatgaggtccccaaacttgtgacctcatctaaacctaaataccagaaggctcacctcctataccatcctcatgggggggggggttaggattttaatgtaaaattttgggaaagatgcaaaaataatctataacattgtttctccagttagtcacaatcagtaggtattttgactgaatcttgaacgaatctacaaatttagaaaaatcctcaagaaaccgacatttactgtaaaaaaatattaaattgtttcttagatgctaaactcttagtgtgcacaggagcatgttctatacacacaatttttctttggagtgtttgtagcaaacactgaatagcttcatagagaagctgttactgctactgtcaaaaaccacagaaataataaacttaacaatatcaatacaaatacaaaaatttcaaaattaaaagtatttttaagattgaaacaatttcatcttcttcactcttcaattctacaaatcatatgaatcaaggattcataaagaatgaatgaatggtatataatgagagcattgcttctattctctgaaagcattcaaaacatgcccattctagtggtgctggaagaattaaaattaaaccagaaaatgtactttgcggccaccttaaaaatctttgtttttattacttagtaatagaaggcagtaatctaaaagtaaaactctaaagtgttttttcttgtacagcatttgaacttctttagtactagatattttcaaataaagaaggaaagaacaacaaaaattctaataatgtacttgtatattttcatcatttaggaattgcaaagattatgatcttatttatttacctttactacatcagcttgaaagctctctccttacctcgtttgattcttaatcactttgaatacatgtaaggcttgagttttagagatctatatctttaaaggtagctatatgaaatgaatgcattattttatattaaacagtcattttccattaaactaagaaatcgatatgttcctgttaaacttccaagttcatggagtacagttgaggttatccatgggacgttcagacaaggcatatgcacattaatcaccagctgcatgttgcaattaaaattcataactacagtaccttaaaacatacgcctctaggcatactaaaagcacatggccatcattcatttcctaatgaatacaatgatgtcaccattcttatcaccactaaacttccaggtataattttaggaaattagaagacaataagtatactgatgaagaaaagtggaaaatttgcaaatccaaattagagtatgtgttcattcctaacctgatgaaatctcacactttcaaaagaggaatgtcacagacaataaagaaatctccttttctttcttcctctaaagaggatgcattttgaagaaacttagtgttctttcactacatagttataataataagaatgatgtcaacctttaatttgtcttttccaaaaattttaattagaaagaaaaaaaatgccttgtgaccagggaccagttgttatgtagattatttaccacactgaatttctaaacactaattgaatattattattaacagtgatgtgtcctattggcagaggacagatctcctgggcatattacttggatagtagaaatattgtccatatattatttaattcacattttaatttaattgatgatgataacaactagaaatcatggaggtttattatgaatcatcatttgcccttctattccttcattagtccagatgggaatttattatgtacatgctactatctggaaaatattacataaagatgttgccagaggtaaaattatgaagacttatctacctaacatgtaagaaatagaacaaagagactctttctgttaaactgtttacacttaaagtaaaatctttttctgcgtttgctatgtagaggtctgatataacaccagatcacatgtctgtacacgttctgagcattcattgcctcatctattctacaagaacactgaactagcaagcaagctccttgaggaacaaacagtaaacagatagcaacagtgtcctttgatgagtgccatcttggaaggatataaacaatacagttgtagtcacccaacctagggggaagggagaaggggcaggatgggcaacaaagattgtttctctattggcttggcttctggagttggagagacctgaatgtgcctgcctcattaactaactgtatggccttggtaaacagcttactctttctctattaccttcacttgaactggaaatggtcatattaaatatctcacagttgtgaaaaagtaatgaatgaaatacatgaattccacttagcttactgactcagggagtgcaaaagaaaccctgttgctattaatattgttgtaattatttttgatcttttgtattattattaataataatacattgtatcttctcttttgatttttacaaaactaacaggtaatatccaactcacgtattttattccatttaagaggtaaagaaaggtgctcatagcatgttgatgacttgcccgaagacacaagctggaaaatgacagggtctagaataaaatcgagttgcttaactctgtttcctgctctgtaataaccgtagctgaaccaggttatagtgtgagttcttgacaaccatatttgtattatatggatgactatgttgattgcttcagcaattcctacaaaacacattgggcagccacatagagtttctggggttaaataatacgtactactaactgttcatctatatcttattcacaatctctctcttctccattgatttctggaatggagcatttactaatcttcatccagtgttgctctggaaagtttcatcttgagattgcatcattatacattcagtatataccaaataccttactccttcactgattcacaagtattttaacactctgatatttaggaagcatgactacttcacattcattagatttttaaaatatatttttaaaagtttgaggtgtatatttcattacacaagtgcaaatatatgtttctgggctatgcattcaagtagaaggtatctaagaagtctactaattttaattaattacctcatggttaaaacccttgaattattttcaaatagaaaataaccaaaattttattttaaaagaaagaatgccatgaaattatacgtttttgtacagcaataactagttatgtaaaatcattaagctcctgggtattggggggtgtgtgtgtgtgtgtgtgtgtgtgtgtgtgtgtgtattagataagtgcccaggagcagtttttttttctaactattgaaggttaatttctgaatatgggcatgagagggtaaacttcattcttagccatgtttcatttttttcctaacctaagaaagaaaaacctggtagtgtgaaagcattttgctaagttccatgcctgagtagtatattgtcaggtaattagtggagatcattgcattgcatgctgggtggaataagggctgcaagatcgggatctgtcacatcgcttcacttgtaatgaatttctgaaataatttttaaggatgctgcatattaaactataaaaggagcaatttgtgaatgttttagagctagcaactgattttaacttttaaaattatctaaatgattctgaacattcgtcccttccaaagatctataagtaaaggaatacaaatgtatttccaaaagtgtcactatatataaaaaagatctgaaacattgtgattgtttcaaatttttagaaatctggtaatttcttacgctaggtttcacattggatttattagatagaattaggagattgtttgtttttgttgaattttgtacaaattcaaccttaatgcatatttcactatgaaatagaggcagaatttacttataatagttatctttcagtttggtttctgtatctgacagtatgacatgaaatccatcaaacagtaaaacagaaggaaaaaaaaatctctaagcatatacattcatggaaacataaatcaaactgcaaaccctacagtgttaagaaaatatgaatctcttttcccagtaatggaatcaccttgaattccttaaatcaatagttcactgaacctgaagaacaattttcaagccctggcacatatgtaatctggtttacgcaatgtgctagaacttgttcaataggagaacttagttcagctgttagaataaaaatgtctttacaatacagactgcttaagcacaagatactagtgaacatcaaaatttcagaatattgctgttatcacatcaatatttgtggacattgcctagatacttaataatttgggaagaaatgaatagtgctagtaaaacttttaaaaagcattataaataaaatcttcattacatttaaaagttaaataagtcttattaatatatgtatgattgtttttcactttaagccaaagggtagacaggatacaacatacacggtagtggtctcttatatggtaacttgtatacaacagagattctatttaaaattttaagtgtatattacaggcttcctagaactcagactattctaaaacttaataggaactagttatcttttgaaaccatttacaagcttaactccaaagaaatattttttgtctgtctaaagtggaattataagcagtcctctaaaaccctaatttttctatacttttgaaagtttttaactggaatattaattttgaagaaaaagtggttcattgagtacacttaggtaaagaatgagttttccctgtagttccattactctcattaaaaccttcctcccctcagaaaaaaaaagcaaaacaaaacaaaaaactattactaacttgtcattgatattaaagaataaattaacaattttgctatcttccaaagttaagaagaaaaattcacagccatgcctaatatcacccagtgagatgatccataaacaaagattttctgtaaaaatgtaactgaggaactcacattggcttctctatttttctacagttttcaaactgtaatgaattttttattatcattcatttaattccatgtaggtttattcttgctgataacatgatctattgttctctgagccctgctgagattgccatttcttaaacagacagcacttattggaaattaaacctctactaatgtattataattattacttgagggtaatttgctgctccagcagggagtcacagccaatgtgatggtaacgtttcttccagagagctgttaatatttcttctatgctgaaatcccacataatggatcttgcctaaggctgattaatgatttcagagctggaacagtgatttgtagctaaatcagtcctcaccggaggagattcagggttatttcagtcaatactgttaaataagtgtaaacagtaacttcagtaacacacatgtaatctagtaggtaagaaagagtagcaataaaaggaagtaaataatgataatgctgcagtttcttcatttcatttatgcttataacagatatatgcttataacagggaagaaacacactgcagtgtcatcaaacccatggaattatttcactgcaacacatttttttctgcattgaaaaagcaatttctcaaacaagtaaaagcaaattgagctaagtgcctaaaataaatcagcatctttccctcctttctttcctttatatcacctttttcgctaaagaagaaattggacaaataacttgtaatgaaacttgggcaagagaaatttcaagtatggaaaaaggtttcgtttagcattatactctacaagcacacagagttccaacattgtccatgctgtccaagctccagggatttcatcttcacctgaaatgaggcagggcatagacatcacaagaagtaaccttgagatttccttgcccagaggcatacatgaggaatgtatagaatcaagactctctagtcactgaatttaattcttctttgttaacgtaaagtcaatatcaataaaaaggcagtgatataactgcagttaaggacaatgttacagacctcaaagtgcatctttcaacttgtatttcacaagggagtcctatctcccatgatccagagatctttaaacattgtgatgtgcattgtttgtctgaggcccttggctttttaaaaaatactctttaaatcattttttttcctaatttttgagggtacatagtaggtgtataaatttatgggacacacgagacattttgattcaggcatgcaatgcacagttatcacatcatggagaatggggtatccatccctcaagcatttatcctttgagttacaaacaattcaattacattctttaagttattttataatatacaattaagttgttattgaatatagtcacccctggattttgactatcaaatttaattaaaaagcagcttctgactaatactgtaagaaaaagaaatatttgtgagttaaaaggtgaggatctagatatacactgattgtgagcacagccattcaaatgattgtgaagtcaaagtgagaactgcgtatgccattaccagctaaataacataattccaggtaaagcataaaagatgggctgtcacgtattcttaggttttcaaacgcgtaggagaatctagactcagagaaatctctcaaagaaatgtcaatgcattttgtaaaatgaaactagagctatagcaattggtgttaaatttctgcaaattatacccagcttcctttctacttgcaacatcgttgtatactaaacagctcttccccacacatctctcacacacacacttgtgcatatacacacagatcacttgagtcaatggtttttattcttcaatcagaatcagtacaaaagcacatcttaacctttacttaaatcaatacaaaacagtgtcccaattaatagaaccagacatgacacatgagttttgttgttgttgtttttttcctccaataggctcagaaagtcaagtgcaaaggggaaaatttctccctttgataataaaaatagttttttggcagaccttcaataaagacctctacgtacattttatggaggtgatttaaagtcaaaattcttgagttcatagcccatcagtttttgtttttagtagctttattaagatacaattcatatatcatttgcctattaacgtgtacaattatttgtacaaatattcactgtcatgaaaccattcctataatccaattttagactatttcgtcacctcaacccatattcatactttatttttttttgagatggagtctcgccctgtcgcccagtctggagttcagtggtgcggtcttggctcattgcagcctccacctcctgggttcaagtgattgtcttgtctcagcctcccaagtagctgggactacaggcatatgccaccatgcccggctaatttttgtatttttagtagaaatggggtttcactacgtcggccaggatggtctcgatctcctgacctcgtgatccacctgccttggcctcccaaagtgctgggattacaggcgtgagtcactgcgcccagcgccatatccatactcttaatccacacctcctttcactcagtactgagcaaccattaatttgttttctgtttctatccatttgcctatcctggatatttcatagaaatagaataacaccgtatgtggtcttttctggctggtttatttcacttactgtgttttcaaggttcatcaatgtcgtaacatgcatcattctttcttttttattgccaaataacatctaattttgtggatagaacacatcgtgtttatccattcatcagttggtggacatttgggttgtttccactctttcagtattatgattaatgccattacgaacatgtgtgtacaagttcgtatggacatatgtttttatttttcatatatatgcttaggagtagaattgctgggtcatactgtagtaattatagttggcatattgaagaaccgctaaactactttccaaagcggcaaggttatattacattttcataaacaatatatgaggactccacctttttccacattcttatccacatctgttactgtccttctttttgattataactactgtagtggatatgaagtggtattacattgtgatttttatttgcatttccttaaagacaaatgatatggaatgtctttttatgtgcttattgggcattttggtttttttataaatatatatatattttcacccagtttcaattttttgtcttatttctgagttgtaaaacttctttttatattctagatacatgtcctttatcatgtatttgatttaaaaatattttctcccatactatgggttgtctttcactttagggatgatgtcttttgatgcacaaatacttttgattttgataaagtacaatttacctaaattttatttggtcatttcatttggtgtcatgttcaagaagtcttcgcctaactaaaggtcatgaagatttactgctgcattttattctaagaattttgtagttttagctctcaaatgttgctcataatgcattttgactttttttttgaatattatgaggaaggagtgcaacttcatattttacatgtggatatccagatgtctcagcaacatttcttgaagagtttttaatactgaaccatgtaattgcctcttctaagcctctgtctcttaatcagtaggatgggggtgatggataaaagtgcctcgttcactgagttgttttcaagattaaattaaattcaataatacacataaaatgtctaacattgttttaatacatagtacttgcactttagctcttaacagatctctacaggttatcataacctatttctaacccaagggttgtctgctcactataacgcttgctgtcatggaaaatattctgttgttaaaaatactctctttttccttatccctctgcctcaaaagttgtccctgtatgaatttctcacttagctaccactgaaatacctgatgaggtaattcatacttaaaaatgaaaaatgggccaggtgcggtggctcatgcctgtaatcccagcacttcgggaggctaaggcgcgtggatcacgacgtcagaagatcgagaccactctgaccaatatggtgaaaccccgtctgtactaaaaatacaaaaattagctgggcatgatggcctgtgcctgtaatcccagcctctcgggaggttgaggcaggaaaatcgtttgaaccagggagtcggaggttgcagtgagccgagattgagccactgtactgcagcctggcaatagagtgaaactccgtctaaaaaaaaaagaaagaaataaaaaaatgaaaaatgataaaataattttattctttaacagaattatgttgttattatgttgagacaaatatagcactgtaaaattcctccacacttttttgttttgttttttttgagacagggtctcactctgttgcccagactgcaatgcagtggcatgatctcgtttcacagcaaccttagcttcctgggctcaagtgatccttctgcctcagcctctcaagtagctgggactacaggcacaagccaccaatgcccaggacatatatattttaaatttttttgtagcgatggggattttccatgttgcccagaccggtcttgagctcctgagctcaagtgacccacctgcctcagcctcccagagttctgggattacaggcgtgagccactgtgcctggctcatgctccacacatattttaagtttgctttataatcctgtgttatcatttattcatttgtatattaaaggcttccaaatgatgtgtcctctattaacataaaaaagattatctgaatatagtaaaatgttgatttattaacaactatgtaatcaaaaagaacagcaaatacagaaggaggtgttaatcacaaaataagctctgtctctttcatagtcttgctaagtttcatgtctctggtaggatattgtgcatttttgaaagatgccttgagatggccaattctgtaagccaaggaaagtctatgagaatagaaagcaccgagaatttataattagcttcatgtactgcatttgtaagttaccagctgtgtgactgacaggactcttttcccctacatagtcccgtttcattgtgtgcgagtaacaactggcgtccaggagattcatgagaattaaatgagatagtataagtggaatgctgtcaagatgtaaggcattagataaaatatattagatagtcacaagttaattccagcttgggaaagaaaaattgggataatttagaataaaatcgttatttgccaatgtaaacatataattattttaacatgtttaaagcattttaataagtcatgtgggtataatgataaaggagaatataattgcagaattacgtgactattcaaattattttcacatcttttgaatttaaaaaatagtaaattatttgagctagaaatttctcgcttccactttacatttgtctagtgcagatttttagatccattggccaactaatagtggatcccgcagcgatggaacatttctattatattcttttctctgtaacgaataataccatctggcaacctgagtgtttttctcatcattacaagtcagaggagtgtgtaattatctcactgaaaggaaacttctgaagaaaagcaaatgtaagaaacattcttgttgcactggatgaaaaaatgtgccaaaaataataggatgttgtataactttatataaagctacaaaaaataaacacaaataaacattatcaaagaaagcatcatgctgtatattatgaattactgatatctcatatatttgaggcttttgacatagaggttagaactctgtgactgagaatctcactcttgaattaattaggaagagagtattttgaatgatagcaaaatggccaattaatgtttatttaataatttttgagcaggcgttaaatgattggtttcaaagtgcaataatatagtctgctttgtaactagagctgtgaaaaatattcacagcctgaattaaaaggagaaatgttaagaagaggaaagggattgtctaaatagcagtataaaaatctctgtaattatgttaacatcatggacaatctgtagtattctagtatatatgaagaatacctatcttctctccaggatatttcaattacttggaaactgtcctggtttcaaacttttggaattgtagatattctgttgtgggcacataagatggaaagagggaatagatggataaagcatggcgtgatgagagctgttgggcttaatttgcaccaacattgtcataatgcttttggccctcagctaacagtagaaacgtgtatgccacattataatggatacactggaaaaagtcctgttcttagaacccttacaaggatgacatatgtagaataggtacacaatatacagggtacatctttgaagacttttcccaaagctacagtgaaagtgttacaaatagcaaaataaaaatgagtaaaattggaagatccttccccacagtaagtgcaaatacataactaggaagttgacccatatttttttgtttcaaaagtatttattcctatatattgcaagaacttagtaaaacaggaaaaaaaggagaaaaaagcttaaattgattgggataatagatgaagatcaagctagacaggtttgtgtcaaaaatcttagtttttaaatattcattttgattgaaataatattaaattttaaaaaactattcacagataaggagctgagttggaagtgatgaagtttagggtcttgtatcaaagtagaaatacattgtgatcttgacacaatatgacagagatgagtggacaaagtcatgggtacaaataattataataaaatttattttgtgaaattctataatttagctataaaatacatgaaagaagaggaaatttttaaccccaaatttgaattttggaagataaacagcacagagatgatggtatttcacctggttttcaaagatagttagatttagacggctatgagaaaggaggaattacttttctgaaagtggattgaaagaaataaaaattgcatgtgacttgaatttttttccttgtttcagtaagaaggcactcacaaacagaaatatgaagaattaccaaagcactattaatggaagtcaatttattgcacaaaactgtgttgtataccatgaaacatctttttgtttgtctttttgctttccttggttttagtgaatcttctaaattaaatcttcttcctgataataactcaaagataaaacagggtatgggaattttaagtgatcttcaacattatctattcacagtactgtatccagtaggataatttttaatggccatccaagttttattacacacttcagctaaaaaggaatccataatattttaaaggagccaatggtataattgaaaagctgtaatggttagcaagtatttcattaaatttacttattccctgactcaatctaaatctatcttctggagatacagataaaattattatatatcacatgacagcaagtatataaagtcaaggagagaaggaggatataacataaggaacagaacagtgtggcaggaagataaatgagctgaaaaatacaatgatagacattctgataacctttttgtaagttcaggaaaatcccttaacttttcttttgtgccacttgcacaaatcacttagtccctctgtgcttgttacttacctttaggggtattataaaattctaatttctgattaaaaatcactagctgggtattttgttaatcattctcattatttaagattttattattctcttataaacagactcagtcttttcactatttctcatgagacagttttcaggtcatgcaccatcctttatctcctccatgggacaccatggttaatgtctctcagactgggatgtccataaccaaacccaataccacagatggaccgatccatgcaatgagttttatttccttttagctagatatgatattttgttaaaaccacttagcatttacctatgttttttaaaaatatttttttccttagcaattgctcatctataacttgcaggaaattcaataaaatcataaagtgttttaaagtcacagttgtgtagctaaacatgtaacacttcaagcagaaatataaaactatacatgtatttcttgcatagaactgaaaaaagcctgtgcttcaattgggcattccttattttttacattccttacttcttgtcaatcttggaaccatgttaactatgagctagatgatattactattagttaacttgatacatcatctagctcatagttcactatcctttactccaagatccagtgagaagttgctccgcagctggagaaattggagatttgggactaggaccatggctctgcaatttactacctatgtgatctcaattcattcaaaccctggtttacttctgctaaaaattgcatcataatacctaactgaaaggtttgagtatacagaaaacacatcttaaacttttaatgtaatgatttccatttcacaaagtccaagaggttctcacaaatctttcctcaaatcttaggcatcaggctttaaaccttttcaaacaagatcatctgggcctataatgcctccagtggaagccatttgcaatcttttgagattcactttttcctacaaggcaaaatggaagcatcactttccctgactgtagtagtgccatttggcttaccctatcccccacactaattgtcacccttttcttaaaatctagcagagtttcttacacactgtaaatgttcattaaatattagtaaaaatgataaatagaagaacagaaaaaaagaaggataaatagaaaggaagagaaaaggtaagaggaaagaaatacatgtttttcttttcctcccacttcactttaactctcccattaacataattacctacatggtgatatagtttggatatttgtcccctccacatctcatgttgcaatctgatccccaatgttagaggtggtacttgatgtgaggtgtttgggtcatggggtcgaatctctcatgaataaattagtgcagtagtagcggtggtaatgagtcagttcttgctctattagttcctacaataactgattgttgaaaagagtctgacagctccctccatcagctccccttcctcttccaccatgaactgaagcagtctggggcccttaacagatgcagatggtggtgtccgggcttctcatacaggctacagagctatgagccaagtaaacttcttttttgaaaataaattatccagcctcgggtattccttagagtaacgcaaatgtactaacccatgtggcatttcaactacatgcctccatggcttcttcacatcatggatcatgggccatttaaggtaggccttttgtttaattcatgtctatcagttcaatgattaccaccatggtgagcgggaatgttaggtgcaatatattaaagaggggaaaaaaaaaaggaatgcagatcaaacatatgctcctgtagaaggattttaaagttcaattagtttagttcttccttgggctacaaatgggactgggataacagcattcaaggtatcagctgacaatgcatgctacagcatgatgacagtgttcttttgatgaagttgtcacacaacatgaaaaaaagcaacaaaattattagagaatccttgtatgattccagtgattgctttattttctttcctgcatgttcaaattacatttgtaaaattgcattcaagaccagagttaagcttacctttttttttcctgaataaaccattgcctcccatttgttttttcctgccatttctaacattcttttctttattctcatgatgaacaaacagatatttcacaacagattttctattaaagttggtttgaggtttgaattcacaccaaacactaaatattattattcccttttgacttactccatgctttgttttctttttaatttctttttttttttttcttgacatggtgttttgctatgttgcctgggttggtcttgaattcctaggctcaagccatcttcctgcttcagcatccagagtagctgggatgacaagcacacacaacctcttgcagccatgctttgttttcttctcagaatttgcactacctctgaacatgtcttatgacggttctatttaattggcaagggaaaagtcattttgtctttattcatttattcttcaaattctcatatggcaccgtattgcaagccatatgcagtgctaagtgcggggtagacagcattgagcaaaaaaagaagcctcactgccttggcagcttgtgagagtgtgtggggactggcgggggtgtggacagggaaacttctcatccagccaaagtggtcatggggaccaataaaggaggaagtaagagagaaggggacttagattggggctttataccatctttctaaagtaaagaaataacccattttgtgtgccttttcttttaaaaataacaatgatttttgaaaatttgaaaaaaaattagaaaatgaacattattcgtaatgttgtactcataaacccagtatccagcttgattcattcaaacattgtttacagagataatgtatatacatttctatgtatatgaattatacaacataatatatgtgttttatttaataggatatcatattcttcatgctctataatttaccaattgaaatgtttattgaatttatatatatatatgtattatctgtctgcatatacaaatgaggagtatttactttcttataaaatccatttttagactatgaatttgatggctgcagaattgtacactgattcatgacttatctattccattattttgaaatatttagttatttcatcaatttaaaaaaaaaattatttatttatttatttgtttattgagagaaaggatttcactctgttgcccaggctggagtgcagtggtgtgttcatagctcattgcagccttaaactacagggctcaagctatcttcctgtctcagcctccaaagtagctggactacaggcacacgctaccatacccagctaattttaaattttttttgtagagatggggtcttgcttggttgcccaggctgacctctttcatcaatataaaacaataatatgatagatattttaatcttaggatccatgtcaaacttaaaattactggataagagagaagaaacactcttaaatcatcaacttaaaataacaaattgcttttgagaatgatcacattttctttacaatctccatacatgatttttctacttagaaatccttctacattccaaaatctaataaaatccttcacttgattatgctgttgatagtctcaaatctatactaatattttttaattgttatgttaacttaggtgagaatttctcttcaattgctctcaaataatcaactgcttaatacaattgccaaatactctattgtttttctatttgtttaggccacatttgttatgtgattattctgtttctagaactggtttcttataaatttttttacaagagtatttctatttctgtatttttttatttagttaattgaagagttactttttaaaggtaatgttaaactttaagttatgttttaaaattagaataattttatatttgcaggatagtgcagttttcttccaccccttgtacacgtctttcaatttccttttaaattaatgttttaagttactatggcatatatatatacacacacacatatatgtatacacacacacatatatatacatatatatgtatataattttactttaggttctggattacatgtgcagaatgtgcaggtttgttacataagtatacatgtgccatggtgatttgctagacctatcaacccatcatctaggttttaagccccgcatgcattaggtatttgtcctaatgctctccctccccttgcccccaacccaccgacggtcctggtgtgtgatgttcccctccctgtgtccatctgtcctcgttgttcaactcccacttatgagtgataaaatgtggtgtttggttttctgttcctgtgttagtttgctgacaatgatggtttccagcttcatccatgtccctgcaaaggacatgaactcattcttttttatggctgcatagtatcccatggtgtatatgtgccacatttatttattaatgatagattatatcattaatggtcatttgggttggttccaagtcttactattgtaaatagtgctacaataaacatacgtttgtatgtgtacttacagcagaatgagttgtaatcctttgggtatatacccagtattgggattgctgggtcaaatgttatttctgattctagatccttgagaaatcaccacaaatatgtagaccgatggaacagagacatcagaaataacaccacaagtctacaatcatctgatcttcaacaaacctgacaaaaacaagcaatggggaaaggattccctatttaataaatggtgctgggaaaaccggctagcatatgcagaaaacagacatattttaaaattatttataatacagtgttaaatctttattattctaaattttctagtttcttcttgacaatctttgggtattctttctaataaaacatagcaatttttttattgtcactttcaattgaaattgcttggaatttagagattaaatcttggcatttgcataacatttttaatgacatctcagaatttagtatactatattcaagttttctttgttgatctttagaaagattttatatttttcttactgtgtgctctgtgcatttcttggcagaatttctttccctattttttcaagtctgaaattatgaattaaatttatctatttactattctaattagccatcattttatgaacactcattttttattcaacaatcttaaccaacactggttcttttcagttgagttttaaattagataaacctgtctgtaaatagtatttgtctcttaatcccaccagaataggttttagtgtccatccttaaaaacattatttttcagctgggcgcggtggctcatgcctgtaatccctgcactttgggaggctgaggcaggcggattgcaaggtcaggagatcgagaccatcctggctaacacaatgaaacccacgtctctactgaaaaatacaaaaaaattagccgggcgtggtggcgggcacctgtagtcccagctactcaggaggctaaggcaggagaatggggtgaacctgggaggcggagcttacagtgagccgagatggcgccactgcactccagcctgggcgacagagtgagactccgtctcaaaaaaaaaaaaaaaaaaaaattttcttttattttacttttctccccatctgcatcaacttaaaataccatattgactttaatgtgaaaacagaaatgttcaatttttgtaaggaatggatattaaattctgtcaaatacctttttagtattaatacatgtttttaatacacttttaaaaagactaatatatattttttcaatattttaattttgtacattcatcagaatattgctcagtgggtgttttttattcacataaccataggtagcttaacatatttgttaataagaaaataagcttccttttaaggtgtagctttctagcagctagaatggcttctgaagatgtttcttctttcacaccaatacatacttcagtatgcattttaacagtattgctatgtcatctcagtgtttttaaaatagttacacttacagtgctttatggaatattctctacaatattgcaaggctgggatgcctggaattccatttctattgaaacaattaagctagcaggaaagcctagaggccagaaccttggtctctagcactgaaaccaagtatgtaatgttcaagaaaaaaaaaaaatcttaaaaagaactcctaccgtgtaacccagattgaagttatttaagaaaatctttcattaatcctggaccataagttctgagcccatggttagattcacagcgcatttcactaggggaatccctttagagcacgattataaaaactgtcatttgatgacacatcatgctaccatagtctttttcccctcccatgaaacagtaaagcagatgatattaaattatagagaagggatgatttcaggtgacagagtaaagggatttgatacagagatgttgcaggtgaggttcagagtgaaacattgttttatataaaagaaaacagccagccgggcgcggtgcctcacacctgtaatcccagcactttgggaggccgaggcgggtggatcacgaggtcaggagatcaagaccatcctggctaacacggtggaaccccgtctctactaaaaaatagaaaaaattagccaggcgtggtggcgggcccctgtggtcccagctactcgggaggctgagacgggagaatggcgtgaacccgggaggcggagcttgcagtgagccgagatagcaccactgcactccagcgtgggcgacagagcgagactctgtctcaaaaaaaaaaaaaaaaaagaaagaaaacatatgtatattctgaagagcacatgtttttatctattcaattatccactctgaagtattttccaaatactttggcaaagcacattgttatggactaaattgtgtccccttaaaatgtatatgttgaagcccaaatccattgtgaatttatctgtagatagagcctttaagaaggtagttaggttataaaggtggggccctaatctcatataactggtattctcataagaaaagaaagagatacctgagagccctctctgcatgtgcacgaagaagaggccctgagaagacacatggagtaggtggctgtctccaagccaggaagagagacatcaccagaaaccagtctttgatcttggacctctcacccccaggactggaagaaagtaaatttctactgtgaaagtcacctatcctgaggtgttttgttatagcagcctgagctaatacaattgaactcattttatattttagagactattcagataggttacattcccttaatgcccgcataaaggcagggcttttttttttttttttgagatggagtttctatctcgttgcccaggctggagtgcaatggcacaatctcagctcactgcaacctctgcctcctgggttcaagcaattctcctgcctcagcctcccaagtagctgggattacaggcatgcatcaccacacttggctaatttttgtaattttagtagagatggggttcaccatgttggtcaggctggtttcaaactcctgacctcaagtaatccgcccacctcggcctcccaaaatgctgggattacaggagtgagccaccgtgtctggccaaaggccagctttttactaggaaaacaaagctctactgatttatagaatcccagactcacttagtcattgaagctcgttaaagcctgaaagtacttagggaagtttatatggaagatcacaacatgtctttttcatgaatgactgacaggatgaatttccctaggcatgtcaatcacagaagttttaattgatgccattctcaactactgtgcatgttgttgaaaagcattacatttagctgcattcaatccccagatatatatatatatatatatatatatatatatatatatatatatatatatatatatatagtgtgtgtgtgtgtgtgtgtgtgtgtgtgtgtgtgaaagagaaagagaagataatttgacaattattagaagtttggcagttcaacaataaaaactaaataattctcatgaacatgctttatggtgggaaaatggtgatgagttttctccgtatacaattaggtgtagtttctctatgtagttgtgataccaatatttctttgtgtttgatgtgcatttcttatcaagacagaaaaattgtgtattctgtgaacagaatgcataagaatttactgatctgaaaagtaatttggtgaattacctctacaacagtcatgcaagcaaggaagaaataaaatgctataagcacttacatagttcttatcatgtgaatcaaaacctaaaagtgtaaccaaacgagatgattcagtcttatttacacatctgatgtgctttttctttaacacaaaagggttctaacattgaccactatcatctgtcttttagaacttatttcttattagtgatttaatatttaaaaatctttaatgttgtggtttaacttaaaatataggttcatataggaaaacttctttttagaacaattatttagaaatgataccaatacatgtttgttaacacgattaactacaaagtgggatttcatgtgaatgaatttcccaagggtactgagatttactaatgtatcgaaatatcagaaaggctttgatacacaaaagctctaaattatacgtgaacattagcatcgaaataaaagcatagtcagacagtagtgccccctggagaagacctgttgtattgtaagcagtgccttatggaagcaatggatggctcagtacctttctaggatctggtcccaagaagggtaccacacatgattttccgagatacacaaatatcatcaataaaacaagaattaatacatattaaccaaactcacaaatgtacatgtaaatataaggcagaaggtgttataagacataaaattacttctattttagaaagaatattctcttcctataagtacattgaactgaaaagccacatgacaatcagaagattgcctaatgagctaaaatttaattcaaaatagggatagttcggtgaatcatattaatgcctattgctattagattatgttaatatcatgcatccacagccaggaacgatggcgcacacctgtaatcccagcactttgagaggccgaggcaggcagattgtttgaggccaggagtttgagaccagcctggtcaataaggtaaaagcccgtgtctacaaaaattagctgcatatgttggcgcatgcctgtaatctcagctatgtcaagaggctgaagctggagaattgcttgaacccaggaggcagaggttgcaatgagccgagattgtaccactgcactccagcctgggtgaaaaagtgagactctgtctcaaaaaaaaaaatattaacctggatagtgctaatgacatgctgacaaattaaaactctccaagagataccctccagacccttccctattaacaaatttattttccttttccacttcaaacatcctgtggacaaatgttctgtgttgaatgttgcaggttgcccactgaacatcttctgtcacatcctcatcacctatgagaactctgtgtttaagaatcttcccctcaccacatgggcatgtgtcaaggcatggctgcctatagtcccaggtcaaataaggcctgatgtattactttacctcttgccaatgatcactccaaaccttgttatgttatttaactctggcctatgaaatgcatgatgaaatatgtataataacttttggcaaagtttcttatcgcctaagcagaaaccgtgataagaaaatgttttctattccttttgagtattgttgaatctgtatatcctagggaagaattgctacactggttgtcttactaaaccaccttcttactatcctaaggagagagtcaatactggtggtaagacacagagaaatgaaaatcacctagatcactgatgatattcagttattgaatccattaattctaatgcctctctatatctgaatgaccaggtaaatgagatataaagtagtccttaactttgagccaatttaaagtggtgtttatattacatctgaaaagactttttaataaatagagagttgtaagatattcttagaacacctccccattttcttgctagtttctacttaagagaaatatagctgggatttcttccttttcctctgattactcttcctttattttaccagtttatctatcttcaaagctcagtcactgacccacttccttttcctgtttatactctttgattgttaatctgatctgatcttaaggcttggattctatccgtatgccccaaacttgcaaatttatttctctaacaaggccaccttagaggctcctttggccagctgcctacttcacatattcatttgtaggtttgataatcacctcaaagtgaacataaacaattaatctactattactctctaagttctcccatatcagcaaattgcaccctcattgatttataatcaatgaatagctctgtctccaaacataacctgaattatcctaatgttctccaactccacagtcttgaaatgctacaacctttactgtaaacaccatcattgaatccctattctacagcaataagattaaaaaaaaagattgtcacttctcatattaaaaatttcaggacttcttgtcctgaaaacaaaattgaacttcttataatatcaaggaaaatccttcataagctggttttgcccatctttcttattgcaactaacactatgttcattctccctaagtaagatctagctctctggatctcctttagatccccaatatctttcatgtcctaaagcattgccttttattactggttttagatcaatttgggaggaaccttctactcccatattttacctaccaggcttcttcatatcatttcaatctcagttcaaacactatcttctgaaaaccttttccctcactactcaatctaaacaatttcccttcctggttctccacaacattacccacccaactttgtaaatggtttcaaatattctgggttgacaggaaaatgttgtgcttttgttagagcttgatgggcaatgctgtttaaaatatcagctcaatcatatgacattcccatctttcctaaaatccctgctttatttctttccatttaatagactgacatttgatataacaaaaatttattacctgttcaaaacccaagactaaacacaagacttccagctacttgacaactataattgttgttgttttattcagtgttacatcatcattgtctagaggcgtctggaacaatcatgaatgataaagataacagtatctatcgtaggatgaatgagttagcatgaggccaggggttgccttacactaactactcattgtgtattgaatattattatactagtcattcattctatgcaacctaagtggaaagactcccagctccattccttagttaggaggaggcctagacccactaacaatggtaaggggtgtgtttagaaagttcatatttcgtcacccatatacaggtaggaaccactgatacaaggcagattctgataatctctcaccaatcagattgtaatccctgctttgttatggtcaagtttttctgctgctcagccacctccttctctggtgttttctcttctctacactcatgcaatacatacagtcgttcaatgtcctaagaaagtctcctcttctcttggaatctcttcctctctcttccccttctccttgatctattttgactttttatgtagctggtaaggatgtgataccttcttatagttatgaatgggctaagaagaaagtgaatatagatattttttcccctccagctcggtcatgtcttcccatctagtctatcaaatctctttattctgcacatcagaatacaagcttgataacaataataaaaaaaacccttcactttcctttgctgttcttactactgggatactttgaacagtttgaatctcatatggtttgcatgagagaccctggtcctttgatctgctattatcaaataatgctccaaattgcatcatcttttcccgaaaaccttaccactttttacaatagttacattttgttaagtaaataaactaacttttctgcaataagcagtctttttcctctcatttctccttccctgattcaaccaaactggccaaggaataaagatgaattttactgtatctctcctctcaatgtttcattaccctgctcataaatctttagcaacattctatttgctgcaggataacctcccacatctttgacatttattaccatgtatctgtgtatactctaatccttaccaacatttccaaaactttattttccctcagttgttaaaaaagcaccccgttcaagtcaaggggatctttgtgctataaaacaatagaccttgtgctatctttttgtgtgtcttcagatatcctttcctcaactacagaccacatcatgcttatttatctaaactatcagctgaaatatcattttttctccctttctgagcaacatagccttacttgaattttcttttctctgaatttgatttgcactaacatcctacaccatctgtatgacattttcccatgataacttttttaagtgaatttgttttttgaatctttgttaatatcaacttttttaaaacagcattttaagatgcttagcacctttttcccccaaaatgagtgagtgtctaagtaaaaagttgaatcagctcctgaaattataaaacaagatgtcatattaatagtgttaactccacataatagttcagtgttaagaaaaatgtggcaaaaaaattaagtattctctgcattctttgaaccctatcttccctttttattttccaatgcagttaatttggaattcttactatacattgatgtgtcaaaatgagtattgtgaaagagaaattatagaattgaaaaccatagaaaagacaataaaactttaaataaaatgtaattttaataagaaatgttggagctggtttttcatcctaaatgtctctactgcctttcttcacaaagaaaataaaggcaatgactgtattatgtatacatgctgttttttattaaaactcttggacaaatagttaaggttaacataatagacgtatttggagtgactgtgccatgtaaaacaacctcctttctttgataactgtccactcaccaaaggcggggacatctaattggttctcaaacattttttggggggttccatgtgctcttcacattcatgacttgggtttacatttgatgtttacattattttcaccagaaaatcagaaatatttttcacagacaattaaattgtaaaagttttgcagctgaggatttctacacatggaacttttttgtggctatcttatcctatatatacagagaggcagcgaaaggcagcagcaggagaagctggagagagaggatgctaagatgtgtagagcagtggggacagtgatgtctagctaacaggtgccaccaccataaagtccttaaaatagtcctgttttcttgtagtaaaacccatttgcataatccagtgcaagtgactttctgttatttgcaatcaaatttttttttagctaagcaaaaactattttaaaatactcctgagggaaatttcataaaatattagggttatatcactagagttctaaaagtccagtaaagtattcacaagcaagaaactgggaaatagtaaactttacaattttatacaacaaagtattataatgtttggcagctgataaaaaatctgttgaaatatttacaagaagtaataataattatagaaaatctagaactacctaaactgacggggaatagtttggaaaaagttagaaataacatcttaccattattgataagattatctacatctattatgttctttagagaactataaacctcaattttttaggcagatgtcaaaactatattatcatacgtgtggtatttatgctgtggctttcactttttggaaacttgaattgttgaggaacccattatgatttgttttcttttgcctcacatattatggtttgaattaagaaattccaccttccttatacaatgtataaaaaacataatgttagaaataaagggaagtcctcttcttagctcatacaaaaaattctaattgaatgaattataaatcatctttgtatactgcatggatctgaatatatatatgcatatatatacacacacgcatatataatgtgcgtgtttgtggggggagtggagttacatatttctcagtcatatttccccacccagtcatatatatatatatacacacacacacacacacacacacacacacacagtgtagagatacgtgtgtgtgtatcttgcattggttctttgaatttgtaacttacatttcctcaaaatatagaaggaggaattgagatgcagagagcttacatttccttgctcaggactacagagtcaatgaatggttaatcaccaaggatattaacaaggtctgtcaaacatactgttttttcataacaaatccaaaatcgtgtcatctaaccctcagctcctgattcttgagattttggtagtaatgcaaactgtctagtttccatttcacaatattaattcaaagtaaactttttgcaaaaataatggtttcattaagaaatcaacacacatgcacacacacacacacacacacacacacacaaacacacaccaatgcaccatttaggcacatatgtatttcccaaattataaaatgggaattattaaaacccttacaatattatagtatttttgggaggaaaaaataaagagcactcctcaaattcagtaaatggtgtggctaaaaaataaagctatgtatgccaccaagggagaagataattacattttttttccttttaatatacactgagggataaggagatataatacaatgaaaaaaagcattaccacatggtttggtatttaatcattgcttttatgtgtttgttaataagactaaaaatgatgatgatttcttcagcatttttttcatattctaatggtatacttatacaaatgctatatatatatacaaaatgctataataaggtgaatggaaagatgttcctattatattaggtttactttcattgttccttgaataactgtcataaaacatgatatgacatatgttatttatgtcatttaattttggagaggtttcagagagtgagtaaatgtatttgcacaattggtatctcaaagcattaaatgagttttgggcagaagaaatcactttacagataaaatgtagttggctctcatcacttatttctaacagttttaactaaattagtaggtttcccctggcaggtactaacatccatcccattcaatatctacatattttggatctattttaatatgtagatagagtgtaatcttaaatgcttctgtttataacttacaattattcccttgattatctttctaaaaagaacatgcatgcttatgtttttccattttagtatttataaacatatctatataaggattcataaatcataattcattcataaatcattatgaaacatatacacaaactaaaaagaaagccaatcatgtatcacagattttaccttgataaataatatgaatgttttggtatgttacatttatttttataatttatttgttttatttcattttatattccaaattcaatttaaatgttggcttttctcttaaattctcctgggcatttgaataatgttacatatctcaattagagagtatataatatttaactattttaatgtatcatagtttagttagctcttaatccacaaattaatatctgttttgaatatattactactataaatattgctagaatgaacatctttgtatatcaatttgcattacattaaatttccatatttgaattactgagaaaaagttgttgggattttaaatgctgttcatagatatctaagccagtaaaaccatggtttaaaattgtttaaataaatggtctcataatatccttttctttttcacactattctgaaaaagggggaaaatctcattgtaatatcccattacattcttcctaagaaaataaatttacacccaaacaagacaggctcatttcagaaataactcccacatctaaggattcaagtgcagacagtcttttctgctgctatcacatttttcttcagcagggtcccatttgaactgatcagtcatctggactctcattgtggatgcaccattgtgaactggccttattacaacctaatcacaccccacccacattacacagcagagtgattcaagaagacacaacattaagcctactaaatatgcataaatcccttcaattaaaactctgcaggattgttttcatgttgaacatacagactaattgttaatatcctttaactgtgctaatgtaatcatttgtgcaaattaaatccgtctttgtaaatttttctgggaaattttcactgtgtgataactaataggaaggaaatgtcttctatattgaaatgataattaacttttaactatgatttcacccttattttaacatttactctgtcctttaatgtcatgttttagtcaggaatgtctactgactttcatctaaagtgtatgcagtaagctcattgaaggaagaaatggtgtatttgtctttgaactatcatcagtgtcatttatgataatagcaacaagcaaacaatataaacaaaacaacaaaagcatcacattgagagggtccttagaaaatgtactgatttggtgaggaaatacatatttttaatatttattaaaaacagttggctgctccattaagacatatggaatattttgtctatttactctggctcaaatctgaaatcaaatatactcatcctttcaaaaatacaaaatcagaaggtgggcttgaattttacattttgtgctacacatatttgatgctaaaactttttttttctaaggtaaaattagtaacacatttatttgggggagtatttttaaatcttatgtgtatggcaggcactaaactagcctccaaaaacatatgctatttctgagaaactgtagttctttgaaaaataagagtttttcttcagtttctaatcggctctataacattgatacagtaaagccaaatccattcttaatgaaatgatttgaaggctgtcctaaaatatattgaggtggcagtgaatttctagatatgctaacacatagccctcttgtaaataaacatattaatatcttagaaaacttgcactgaaatgcaaaaatatattatcaagactctttccttcgctttgtcatttaagtagattattctctcattatttcatgtactaaacacacacatatgcatttacagttcactctgtattaagcactttggtgagtattggagatacaaagttcgctccaacacacagggtccctttatttacagtacgcttactcaacacaaacatatgtacaaagagacacaaactctcccaaaccggcataaatataaaataacaattcttctaaagtctttgcagttgtgctgagaaattctagtagggatttgataaagaaagggaggtcagagagtttgtcttgcaaaaggattgaccacactgagtttggagaaatgtgtaaaaggggtggatggagtaaaaggaaaagcctcctgagacaaagggtatggtgtgcatgcaaacacaccagggtaaaagaaagcaggacaattttcaaacaagtgtagttagagcacagagagaagatagcctagcatgtggtgggggccgtgggtgtgcggctggagttatttaggctggatttgataatgtaatctctcaaaatctatatgaaatgcatttttagagcttattaaagacacagaccacagatattgagggtgaaataaataaaatagaaaaatgaatataagataaatgtagaactagttttcctaaatttagaaaattatttgcttttatcagagaatcgcaaaagcactagcagaagcaaagtgaagcatccatgagcgggaagttagatgccaccggccactgaaagcgccgccaccctgtggtcactgttcttgattcagaacaaggggcttgcactcctgacagaaagagcacagggggcaggtctttggcaccaacaaacaggagcttgaactgggacctaaaaagaaagagggatgctcaaatatagaaatgtggatgggggtgacattttcctaccgacaccaaaaaaatcaagacagttgcagtctcccgcaggacctgtagggtgacgggaagagagagagtggccacaaattctgagaactgctaaatgcaagtcagttctatgagatctgggagacaaaaaatataggaaattgtaatgcaaacaaataataaccggaaaaagatgaaatatttccattgaaaagctatatttgttacaaggtggtacatgacagaaatatgcagaagatttgtgtgtatgcacctaaaaaatagcctgaaaatgtgtacagcaaaaattggtatgattacagggagcaattgagccatccttgatcttagaagatttaacaactcatctgtcagcaattttgcaatcaaacagaaaaatatatatataattttaaatttctgccagtataactgtacagttaacaagcttcatctaatgtgtatttctgcactaaataattagcaaatgtatattcttctgttgtatacatgggctatttataaaaattaatcttaaatcataatcttaaatcaaccaagttcaaataatcaacgtacagaaccaccttcaccgaatacaatagatgttaagttaaaaatgagtagcccatcaaaaaatgaacacccatgtgatgttgacagattactgttggagtaaagtattcataaagtttaaaatgtaatttattctgaccaacattgagagctcagatgattgaacctatggtacagactgaaagttctgtgtctatgattggaatttatttttcttttccttctagacagccacactggagtagagtccatactgcctggttctcttgcacaaaggtgtgattatgtgtaggttttctggcaagtaggaacatggtgtaggtgttaccttagaccatgaagatatgagtcatagcctagcaaagaaaatgcaacaaaataaaggtagctcaggtttctaaccattctgaaacaaaatccttgctttattaaattgcttaagcctagactgctacatcaaagcaaaatcaccctctatttcctataatttatattatgttgtgtctttatttcacagccaactttatttcctaagtacagaaatcaaattgatttcaaaaatacaaagtgaccaacaggtacctcaagctacttgttttgactttgcaaactttatatgtttcatagttttcacttctaaatatacagttaggagaaattaaatatatttaggtttatttctaagtgttggctaaaacaaaatttcattcatcagcatttggaattgtccactacatgtgtgctgttcagattataaaacagaaaaaagtacacggcagctggtgtagtagcttagacagtaatggctgttgacaaccgaggtacacaataatttttagaatgaagtttctaccatgtgcaaatgagttggtttttgaaaagttgcttcataatattatttatctcagcctcctgagggtaaggatttttgcttaatctatagagtatgataatggtatgttctaacttcagatgcaattgaatattaggaatttgcaaaagagaaagcactaccagaaaggaggcagtcaatttcttgcagtctcccatcccagaattagagaatattaaaagtctacttcacaattagttggtcttttgcttattctagttgacagcctcagtggagagggcatggtacttgtggtcagaagagctgtgcctatctagattctgcagcttaaaattatctgctcctgacgtcatacaaaaatagattcgtgatgaccttataggattcttgtgagggttcaaaatatatttggaagttattggcacaattatttgtatatgtcatttgcttgttatgtaatgtattgtctggtcactatgcctcaagtaggaatgtcttgtgccaattagactattaatgcctagaattaagagatttcatcttaaattgttatatttattccttagtacattacgcagtgtttttatcctagtacttaatcaaaactttgtaaaattgggaaaatctagaaaaaaacagtgaatgataaagaacaaaacatataataaaggagataagagaatagaaaagtgtaaacagatgtcatagcatcatatgcaatacaacaggtcgaagtaaagtaatgggaatatattgagatcttgggtgttcatattttgctgaaatggattctagatatcaaaccaaggtggataagtaagtggataaacaaaacagcaaggagttaatatgaagtcacagggcatagacatagttctagagattgcttaccactccatatgaaatgtgtgatatgacaattttttagaagattcagcacaccatacacaaaatacccaggcataacaaagggtattgctaagaaacaaaggtcatcattggaaaacaaacagcaattatagttttacttgtttttgttcttaagtatcctgcaagttcactgacaaccaggtcttgtcataaataattgaaataatatggcactatgtttagagttaagaattcccagtaaataattctgtaccaaatgaagtacaggatttaccatatacatattcataggaaattttttattgcttttctgaaacaatctatcaatttacttgattctttagggaaaaataaaacatgttgtgaaataacaaaggagaaattaagagttgattgactgattttcaaaaaacacttgaactaaatgtgttaaaattagagaagtaataactttgttctctctgaaaggaattcttgagggcattcattacaaaatcaagttcataatgtatccaagccttaaagtaactcacaactgttgaatagaaagctaccctttaaggtccacattttctaatatttactttgttagcattcaggatacttcttgagcccaaattaaatttattacataaatgtttatgcacatgtctattcctacattaatatccatatctacatcacctaacacagtgtagcacacacagtaaatgctcagtaagtggtgttataggtatcgttatacctataacatcatcacattgttatacctgtaacaatacctaaaacataatttgaaataatgcttccttctttttcataaatatgggtaaaaatgacatttgaaaatggaaaatacaattacttttttaaatatgctttgacataaaaaagtgatctcaaacacttctgctcccaaatcagtatattcattggtactaataaaagtttgttttattatttagagttccataactttataaattccttttaattttattaaaaatataagatacattttacaagttcctcagcatcaaaacctctccccttttaaatctactctaatcaatagaggccttttggctagaatagatgttcctggatcatttctataggataacctgatgaaactctccatgattctattttcagctctcatttcctcattactcctactttataatcataatgatatgaaaataactaattgttttaattggtttctctgttgtagacattgttctgaaagcttaacttatatttattattttttgtccttacaacaaccttatgaagtacacattaaaggctctttttttacagatggagatattaaaatacaataaagtttatgttatttgctaaatgtcacaaaatgtataagaggtgaagctaggatgtgtacaaaagaagctctggctctccagaaatcattttcccaacaaataaaaaatatactgcctctccaataccatacagaactttggaaggaatgaatattgcccatttagatagtttgacacctcctatacaagttagttttaaaatttccactaaattaaataatataatcagcaatccactttgtaatgagctctacgatagtggccaggcatgtatacaccaggaaactgggcaaacttggcatacatcagagaatacttaacgattatcaagtttcagagatagactggattaaaatccctcctctgtcatttactttccatatgatcttatgctaattctttttttttttttttttttttttttttgaggtggagtcttgctctcccgcccatctggagtgcagtggtacgatctcggctcactgcaacctacgcctcccaggttcaagcaattctcttgcctcagcctcccaagtagctgggactacaggcacaaaccaccatgccccactgatttttttgtatttttagtagagacggggtttcactatgttggccaggatggtctcaatctcttgacctcatgatctgcccaccttggcctccgaaactgctgggattacaggcatgagccaccgcacccggccgaccttaggctaattctttagccttcttgtcttagtttcctcatgtgtaaaataaggacagtaatattcatgtctcagggttgttgtgaggcttgagtctacttatgaaaaatgctggaaaaatgtgtgacacaatacacactgcgtaagtgttttcaataaattatcgattagagatatgtataaggagattgtggcataatagatatgtaacataataaataggtagatagatacatagatacatacactggttgtagatgggagggtgtgtgtatgtgtgtgtgtgcctgtgttattaaacacattattttatttcagtgcttagtcttataacatcctactgctaatgtaacccagaattcaccttatcctgacttttaaaactcaaactttcaaaactcacatattccatgtcttctagaaaatctaatgctattaccaatgtatcactgagtttaaagttatactatattcccatcctcatccatagctctacatcagttttcttaggtattaattcaatgttaaggccaaattaccttgttgtccttgtcctatttcacgttatgttgtttcagacataaaattctctctcttttatttttactcctcaatcacctcactaacaacttataattttatattacaattgtctgtttctaaaatgttctgacccattccatcaactggagagctaatattcaagcaaaattgcttctcctcttgattgccttcctcctccctagtttttgtattttctaatgcagagcgatttgggcacttgattctaactaggctgtcagttaacccgtgacgtctgaacttaaccttttttcataggatgtagaagcaaactttctaaatagagtggttcatgtatgatgggagagtttctcattagcttgaaggtggatatgacctaggaatgcatacctgctccatggagctagtataactcttttcatttgatcaccagcctctttcagcgattactggcctataattatgttagtgacctattgcaagtaaaataattagataaatatgctctgctatctgatggcaggtcatgaggagcccatttaagaaaacagttatatcttttattctagatatggatagaagggggaaaagaaaagagggaaaaaggttaattctaacttaaaactgggataattcataaatattcatatgaccctgccctaataaaaacctcattactaccacatcagacagctaatttatcccaataggcccgcctaatattgcaataatagtaaaattagacgttctgcagtaatcatattgagatttgtttagttcagaaaacctgttccaagaaaaatgtgcaaagcagaatgatcttttccatgccatttaaaattgaattctggggcttaacaacgtactttgttggtattttttgaatgcttgaacagatgtaaaactccttttttgatggaacactttttagatggaatactggtgcatctcgcagaacgtctttcccaggctggaatactggtgcatctctcagaacgtctttcccaggcataagagaattgtatttctgcttaagtaaagtacaagtatgtttctaaactttcagttatcaaccttaactttgccatcctgcacatctgtcatctagagtgcctgaattcctctttaatcagtagcacaggcactcaatgcttgtcaaaattgtaccttaagatcacagggttatttggcacatctaatattaatcagtaaatctgagaatcatgttaattatccatctctttagttactctgaaaaatgtaatttgactatattacctcagctgtctaagcatattttaatggattataatttgatattagttattcagcttattaaagaacaatctaagtcagtcccatctgaaggcagcatctgcctctttaataaaaacctatttgaaagcgttagtttttatttcacttgctcactgattcatcagccacttattgtgctgctactcagtaccaaatactgtgattgatgtttgagcagcagatggaaagggtgatgagtacctgtctcagggttcaaaatggagcacaatagcaaatacatagaaatacatgcatatttgggaggccaaggcgggtggatcacaaggtcaggagttcgagaccagcctgaccaacatggtgatcccgtctctattaaaaatacaaaaattagccaggcgtggtgtcaggagccagtaatcccagctactcaggaggctgaggcaggagaatcgcttgaacccaggaggcagaggttgtagtgaaccaagatcgcgccattgcactccagcctgagctacagagtgagatcccatctaaaaaaaaaaaaaaagaaaaaaaagaaaaaagaaaagaaagaaatatatacatatggctaagcacgttgggttacgcctgtaatcctagcactttgggaggccttggtgtgcggatcacttgaggtcaggagttcaagatgagcctggcccacatggtgaaactccatctctaataaaaatacaaaaattagccgagtgtgatggtgcgtgcctgtaatctcagctacttgggaagctgaggcaggagaattgcttgaacctgggaggcagagattgcagtgagcggagattgtgccactgccctccagcctgggtgacagagcaagactctgtctcaaaaacaaacaaacaaacaaaaaacatacatataactcaatggacagcactgaaacaacagaagactagaagtaaacccaaaatattaacagaatcagtgtgaagagaggagcagagcctttactggatggttggtgaagggcaagatgagaatacaatcgtatactgcatctggatatttccattaacactgaggcacatacgatggtgtggtcccatgagattataaaggaactgaaaaactatcacctagtgacattgctgctgtcataacttgctgcaacgtactactcatgtgtttgtgaggatgctggtgtgaacaaatctactgtgctgccagtcacataaaattctcacacatacagttatgtataataataataattctatcattggtttttgtatttattatacttatcattattttagtgtgtgctccttaagcctattgagattaaaaattacctgaaaacttaaaaaaaaaaaaacaaaaaataaatgaacagtctcaggtccttcgggaggtatccagaaggcatcgtcatcatgggagatgacagctttattggccctgaagaccttccagtgggacaagatgtggagataaaaaacagtgatattgatgatcctgaccctgtgtaggcctaggctaacatgtctgcttgtgtattcatttttaacaaaaagttttaaaaagtaaacatcaaataaatttgaaaaagaaaaaaagattatagaataaggatataaagaaaggaataaaatatagaaaagaatgtataataaggatataaaggatatcatatttttgtatagctgtacaatgtgtttgtgttttaagctaagtgctattacaagagccaaaaagttaaaaatattaaaatgtttgtaaagtggagtagttataggaagctaaagttaatttattactgaagaaaaatgtttttgataaatttagtgtagcccaagcagtgttgataaagtctacagtagtgtccacgaatgtcctaggccctcacattcacccacctctcactcactgactcacccagagcaacttccagtactgcaagctccattcatggtatatgccctatacaggtgaacctttttttttaatcttttacctcacttttactgtgtcatttcaatgtttaaatacacaaaaatatttaccatgtgttacagttgcctgcagtatttagcacagtaaaatcctgcatagatcagtaacgtaggagcaacagactataccatataacctaggtgtgtagtaggctgtaccacttaggtttgtgaaaatccattctttgatgttcagtcaatgacaaaacttcctaaggacacgtttctcagaacatatacctctcattaagtgatggcatatctgtataggcaagtggagtatattttctacagtagaaaggatacacaaatgtgacccaaaatgccaggcaagtttagaagtggtgggtcgatatccaataagaagaaaaacatgttttctggagttcatttcttaaggagttgtctgtgtttggaatgaatacttagactatgtagtaaggtgtgtgtgtttgaggatgggagaggtaaacttctatttgttctaagaatacatgttctttacagttagtgtattgttgcctgaggtttgcaattgggggaccacttcctgccaagattagagagaaataagaaaatgctcaaatattttcttatttcagacagaccttgtgtcctgatcttgcctaaaaactaatatctacatccacaaagaaaaaaaaagcatcttctgtagctagaattctgttttaattgagataattttctgtcttttggcctgtgtgtttaatttgtaagtacagcccgagaatcagctaatgctttcatattctgtgtgcctcatgcattttaagaatgcccattttagctaatacatgtttattaaatacacattcattgtgaaaattactcaaattcatcaaatgctcaattatcatttcctgaaaagaacatcagtttaggtattgagaaagtaatgtaaatatccagttatagaatttagattacagaaagctatactttgtgccttagcctgaaaaaattcaatggcaaacactgggttgaaaaatcatactactctttccatccacccccactcccacacctcttaaagtgggaactctagtaatttatgaatggtacatgctttacataaatgtgaaaaaggtgcctgacatctagtgacacatgtactgggaatgaaagggaaatatctcatgatcgttgtttccatgtcactgagctttggcttaaggaataacggttgatgaaaacaaaccaagtaaaggtattagaaatattatcaacttcttaagttaaatttctgggccactgggtaagatccttactgagagagagagccctgttaagaatatttttgcccagggacattgcccactgtgtagtataacactgtgaagtatggtgggagctcagggtcactcgatatcagtcttgacctccagagacaatggagactcaaagtattggtctgaatctccaggaagggctgcaaactaaaggccagcgaggcaggcatgaggggatcaaactgcagtaagaactgaagacactaaaacctccagtgagcattctagggggcattcctctgtgtattgccatgcattgtggccaaaagatgctaaacccatctgtgactccaagagggagaatgactggaagctctgcatgtggatctctctgggactttgccctgtgtgtctctttccttcgctgattttgagtcttttcactatcataaaactgtaattgtaaatatagagcttttactgaggttctgtgggttattctagtgaattatcccacccgatggtggttgtgaggagccccaaattgatagccagctagtctgaggtagaagtggtcctggagacacccagtttatggctgctatctgaagtgagggcagtcttgtggggatggttccctcagcctttgcagtttggcttaagtcgttgtggacactaaaaggcattgttatctatatcatatttataaacttatgctaagagttggcatccctgcttgttacaaagtatagtgctaaatgtataatggtatgtaaagccttgattggtagttgtaaacaaataacaatcaaaaatgaaaatataactagattgatctaatcagaatcatggaatagatggttacggtgatggtagaacccttcaacattcttcctgagagaatagcaaatgtggaaaagatagccttccatcctttgcatttgcctagtgaagtaaagttaatgtggtcatgaggacgtgaatgcatgtgactgcaaatgtgtgtctagtggcatttcttgggccaggtgcatggttcagagaatgagggagcacatcaaaaatatttaataggaatgtcctgggattatgaaacattcctccatgtgggccataatttctggatatgctttgctaagtgcaggaggcagcaaggtattagatgtcattttgggggtagaggaggctacagggcagggaaaataatcataatttatagatcctaaaatactgttccttatttcacttacaatgtttagtggactctacatggtttccaaaaagatctttgattcttccctttgctataattggaaatattagcttggacatgttacttggtctctctgttagagtaggcagatagccagaagcgagcaggaaagggagcccctggggaaagaagtcttcacagcagcttctttgcttcctccaaccctccttgaagacacttggggccatgcaatatgtgtttgtcttttcaaccaaaaaactgctgcctcagcactaggattcacaaaaacacaacacacacacacacacacacacagaagaaaacagcatagaaaatatctttgtgacactgatatggtttggctacatgtccccactcaaatcttatctcaaattgtaacccctatgtgttgaaggagggacccggtgggaggtgattgaatcgtggggggcagtttcctttttgtgatagtaagtgagttctcacaattttgtctttgtgatagtaagtgagttctcacaatatccgatggttttttaaggggcttttccccctttgcttactctttcctatcactttgtgaagaagacacttgcttctccttcaccttgcgccatgattgtaagtttcctgatgcctccccatccctgcagaactgtgagtcaagtaaacttcttttctttataaattaccctgtctcaggcagttctgtatagcagcgtgaaaatgaactaatatcggaaattggtgctgcagagagtgggggcactgctataaagataacctgaaatgtggaagtgagtttggaactgggtaacagtcagaggttggaacagtttggagggctcagaaaaagacagaaagatgtgggaagtttggaacttcctagggtcctggaggactcagaagacaggaagatgtgggaaagtttggagcttcctagagacttgttgaatggttttgaccaaaatgctgttagtgatatggacaatgaagtctggctgaggtggttgcagatgaaaatgaggaactcattgggaagtggaacaaaggtcacccttgctatggtttagcaaagagactggtggcattttgcccttgctgtagacatctgcggaactttgaacttgggagagattatctgaaattggaatttatgtttaaaggggaagaagagtgtaaaagtttggaaaatgttcagcctaaccatgtggtagaaaagaaaaacctattttctgtggagaaattcaagccagctgaagaagtttgcataagtaacaaggaactgaatgttaatagccaagacaatggggaaaatgtctccagggcatgtcagagatcttttgtgtcagctcctcccatcacaggcctgaaggcctaggaggaaatagtggtttcatgagcccggcccagggccccactgctgctctgtgcagcctaggaacttagtgccctgtgccccagctgctccagctccagctgtggctaaaaggggccaaggtggagtggatcaaggccatgggagcctacctcttgcatcagcatgccctgggatgtgagacatgaagtcaaaggagattattttggagctttaagattgaatgactgtcctgctctatttcggatttgcatggggcttatagcccctttgttttggccaatttctcccatttggaatggcagcatttacttaatgcctgtaccctcattgtatcttggaagtaactaacttgcttttaatttttttataggcttctaagtggaagggacttgccttgtctcaggtgagactttggactatggactttcgagttaatattgaaatgagttgagactttggaggactgttgagaaggcatgattggttttgaaatgtaaggacatgagatttgagagggaccagggacagaatgatatggtttgtctctgttttcccacccaaatctcatcttgaattgtaatccccatgtgttgagggagggacatggtggaaggtgattggatcatgggggcagctttttccaatgctgttgtcatgatagagagtgagttttcatgatatctgttgattttataaagggctcttcctctttagcttactctctttcctgctgccttgtgaagaaggtgcttgcttctccttctccttctgccatgattgtaagtttcctgatgcctccccagccatgcagaactgtgagtcaattaaacctctttataaattacccagccttaggcagtcccttacagcagtgtgaaaatggactagtacagacacttctaaattggctcccccaggttttgctgacatatgtcaccttttctctttggctacaccctcaggtgtctcctctaacctttgtgacaattgtaacatggattacagaacctacctgatcaagctgtagttatttgtttccctactgtttgttgagtttctagaaaacactaacatctcttatgcaaccctataccccaagcagcaagcatattgcctggcatgcagtcagcatgcttctgctccagttaagtagcctgaaacacagaaaatcagagtatgtggtggtgttttgcttattgtctagcaagttacaaccaagtcccttgcagagttatatcacaaagccacgttgtggcactctatttaaaaactactatatggagcagggacttaaacaataaagaaagattttcccttaagttatacagttaaaattcataatgactctcccttatatattcaattataactatgataaataactatgataaaatgtgcataatgatataaatctcatgtcagggcagaatcaagagcctacaattgatttaaatactcacaagttcaagtgatatagatgaattttgcaatgtcaaattaggtaaaataaatctacccagatgtcttgccaaatatgcgtacacatagttgcagccttcagctacatcatacatatgtccccttgaaacagatgtatatccatattcactcaggaaattgtgtgtgcttgcatatcaaatataaaagaagaatgaatgtgcagatgaaaataactgctctctaaaggaaaactctaaaattggtgctaaatttgtgtttctgtccatatgtgtttatgcaccttgagttgtatgtgagcaaagtgtgtaattctgctgttcctattcctgttgcatcattgaggcacagaatttatgtaaaatatcaccctaaatgaagcttcatttcactggaggcattcctttaaatatagcaggtaaacactgaaaagcactttgtggttgaggagcaatataactcaatatgtctacacaggaaatcagaaaatataatgctactgtaaaaaatgtaattgctaattcttttctttaaaagggttataaggctttcattttatagtccttttcttcttacaaatgcaaggcatgctcattttagaaaatttcacaaattcacagaggtacaaaaggtagaaaggggttggaagaaaaaataaactcacttcttcacacatccctcattcaaatacacatcaccatgtcagttttacacaaagcgtttatacgttttactttgtatgaaaagtacaaagtataacataagattttccagactatagaagtctttatgcatttctgtaatgtgcccaatgtaacagaagacagaggatgagttaaaagtgttaacattaaattttggcttgatagtagatagagcaatatctataataatattaaatgtaaagcagcagtttagtcaagagctaagagttaagattgctgtgaaggcattagagacagacaacacaaaaacattccccttattctagacagagctctaaagcttgggatacctcctggcacaatcatcattctagaagtctagaaccttcataacctttagtgttgattctaaattttgagacaataattttaagaaaagctagtttattttcccctcctgttttctaaagatttattcagataattacaagtggagaaggagaaggaggtaacttaatatttaactatgtatttggcactaataagtgatggtgtcactaatttccaatggtttcttgatgtacagtttctggaaacaacatctgacagagatggaagatagtaatcgcacactcagctcatagggttataataacacacaaacatttcacatactgtgtaatggaaactcttctgctgtcctcttaattctctcaacaacttgattaatacgtgataccgttttctcagttttacaattgagcaaactgaggcacagaaagattatgttaaattcttagcgtcacataggtagcaattgcaaaagatgggctgtcaacttaggtaccctggaattggggttggaatttataatcactgaagcagagtttagaattatctatcattaacatactacttcactttttcccctaaacttgtattttgatgtcattaaatttttttaaagatattatttttaatttttaaaattttttaatttcaattgtttttggggtacaggtgagtttgtgttaatgggtaagtcatttagtgttgatttctgagattttagtgcactcatcacctgagcagtgtacactgtatgcagtatgtagtcatttattcctcatcacttttccaacctttcccccgagtctccaaagtgcattatatcattcttatgccttggcatactcatagcttagctcccactaataagtgagaccatatgacatttagttttccattcctgagttacttcacttagaataatcacctccagctccatttcagttgctgcaaaagacattatttcattcatttttatggctgagtagtattccatggtgtatatataccacattttctttatccatttgttggtttataggcacttaggttggttccatatcttttcaattgtgaattgtgctgctctaagcatgtgtgtgcatgtgttaaagatattgttttaaatgatggcataatgttccatcttttaaaaatattataactgatctaataatttctctatttttagattgtttccactttcttgctatcatcattatggctgtgaatatactggaataaatatcttgttactaagttaataacttttaatttaaaaaatttctatataaattaaaaaaatagtttccaaaacagttttaccaataatattttcatcaggaacctatgagaacactcagaacaccacgtttccagtaataggaaatattatcaacttaattttactgtgttgggactttgctatctttgaggtgattcttatagactttatgcatcaactttcatgtttatttctatgaactggaatatagtaaaacatgagaaaaatccggatttgagtgtgattctggcaaattttagctctatgacatcacacctaaattctctctgtgcttcagttttcttgtctacctgttctctttaatttagtggtttgtgtttttataaaggatgaaataaaatattatgtgaacgtatttcatcatgtataaagtataatctaaatttatgatagtagctattgataatatatacaatggatgagccatatttttcccctatgggggaaacagaaagtgctgagaaccttgatactgtttattatagtattgaagttaatctagctcaatctcttttattctttaactctgatctagtcattcagcatgaattgaatataacaatcagctaaatctacaatacacgtgtcttagcctatttgggctgctgtaacaaaatatcatagactaagtatcttataagcaacagaaatttattttggtggacgagaagaggcaggtccttcaagccatttttttttatatatataaggacactaatctcacttttgagggccccatcctcatgatctaatcatatcccaagggccctacctcctaatactgccacactgtggattaggtttcaacatatgaattttttagggacaaaaacattcagactatagcagcacatttccaaagaaagtgacattagtagatgcatattcttttaaggtcatgagacaaacaccagaaactaaattgaggtccatagaattttatcctcatgtaaaacataaatatatgttttataacttacactccgacatgatcttttccacttttatttttaaatgaacattatttttcaagcagctttagttttacagcaaaatttaggggagaatacagagttttctgtccccactatcaagattttgcaccagagtggcacatacgttgcaactgatgaacctacattgacacatcattatcaatctgtagtttatattaaggccccttcttgttatatattttatgtgttatgacaaatgtacaatgacacatattcatcatgataatatcatacagagtatttccactaccttcgaaatgctctgttctccatgtattcattcatccctgcccctaaaccttagcaaccattgatcctttgattgtcttcatagtttttccttttctggaatgtcatatggttggaattatatgttatatggccttttcagattggcttatttcacttagaaatatgcctttaagtttcctccctgtctttttgttgcctgatagctcattcctttttagtgctaaataataattcatcgtctagatgtatttttatctattcattcacctactgaaagacatattgattacctaggtaaattccaagaagtgtgattgctggatagtatagtaaacatatgtttcattttttaagaaactgctaaactctcctccaaagtggctgtgtcataatgtatttcctccagcaatgaaagagagctcctattgcttcacattccaggcagcatttgttgttgttactgttttatattttggccattgttataagtgtgtagtgtcacatgatgtttttacaacagaacatatatcagagtttacaatagctctatgcttatcacaatacaattgaacctgttcttgaaaagcctgagtattcttagagagctttcttcctggacaaaaaaataatctcagaccttcattatagaagtaatacaaacaggacctatagtgattgctagagcagtggattatatattcaaataaaaaccaaaagaatacttatatattgttttactttataaacactcttattctcttaaaatatgtaatattactctagtattatgtacttctgtcctttagcgtccttaaggcatttttcagatactatttaaacaattattacaatcagatgaaatgaattaatgggagatattatgtccaatctgtatataataggagtacaaggcatttgtttattagctgaattatgaacataaatttttcactctgacctttattgggtgtgtgactaagaattaactgggaacttgcaatatagaaaagccaattaacaggagcttgaataggtctatcatgaatgtttctaccagcactaagtataatcagacaaaacgttaagtaggatatcaatttcttacatatttgactgttaattagtctgcatttgtattttttcttattaaatatttttaaaagaagattgggaggacaaccctttttactccttctatcttattattaacttttaaaaagtacaatttagtgggtttttttggtattgtaactcatcttgctagaaaagacaagaaaattatacctctagtaatcatatccatacttcacatactatttcactatttatatatgacattgttgtttatatagtcattactcgtttagatttgcatatttagcatttcatttctctttgtcacttctagatctttgcaatatactctagagttcctttaggagaatagtatttattagtgtggcttcatggtaataaattcctttttcttctgcctgaaaatgttttgatttcacttttattcttggaggatattttaggtaaaggaattctaggttgactttttttttaatcgtttatttcatcacattgaagatgttccatagtctctggcttctattgtttctttttttgaagtcatctttcagttgttcccttgagtgtagtgtatcatttttcttatggaggttttcgtttattttacttttgttatctgcattctgacactgctgtgtttagctgtgaatttccttgaatttatttcactgaaaagttgttgagttttttcaatttagaaattgttgttgcctccatttctaataaattttagtcaaaattttccaaatttaactacttcaccatttgttatcttattataatgtgagatttcaattaaatatgttatctcttctaatattactgtcaatatatattaaatctcttgcaattttttatccttttatttcctcccatcattaattatttcttcattttatctatttactttaaaagctattgattgaattcttaatttcagctattttttttcccagttctagtatttccatgtggcagattttgaattctgacatgtaacttttgattttctgaatcactgccaaaatttttaatcttgtcatttaacttctcttgagtagatgaggtagttattttaaattctatgatgattctacttacaaggagataaatagaatctgagtctgtttctgtgatcttgtttcttccggtagtcattcacgttgttttatctcctcaattgctttatctatttatatttcgtgctggatatttcattcataaaactctgtagtaataccttgaggacttaaaataatattaaattattcaaggaaaaaaattctgtttgcttctcctaggcatccacaggtactggccatctgggaaacctttgatacattatttgagaactgcaggattactgtcattgtgggaaagataaatattttgggatgctgaagtctaagatgcggcaaatccagtgtctgttaggagtcagcctcctaatttgcatatggctgtcttcttgctgtgttctcacgtggcggagagcagagagagagaggaagcaagctctctcatatttcatctcataaggtcactaattctagcttgagccctccaccgtcatgacctaattacccacacacagccccacatcctagtaccataccattgatgcttagggtttgaatagatcagttctgaggggacaaaagcatgcaatccataacagcctcctagtctcctctggattagcaaatgtctccaaggtaaaagcattcccacatgc

SEQ ID NO: 844 - DNA, 39408 bp, Homo sapiens
acagtaacttcagtaacacacatgtaatctagtaggtaagaaagagtagcaataaaaggaagtaaataatgataatgctgcagtttcttcatttcatttatgcttataacagatatatgcttataacagggaagaaacacactgcagtgtcatcaaacccatggaattatttcactgcaacacatttttttctgcattgaaaaagcaatttctcaaacaagtaaaagcaaattgagctaagtgcctaaaataaatcagcatctttccctcctttctttcctttatatcacctttttcgctaaagaagaaattggacaaataacttgtaatgaaacttgggcaagagaaatttcaagtatggaaaaaggtttcgtttagcattatactctacaagcacacagagttccaacattgtccatgctgtccaagctccagggatttcatcttcacctgaaatgaggcagggcatagacatcacaagaagtaaccttgagatttccttgcccagaggcatacatgaggaatgtatagaatcaagactctctagtcactgaatttaattcttctttgttaacgtaaagtcaatatcaataaaaaggcagtgatataactgcagttaaggacaatgttacagacctcaaagtgcatctttcaacttgtatttcacaagggagtcctatctcccatgatccagagatctttaaacattgtgatgtgcattgtttgtctgaggcccttggctttttaaaaaatactctttaaatcattttttttcctaatttttgagggtacatagtaggtgtataaatttatgggacacacgagacattttgattcaggcatgcaatgcacagttatcacatcatggagaatggggtatccatccctcaagcatttatcctttgagttacaaacaattcaattacattctttaagttattttataatatacaattaagttgttattgaatatagtcacccctggattttgactatcaaatttaattaaaaagcagcttctgactaatactgtaagaaaaagaaatatttgtgagttaaaaggtgaggatctagatatacactgattgtgagcacagccattcaaatgattgtgaagtcaaagtgagaactgcgtatgccattaccagctaaataacataattccaggtaaagcataaaagatgggctgtcacgtattcttaggttttcaaacgcgtaggagaatctagactcagagaaatctctcaaagaaatgtcaatgcattttgtaaaatgaaactagagctatagcaattggtgttaaatttctgcaaattatacccagcttcctttctacttgcaacatcgttgtatactaaacagctcttccccacacatctctcacacacacacttgtgcatatacacacagatcacttgagtcaatggtttttattcttcaatcagaatcagtacaaaagcacatcttaacctttacttaaatcaatacaaaacagtgtcccaattaatagaaccagacatgacacatgagttttgttgttgttgtttttttcctccaataggctcagaaagtcaagtgcaaaggggaaaatttctccctttgataataaaaatagttttttggcagaccttcaataaagacctctacgtacattttatggaggtgatttaaagtcaaaattcttgagttcatagcccatcagtttttgtttttagtagctttattaagatacaattcatatatcatttgcctattaacgtgtacaattatttgtacaaatattcactgtcatgaaaccattcctataatccaattttagactatttcgtcacctcaacccatattcatactttatttttttttgagatggagtctcgccctgtcgcccagtctggagttcagtggtgcggtcttggctcattgcagcctccacctcctgggttcaagtgattgtcttgtctcagcctcccaagtagctgggactacaggcatatgccaccatgcccggctaatttttgtatttttagtagaaatggggtttcactacgtcggccaggatggtctcgatctcctgacctcgtgatccacctgccttggcctcccaaagtgctgggattacaggcgtgagtcactgcgcccagcgccatatccatactcttaatccacacctcctttcactcagtactgagcaaccattaatttgttttctgtttctatccatttgcctatcctggatatttcatagaaatagaataacaccgtatgtggtcttttctggctggtttatttcacttactgtgttttcaaggttcatcaatgtcgtaacatgcatcattctttcttttttattgccaaataacatctaattttgtggatagaacacatcgtgtttatccattcatcagttggtggacatttgggttgtttccactctttcagtattatgattaatgccattacgaacatgtgtgtacaagttcgtatggacatatgtttttatttttcatatatatgcttaggagtagaattgctgggtcatactgtagtaattatagttggcatattgaagaaccgctaaactactttccaaagcggcaaggttatattacattttcataaacaatatatgaggactccacctttttccacattcttatccacatctgttactgtccttctttttgattataactactgtagtggatatgaagtggtattacattgtgatttttatttgcatttccttaaagacaaatgatatggaatgtctttttatgtgcttattgggcattttggtttttttataaatatatatatattttcacccagtttcaattttttgtcttatttctgagttgtaaaacttctttttatattctagatacatgtcctttatcatgtatttgatttaaaaatattttctcccatactatgggttgtctttcactttagggatgatgtcttttgatgcacaaatacttttgattttgataaagtacaatttacctaaattttatttggtcatttcatttggtgtcatgttcaagaagtcttcgcctaactaaaggtcatgaagatttactgctgcattttattctaagaattttgtagttttagctctcaaatgttgctcataatgcattttgactttttttttgaatattatgaggaaggagtgcaacttcatattttacatgtggatatccagatgtctcagcaacatttcttgaagagtttttaatactgaaccatgtaattgcctcttctaagcctctgtctcttaatcagtaggatgggggtgatggataaaagtgcctcgttcactgagttgttttcaagattaaattaaattcaataatacacataaaatgtctaacattgttttaatacatagtacttgcactttagctcttaacagatctctacaggttatcataacctatttctaacccaagggttgtctgctcactataacgcttgctgtcatggaaaatattctgttgttaaaaatactctctttttccttatccctctgcctcaaaagttgtccctgtatgaatttctcacttagctaccactgaaatacctgatgaggtaattcatacttaaaaatgaaaaatgggccaggtgcggtggctcatgcctgtaatcccagcacttcgggaggctaaggcgcgtggatcacgacgtcagaagatcgagaccactctgaccaatatggtgaaaccccgtctgtactaaaaatacaaaaattagctgggcatgatggcctgtgcctgtaatcccagcctctcgggaggttgaggcaggaaaatcgtttgaaccagggagtcggaggttgcagtgagccgagattgagccactgtactgcagcctggcaatagagtgaaactccgtctaaaaaaaaaagaaagaaataaaaaaatgaaaaatgataaaataattttattctttaacagaattatgttgttattatgttgagacaaatatagcactgtaaaattcctccacacttttttgttttgttttttttgagacagggtctcactctgttgcccagactgcaatgcagtggcatgatctcgtttcacagcaaccttagcttcctgggctcaagtgatccttctgcctcagcctctcaagtagctgggactacaggcacaagccaccaatgcccaggacatatatattttaaatttttttgtagcgatggggattttccatgttgcccagaccggtcttgagctcctgagctcaagtgacccacctgcctcagcctcccagagttctgggattacaggcgtgagccactgtgcctggctcatgctccacacatattttaagtttgctttataatcctgtgttatcatttattcatttgtatattaaaggcttccaaatgatgtgtcctctattaacataaaaaagattatctgaatatagtaaaatgttgatttattaacaactatgtaatcaaaaagaacagcaaatacagaaggaggtgttaatcacaaaataagctctgtctctttcatagtcttgctaagtttcatgtctctggtaggatattgtgcatttttgaaagatgccttgagatggccaattctgtaagccaaggaaagtctatgagaatagaaagcaccgagaatttataattagcttcatgtactgcatttgtaagttaccagctgtgtgactgacaggactcttttcccctacatagtcccgtttcattgtgtgcgagtaacaactggcgtccaggagattcatgagaattaaatgagatagtataagtggaatgctgtcaagatgtaaggcattagataaaatatattagatagtcacaagttaattccagcttgggaaagaaaaattgggataatttagaataaaatcgttatttgccaatgtaaacatataattattttaacatgtttaaagcattttaataagtcatgtgggtataatgataaaggagaatataattgcagaattacgtgactattcaaattattttcacatcttttgaatttaaaaaatagtaaattatttgagctagaaatttctcgcttccactttacatttgtctagtgcagatttttagatccattggccaactaatagtggatcccgcagcgatggaacatttctattatattcttttctctgtaacgaataataccatctggcaacctgagtgtttttctcatcattacaagtcagaggagtgtgtaattatctcactgaaaggaaacttctgaagaaaagcaaatgtaagaaacattcttgttgcactggatgaaaaaatgtgccaaaaataataggatgttgtataactttatataaagctacaaaaaataaacacaaataaacattatcaaagaaagcatcatgctgtatattatgaattactgatatctcatatatttgaggcttttgacatagaggttagaactctgtgactgagaatctcactcttgaattaattaggaagagagtattttgaatgatagcaaaatggccaattaatgtttatttaataatttttgagcaggcgttaaatgattggtttcaaagtgcaataatatagtctgctttgtaactagagctgtgaaaaatattcacagcctgaattaaaaggagaaatgttaagaagaggaaagggattgtctaaatagcagtataaaaatctctgtaattatgttaacatcatggacaatctgtagtattctagtatatatgaagaatacctatcttctctccaggatatttcaattacttggaaactgtcctggtttcaaacttttggaattgtagatattctgttgtgggcacataagatggaaagagggaatagatggataaagcatggcgtgatgagagctgttgggcttaatttgcaccaacattgtcataatgcttttggccctcagctaacagtagaaacgtgtatgccacattataatggatacactggaaaaagtcctgttcttagaacccttacaaggatgacatatgtagaataggtacacaatatacagggtacatctttgaagacttttcccaaagctacagtgaaagtgttacaaatagcaaaataaaaatgagtaaaattggaagatccttccccacagtaagtgcaaatacataactaggaagttgacccatatttttttgtttcaaaagtatttattcctatatattgcaagaacttagtaaaacaggaaaaaaaggagaaaaaagcttaaattgattgggataatagatgaagatcaagctagacaggtttgtgtcaaaaatcttagtttttaaatattcattttgattgaaataatattaaattttaaaaaactattcacagataaggagctgagttggaagtgatgaagtttagggtcttgtatcaaagtagaaatacattgtgatcttgacacaatatgacagagatgagtggacaaagtcatgggtacaaataattataataaaatttattttgtgaaattctataatttagctataaaatacatgaaagaagaggaaatttttaaccccaaatttgaattttggaagataaacagcacagagatgatggtatttcacctggttttcaaagatagttagatttagacggctatgagaaaggaggaattacttttctgaaagtggattgaaagaaataaaaattgcatgtgacttgaatttttttccttgtttcagtaagaaggcactcacaaacagaaatatgaagaattaccaaagcactattaatggaagtcaatttattgcacaaaactgtgttgtataccatgaaacatctttttgtttgtctttttgctttccttggttttagtgaatcttctaaattaaatcttcttcctgataataactcaaagataaaacagggtatgggaattttaagtgatcttcaacattatctattcacagtactgtatccagtaggataatttttaatggccatccaagttttattacacacttcagctaaaaaggaatccataatattttaaaggagccaatggtataattgaaaagctgtaatggttagcaagtatttcattaaatttacttattccctgactcaatctaaatctatcttctggagatacagataaaattattatatatcacatgacagcaagtatataaagtcaaggagagaaggaggatataacataaggaacagaacagtgtggcaggaagataaatgagctgaaaaatacaatgatagacattctgataacctttttgtaagttcaggaaaatcccttaacttttcttttgtgccacttgcacaaatcacttagtccctctgtgcttgttacttacctttaggggtattataaaattctaatttctgattaaaaatcactagctgggtattttgttaatcattctcattatttaagattttattattctcttataaacagactcagtcttttcactatttctcatgagacagttttcaggtcatgcaccatcctttatctcctccatgggacaccatggttaatgtctctcagactgggatgtccataaccaaacccaataccacagatggaccgatccatgcaatgagttttatttccttttagctagatatgatattttgttaaaaccacttagcatttacctatgttttttaaaaatatttttttccttagcaattgctcatctataacttgcaggaaattcaataaaatcataaagtgttttaaagtcacagttgtgtagctaaacatgtaacacttcaagcagaaatataaaactatacatgtatttcttgcatagaactgaaaaaagcctgtgcttcaattgggcattccttattttttacattccttacttcttgtcaatcttggaaccatgttaactatgagctagatgatattactattagttaacttgatacatcatctagctcatagttcactatcctttactccaagatccagtgagaagttgctccgcagctggagaaattggagatttgggactaggaccatggctctgcaatttactacctatgtgatctcaattcattcaaaccctggtttacttctgctaaaaattgcatcataatacctaactgaaaggtttgagtatacagaaaacacatcttaaacttttaatgtaatgatttccatttcacaaagtccaagaggttctcacaaatctttcctcaaatcttaggcatcaggctttaaaccttttcaaacaagatcatctgggcctataatgcctccagtggaagccatttgcaatcttttgagattcactttttcctacaaggcaaaatggaagcatcactttccctgactgtagtagtgccatttggcttaccctatcccccacactaattgtcacccttttcttaaaatctagcagagtttcttacacactgtaaatgttcattaaatattagtaaaaatgataaatagaagaacagaaaaaaagaaggataaatagaaaggaagagaaaaggtaagaggaaagaaatacatgtttttcttttcctcccacttcactttaactctcccattaacataattacctacatggtgatatagtttggatatttgtcccctccacatctcatgttgcaatctgatccccaatgttagaggtggtacttgatgtgaggtgtttgggtcatggggtcgaatctctcatgaataaattagtgcagtagtagcggtggtaatgagtcagttcttgctctattagttcctacaataactgattgttgaaaagagtctgacagctccctccatcagctccccttcctcttccaccatgaactgaagcagtctggggcccttaacagatgcagatggtggtgtccgggcttctcatacaggctacagagctatgagccaagtaaacttcttttttgaaaataaattatccagcctcgggtattccttagagtaacgcaaatgtactaacccatgtggcatttcaactacatgcctccatggcttcttcacatcatggatcatgggccatttaaggtaggccttttgtttaattcatgtctatcagttcaatgattaccaccatggtgagcgggaatgttaggtgcaatatattaaagaggggaaaaaaaaaaggaatgcagatcaaacatatgctcctgtagaaggattttaaagttcaattagtttagttcttccttgggctacaaatgggactgggataacagcattcaaggtatcagctgacaatgcatgctacagcatgatgacagtgttcttttgatgaagttgtcacacaacatgaaaaaaagcaacaaaattattagagaatccttgtatgattccagtgattgctttattttctttcctgcatgttcaaattacatttgtaaaattgcattcaagaccagagttaagcttacctttttttttcctgaataaaccattgcctcccatttgttttttcctgccatttctaacattcttttctttattctcatgatgaacaaacagatatttcacaacagattttctattaaagttggtttgaggtttgaattcacaccaaacactaaatattattattcccttttgacttactccatgctttgttttctttttaatttctttttttttttttcttgacatggtgttttgctatgttgcctgggttggtcttgaattcctaggctcaagccatcttcctgcttcagcatccagagtagctgggatgacaagcacacacaacctcttgcagccatgctttgttttcttctcagaatttgcactacctctgaacatgtcttatgacggttctatttaattggcaagggaaaagtcattttgtctttattcatttattcttcaaattctcatatggcaccgtattgcaagccatatgcagtgctaagtgcggggtagacagcattgagcaaaaaaagaagcctcactgccttggcagcttgtgagagtgtgtggggactggcgggggtgtggacagggaaacttctcatccagccaaagtggtcatggggaccaataaaggaggaagtaagagagaaggggacttagattggggctttataccatctttctaaagtaaagaaataacccattttgtgtgccttttcttttaaaaataacaatgatttttgaaaatttgaaaaaaaattagaaaatgaacattattcgtaatgttgtactcataaacccagtatccagcttgattcattcaaacattgtttacagagataatgtatatacatttctatgtatatgaattatacaacataatatatgtgttttatttaataggatatcatattcttcatgctctataatttaccaattgaaatgtttattgaatttatatatatatatgtattatctgtctgcatatacaaatgaggagtatttactttcttataaaatccatttttagactatgaatttgatggctgcagaattgtacactgattcatgacttatctattccattattttgaaatatttagttatttcatcaatttaaaaaaaaaattatttatttatttatttgtttattgagagaaaggatttcactctgttgcccaggctggagtgcagtggtgtgttcatagctcattgcagccttaaactacagggctcaagctatcttcctgtctcagcctccaaagtagctggactacaggcacacgctaccatacccagctaattttaaattttttttgtagagatggggtcttgcttggttgcccaggctgacctctttcatcaatataaaacaataatatgatagatattttaatcttaggatccatgtcaaacttaaaattactggataagagagaagaaacactcttaaatcatcaacttaaaataacaaattgcttttgagaatgatcacattttctttacaatctccatacatgatttttctacttagaaatccttctacattccaaaatctaataaaatccttcacttgattatgctgttgatagtctcaaatctatactaatattttttaattgttatgttaacttaggtgagaatttctcttcaattgctctcaaataatcaactgcttaatacaattgccaaatactctattgtttttctatttgtttaggccacatttgttatgtgattattctgtttctagaactggtttcttataaatttttttacaagagtatttctatttctgtatttttttatttagttaattgaagagttactttttaaaggtaatgttaaactttaagttatgttttaaaattagaataattttatatttgcaggatagtgcagttttcttccaccccttgtacacgtctttcaatttccttttaaattaatgttttaagttactatggcatatatatatacacacacacatatatgtatacacacacacatatatatacatatatatgtatataattttactttaggttctggattacatgtgcagaatgtgcaggtttgttacataagtatacatgtgccatggtgatttgctagacctatcaacccatcatctaggttttaagccccgcatgcattaggtatttgtcctaatgctctccctccccttgcccccaacccaccgacggtcctggtgtgtgatgttcccctccctgtgtccatctgtcctcgttgttcaactcccacttatgagtgataaaatgtggtgtttggttttctgttcctgtgttagtttgctgacaatgatggtttccagcttcatccatgtccctgcaaaggacatgaactcattcttttttatggctgcatagtatcccatggtgtatatgtgccacatttatttattaatgatagattatatcattaatggtcatttgggttggttccaagtcttactattgtaaatagtgctacaataaacatacgtttgtatgtgtacttacagcagaatgagttgtaatcctttgggtatatacccagtattgggattgctgggtcaaatgttatttctgattctagatccttgagaaatcaccacaaatatgtagaccgatggaacagagacatcagaaataacaccacaagtctacaatcatctgatcttcaacaaacctgacaaaaacaagcaatggggaaaggattccctatttaataaatggtgctgggaaaaccggctagcatatgcagaaaacagacatattttaaaattatttataatacagtgttaaatctttattattctaaattttctagtttcttcttgacaatctttgggtattctttctaataaaacatagcaatttttttattgtcactttcaattgaaattgcttggaatttagagattaaatcttggcatttgcataacatttttaatgacatctcagaatttagtatactatattcaagttttctttgttgatctttagaaagattttatatttttcttactgtgtgctctgtgcatttcttggcagaatttctttccctattttttcaagtctgaaattatgaattaaatttatctatttactattctaattagccatcattttatgaacactcattttttattcaacaatcttaaccaacactggttcttttcagttgagttttaaattagataaacctgtctgtaaatagtatttgtctcttaatcccaccagaataggttttagtgtccatccttaaaaacattatttttcagctgggcgcggtggctcatgcctgtaatccctgcactttgggaggctgaggcaggcggattgcaaggtcaggagatcgagaccatcctggctaacacaatgaaacccacgtctctactgaaaaatacaaaaaaattagccgggcgtggtggcgggcacctgtagtcccagctactcaggaggctaaggcaggagaatggggtgaacctgggaggcggagcttacagtgagccgagatggcgccactgcactccagcctgggcgacagagtgagactccgtctcaaaaaaaaaaaaaaaaaaaaattttcttttattttacttttctccccatctgcatcaacttaaaataccatattgactttaatgtgaaaacagaaatgttcaatttttgtaaggaatggatattaaattctgtcaaatacctttttagtattaatacatgtttttaatacacttttaaaaagactaatatatattttttcaatattttaattttgtacattcatcagaatattgctcagtgggtgttttttattcacataaccataggtagcttaacatatttgttaataagaaaataagcttccttttaaggtgtagctttctagcagctagaatggcttctgaagatgtttcttctttcacaccaatacatacttcagtatgcattttaacagtattgctatgtcatctcagtgtttttaaaatagttacacttacagtgctttatggaatattctctacaatattgcaaggctgggatgcctggaattccatttctattgaaacaattaagctagcaggaaagcctagaggccagaaccttggtctctagcactgaaaccaagtatgtaatgttcaagaaaaaaaaaaaatcttaaaaagaactcctaccgtgtaacccagattgaagttatttaagaaaatctttcattaatcctggaccataagttctgagcccatggttagattcacagcgcatttcactaggggaatccctttagagcacgattataaaaactgtcatttgatgacacatcatgctaccatagtctttttcccctcccatgaaacagtaaagcagatgatattaaattatagagaagggatgatttcaggtgacagagtaaagggatttgatacagagatgttgcaggtgaggttcagagtgaaacattgttttatataaaagaaaacagccagccgggcgcggtgcctcacacctgtaatcccagcactttgggaggccgaggcgggtggatcacgaggtcaggagatcaagaccatcctggctaacacggtggaaccccgtctctactaaaaaatagaaaaaattagccaggcgtggtggcgggcccctgtggtcccagctactcgggaggctgagacgggagaatggcgtgaacccgggaggcggagcttgcagtgagccgagatagcaccactgcactccagcgtgggcgacagagcgagactctgtctcaaaaaaaaaaaaaaaaaagaaagaaaacatatgtatattctgaagagcacatgtttttatctattcaattatccactctgaagtattttccaaatactttggcaaagcacattgttatggactaaattgtgtccccttaaaatgtatatgttgaagcccaaatccattgtgaatttatctgtagatagagcctttaagaaggtagttaggttataaaggtggggccctaatctcatataactggtattctcataagaaaagaaagagatacctgagagccctctctgcatgtgcacgaagaagaggccctgagaagacacatggagtaggtggctgtctccaagccaggaagagagacatcaccagaaaccagtctttgatcttggacctctcacccccaggactggaagaaagtaaatttctactgtgaaagtcacctatcctgaggtgttttgttatagcagcctgagctaatacaattgaactcattttatattttagagactattcagataggttacattcccttaatgcccgcataaaggcagggcttttttttttttttttgagatggagtttctatctcgttgcccaggctggagtgcaatggcacaatctcagctcactgcaacctctgcctcctgggttcaagcaattctcctgcctcagcctcccaagtagctgggattacaggcatgcatcaccacacttggctaatttttgtaattttagtagagatggggttcaccatgttggtcaggctggtttcaaactcctgacctcaagtaatccgcccacctcggcctcccaaaatgctgggattacaggagtgagccaccgtgtctggccaaaggccagctttttactaggaaaacaaagctctactgatttatagaatcccagactcacttagtcattgaagctcgttaaagcctgaaagtacttagggaagtttatatggaagatcacaacatgtctttttcatgaatgactgacaggatgaatttccctaggcatgtcaatcacagaagttttaattgatgccattctcaactactgtgcatgttgttgaaaagcattacatttagctgcattcaatccccagatatatatatatatatatatatatatatatatatatatatatatatatatatatatatagtgtgtgtgtgtgtgtgtgtgtgtgtgtgtgtgtgaaagagaaagagaagataatttgacaattattagaagtttggcagttcaacaataaaaactaaataattctcatgaacatgctttatggtgggaaaatggtgatgagttttctccgtatacaattaggtgtagtttctctatgtagttgtgataccaatatttctttgtgtttgatgtgcatttcttatcaagacagaaaaattgtgtattctgtgaacagaatgcataagaatttactgatctgaaaagtaatttggtgaattacctctacaacagtcatgcaagcaaggaagaaataaaatgctataagcacttacatagttcttatcatgtgaatcaaaacctaaaagtgtaaccaaacgagatgattcagtcttatttacacatctgatgtgctttttctttaacacaaaagggttctaacattgaccactatcatctgtcttttagaacttatttcttattagtgatttaatatttaaaaatctttaatgttgtggtttaacttaaaatataggttcatataggaaaacttctttttagaacaattatttagaaatgataccaatacatgtttgttaacacgattaactacaaagtgggatttcatgtgaatgaatttcccaagggtactgagatttactaatgtatcgaaatatcagaaaggctttgatacacaaaagctctaaattatacgtgaacattagcatcgaaataaaagcatagtcagacagtagtgccccctggagaagacctgttgtattgtaagcagtgccttatggaagcaatggatggctcagtacctttctaggatctggtcccaagaagggtaccacacatgattttccgagatacacaaatatcatcaataaaacaagaattaatacatattaaccaaactcacaaatgtacatgtaaatataaggcagaaggtgttataagacataaaattacttctattttagaaagaatattctcttcctataagtacattgaactgaaaagccacatgacaatcagaagattgcctaatgagctaaaatttaattcaaaatagggatagttcggtgaatcatattaatgcctattgctattagattatgttaatatcatgcatccacagccaggaacgatggcgcacacctgtaatcccagcactttgagaggccgaggcaggcagattgtttgaggccaggagtttgagaccagcctggtcaataaggtaaaagcccgtgtctacaaaaattagctgcatatgttggcgcatgcctgtaatctcagctatgtcaagaggctgaagctggagaattgcttgaacccaggaggcagaggttgcaatgagccgagattgtaccactgcactccagcctgggtgaaaaagtgagactctgtctcaaaaaaaaaaatattaacctggatagtgctaatgacatgctgacaaattaaaactctccaagagataccctccagacccttccctattaacaaatttattttccttttccacttcaaacatcctgtggacaaatgttctgtgttgaatgttgcaggttgcccactgaacatcttctgtcacatcctcatcacctatgagaactctgtgtttaagaatcttcccctcaccacatgggcatgtgtcaaggcatggctgcctatagtcccaggtcaaataaggcctgatgtattactttacctcttgccaatgatcactccaaaccttgttatgttatttaactctggcctatgaaatgcatgatgaaatatgtataataacttttggcaaagtttcttatcgcctaagcagaaaccgtgataagaaaatgttttctattccttttgagtattgttgaatctgtatatcctagggaagaattgctacactggttgtcttactaaaccaccttcttactatcctaaggagagagtcaatactggtggtaagacacagagaaatgaaaatcacctagatcactgatgatattcagttattgaatccattaattctaatgcctctctatatctgaatgaccaggtaaatgagatataaagtagtccttaactttgagccaatttaaagtggtgtttatattacatctgaaaagactttttaataaatagagagttgtaagatattcttagaacacctccccattttcttgctagtttctacttaagagaaatatagctgggatttcttccttttcctctgattactcttcctttattttaccagtttatctatcttcaaagctcagtcactgacccacttccttttcctgtttatactctttgattgttaatctgatctgatcttaaggcttggattctatccgtatgccccaaacttgcaaatttatttctctaacaaggccaccttagaggctcctttggccagctgcctacttcacatattcatttgtaggtttgataatcacctcaaagtgaacataaacaattaatctactattactctctaagttctcccatatcagcaaattgcaccctcattgatttataatcaatgaatagctctgtctccaaacataacctgaattatcctaatgttctccaactccacagtcttgaaatgctacaacctttactgtaaacaccatcattgaatccctattctacagcaataagattaaaaaaaaagattgtcacttctcatattaaaaatttcaggacttcttgtcctgaaaacaaaattgaacttcttataatatcaaggaaaatccttcataagctggttttgcccatctttcttattgcaactaacactatgttcattctccctaagtaagatctagctctctggatctcctttagatccccaatatctttcatgtcctaaagcattgccttttattactggttttagatcaatttgggaggaaccttctactcccatattttacctaccaggcttcttcatatcatttcaatctcagttcaaacactatcttctgaaaaccttttccctcactactcaatctaaacaatttcccttcctggttctccacaacattacccacccaactttgtaaatggtttcaaatattctgggttgacaggaaaatgttgtgcttttgttagagcttgatgggcaatgctgtttaaaatatcagctcaatcatatgacattcccatctttcctaaaatccctgctttatttctttccatttaatagactgacatttgatataacaaaaatttattacctgttcaaaacccaagactaaacacaagacttccagctacttgacaactataattgttgttgttttattcagtgttacatcatcattgtctagaggcgtctggaacaatcatgaatgataaagataacagtatctatcgtaggatgaatgagttagcatgaggccaggggttgccttacactaactactcattgtgtattgaatattattatactagtcattcattctatgcaacctaagtggaaagactcccagctccattccttagttaggaggaggcctagacccactaacaatggtaaggggtgtgtttagaaagttcatatttcgtcacccatatacaggtaggaaccactgatacaaggcagattctgataatctctcaccaatcagattgtaatccctgctttgttatggtcaagtttttctgctgctcagccacctccttctctggtgttttctcttctctacactcatgcaatacatacagtcgttcaatgtcctaagaaagtctcctcttctcttggaatctcttcctctctcttccccttctccttgatctattttgactttttatgtagctggtaaggatgtgataccttcttatagttatgaatgggctaagaagaaagtgaatatagatattttttcccctccagctcggtcatgtcttcccatctagtctatcaaatctctttattctgcacatcagaatacaagcttgataacaataataaaaaaaacccttcactttcctttgctgttcttactactgggatactttgaacagtttgaatctcatatggtttgcatgagagaccctggtcctttgatctgctattatcaaataatgctccaaattgcatcatcttttcccgaaaaccttaccactttttacaatagttacattttgttaagtaaataaactaacttttctgcaataagcagtctttttcctctcatttctccttccctgattcaaccaaactggccaaggaataaagatgaattttactgtatctctcctctcaatgtttcattaccctgctcataaatctttagcaacattctatttgctgcaggataacctcccacatctttgacatttattaccatgtatctgtgtatactctaatccttaccaacatttccaaaactttattttccctcagttgttaaaaaagcaccccgttcaagtcaaggggatctttgtgctataaaacaatagaccttgtgctatctttttgtgtgtcttcagatatcctttcctcaactacagaccacatcatgcttatttatctaaactatcagctgaaatatcattttttctccctttctgagcaacatagccttacttgaattttcttttctctgaatttgatttgcactaacatcctacaccatctgtatgacattttcccatgataacttttttaagtgaatttgttttttgaatctttgttaatatcaacttttttaaaacagcattttaagatgcttagcacctttttcccccaaaatgagtgagtgtctaagtaaaaagttgaatcagctcctgaaattataaaacaagatgtcatattaatagtgttaactccacataatagttcagtgttaagaaaaatgtggcaaaaaaattaagtattctctgcattctttgaaccctatcttccctttttattttccaatgcagttaatttggaattcttactatacattgatgtgtcaaaatgagtattgtgaaagagaaattatagaattgaaaaccatagaaaagacaataaaactttaaataaaatgtaattttaataagaaatgttggagctggtttttcatcctaaatgtctctactgcctttcttcacaaagaaaataaaggcaatgactgtattatgtatacatgctgttttttattaaaactcttggacaaatagttaaggttaacataatagacgtatttggagtgactgtgccatgtaaaacaacctcctttctttgataactgtccactcaccaaaggcggggacatctaattggttctcaaacattttttggggggttccatgtgctcttcacattcatgacttgggtttacatttgatgtttacattattttcaccagaaaatcagaaatatttttcacagacaattaaattgtaaaagttttgcagctgaggatttctacacatggaacttttttgtggctatcttatcctatatatacagagaggcagcgaaaggcagcagcaggagaagctggagagagaggatgctaagatgtgtagagcagtggggacagtgatgtctagctaacaggtgccaccaccataaagtccttaaaatagtcctgttttcttgtagtaaaacccatttgcataatccagtgcaagtgactttctgttatttgcaatcaaatttttttttagctaagcaaaaactattttaaaatactcctgagggaaatttcataaaatattagggttatatcactagagttctaaaagtccagtaaagtattcacaagcaagaaactgggaaatagtaaactttacaattttatacaacaaagtattataatgtttggcagctgataaaaaatctgttgaaatatttacaagaagtaataataattatagaaaatctagaactacctaaactgacggggaatagtttggaaaaagttagaaataacatcttaccattattgataagattatctacatctattatgttctttagagaactataaacctcaattttttaggcagatgtcaaaactatattatcatacgtgtggtatttatgctgtggctttcactttttggaaacttgaattgttgaggaacccattatgatttgttttcttttgcctcacatattatggtttgaattaagaaattccaccttccttatacaatgtataaaaaacataatgttagaaataaagggaagtcctcttcttagctcatacaaaaaattctaattgaatgaattataaatcatctttgtatactgcatggatctgaatatatatatgcatatatatacacacacgcatatataatgtgcgtgtttgtggggggagtggagttacatatttctcagtcatatttccccacccagtcatatatatatatatacacacacacacacacacacacacacacacacagtgtagagatacgtgtgtgtgtatcttgcattggttctttgaatttgtaacttacatttcctcaaaatatagaaggaggaattgagatgcagagagcttacatttccttgctcaggactacagagtcaatgaatggttaatcaccaaggatattaacaaggtctgtcaaacatactgttttttcataacaaatccaaaatcgtgtcatctaaccctcagctcctgattcttgagattttggtagtaatgcaaactgtctagtttccatttcacaatattaattcaaagtaaactttttgcaaaaataatggtttcattaagaaatcaacacacatgcacacacacacacacacacacacacacacaaacacacaccaatgcaccatttaggcacatatgtatttcccaaattataaaatgggaattattaaaacccttacaatattatagtatttttgggaggaaaaaataaagagcactcctcaaattcagtaaatggtgtggctaaaaaataaagctatgtatgccaccaagggagaagataattacattttttttccttttaatatacactgagggataaggagatataatacaatgaaaaaaagcattaccacatggtttggtatttaatcattgcttttatgtgtttgttaataagactaaaaatgatgatgatttcttcagcatttttttcatattctaatggtatacttatacaaatgctatatatatatacaaaatgctataataaggtgaatggaaagatgttcctattatattaggtttactttcattgttccttgaataactgtcataaaacatgatatgacatatgttatttatgtcatttaattttggagaggtttcagagagtgagtaaatgtatttgcacaattggtatctcaaagcattaaatgagttttgggcagaagaaatcactttacagataaaatgtagttggctctcatcacttatttctaacagttttaactaaattagtaggtttcccctggcaggtactaacatccatcccattcaatatctacatattttggatctattttaatatgtagatagagtgtaatcttaaatgcttctgtttataacttacaattattcccttgattatctttctaaaaagaacatgcatgcttatgtttttccattttagtatttataaacatatctatataaggattcataaatcataattcattcataaatcattatgaaacatatacacaaactaaaaagaaagccaatcatgtatcacagattttaccttgataaataatatgaatgttttggtatgttacatttatttttataatttatttgttttatttcattttatattccaaattcaatttaaatgttggcttttctcttaaattctcctgggcatttgaataatgttacatatctcaattagagagtatataatatttaactattttaatgtatcatagtttagttagctcttaatccacaaattaatatctgttttgaatatattactactataaatattgctagaatgaacatctttgtatatcaatttgcattacattaaatttccatatttgaattactgagaaaaagttgttgggattttaaatgctgttcatagatatctaagccagtaaaaccatggtttaaaattgtttaaataaatggtctcataatatccttttctttttcacactattctgaaaaagggggaaaatctcattgtaatatcccattacattcttcctaagaaaataaatttacacccaaacaagacaggctcatttcagaaataactcccacatctaaggattcaagtgcagacagtcttttctgctgctatcacatttttcttcagcagggtcccatttgaactgatcagtcatctggactctcattgtggatgcaccattgtgaactggccttattacaacctaatcacaccccacccacattacacagcagagtgattcaagaagacacaacattaagcctactaaatatgcataaatcccttcaattaaaactctgcaggattgttttcatgttgaacatacagactaattgttaatatcctttaactgtgctaatgtaatcatttgtgcaaattaaatccgtctttgtaaatttttctgggaaattttcactgtgtgataactaataggaaggaaatgtcttctatattgaaatgataattaacttttaactatgatttcacccttattttaacatttactctgtcctttaatgtcatgttttagtcaggaatgtctactgactttcatctaaagtgtatgcagtaagctcattgaaggaagaaatggtgtatttgtctttgaactatcatcagtgtcatttatgataatagcaacaagcaaacaatataaacaaaacaacaaaagcatcacattgagagggtccttagaaaatgtactgatttggtgaggaaatacatatttttaatatttattaaaaacagttggctgctccattaagacatatggaatattttgtctatttactctggctcaaatctgaaatcaaatatactcatcctttcaaaaatacaaaatcagaaggtgggcttgaattttacattttgtgctacacatatttgatgctaaaactttttttttctaaggtaaaattagtaacacatttatttgggggagtatttttaaatcttatgtgtatggcaggcactaaactagcctccaaaaacatatgctatttctgagaaactgtagttctttgaaaaataagagtttttcttcagtttctaatcggctctataacattgatacagtaaagccaaatccattcttaatgaaatgatttgaaggctgtcctaaaatatattgaggtggcagtgaatttctagatatgctaacacatagccctcttgtaaataaacatattaatatcttagaaaacttgcactgaaatgcaaaaatatattatcaagactctttccttcgctttgtcatttaagtagattattctctcattatttcatgtactaaacacacacatatgcatttacagttcactctgtattaagcactttggtgagtattggagatacaaagttcgctccaacacacagggtccctttatttacagtacgcttactcaacacaaacatatgtacaaagagacacaaactctcccaaaccggcataaatataaaataacaattcttctaaagtctttgcagttgtgctgagaaattctagtagggatttgataaagaaagggaggtcagagagtttgtcttgcaaaaggattgaccacactgagtttggagaaatgtgtaaaaggggtggatggagtaaaaggaaaagcctcctgagacaaagggtatggtgtgcatgcaaacacaccagggtaaaagaaagcaggacaattttcaaacaagtgtagttagagcacagagagaagatagcctagcatgtggtgggggccgtgggtgtgcggctggagttatttaggctggatttgataatgtaatctctcaaaatctatatgaaatgcatttttagagcttattaaagacacagaccacagatattgagggtgaaataaataaaatagaaaaatgaatataagataaatgtagaactagttttcctaaatttagaaaattatttgcttttatcagagaatcgcaaaagcactagcagaagcaaagtgaagcatccatgagcgggaagttagatgccaccggccactgaaagcgccgccaccctgtggtcactgttcttgattcagaacaaggggcttgcactcctgacagaaagagcacagggggcaggtctttggcaccaacaaacaggagcttgaactgggacctaaaaagaaagagggatgctcaaatatagaaatgtggatgggggtgacattttcctaccgacaccaaaaaaatcaagacagttgcagtctcccgcaggacctgtagggtgacgggaagagagagagtggccacaaattctgagaactgctaaatgcaagtcagttctatgagatctgggagacaaaaaatataggaaattgtaatgcaaacaaataataaccggaaaaagatgaaatatttccattgaaaagctatatttgttacaaggtggtacatgacagaaatatgcagaagatttgtgtgtatgcacctaaaaaatagcctgaaaatgtgtacagcaaaaattggtatgattacagggagcaattgagccatccttgatcttagaagatttaacaactcatctgtcagcaattttgcaatcaaacagaaaaatatatatataattttaaatttctgccagtataactgtacagttaacaagcttcatctaatgtgtatttctgcactaaataattagcaaatgtatattcttctgttgtatacatgggctatttataaaaattaatcttaaatcataatcttaaatcaaccaagttcaaataatcaacgtacagaaccaccttcaccgaatacaatagatgttaagttaaaaatgagtagcccatcaaaaaatgaacacccatgtgatgttgacagattactgttggagtaaagtattcataaagtttaaaatgtaatttattctgaccaacattgagagctcagatgattgaacctatggtacagactgaaagttctgtgtctatgattggaatttatttttcttttccttctagacagccacactggagtagagtccatactgcctggttctcttgcacaaaggtgtgattatgtgtaggttttctggcaagtaggaacatggtgtaggtgttaccttagaccatgaagatatgagtcatagcctagcaaagaaaatgcaacaaaataaaggtagctcaggtttctaaccattctgaaacaaaatccttgctttattaaattgcttaagcctagactgctacatcaaagcaaaatcaccctctatttcctataatttatattatgttgtgtctttatttcacagccaactttatttcctaagtacagaaatcaaattgatttcaaaaatacaaagtgaccaacaggtacctcaagctacttgttttgactttgcaaactttatatgtttcatagttttcacttctaaatatacagttaggagaaattaaatatatttaggtttatttctaagtgttggctaaaacaaaatttcattcatcagcatttggaattgtccactacatgtgtgctgttcagattataaaacagaaaaaagtacacggcagctggtgtagtagcttagacagtaatggctgttgacaaccgaggtacacaataatttttagaatgaagtttctaccatgtgcaaatgagttggtttttgaaaagttgcttcataatattatttatctcagcctcctgagggtaaggatttttgcttaatctatagagtatgataatggtatgttctaacttcagatgcaattgaatattaggaatttgcaaaagagaaagcactaccagaaaggaggcagtcaatttcttgcagtctcccatcccagaattagagaatattaaaagtctacttcacaattagttggtcttttgcttattctagttgacagcctcagtggagagggcatggtacttgtggtcagaagagctgtgcctatctagattctgcagcttaaaattatctgctcctgacgtcatacaaaaatagattcgtgatgaccttataggattcttgtgagggttcaaaatatatttggaagttattggcacaattatttgtatatgtcatttgcttgttatgtaatgtattgtctggtcactatgcctcaagtaggaatgtcttgtgccaattagactattaatgcctagaattaagagatttcatcttaaattgttatatttattccttagtacattacgcagtgtttttatcctagtacttaatcaaaactttgtaaaattgggaaaatctagaaaaaaacagtgaatgataaagaacaaaacatataataaaggagataagagaatagaaaagtgtaaacagatgtcatagcatcatatgcaatacaacaggtcgaagtaaagtaatgggaatatattgagatcttgggtgttcatattttgctgaaatggattctagatatcaaaccaaggtggataagtaagtggataaacaaaacagcaaggagttaatatgaagtcacagggcatagacatagttctagagattgcttaccactccatatgaaatgtgtgatatgacaattttttagaagattcagcacaccatacacaaaatacccaggcataacaaagggtattgctaagaaacaaaggtcatcattggaaaacaaacagcaattatagttttacttgtttttgttcttaagtatcctgcaagttcactgacaaccaggtcttgtcataaataattgaaataatatggcactatgtttagagttaagaattcccagtaaataattctgtaccaaatgaagtacaggatttaccatatacatattcataggaaattttttattgcttttctgaaacaatctatcaatttacttgattctttagggaaaaataaaacatgttgtgaaataacaaaggagaaattaagagttgattgactgattttcaaaaaacacttgaactaaatgtgttaaaattagagaagtaataactttgttctctctgaaaggaattcttgagggcattcattacaaaatcaagttcataatgtatccaagccttaaagtaactcacaactgttgaatagaaagctaccctttaaggtccacattttctaatatttactttgttagcattcaggatacttcttgagcccaaattaaatttattacataaatgtttatgcacatgtctattcctacattaatatccatatctacatcacctaacacagtgtagcacacacagtaaatgctcagtaagtggtgttataggtatcgttatacctataacatcatcacattgttatacctgtaacaatacctaaaacataatttgaaataatgcttccttctttttcataaatatgggtaaaaatgacatttgaaaatggaaaatacaattacttttttaaatatgctttgacataaaaaagtgatctcaaacacttctgctcccaaatcagtatattcattggtactaataaaagtttgttttattatttagagttccataactttataaattccttttaattttattaaaaatataagatacattttacaagttcctcagcatcaaaacctctccccttttaaatctactctaatcaatagaggccttttggctagaatagatgttcctggatcatttctataggataacctgatgaaactctccatgattctattttcagctctcatttcctcattactcctactttataatcataatgatatgaaaataactaattgttttaattggtttctctgttgtagacattgttctgaaagcttaacttatatttattattttttgtccttacaacaaccttatgaagtacacattaaaggctctttttttacagatggagatattaaaatacaataaagtttatgttatttgctaaatgtcacaaaatgtataagaggtgaagctaggatgtgtacaaaagaagctctggctctccagaaatcattttcccaacaaataaaaaatatactgcctctccaataccatacagaactttggaaggaatgaatattgcccatttagatagtttgacacctcctatacaagttagttttaaaatttccactaaattaaataatataatcagcaatccactttgtaatgagctctacgatagtggccaggcatgtatacaccaggaaactgggcaaacttggcatacatcagagaatacttaacgattatcaagtttcagagatagactggattaaaatccctcctctgtcatttactttccatatgatcttatgctaattctttttttttttttttttttttttttttgaggtggagtcttgctctcccgcccatctggagtgcagtggtacgatctcggctcactgcaacctacgcctcccaggttcaagcaattctcttgcctcagcctcccaagtagctgggactacaggcacaaaccaccatgccccactgatttttttgtatttttagtagagacggggtttcactatgttggccaggatggtctcaatctcttgacctcatgatctgcccaccttggcctccgaaactgctgggattacaggcatgagccaccgcacccggccgaccttaggctaattctttagccttcttgtcttagtttcctcatgtgtaaaataaggacagtaatattcatgtctcagggttgttgtgaggcttgagtctacttatgaaaaatgctggaaaaatgtgtgacacaatacacactgcgtaagtgttttcaataaattatcgattagagatatgtataaggagattgtggcataatagatatgtaacataataaataggtagatagatacatagatacatacactggttgtagatgggagggtgtgtgtatgtgtgtgtgtgcctgtgttattaaacacattattttatttcagtgcttagtcttataacatcctactgctaatgtaacccagaattcaccttatcctgacttttaaaactcaaactttcaaaactcacatattccatgtcttctagaaaatctaatgctattaccaatgtatcactgagtttaaagttatactatattcccatcctcatccatagctctacatcagttttcttaggtattaattcaatgttaaggccaaattaccttgttgtccttgtcctatttcacgttatgttgtttcagacataaaattctctctcttttatttttactcctcaatcacctcactaacaacttataattttatattacaattgtctgtttctaaaatgttctgacccattccatcaactggagagctaatattcaagcaaaattgcttctcctcttgattgccttcctcctccctagtttttgtattttctaatgcagagcgatttgggcacttgattctaactaggctgtcagttaacccgtgacgtctgaacttaaccttttttcataggatgtagaagcaaactttctaaatagagtggttcatgtatgatgggagagtttctcattagcttgaaggtggatatgacctaggaatgcatacctgctccatggagctagtataactcttttcatttgatcaccagcctctttcagcgattactggcctataattatgttagtgacctattgcaagtaaaataattagataaatatgctctgctatctgatggcaggtcatgaggagcccatttaagaaaacagttatatcttttattctagatatggatagaagggggaaaagaaaagagggaaaaaggttaattctaacttaaaactgggataattcataaatattcatatgaccctgccctaataaaaacctcattactaccacatcagacagctaatttatcccaataggcccgcctaatattgcaataatagtaaaattagacgttctgcagtaatcatattgagatttgtttagttcagaaaacctgttccaagaaaaatgtgcaaagcagaatgatcttttccatgccatttaaaattgaattctggggcttaacaacgtactttgttggtattttttgaatgcttgaacagatgtaaaactccttttttgatggaacactttttagatggaatactggtgcatctcgcagaacgtctttcccaggctggaatactggtgcatctctcagaacgtctttcccaggcataagagaattgtatttctgcttaagtaaagtacaagtatgtttctaaactttcagttatcaaccttaactttgccatcctgcacatctgtcatctagagtgcctgaattcctctttaatcagtagcacaggcactcaatgcttgtcaaaattgtaccttaagatcacagggttatttggcacatctaatattaatcagtaaatctgagaatcatgttaattatccatctctttagttactctgaaaaatgtaatttgactatattacctcagctgtctaagcatattttaatggattataatttgatattagttattcagcttattaaagaacaatctaagtcagtcccatctgaaggcagcatctgcctctttaataaaaacctatttgaaagcgttagtttttatttcacttgctcactgattcatcagccacttattgtgctgctactcagtaccaaatactgtgattgatgtttgagcagcagatggaaagggtgatgagtacctgtctcagggttcaaaatggagcacaatagcaaatacatagaaatacatgcatatttgggaggccaaggcgggtggatcacaaggtcaggagttcgagaccagcctgaccaacatggtgatcccgtctctattaaaaatacaaaaattagccaggcgtggtgtcaggagccagtaatcccagctactcaggaggctgaggcaggagaatcgcttgaacccaggaggcagaggttgtagtgaaccaagatcgcgccattgcactccagcctgagctacagagtgagatcccatctaaaaaaaaaaaaaaagaaaaaaaagaaaaaagaaaagaaagaaatatatacatatggctaagcacgttgggttacgcctgtaatcctagcactttgggaggccttggtgtgcggatcacttgaggtcaggagttcaagatgagcctggcccacatggtgaaactccatctctaataaaaatacaaaaattagccgagtgtgatggtgcgtgcctgtaatctcagctacttgggaagctgaggcaggagaattgcttgaacctgggaggcagagattgcagtgagcggagattgtgccactgccctccagcctgggtgacagagcaagactctgtctcaaaaacaaacaaacaaacaaaaaacatacatataactcaatggacagcactgaaacaacagaagactagaagtaaacccaaaatattaacagaatcagtgtgaagagaggagcagagcctttactggatggttggtgaagggcaagatgagaatacaatcgtatactgcatctggatatttccattaacactgaggcacatacgatggtgtggtcccatgagattataaaggaactgaaaaactatcacctagtgacattgctgctgtcataacttgctgcaacgtactactcatgtgtttgtgaggatgctggtgtgaacaaatctactgtgctgccagtcacataaaattctcacacatacagttatgtataataataataattctatcattggtttttgtatttattatacttatcattattttagtgtgtgctccttaagcctattgagattaaaaattacctgaaaacttaaaaaaaaaaaaacaaaaaataaatgaacagtctcaggtccttcgggaggtatccagaaggcatcgtcatcatgggagatgacagctttattggccctgaagaccttccagtgggacaagatgtggagataaaaaacagtgatattgatgatcctgaccctgtgtaggcctaggctaacatgtctgcttgtgtattcatttttaacaaaaagttttaaaaagtaaacatcaaataaatttgaaaaagaaaaaaagattatagaataaggatataaagaaaggaataaaatatagaaaagaatgtataataaggatataaaggatatcatatttttgtatagctgtacaatgtgtttgtgttttaagctaagtgctattacaagagccaaaaagttaaaaatattaaaatgtttgtaaagtggagtagttataggaagctaaagttaatttattactgaagaaaaatgtttttgataaatttagtgtagcccaagcagtgttgataaagtctacagtagtgtccacgaatgtcctaggccctcacattcacccacctctcactcactgactcacccagagcaacttccagtactgcaagctccattcatggtatatgccctatacaggtgaacctttttttttaatcttttacctcacttttactgtgtcatttcaatgtttaaatacacaaaaatatttaccatgtgttacagttgcctgcagtatttagcacagtaaaatcctgcatagatcagtaacgtaggagcaacagactataccatataacctaggtgtgtagtaggctgtaccacttaggtttgtgaaaatccattctttgatgttcagtcaatgacaaaacttcctaaggacacgtttctcagaacatatacctctcattaagtgatggcatatctgtataggcaagtggagtatattttctacagtagaaaggatacacaaatgtgacccaaaatgccaggcaagtttagaagtggtgggtcgatatccaataagaagaaaaacatgttttctggagttcatttcttaaggagttgtctgtgtttggaatgaatacttagactatgtagtaaggtgtgtgtgtttgaggatgggagaggtaaacttctatttgttctaagaatacatgttctttacagttagtgtattgttgcctgaggtttgcaattgggggaccacttcctgccaagattagagagaaataagaaaatgctcaaatattttcttatttcagacagaccttgtgtcctgatcttgcctaaaaactaatatctacatccacaaagaaaaaaaaagcatcttctgtagctagaattctgttttaattgagataattttctgtcttttggcctgtgtgtttaatttgtaagtacagcccgagaatcagctaatgctttcatattctgtgtgcctcatgcattttaagaatgcccattttagctaatacatgtttattaaatacacattcattgtgaaaattactcaaattcatcaaatgctcaattatcatttcctgaaaagaacatcagtttaggtattgagaaagtaatgtaaatatccagttatagaatttagattacagaaagctatactttgtgccttagcctgaaaaaattcaatggcaaacactgggttgaaaaatcatactactctttccatccacccccactcccacacctcttaaagtgggaactctagtaatttatgaatggtacatgctttacataaatgtgaaaaaggtgcctgacatctagtgacacatgtactgggaatgaaagggaaatatctcatgatcgttgtttccatgtcactgagctttggcttaaggaataacggttgatgaaaacaaaccaagtaaaggtattagaaatattatcaacttcttaagttaaatttctgggccactgggtaagatccttactgagagagagagccctgttaagaatatttttgcccagggacattgcccactgtgtagtataacactgtgaagtatggtgggagctcagggtcactcgatatcagtcttgacctccagagacaatggagactcaaagtattggtctgaatctccaggaagggctgcaaactaaaggccagcgaggcaggcatgaggggatcaaactgcagtaagaactgaagacactaaaacctccagtgagcattctagggggcattcctctgtgtattgccatgcattgtggccaaaagatgctaaacccatctgtgactccaagagggagaatgactggaagctctgcatgtggatctctctgggactttgccctgtgtgtctctttccttcgctgattttgagtcttttcactatcataaaactgtaattgtaaatatagagcttttactgaggttctgtgggttattctagtgaattatcccacccgatggtggttgtgaggagccccaaattgatagccagctagtctgaggtagaagtggtcctggagacacccagtttatggctgctatctgaagtgagggcagtcttgtggggatggttccctcagcctttgcagtttggcttaagtcgttgtggacactaaaaggcattgttatctatatcatatttataaacttatgctaagagttggcatccctgcttgttacaaagtatagtgctaaatgtataatggtatgtaaagccttgattggtagttgtaaacaaataacaatcaaaaatgaaaatataactagattgatctaatcagaatcatggaatagatggttacggtgatggtagaacccttcaacattcttcctgagagaatagcaaatgtggaaaagatagccttccatcctttgcatttgcctagtgaagtaaagttaatgtggtcatgaggacgtgaatgcatgtgactgcaaatgtgtgtctagtggcatttcttgggccaggtgcatggttcagagaatgagggagcacatcaaaaatatttaataggaatgtcctgggattatgaaacattcctccatgtgggccataatttctggatatgctttgctaagtgcaggaggcagcaaggtattagatgtcattttgggggtagaggaggctacagggcagggaaaataatcataatttatagatcctaaaatactgttccttatttcacttacaatgtttagtggactctacatggtttccaaaaagatctttgattcttccctttgctataattggaaatattagcttggacatgttacttggtctctctgttagagtaggcagatagccagaagcgagcaggaaagggagcccctggggaaagaagtcttcacagcagcttctttgcttcctccaaccctccttgaagacacttggggccatgcaatatgtgtttgtcttttcaaccaaaaaactgctgcctcagcactaggattcacaaaaacacaacacacacacacacacacacacagaagaaaacagcatagaaaatatctttgtgacactgatatggtttggctacatgtccccactcaaatcttatctcaaattgtaacccctatgtgttgaaggagggacccggtgggaggtgattgaatcgtggggggcagtttcctttttgtgatagtaagtgagttctcacaattttgtctttgtgatagtaagtgagttctcacaatatccgatggttttttaaggggcttttccccctttgcttactctttcctatcactttgtgaagaagacacttgcttctccttcaccttgcgccatgattgtaagtttcctgatgcctccccatccctgcagaactgtgagtcaagtaaacttcttttctttataaattaccctgtctcaggcagttctgtatagcagcgtgaaaatgaactaatatcggaaattggtgctgcagagagtgggggcactgctataaagataacctgaaatgtggaagtgagtttggaactgggtaacagtcagaggttggaacagtttggagggctcagaaaaagacagaaagatgtgggaagtttggaacttcctagggtcctggaggactcagaagacaggaagatgtgggaaagtttggagcttcctagagacttgttgaatggttttgaccaaaatgctgttagtgatatggacaatgaagtctggctgaggtggttgcagatgaaaatgaggaactcattgggaagtggaacaaaggtcacccttgctatggtttagcaaagagactggtggcattttgcccttgctgtagacatctgcggaactttgaacttgggagagattatctgaaattggaatttatgtttaaaggggaagaagagtgtaaaagtttggaaaatgttcagcctaaccatgtggtagaaaagaaaaacctattttctgtggagaaattcaagccagctgaagaagtttgcataagtaacaaggaactgaatgttaatagccaagacaatggggaaaatgtctccagggcatgtcagagatcttttgtgtcagctcctcccatcacaggcctgaaggcctaggaggaaatagtggtttcatgagcccggcccagggccccactgctgctctgtgcagcctaggaacttagtgccctgtgccccagctgctccagctccagctgtggctaaaaggggccaaggtggagtggatcaaggccatgggagcctacctcttgcatcagcatgccctgggatgtgagacatgaagtcaaaggagattattttggagctttaagattgaatgactgtcctgctctatttcggatttgcatggggcttatagcccctttgttttggccaatttctcccatttggaatggcagcatttacttaatgcctgtaccctcattgtatcttggaagtaactaacttgcttttaatttttttataggcttctaagtggaagggacttgccttgtctcaggtgagactttggactatggactttcgagttaatattgaaatgagttgagactttggaggactgttgagaaggcatgattggttttgaaatgtaaggacatgagatttgagagggaccagggacagaatgatatggtttgtctctgttttcccacccaaatctcatcttgaattgtaatccccatgtgttgagggagggacatggtggaaggtgattggatcatgggggcagctttttccaatgctgttgtcatgatagagagtgagttttcatgatatctgttgattttataaagggctcttcctctttagcttactctctttcctgctgccttgtgaagaaggtgcttgcttctccttctccttctgccatgattgtaagtttcctgatgcctccccagccatgcagaactgtgagtcaattaaacctctttataaattacccagccttaggcagtcccttacagcagtgtgaaaatggactagtacagacacttctaaattggctcccccaggttttgctgacatatgtcaccttttctctttggctacaccctcaggtgtctcctctaacctttgtgacaattgtaacatggattacagaacctacctgatcaagctgtagttatttgtttccctactgtttgttgagtttctagaaaacactaacatctcttatgcaaccctataccccaagcagcaagcatattgcctggcatgcagtcagcatgcttctgctccagttaagtagcctgaaacacagaaaatcagagtatgtggtggtgttttgcttattgtctagcaagttacaaccaagtcccttgcagagttatatcacaaagccacgttgtggcactctatttaaaaactactatatggagcagggacttaaacaataaagaaagattttcccttaagttatacagttaaaattcataatgactctcccttatatattcaattataactatgataaataactatgataaaatgtgcataatgatataaatctcatgtcagggcagaatcaagagcctacaattgatttaaatactcacaagttcaagtgatatagatgaattttgcaatgtcaaattaggtaaaataaatctacccagatgtcttgccaaatatgcgtacacatagttgcagccttcagctacatcatacatatgtccccttgaaacagatgtatatccatattcactcaggaaattgtgtgtgcttgcatatcaaatataaaagaagaatgaatgtgcagatgaaaataac

SEQ ID NO: 845 - DNA, 57810 bp, Homo sapiens; identical to SEQ ID NO: 78

SEQ ID NO: 846 - DNA, 65521 bp, Homo sapiens
aaacccaccatttcaggatgaaaaaaaatggttgttgaaatgactaaatttgtaaaacgaaaaagaaattactgcctggtaagagttcacttgaaacaactttttttttttttttttgaggcagagtatcattctgttgtccaggctggagtggagtggtgtgatcttggctcactgtaacctctgcctcccaggttcaagcgattctactatctcagcctctctatagctgagattacaggcatgcaccactgcacatggctaatttttgtatttttagaagagatggtgtctcaccatgttggccaaactggtctcaaattcctgaactgaagtcatccacctgcctcagcctcccaaattgggattacaggtgtaagccactgcacccagtccaaacaatatgtttataaagcttcctgtagttcttctttttcttaagaagtttccttttagtttttatccatttatttcatatatgtttttgttgcccctccagatacatagtgggactcttgaattttttgtgttgatttatcttcatggatattttaggaagaggttgggacaagttacaatagtactggcaacaagatgtcatttaaaacaggatgttcccagagtaagtctcatggtgtttatgatatttaaggcaggttctgagaggtttttatataagggtccctttctgtgctcttcaaagtctgcgatattgctacagtgttacccagtcccactccccccatgaaagaaaaaactcaagacagtggccacatctattcctcctccttttgtctaatgcatgttcttgcatgtgcttggatggagagggctgtatgggatcctgtgctgatgaccactgctcactcacagtaccccaagcatgaaaacaaagaaagggctttctcaggggtgggagattgttcctctagcaaatactctgagaggtctggtcctttaagcctggagagagttgccagacttgctcaaggagccacatcccttccattttaaccactttctccctctgcaccatgtacaaataccatgccccacacccatagacattgccggctgcgcaaacctccccgtgtaccttctactagataccctcattagagaaacttagaggttgatcttaccatttcttaacttgtccaaatcttctgcagattttataaatttctcttcaaactggaagcagaaacagtaaatatgttcttgttagttcattctattatagacctgtgaaattgaatggcctctatctggtgcatcatttggagaatataagatttctgagtttggcagggtacacagagggggctagtcatggccatttggaaatttagacctaattcattgagaaaagtgcatgggtcacagcacatagctgctcaatcttctagttcacttcacctccaccttgatatgaatgtctatgattaggtcatgttttgagagggacatcactggagaaaaggcactgagcagttcttctagttatggtgttgtcatatcttaggaaagcctgtgtctccaagtgagatcagaccacaaccttgtgtgtccccagcatgaggcatgacatgggctaatggccatcaaatattctgccaccaaggagcctctgctgtaatttgtatcgccccacttctcaggaaccctgctaagggtgacataggtcgccactgttgcacagctttcacacttgcaactgtaattttctcttctgaagtacgtgagacacaatagggtaaaattctcaatttaataaaggaattagggtcccacactagcattatttttaaggaaaacctctggtttctgatgtggttttgtggcattggggaatgcttgtgtgttctagaagcctcctcccctcattttaaccacgtgtttatttctctgcatcctcatagacacgtaggctgccccagggcagggactgtgtctgtcttgttcactatctccatgaccgagtacagaacctggaattaataagtgctcaagtaaataattgctgtgaatgtagtcaatctttaataggtagtttgttacaatccactcccttccatctctcatttgtagtttgcattttacctctaattacaatcattttttaatattatgcatttttatttttttattgtggaaattatgaacatgaataaatataaacagaaaagcataatgattctccttatacttctcacctagaatcaataattatcaatcaaaaccaatatggtttcatctatatgcccacctacttctcctcttgtaataattccaaggaaatcccagatccatatgattaatccttaaatacttcaatgtgttttcctaaaacacattaactattctaaagacagccatagtacattatcacacatgaaatattaacaataattatttcatgtcctcaaatattcaatcgatatttgtgtttctaattgttgtataaatgccataaattattttttacagtttgtttaaattctaatccacttaagttctgcactttgtgattagtgtcttaaatgtattttaatatgtatgcttttagaggagaagaaattttaagaattaataggtcaaatctgttcatctttttcttaattacagtccctttttatttaaggcacaatgcttcagttagtaatcatctcatagtttctgtgggaaaagtatgtgataacgcaatcgtaaatctgacttaagatgacctaactcagaacctacctctactccagctgcagccaggagccaccggatggactccattctgccccgtatattggagtagtggagcttgggcttctctgccatggtagcagtctcctggaggtttctctaagcctgagtgaatgaatgaatgaatgaatgaataattgaaacgatagaatcaaaaatgtactttaggatgtatggttgaaaaccacaaacaatgctgaagaagaacctgccttcttcatgacggtgttggaggagttcccggaatgttttcttggctcaaattattacccagcagtggccaccctcagattccagcaaaccagtctcaagttttcactgtttaactctgaattttcttggcagcctaagaggtgagagtatgtggtaataatacatgtataggagttaatgggaagaggaagaattcaagaactaatatttactgaaaacttcctagtgatccttcctcaatgctagtccctttcaatattttatatctttaaccctccttatagtcccatgaaatgattatctccattttttcgttaatgaaatggaacatcagagaaatacaatgttcacagtcacactccggttggtgatggacatgaatatctacaccaaggactaaaatgaaatcatgcctggaagccagctgggtgaaggccctgggaacccatgaactggccatgaaaccagaggatgtcactgacagggaggaccggctgggagctaaatcactcttcagctctttggctgtgagactgcatttgatcaaaaccagaaattaggcctcagacttgtttaactgtagctagaagatccaaattctttcaagagacagagattgtttatcccttgcttcttttggaattctgtattctaactctatggggtgcattttgttttataagctggaagaagagatgttgctgcattaattttgcaatatggaaggagctagcatttgttcaacatcagtcacacactgatcattcttctaaacttctctttgttttatcctacaaaaattacctaaggttaatgtggttgttattctcattttacatttgaggatactgaggtttttaaagtaacttgctcagagtaaatgatagatctgggatccagggtcactgctattaaaaaccaaatactgagtcttattttctatgttagtgtttctcaaatatgcatggtaatctctcagcagattgtgaaatcccattactttaaaaaataaatagaaaagaaaagaatagaaaatatcagtgagcatgacatgttgaaaggtaagtaatgtttcatgagttgttagtttcagttatttgtatactgtgtgtatggatctttgcatgtgtgcatgctcacttggtcattgtaaatggttagagactgggcttatcagtgaaatttgatagcccttgctctatgccaggctgtttgggtggtggaatgtagcagagtatcagagaatgaaaaccagtggctgcagagacagatgcaactaattgtatcatgaatgtgaatggaaagacacaggactcattgaaagaaggagttccagtgccaggacttaggaatagttgcgttttatcaccaaacccccagctctgttattaaacattaagattcttcttgcaaagttttgtggttgttgagtgtggaacaaaaatatacttgcctttaacaactaatgtatttatttgttttttttttttttttttttttttttttttttttttttgagacagagttttgctgtttttgcccaggctgcagtgcaatggcgcgatcttggctcactacaacctcagcttcccaggttcaagtgattctcctgcctcagcatcctgagtagctgggattacaggcacatgccagcacacctggataattttgcatttttagtgaagacagggtttcagcatgttggacagtctggtctcgaaagtctgaccccaggtgatccactcacttcagcctcccaaagtgctgggattacaggcatgagccactgcacccaacctcaactaatgtatttctaaaaaagtatgcatgattaaaattaggcatcaaaatcttttaaatgtctacattttaaaatatgggagtcaatagtttaacctttggaaagtaaagaattctttgaaatcatactgaatcaactcacctgttttgtaattagatattttgacattgtactttctatgataactccaggagtaaattaaagtaacttgggaaatggaaatagcataattcgacagaatgaaagggagagtgaagttcacatgaaagcgtagggtgtgcttgtttaattgttatgtactagagttcacagtgtcataattccaatccccaaaataaactctcttagccattgatcgaggatcatgtttcaaaaggaagtgaaattttatcttacataatattttatcacaacactccagctgataattaacatatcacttcctcaatgtgaggtttccaagggtcaggctaagactgagacataagttaccattgagctttgttgggtcaacagaaaatgagaaccagagagctcaaggatttgccatgggtcatacacacatgctcctcattcatagtcaatatctagggagtgtgtttaccttctgcaacaaccctgggaaatggctcctattatcctaattaaagatgggtacactgaatttcagagagctaaagcacctgtctcatgctgcacacgtggtgagtgttgggtcagcctgaacttctgattgcaggtccggagcttttccactccacctcataacctggctctcagctcctgtctgagaagttgttttgtattttcctattcaatgtatattagccaaataaatgttggaaggagagggcgagaggggaacatctaattcctgagttcctcctgttagcaacttttcaggggcttgcttggaagaaaaaactaataaaagtgtgcctttctctactttgacaacctaaaaaccagagtgagttgaggactagtgtaattactttacatcaataattaatttacatcaattaaaaaatgggcttgttttgaaaggactataaggtctcatatttccaggagtaaattaaaggagttacgtctctgaggttgtcccagtgacactgtttcttatcagagagaagggagaatgagataaaccatgactccttccattatgagattcataaatgcagtaggttgtttaatctctgagcctcaattttctcttcttagattagagatagttatttctacttttgagggttgttgagaaagttaaatgagataatgtagaaaaaaatcatagtaggaacacagggtgtttgctcttgtcccagtgcttggaagatgggtgaggctctggacacattgagtagcccatggatcttctttctttgatctatctatccaccaattattttaccaaccaacaatctatgtacatgtatctgtttataatctctgtctacccatccatgtatgtattattttatctatcaatcgttctatgtatctatctctctgtaatctgtctcttcatcatctattatctatcttgtatccatttctctggttctctatattttgtccgtagaactctagtaggaataagattttatatgaatccagacttatatcaaatctgtcatatgatggctctctgtttctctctctctttgctttttagctcctgtacagaggtcaatgatattcactaatcagcccacctggattaacaggaagttttcagtgaatgtccaagcagtggggcacatcggtaacacagccttgcttagccccatgaggtcatgtagtcccatggttctcaaccagggggattttgttcctctgctccagaggacattgagcaaggtctagagacattttgggttgctatatctgcagagagggaggggggctacaaatcagataggtagagggcagggatgtgtggggaaaagaaagagagatcagactgttactatgtctatgtagaaagaagtagacataagagactccattttgttctgtactaagagaaattcttctgccttgagatgctgttaatctgtaaccctacccccagccctgtgctcacagaaacatgtactgtgtggactcaaggtttaatggatttagggctatggaggatgtgctttgtaaacaaatgcctgaaggcagtatgcttgttaaaagtcatcactattcagtaatgtcaagtacccagggacacaaaacactgcggaaggccgcagggacctctgcctaggaaagccaggtattgtccaaggtttctccccatgtgatagtctgaaatatggcctcgtgggaagggaaagacctgatagtcccccagcccgacacccataaacggtctgtgctgaggaggattagtaaaagaggaaggcctctttgcagttgagataagaggaaggcatctgtctcccgcttatccctgggcaatggaatgtcttggtgtaaaacccaattgtatgttccatctactgacataggagaaaactgccttaaggctggaggtgagacatgctggcggcaatactgctctttaatgcaccagatatgtttatgtatgtgcacatcaaaacacagcacattttctaaccttgtttatgacacagagacgtgagtttgttcacgttttcctgctgaccctctccccactattatcctattgtcctgccacatccccctctctgagatggtagagataatgatcaataaatactgagggaactcagagactggcgccagcgcaggtcctccatatgctgagccccggtcccctggacccacttttctttctctatactttgtctctgtgtctctttcttttctcagtctctcatcccacccaacaagaaacacccacaggtgtggaggggcaggccaccccttcagggatgcttagaaatatcctagagtgggcaggacagatctccgttcaaagaattacacagttcgcagcaacagtcagagcctctttcttagctattctctatattggccatgagttggtagtactccagagacagaatatgacttgtcgtcgagctaattagtggcagaggctcaactagaatctagtcctcctaacattcaaactaattttttctaattataataaaccttagttttgaattttcacagccaatatagaattacagtgtcacaatttacaattgtgtgttgactatatatataaagaaatttttgcatacattgccacttcttccagcactgattattctcagattgtttaaaatgctaccatttcttttttctcctcatgtcattgtttcccatacctttaaatgctgaggccctggttttctaaactcttcatttttacatttctgtaaagatgtatccaacagaaaagaaataaacagttcttgaactgtcacccaaacacaccaagatggcatgatatgagtaaaaacaaactttttcttgtgctaaggacacatattagtgtatttttctaggaggctagagaggagggtgtgaggcaatgtagagagatttataagatcagtacttactttgttaaatgctgtcacctttgtggctggacaaccgaattccaggtcctaatgtatttataagctctttgttcctctcaatagttccctcccactgaaagaagggtcaagttagggaaaagccactcccacacatttcatggccaaggggccacctactggattctaagacatgaggcaagtgatctgcttatcagaagacactggttaatatgttccttttcaaggttggtaatcaaagtttaaacaatacatttcacctagattttgctctttttgcaagtcagcagaaactggctttttaaagatactttttttcatgagttggatgcaaagactagggcaactgaaaaaaccctattgtgagcatagctgggagaggatgtctgtgaagggcaagctgatgccaccgttttcttactgggttgccaaataaaatataggacatccatgtaaatgtgaatttcaggcaaacaatcaacaattttttagttatagctatgttccaaacacggtatgaaaccagattatactgaaatattatttatcgtttacctgaaattcacatttaggtgggtatcctgcattttatctgacaaatccgggaaccctatttgcatatgctatcctctttgcgtcactcaaattgcccataatataacaaatatgaaagtatccatcacctggattcatcaattgcaaatattctttcttcatctacaccatgtagggggttatgttggaccccaagaaagacaggtccatatataaatccctagatcctgtgaacttgatcttatttggaaaaaggctctttgcagatgtaatgaagtaaaagaatttgagatgagatcatcttggtatatctggataggccccaaatccaatgacaattgtcctcacagcagagagaagagaagacacaacacacagggggtgaggtgcaggaagacagaggcagaaattagagtgatgtggtcatgatccatgaaagtccagaaaggccaagagccccccgaaactagaagacgcagggaaggattcctggaaatcacttctaatccaaacacgctggcacaatgacacaccagggaaaaataattttaaatatagttacttatacgtaattcacatataccatctgtatcttcgcagccaggcctgagtggcactgaacgaactgagggaaggcttatgcccgggtccccacagagccttaaggaggagagtgaggatgagccaggagcacatgcactgtaagggatgacaagttggcctgagagcagagggtgggtctgtttgctcttcaatatttcctcacctcctagaaaactgagggatccatagcagacagaaaggttgtttgaaaatgcataagaaaaagtgttttcatgagaaataaaatggatgtcaaggaaaaaagaaaatttcattttgccattccccagaatgataactgttttcttgtgcagaatgtcagaagtaaatttctatacatgagtttttgataggcaatttcacaaatgttgcaggacaattcttgaaaaagtcaaacaaaccacatagtctacattgtactttttactaaatttttaattccaagaaaatttatgggcagttcggaaatctgatttcatatcagatactaatgaaaagaaatcaattttaactaaatctggtcataggcattttactatgtaattagcatacaatttttaaaaagtttattaacttcacaatagccacaaccaacatttagataaagcaatttattgttgcaaaactttagaatattggtattgcatgttcttggcatccatgcctgctttatcaaaccttgaaaatctttgttgcttcttgtaaaccttttgcatctatgggaagcttcctcaggctgccaggctgcaaaaacttcttcactgtggggagtttgctgattctgattttcagggcccgcaatgcacaaagcacagcctcagagtgaagccaaggactgacaccaccattaacacaacccagggaatctgcgcccctcctacacaaagaccaactaagttccctctatcagcaccagtagggaggcagaaagagacactacgtgagaaatgaagataagaggaagaacatgcagctcactagcattttcccaaaaaatgtctttaagactttattcagttcagtcttcctaccctcttccttacacatgaatcttgtagattcatggctcttgtagaagatgagaaagaacaatgtgcctgtgagatatcagcacagatcagtctctaagcagaagaagtgaagatatgggaaaattgagttagaaatgaaaatagaaaatgttaaagtcaaaccatggggccactttttcccatagagagatatagctttcggggacagcgtgttgggagagctgtgcacaaggaactcagttatctgacagcaggagccagagcataaggaaggaaccagatggaaagggccctgctcagacacacttggtgtgggaagataagggcatattgggataaagggcatcacagagaactcaggaacagaaaccacagtgaaataaagggatgaggagagatgctgggccctgggtccttggcattataaaaagcgaaatattcttggggtagcatgcacatcagatttccttggcataacaagaaggcatttccatgcctcagaatcaggacttggaagctcattttggagacctggggggccctgaagacctggagaaggctgaggtcagaatgtggccagtccaagggcccagatactagatcccaagatgggagatgaggagctgcctcttgaggactgggaaatgggtcacctttagcacagggaagttggagatgaggctggagtcaggctcttccacgtggtagagaagtttgaccaggtgaatgtcagcctggctcagcttgttgccaatgaagtagtcttgttcatggctcttcaacacctggagaatcagaggaatcagatcaggaacacatgtgcaatgaggctggggcctctgcttctccctgagtttgtccaggctgactctccctctcccacctctgcttccttactgggcaggtgcagagatccagacctttctccatgttacctgattcagtgagagagtaagaagtgtggctctgctcactccttgtttggagcccaggctcccattttctcttctcattccacatcactatggcatccacagcacccacccagcttgcaacttccacatgggccaggggcttatcccctgctgcagcctgttctgtctgccccaggccctacagtgtgcatccctgatgttcaatggctctacacactctctctccagtctctcttgggcagcgactccaccttcatgacagcactcttctcccacgagtagactatttcagaatcctcatttctcctcatctgccctcctcatttcctgctctgggatctgaaataagcctgggtgaactttaattcatcctctttcttgcaatggtggttcttactgctttgactatgttataatctgcatgccactgtgtcccagggtgaactgcaaagatgtctgcaacttactttgaaatgcacaataataataataataataataataataataataataatgtgtttgagtgaggcaaacaggggtggagtgactgacacgtgataaatcaaagataaaaggttaactttgctctttagatccttggtgtatatatgttcataaaacatttctttggactacactaggtgtattcatttttaataatacaatttttgactgatatatgatatttattaaaatatctcagcacattgacatcataaataataaaaagagaaaacatggcaacattgatttaagataatattttggcaaatacattttcacactatgtatacatacaaacgtatagataatgacttggtacacaaacaaaacaacttcaatgctatattgtaatatacattgttcaaatgcacatatcacaggctatttggtagaactcgtagtattcttattcacagtctatttttataccatgccttgagagtcaggtgctccattaacatcaaggaaagctttttggaagtgaaggtcaatgccccaaaaatacacaggtactattttatttttctgttgccttgtgttatggactgaatgtttatgtttcccaaaaattcatatgttgagatcctgacccccaaatctttagaaaagatccctaaaaaatatattctttcaagccattagtaggtgggggtttcaggagatgatcaagtcatgggggtggagctcttatgaatgacattagttcccttataaaagggatcttagagaactcccttggcatgtttgccatgtgaggacatagccagagattggctgtctatgaaccaaggaacaggtgctccccagatgtaaaatctgctggcacattgatcttgtacttcccagcctacagagctgtgagatagaaacatctgttctttaagctacccagtctatggtattttgttattgcagccaaactgctaagaaatcctctaacctcttagtgcccttatagactaaacagcttctatcatgacccttacaacagtcaaatacaccagcattggtcaataactgccagcttccctaatttttgcctctattttcaatttatgaccaaccacagaaagcaaaatatggatctctgactaatcccatagaaatccacacttctagttagccagcttacagcatccctaggccagcaacctgcaatcaggacataactttttctaccatgaatctctcagactttcctgcctacctctgaatctctgacaaatgcaagtgatggtggctgacttcctttctatagcaagctctgtataaacaccttttgcttattctcatttggattgtcttcacttccacagtttttctggaggtttcaacaagacatggtctatgttgcccattgccatggaccccagccgtcaaccaggttcagtattcacaaatgctccttatcccttgtggtaagcccacacctgggctgaactcttttctctttgcactgagctctttgactttattctcaggttggtccttggttttggtattggttctcatctgcttagcatcctttgtagaatcaggattttcttttcatttcttttgtagtcttttgtgttactgttttttgtcatgtgatctaaaggtgttgtttgtcataaaagaagcagcataagagcagaggcccaggagcctgtttttcaagatagcctcacagtacattaagttcgaggttctcattggacccctttccatttgtacaaactttgctgtgggtcatccttaaaaccaaatgaagttcttctctcttgatttttggttcttgttctgcaaacttggcagtgatccagacagaaacatcacagtttccacttgaggcagagtattgactgtgactttagatttactttatccttgttaagtggtaatccatatatcagactgaataattctctattgtagttttgaagctcaaatcacgtagccactaagaagctgaagaaatgcctagggcgagatctggggaaggcctggacaggccaccctccaagaagctccatgtgtttagttatccagaagctcccaggtacggtttcaaagacagggaaataatggcttgttgttccctctttgatcagggcaagctttgcatctttttcctcaggtggatgcaatgagcaatgaagaagcttttcactcaaacctgccctaccttctatatacatatcgaccctgtaagacaaaaataaccaaactgctgagtgccttctgccttagattttatgtttaaacacttgagaccgtgaagctttaggtgacaggaaattaattcagctccactgcgtgccttttatatgctagtcattaggctatgatttttataaatatatttacatttatttctcagaacactctactgtgatagatttatatctaaaatgtttgttttacacatgaccaaatacaggtacaagaaacatcggtgacctgtccagtgtcacagtcatgagagaaattagtggaatcactgcaagtaaccactgatgctacaaatagggtttgctcactctgctgtggtttgttttacacataagcttagcgtgattcatatggctaaagccctgccatttacataatcccaagacagcctccccagcacagtgatctcgaacgtgtctgttttcctctctcatcatactacaaatcccaggctcacttttatgcccaatattagaagttcttaaaaaagaaaaaattaaaataaataaaggaaaaactaggaaataaggtatgtttttaaaagatatccctaaaaatatattttttcaagcaagctactaattttcaaaaaaaaaaaggagttctctcaattgttttccacaaaacattgttccattaccttctccacatgatattggccaattctagtcatgattgtgtttcaagacctcacctaatattcccatagtaacatgggaaaattgtttacatgggaaaattggtaaacatggtaaaattattcatatagttaaagccagtgcatagcataggacatcttctttcttctcatttcaaactgtgtttcctacaaaacttttgtttgtttgtttgttttgagacagtctctttctgtcatcaggccagagtgcagtggtgtgatctcgtctcactgcaacctccgcctcccagattcaagcgattctcctgcctcagcctcccgagtagctgggattacagacacctgccactacgcccggctaatttttgtattttgagtagagatggggtttcgccatgttggccaggctggtcttgaactcccaacctcaggtgatctgtctactttggcctcccaatgtgctgggtttacaggcgtgagccaccgtacctggcgaatacttttaaaataacagctgtattgacaagtattcacataccataattgccacccctttatagaatattattcagtaatttgtagtacatttacagaattctgcaaatactatctccgtctaattccagaacatttttatcatctgggaaagcagtagcacgtgctttgacagccatttcccattgccccctttctccatcccctgtcaacaactgatttgctttctggactcaaatggtctggatggttcatacaaaagaattcatgtcacatgtggcctttggtgtctggtttcttttacagcacatgttttcaaggctcaccaatgttggagcatgcatcagtacttcatcccttttttttaaattttattattattatactttgagatttagggtacatgtgcacaatgtgcaggtttgttacatatgtatacatgtgccatgttgatgtgctgcacccacaacctcgtcatttagcattaggtatatctcctaatgctatccctcccccctccccccaccccacaacaggccccggtgtgtgatgttccccttcctgtgtccatgcgttctcattgttcaattcccacctatgagtgagaacatgcagtgtttggttttttgtccttgcgatagtttgctgagaatgatggtttccagcttcatccatgttcctagaaaggaaatgaactcatcattttttatggctgcatagtattccatggtgtatatgtgccacattttctttttttttttcctttttttttacttcaagaaatattttatttatgaacttttttttcttttttttaattatactttaagttttagggtacatgtgcacattgtgcaggttagttacatatgtatacatgtgccatgctggtgcactgcacccactaactcgtcatctagcattaggtatatctcccaatgctatcccttccccctccccccaccccaccacagtccccagagtgtgatattccccttcctgtgtccatgtgatctcattgttcaattcccacctatgagtgagaatatgcggtgtttggttttttgttcttgtgatagtttactgaaaatgatgatttccaatttcatccatgtccctacaaaggacatgaattcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctaggtctagatccctgaggaatctccacactgaattccacaacggttgaactagtttacagtcccaccaacagtgtaaaagtgttcctatttctccacatcccctccagcacctgttgtttcctgactttttaatgattgccattctaactggtgtgaaatggtatgtcattgtggttttgatttgcatttctctgatggccagtgatgatgagcattttttcatgtgttttttggctgcataaatgtcttcttttgagaagtgtctgttcatatccttcacccactttttgatgcaattgtttgtttttttcttgtaaatttgtttgagttcattgtagattctggatattagccctttgtcagatgagtaggttgcaaaaattttctcccattctgtaggttgcttgttcactctgatggcagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttgtggttttaggtctaacatgtaagtctttaatccatcttgaattaatttttgtataaggtgtaaggaagggatccagtttcagctttctacatatggctagtcagttttcccagcaccatttattaaatagggaatcctttccccatttcttgtttttgtcaggtttgtcaaagatcagatagttgtagatatgcagcattatttctgacggctctgttctattccattggtctatatctctgttttggtaccagtaccatgctgttttggttactgcagccttgtagtatactttgaagtcaggtagcgtgatgccttcagttttgttcttttggtttagatttgacttggcaatgtgggctcttttttggtgccataggaactttaaagtagttttttccaattctgtgaagaaaggcattggtagcttgatggggatggcattgaatctataaattacgttgggcagtatggccattttcacaatattgattcttcctgcccatgagcacggaatgttcttccatttgcttgtatcctcttttatttccttgagcggtggtttgtagttctccttgaagaggtccttcacatcccttgtaagttggattcctaggtattttattctctttgaagtaattgtgaatgggagttcactcatgatttggctctctgtttgtctgttattgatttataagaatgcttgtgatttttgcacattgattttgtatcctgagactgctgaagttgcttatcagcttaaggagattttgggctgagacgacggggttttctaggtatacaatcatgtcatctgcaaacagggacaatttgacttcctcttttcctaattgaatgccctttatttctttctcctgcctgattgccctggccagaacttccaacactatgttgaatagtagtggtaagagagggcatccctgtcttgtgccagttttcaaagggaatgcttccagtttttgtccattcagtatgatattggctgtgggttttgtcatagatagctcttattattttgagatatgcccatcaatacctaatttattgagagtttttagcatgaagcattgttgaattttgtcaaaggccttttctgcatctattgagataatcatgtggtttttgtctttggttctgtttatatgctggattatgtttattgatttgtgtatgttgaaccagccttgcatcccagggatgaagcccacttgttcatggtggataagctttttgatgtgctgctggatttggtttgccagtattttattgaggatttttgcatcaatattcatcaaggatattagtctaaaattctctttttttgttgtgtctctgccaggctttggtatcaggatgatgctggcctcataaaatgagttagggaggattccctctttttctgttgattggaatagtttcagaaggattggtaccagctcctccttgtacctctggtagaattcggctgtgaatccatctggtgctggactttttttggttggtaagctattaattattgcctcaatttcagagcctgttattggtctattcagagattcaacttcttcctggtttagtcttgggagggtgtatgtgccaaggaatttatccatttcttctagattttccagtttatttgtgtagaggtgtttatagtattctttgatggtaggttgtatttctgtgggattggtggtgatatcccctttatcattttttattgcatctttttgattcttctctcttttcttctttattagtcttgctagcagtctatcaattttgttgatcttttcaaaaaaccagctcctggattcactgattttttgaagggatttttgtgtctctatttccttcagttctgctctgatcttagttatttcttgccttctgctagcttttgaatgtgtttgctcttgcttctctagttcttttaattgtgatgttagggtgtcaattttagatcattcctgctttctcttgtgggcatttagtgctataaatttccctctgcacactgctttgaatgtgtcccagagattctggtatgttgtgtctttgttctcgttggtttcaaagaacatctttatttctgccttctttttgttatgtacccagtagtcactcaggagcaggttgttcagtttccatgtagttgagtggttttgagtgagtttcttaatcctgagttctagtttgattgcactgtcgtctgagagacagtttgttataatttttattcttttacatttgctgaggagagctttacttccaactatgtggtcaattttggaataggtgtagtgtggtgctgaaaagaatttatattctgttgatttggggtggagagttctgtagatgtctattaggtccgcttggtgcagagctgagttcaattcctggatatccttgttaactttctgtctcattgatctgtctaatgttgacagtggggtgttaaagtctcctattattattgtatgggagtctaagtctctttgtaggtcactaaggacttgctttatgaatctgggtgcgcctgtattgggtgcatatatatttaggatagttagttcttcttgttgaattgatccctttaccattatgtaatggccttctttgtctcttttgatcttttttggtttaaagtctgttttatcagagactaggattgcaacccctgcctttttttgtttctcatttgcttggtagatcttcctccatccctttattttgagcttatgtgtgtctctgcacatgagatgggtttcctgaatacagcacactgatgggtcttcagtctttatccaatttgccagtctgtgtcttttaactggagcatttagcccatttacatttaaggttaatatttttatgtgtggatttgatcctgtcattatgatgttagctggttattttgctcgttagttggtgcagtttattcctggccttgatggtcttcacgatttggcatgtttttgcagtggctggtactggttgttcctttccacatttagtgcttccttcaggagctcttgtatggcaggcctggtggtgacaaaatctctcagcacttccttgtctgtgaaggattttatttctccttcacttatgaagcttagtttggctggatatgaaattctgggttgaaaattcttttccttaagaatgttgaatattggcccccactcttttctggcttgtagagtttctgccaaggcatcagcagttagtctgatgggcttccctttgtgggtaacccgacctttctctctggctgcccttaacattttttcctttgtttcaactttggtgaatctgacaattatgcgtcttggagttgctcttctcgaggagtatctttgtggcattctctgtatttcctgaatttgaatgttggcctgccttgctagattggggaagttctcctggataatatcctgcagagtgttttccaacttggttccattctctccgtcactttcaggtacaccaatcagatgtagatttggtcttttcacatagtcccatatttctggaaagctttgttcattactttttattcctttttctctaaacttctcttctcacttcatttcattcatttcatcttccatcgctgatacccttgcttccagttgattacattggctactgaggcttgtgcattcgtcatgtatttctcgtgccacagttttcagctccatcaggtcttttaaggacttctctgcattggttattctagttagccattcgtctaatttttttcaaggtttttaacttctttgccattggttcaaatttcctcctttagctcggagtagtttgatcttctgaagccttcttctctcaactcatcaaagtcattctccatccagctttgttctgttgcgggtgaggaggtgcattcctttggaggagtagaggcactctgatttttagagtttctggtttttcggcactgtttattccccatctttgtggttttatctacctttggtctttgatgatggtgacatacagatgggtttttggtgtggatgtcctgtttgttagttttccttctaacagtcaggaccctcagctgcgggctgttggagtttgctggaggtccactccagaccctgtttgcctgggtatcagcagcggtggctgcagaacagtggatgttggtgaactgcaaattctgctgcctgattgttcctctggaagttttgtctcagaggagtacccggctgtgtgaggtgtcagaccgcccctactagggggtgcctcccagttaggctcctcgggggtcagggacccacttgaggaggcagtctgcctgttctcagatctcaagctgcatgctgggagaaccactactctctttaaagctgtcagacagggacatttaagtctgcagaggttactgctgccttttgtttgtctgtgccctgcccccagaggtggagtctatagaggcaggcaggcctccttgagctgcggtgggttccaccctgtttgagcttctgggccgctttgtttacctactcaatcctgggcaatggcgggcgcccctcccccagcctcgctgccaccttgcagtttgatctcagactgctgtgctagcaatgagtgaggttccatgggtgtaggaccatctgagccaggtgtgggatataatctcctagtgtgccatttgttaagcctgttggaaaagcacagtattaaggtgggagtgacccgattttccaggtgccatttgtcacccctttctttgactaggaaagggaattccctgaccccttgcacttcctaggtgaggcaatgcctcgccctgcttcagctcatgcacggtgcactgcacccactgtcctgcacccactgtcccacactccctagtgagatgaacccggtacctcagttggaaatgcagaaatcacctgtcttctgtgccactgactctgggagctgtagactggagctgttcctattcagccatcttggctccaccccttcatcccttttcataccccaagaatattccattgtctcctacagcacatcttgttcctccattcatccatgggtggacatttgggttgtttccaccttttgcatatcatgaataattctcctatgaacacttctgtgcatggattagtaaggatgtgttttcctttctcctggatgtagacctggtagtggaattgctaggtcattggtaactctatattggacttttcaaggaatggccatcaagggaggagacccctcctcccagctttgctgatgcaaaatcagtctggctgcttaggtctgtatcaaatgctgcacttaggtaagcctagtatcttgggcaccagcctctcaaaccttagtcaagttgaccagttaatacaactggctggaaacttaggttcctggtcaccattcttggaattactggaacctgagattcagctcctttgcagcattctctccccaggccttcatctaccgactctcaaacattctatgccttgtcctaagctgttggctggagtccagcctctgaagtcctgagcacctggaatcatgattccccatcctcctgagttcatggttcatcagcgtttggaaacctctgtcagggtgctggatccataggctgcattgtcttctagaatcacactcgcctgaaccctccccatattcactcttttctcatctccatgggactctgcaatactggacacaagcatatatgcccaaggcccagcctgctgctagttatgatgctccttcaacagtcctgcccactcacagaaggacctaaatcactctgtgttctctgttgattgaagaacagaaaatatactatatggggctctctcctttatgtctttcccacacaggttgtatttgctggcaatgtagttgagaatggctctggtctgcaccagcttcatcccgtcaatctcaaccattggcacttgttggaacatgaaactctcatctttagaaaatagaaaaaaaaaaggcagagtgaaatttctatgaatcccaccctttcaggatgaaaaagtggttgtggaaatgactaaatgtataaaatgaaaaaaaaattgcctggcaactgttcaaatgaaataggaatttgtttttagcttctggaagtgctttttttcatttataaatgtttattaaatgtcagtaatttttacaaagcaaatatttatagcaagaggcaagtgttttgcaaaatatgtacaaaagtaaaaagctgtaatgaactagcaattcattttataaaatcaaaccattctctccacttttagacctcctttagaaaaaatttgttgtccatcctgaactaaagcactgacaaaaaaatttacaattatcagataatgtgcttagttcctggaaagttataaaaagatatatgtaaaaaaaaaaccctaaaccacaagtattttatagagctaatacaaatcatgttttgttaagtacagtatctatgggattattacaaaatatacttttctataaggcttcttgtggtaaatgtgctctcaccagagtagtatagaaaagccatttcaaatgttttgcgattctgccttcaagtaagaggtaaaaggtaaatgccatagtttgttgcgctgttgcatatactttgcaagaattaatctctacccctttctttcctagtaccatcaaataggcatgattaagtacaaatgtatcacttactatggcaagaaatattataaacaaaccaaatattataaaacaagccaaagtcacataccaagtaagttgtacatgactttcagtgatattcaccgactgaaacatttatgcatagtgagttccagcatactctgatccatctgtaaactttcatcaacagcagatttgtataggtcacaaaactctcctcatcaagacataaaatattgccatatcattcatgctttcaaaacaatgatccatataagctcttgcatttgaaaccaggtatttagacctgaatgctgcaagagtgaacataacttaaatgctaactatacattcaagtacagacataagagtgctagtggtacaaacactgtacttcaaataatgttgttaatcacctaccagcctaaggctagtatctacttgatggaacttgaaaaagccacaaagtccaacttgtttaaaatgttcagacatagacttatacttaaagctctagtatacatttattaagccctaacctcgtaccataaaaaaatgggcatgtgctatatttgggacatgcagacacacccacgcccacccacaatctctcccctcctcctgtttactagactgaaaagccaccctgtatcctatcattaaaaaaaaaaaaaaacagtgcttttagtcaagcagcacaacacaaggacggatcatctgtgattaacagaagagaacaccttaaaataatgggggagagacaaattaactaggtactaagtcagatttccaagtgaaaaagacatgagcaaaacttctggtcttaattcctcaaataaaatgaaaataaataaaatggtaacagagtgactttctctaaattttttagggagtttgttacaaacctttgggctttacaggcatgatttcatggattcaaacacgaaattaacactgatatttagccttctcatgacacacacagaaataccattgctgcaaattgcaatggagcgaatcttgtttcaaatggcttagtttggggttttgtctaaatgtatcattatataatgaaagcaccaattagagggtttctcaaatagtgatttgaattttaggacataacagtataacatggtagctttattcttcatatataaacaaggcataattggatgtgtaatatgctgaaaatacattttatcaaaagcataaatacaagtatttgggtacacattgatcctgttatttcatttatgtttttatcccccatccagctacaaaataggtcccttgtattgtctgtgttgatttatcttcatgatatcttagaaagaagttgggagagactgcaacaggccaccagccagatgccatttaacatgggaatttctcaaagtaagtctcatgctgttgaagacattaaatacagttctgagagaagtttctatgtaggctctttgtgtgctcttcaatacccccattagacagtgtgtgcagggcaggctctgtgtttcttaccccatagctgctaccctgactcatgtccctcctcaccctctgacctgcacatccaaccaattcaacactgtctcattatctaagtctacatcattgaaaaaatatcaccttgtcaaacttataagagaaacaaattcaaaatggacctatttcaactccttttgtctaaaatctgtccttgaatggggtgggctatatggcatcctgagctgatgaccacagctcactcatggtgccaaaagcaggaaagtaagaaaagggcatctgcagggcgctgcatatggttctccagcaaatacaaagagaagtctggccctttttagcctggaaagagttgccagaccggctctaagagcccaccctttccattttatcgattttctccttctccaccatcaacaactacaaccttacatacacaaagcattgcttggctgttcaaacctccctgtgtatcttctactagataccctcctcagaggcacttagaggcttgatcttaccatttcttaacttttccaaatcttttgcagattccagaaatttcctttcagactggaagcagaaacagtaaatgggctcttgttaattcattccatagcattgcagacctttaaccttgaatggcttctgtctggtacataatttggaaaatataagacttctgatcttggcagagcatgcagaggaggctggtggtggccattttgaaatttacactagatcatcaagaaaagggcatggatcacagcacatagtcgctcaatcttctagttcactttacttccaccttgatcactcccatgtccctgattagggcatcatttgacaggggatgtcactggagttaagggatcaggcagttcttctaattatggagttgtcatatcttaggaaagcatatgtctctgagtgagatcagaccacagcctttgtgtccccagcatgggtatgccatgggccagtgaccaccaaagattctgccaccaagggccctctgctgtaatttacatcagctcagtttgtaggagccctgctaagggtgaaataggtcatagctgttgcatagttataactctggcaattataatttcccctcctggagtatatgggacacaataggatagaattctcaattttaggaaggaattaaagtccccactgtaacattatttttaatgaaaatctctggcttgtgacatggctgtgtgggtttaatatcctgtcatgtcctggcttcttgacttcggacacattgtagactccctctgtgtcttagtatcctaacctatgaagtgggtatacttatggtacctatgttataggttggtatgaagattaaattacaaagtcatgcaaagcactcagaaaagtagcaagtgtataataagtgctcattaaatagacactattaggattctgagagatggctgctgtttcatatcatcattaaaaaattaaatcaatctaatattgatgataatatactatattgctgatctatatccagtgatttaaactttgaaataaatcacaccttgtcctgagtgtagtcactttggttggaatggcagccagcaataaggctgtctcaatctgatcagaagctctgagtggatgcaagtatttaatacaaatatgaaaaccagttattgcataaaaatacagttgacttaataggcagaatctataaaaataaaaatcaaagtagacacttatcaagattttctgtatttcactgttgatatgatctggtaccaatcttgactctgcctcaaaatagctgtgtgatctgggaatcatcacttaacatcttcaagccttagtttcctcatctgcaaaatggggatagaacattttcttaaacagaatattgtaatgttttcaaaatgcatgatacagggcctgacccacatacatcaaggaataaatggtagttgtgtttgcagtggttacttatagtttaatggagatctttatggtgaaagttcaggaatttgggggtttctagcttgctccatggaaaagagtttgttgtggatctatgattgcacagtagcaggatctggagatcatggggggtgtgtgccagcaattaataaagcgtccaattcaggacaaacctaaggaatggtgggtggtcctggcaggagggtgaccgaggtggggtgggattggcaagtgggatgtgcttgtgaggctgaggactgggttgtgatcatcagccttagggcactgagaccccagaagcctgagtaaggtctgcagtcagcccttccactgccttcagtcaagctggatggatgccagggaacctgggttcctcccagccttgcccctccctccctcctgctgaactcttcctacccgggctctgaacacatccctgagctgcagagctgatgtctgggtgacagtgaaacagggtattcatttgtacaaagaaaacaacctggaatggcagtgtttggatttcttgtgtgcttacttcctcataggattgagaaagggtgaggctaaagggtttggcccacaaaaccatttttctctctaggcctctaggcctgtgatgggaggggcggtaacaaagccctgggcatgccctggagacattttccccattgtctttgctgttaacatttggctacttttgcaaatttccaaacttttgcaaaaggagcagtatgttcataactgagacttttgcaaatttctgccactggcttgatttcatcccctgaaagtggggttttcttttctaccatatgatcaggctgcaatttttccaaacttttatgctctgcttcccttttaaatataagtttcaattgcagattgattcattcagattcaatgacagatttcagatcatgtctttgggaacacatatgaacatatgctgttagaaagagccaggctaaatcttgaatgctttgcagcttagaaacttcttctaccacataccctaaatcatctctcaagttaaaagtctcacagatctctagagcagaggcacaatgccacgagtctcttcgctaaggcatagcaagagtgactttcactcccattcccaaaaggtttctcatctccatctgagacctcagcctggacttcatggtccatatcactgtcaacattttggacagaaccattcaactagtttccaggaagttccaaacttaccctcatttttctgccttcttctgagccctccaaactgttccagcctctgctccttacccaattttaaagcagcttccacattttcaggtatcttcataggaatgtcccacttttctggtaccaatttcttgtattagtccattctcacacttctataaagacgtatctgaaactgggtaattgataaagaaaagaggtttaatcagctcacagttctgcaggctgtacaggcgtctgcttctgtggaggcctaaggaaacttacaatcatggtggaaagtgaaggggaagcaagcacatattcacatggctgtcaggagagagagaatgaatgggaaggtgctacacactttcaaacaaccagatctcatgagaactctataagaagaaagcactagggggatgatgtgaaaccattcgaaaacaccccatggtccaatcacctcccaccaggccccacctccaacactggggatgatgtgaaaccattagaaaacaccacatcgtccaatcacctcccaccaagccccacctccaacactggggatgacaatacaacatgagatttgggtggggacacagagccaaactatatcaggtgtcatatttttttcctgtgaattattttatagcctggacaggtctcacatctggatccaaaaggaggacatcactgaagctcctaatctttcctttatatttttccccactattaaacatttattccaggacattgttgacttatattctaatggcaccatacatattagctgggttcctttaggtgcattttaaaaactagctataaggctgggtatggtcactcacacctgtaaacccagcactttgggagacagcagcgggaggatcacttgagccaggagcttgagtgcagcatgagcaacatagcagaccatgtctctacaaaaataaacaaattacatcaggtgcaatagcgtgcacctgtggtcccagctactcagtagactgagctgggaggattgattgagcccaggaggtggtgattgcagtgagccatgattgtgccactgctctccagcctgggccatggagaaagaccctgtctctgaaacaaagcaaaacaaagccagttatatgctgcagtaattatttagttattctatcagcttctgaattttaatacttgagaagtcatgtagtctgcagattccaaaccacaaaatattttgctcccataccccagaggacattcagagtatctggagacattcttggttgtcacatcaaggcagaaggtggtgggtagtgcttcaacataggtaggtggaggccggtgatgccttggaacatcctatcatgaacaggacagcccctgaacccaaagaattacccatcccaaggggtgccaagggtaagatgagagacttttccttagccattttcaaggtttgctgtgagttggttgaaccctagatagagaatgtaacttgtcatctagctaattagtgggaaagactgaatcagattctagttttcctgacattcagaaactaatttattcctattataaatcaaccttaattttgaattttcacagctataaagtattacagttacttatatacacattgtgtccctactaaattgtgaggttccgaaagagcagagaggtctcacagtatgtttaacacagtgtattgcacatggtagtattacaatatcactgatacttggatagatcacacagcaatgctagacattttagcagtcacagagagttctataatttcatcttttgaacttccttgatgagaaaatcaaatgatatagaaaaaattaaatagaaaaattaaataatagattccagataatggatcaaccaatcctgattatcagactcaattttctacaatttcacagaataaataaagatatgggtgtggctcactgagtagacccagaaggactaagaaaagaggaatttggaaagagcaaggttatcaggcaagtgtttaattgggcaaaggacaaggattaacagatatttgttgaatcaggaatctgaaaattcacaagaagggcattattgtttttaattttgttaatcattaatctaggtcatcttgctttatagaactaaaagttctaaagacttaaattcacctgtaagttctagaaaactgctctcaaaacattctgcctccctttggagcattacaatcttaaagaaatattgaaaagccaatggcatcaacacttgacaacaaatcacaaagcacttcctgaaagaagcattaatgtgtgatatctaccatcaagttgcaaattagacttgtgcttggcaggtgttggtggctcttttctcagcaggagatggaggtttggagaagcaactgcagacatggaactgtctagttgtatgtcccttttaccagtcattgggaattcccaagtctgtgatcttgccaaatgtaagttcacaataattgtgtgttgattacttgtctagaaaatgtaactttagcataaacacctacttttgctctggcaatgatcatattctcagatgacctaaaatgacattgacaggtgacagtgtgctggcagccctcgcagccctcgctcgctctcggcgcctcctcagccttggcgcccactctggccacgcttcaggagccccttcagcccgccgctgcactgtgggagtccctttctgggctggccaaggctggaaccagctcccttagattgtggggaggtgtggagggagaggcatgggtgagaacctgggctacgccaggcacttgcaggccagtgcgagttccaggtgggtgtggactcgccaggccccacactcagagtggctggccggccccgccggccccaggcagtgaggggcttagcatctggtccaacagctgctgtgctcaacttctcgctgggccttagctgcctccccgccaggcagggctcaggacctgcagcccgccatgcctgagcctctccccctaccccgccccctgactgtgggcttttgcatggcctgagcctccccaacgagcgctgccccctgctccagggtgcccagtcctatcagcggcccaaggactgaggaatgtgggcacatggcacgggactagcaggcagctccacctgcagccccggtgtgggatccactgggtgaagccagctgggctcctgagtctggtggggacttggagatctttatgtctagctaagggatcgtaaatacacaaatcagcactctgtatccagctcaaggtttgtaaatgcaccaatcagcaccctgtgtctagctcagggtttgtaaatgcacaaatgggcactctgtatctggttactctggtggggaggtggagaacctttatgtctagctaagggatcgtaaatacaccaatcagcactctctatctagctcaaggtttgtaaacacaccaatcagcaccctgtgtctagctcagggtttgtaaatacaccaatcaacactctgtatctagctaatctagtggggacctggagaacttttgtgtctagctcagggattgtaaatgcaccaatcagctctctgtaaaacagaccaattggctctctgtaaaatggaccaatcagcaggatgtgggtggggccagataagagaataaaagcaggctgccccagccagcagtggcaaccagctcagttcccttcgacactgtggaagctttgttctttcactctttgcaataaatcttgctgctgctcaccgtttgggtccacactgcttttatgagctgtaacacgcactgcaaaggtctgcagcttcactcctgaagcctgagagaccacgaacccactgggaggaactaacaactccagaggtgccacattaagagctgtaacactcacgcgaaagtctgcagcttcactcctgagccagtgagaccacgaacccaccagaaggaagaaactctgaacacatctgaacatcagaaggaacaaactctggacacgccgcctttaagaactgtgacaccgcaagggtctgcggcttcattcttgaagtcagtgagaccaagaacccaccaattccggacaaaacatcgtgactattttttcccctcatggtattaatttttctactataattaaattctcatagtctagttttctaaattcttcatttttgcgtttctttaatgattgtgagagttgtcagagtcaaaaggagtcacaatgttaggaaaactctgacaacagagctgaaaaaggccataaagagaatgttcttactgtttatctgataacaaaacaaactaggaaaaacacaaccttgaacaaaggccatcgcaatcttaataaaagaatctgttaggacacttgctcagcaactgcctgttgaaacttggcctggcattacccttgttattgacatttgtagtgactgataagtatttcaaaacgtttatttaatcctcattttattcctataaaaatctttgtcttccttaacttccctgaatacatacatagtttactgtgataaacatatacccattacaacacttaattctcaaataaatatcttttatttgaaagggtctctttattatttaagttgaaacaatgtatccaaaagcaggtgaatgcagaacttttaaactgtcatccaagcacacagaaaaggcactaatataagtataaaacagatttttcttgtgccaaggacacattttaaagtatttttctagtgacctagatgggaggtcatgaggtaatgtagggagacttctaagatcagtatttactttgttaaaggctgtcacccttgtggctcaacaacttaatttgaggtcctaatgtggtgtataaactacatgttcgcttcaatagctccctcccactgaaaggaatagagtcaagttaaaaacagccactcccacacatttcagggctgcagaactgcctaccagattctaagaaaaatcgcaagtcatcctcttatcacaaggtaactagttaatatgttccttttcaaggttggcaataaaagtctaaccaaaaatttcagcagattttgctctctttacagtaagtcagtagaaactggctttttgaagacgctcatttttaatgacttggatgtaaggactaaggcagatgagaaatctctgctgggagcatagctggcaggggatgtctgtgaagggcaggctgatggcactctggaagtcttctcttactgggttgccacacaaaatacagggcacccaggtaaatatgaattccaggcaaaggatcagtcatttgttagtataagtatgtcccaaacactgtaggaaacatgtttatactaaaaaagtattgcttgtttgtctaaaaattcacatttatttgggtgtcctgtatcttatccgccaaatctggccaccctatttttacagtgttacctctctgcattgcacaaatcacccttcctggcctctgggcctttgcacatggcatttgtcctgactggaatactccactttcacctcctactgtattttctctattgtgtctttccctacattaatttacatgatgtattcaatatctgatttctccctagaccttgagctcctgagaacagagccttcttatgtcagtccagtccttattgtctgggacaaaacctggacattgtaggagctcctaaaataagatagttttaaaatttacatggaaaaattctggcaaatacaaaagtagagggaataatataacaagcttgaaggtacccatgacctgcattcatcaattgccagcaacatttcttcatctatacctggcagtggattaagttatgttggctcccaagaaagacaggtccatgtccaaatccttgagtcctgtaaatgtgaccttatttggaaaaaggctctttgcagatgaggttaaggaacttgagatgagatcatcctggtatatccagataggccctacatccaatgacaaatgtccctgcaatgtagcgaatagaagacacagacacacagagggtgaggtgctggaagccccaggcagaaagtagagtgatgtggccatgatccatgaaagtccagaaatgccaagagcccccagaagctgtaggaggcagggaaggattgttctctagtacttccaggggaatgtggccctactcacatcctgacttcaggcttctggccttcagaattgtaagcaaatgcctttctgatgtttcaagccacccagtttgtaggaatctgtgacaggagccacaagaaaatgatacaaactcccacatactcccaccactaccaggggattcttttcaagcaaatcccagacagcatatcatttcatctgtaaatactagtattcatctctagaaaggaagaacttcttttctaaacataatcacactatgattgtgtttaatatgataatctcttatcatattaaaattctataattctttaatttcatcaaagctccagcgttctagttcatgtaagtgtcccataaaaatttcttagcagtttgtttattttggtcagcatgcaagcaaggtccttacaaagcatttgagggatatgagtcaattttttttttttttttttagaaattaatgaatgaatagagacaggtagagagtgtgggggtttgtgagttctcaaagcccaatctcatatacccaggttctggagttgcatagagctgtgcatgggtctgtgcagatgtcattgtccattagtgatgaagcactggggacccagcaggccaagcctcacaccacaggctcacagtacaggggagcagacacagtggccctcaggtgttattagaggctcactgggactctgtggagggcagaggacagcccagtgctcctgggaagcaatgaggtagtgttaagtgtgtccactgggaaggagcttgccaggcagggctagcaaacgcacccaggcaggaaggcaagaggccccaccatgctcggagagttgactgggctgaagatcacggagtgaagacaggtgtgaggatgcattgtatatgcagtcaggactcactgaagaattctgtgagtatttttccaatttgtattttggaaaaactactctggttgtaagtggagaagagactagagcaaagtgaagctgcaggtaggaagcctgtgtgtttgtctgctccctcaaccacctctgccaactgtggggaagctccctctaagaggaggagagtgcaaattgcagaagcccaggtgtcctgggagagattagcactatgggaccagtatgggggtggagctagaaagcactcctaatctaagcattctggcacagtgacacaccagggaaaaatgattttgcatatagttatttgtatttcacatataccatctgtatcgtggcagccaggcctgagtggcactgaaggaactgagagaaggcttatgcctgggaccccacagagccttaaggagcagagtgaggatgagccaggagcacacacactgtaagggacaatagggtggcctgagagcagagggtgggtctgtttgctcttcagtatttcctcacctcctagaaaactgaggaatccacagcagacagaatcattgttttgcaaatgcataagaaagaacgcttttatcagaaataaaatgactgtccaggaaaagaagaaaatgtctttatgccattatccaggatggtaactcttctcctgtgcatacctgaaaatgtcagaagtgcatttctacattgacattttaatagattgtatgacaaattgtatgttacgggacaattcttggaaaagtcaaacaaaccacataatctatagtttccttttttactgaatttttaattccaggaaaatggttggctaggagaagattggaaatctgaattcacatcagatcctaatgaaaacaaatcaattttaactaagtcagcgaataggagttgtattatttaattagcatataatttgaaagagttcattagcttcacaacaggcacaatcaacacttaggtaaagtactttattgttgcaaaactttagaacattggtattgcaagttcttggcctccatgactgcgttattaaaacctgaaaatcttccttgcttcttctaaagatttctcatccatgggaggcttccttgggctgccaggctgtagaaacttcttcactgtgggcaggttgctgattctggttttcagggcctgtaattcataaagcacagcctcagagtgaagccaagggctgacaccaccattaacatgacccagggaatctgagcccctcctgcaaagaccaagtgagtctgctccatcagcacaagcatggaggcagaaacagacacccagtgagaaatgaagataaggggaaggacatgtagctcactttattttccccaaagatgtcttgaagttttaatcagttcagtcatctctatctttctccttacacactaatcctatagattagtgactcttgtataagacaagaaaaaataatgtgcctgtgagatatcaacacagatgagtctctaagcagaagtgaaaacatggggaaattatttgggaagggaatagttatagaaaatattaaagacaaaccatgggaccaccttttctcagtgagagatacagtgtggggggccagtgttctggagagctgtgcagagaggaacacaatgtcagacagcaggagccggagcccagggaggaaaccagatggaaagggctctgctcagaccggctcattgtgggcacatatgggataaaggacatcacagagaactcaggaacagaaaccacattgaaatagagggatggggagagatgctgggccctgggttctttccataataaagggcaaaatactctttgtggggtagcatgcagcacagatttcctttccataacaaaagtgttttcattcctcaaaattggagcctggaagctcattttggagaccttggggcactgaaggcctggagaagactggggcaaaacttggtcagtcgcagggcccagatacaagatcccaagatgggagatgtggggctgcctctctgggctgtgaaatgggtcaccttcagcagagggaagctggagataagactggagtcaagctcctcgacgtagtagagaagttccaccagatgaatgtcagcccggctcagcttgttgccaacaaggtagtcttgtccatggctctttaagacctggagaatgggaggaatcagatcaggaacacatgcacacccaggctaggacccctgcttctttcggagcctctccaccctgactttccccacctctgttgccttactgcatgggtgcagaaatccagagctttctccacattatctgaatgaatgagagagtaagaactgtaactctactcactcctcagttgtagctcaggctcccattttctcttctcattctacatcactgtggcatctacaccacccacgcagcttgcttcttccacatgggccaggggcttagcacctgcctccatgtgttctgtctgccccaggccctacagcgtggagccctcacattcaggatgtggctctacattctgctctctccctctccaatctcccttgggcagtgactccaccttcatgacaacactcttccccaggaggagactatttcagagtcctcatttctctttgtctgctctcctcattccctgctctatctccctgggatctgtaggaaacctgggtgaacctgaattcatctttcttacagcattgactctcactcccaactggcactatgttataatctgcaagctgaagcgtttacgggtgaactgcactgatgtctgcaacttactctaaaatccattttaaaaaatcttcctctgcatcccacaatcactctccttttaaaaaatacccatccctgaaacgctacagtattctctggttgggcaattggtctcctatcttcctgcatatggtgccagaatattttctgatggatcgctttcatcatgcccctgttcagtcaaagtccatggggttccatagactcaacagcaacctctagtgtggtccagagcccacattctacttatgaacatgaaatcttgttgaacaggtaattccatgttggggtccagtaaattaaaattttactggaaaagtatagcttgggtataaatgatacaattgtttctccaagtctattttcataaaatgccttgagagtcagagtgctgcattggtgttcaggaagtctcactgaaagtgaagatcagtgacccaggaatgcccagccactatttttctattggcctctaaactcagttccccaaaacactgaactgcttcacttactttttcaaaggcagggaagtagcgattttttattttctctttgatcaaggcaagcttggcatctttttcctcaggtggacatacgggcagaaggaggatcatttcacccaaatctgctataccttctatatacatatcaatcctgaaagacagaaacaaccaaatggtcaaataccttttgccttagattttataggtttataaaaacctaagggagtagagtatcaggtgatggcaaaataattcacctccagtgggtgccttttatagtctagtcattatgctctgagttttacaggtatattaacatttatctcttaacctatcaaggtagatagatctctaaattttgttacacacatgacctaatacaggtaaaaagaacgtcggtggtcacagtcatgagagaaattggcagaatcactgccagtacccactgatgctgtgccaagatttatcatctccattgtggtttgttctgtgcatgaacttagtgtgagtcaaatggccaaagacctgcttcctaagtaatcctaagagagtccctggcacagccatgtcagccatattccttgtcctctctcatcattttacagctcccagggctgcttctatgccccatatttgcagttctttcaattacacccatgaaacacatttccacagccctttccatgtgctgttgcgcaactctagccatgtgtgcctttcctgagaccccacctaagaatccccttccctggtgaaattctctatacagttacaaccagtgcaaacttttcttcttttgtgtcaaactggagtttcacaatactttttaaaacaagaactttattgatgcatattcacatactataattgccaccaggtatattatactattgagtggtttttagtgcactcacagaaatctgtaaaaataaccacagtctaattgcagaattatttttgtcgccctgataaggacacctgtaccattagcagtattcttttttctccaagccccactcctttagctccaggcaagcactaatctactttctacctctatggatttgactatctggacatttcatacaaaaagaatcctataatatgtggccttctgtgtcttgtttcttttatgtaacatgtcttatggcttaactgtcttatagcatgcattagtacttcattccttttcatgaccaaatatctttccattgcatggctaaggcacatttttctccttcatttattgattgatggatatttgagttgtttccactttttgaattctatgaatattgttattcgcattatttatttatgtaaaatatatagtgtggatgtattttcgattatttggggatatacctgttagaggaactgctgggtcattggtaatactatattaaagtttttgaggagctgccagcagtttcattcaggatttatttggaatcatgcagtctcatcacaacagcaaggagaccccttggttttgctggtattgaatcaatctggctgttttgtgcttctatccatgtgtcaaggtaaccccagcatccttggtgccagcctctactagccctgctcaagtattccagttgatatacttggttggtaatttaggttcccggtcatcattcttggaattactgggaccttagctttggcgtctttgcaactttccctccccagtccttcatctacagactctcacatattctatgcctgtcctaaactgttggccagagtcgagcctctgaagtcctgagcacctggaatcatgattccccatcctcctcagttcatggttcatccgtgtttggaaattaccgtgaggtgctggatccatggactgcatcctcttctagaatcacccttgcctgaaccctccccatgttcactgttccctcatctccatgggactctgcaatactggacctcagcgtacatgcccaaggcccagcctgctgctggtcatgatgccctgccatcgtcccacccactcaaggaaggacctaaatcactctgtgttctctgtggatggaagaacagaaaatataccgtacagggctctctcctttatgtctttcccatagaggttgtatttgctggcaatgtagttgagaatggctctggtctgcaccagcttcatcccatcaatctcaaccattggcacttgctggaacatcaaatatccatctttagaaggaagaaaaaaaaggagagtgaagtgtctatgaaacccacccttttgggatgaacaaatggttgtggaaatgactaaatttgtaaaatggcaaagaaattactgcctggtaagatttcacttgaaacaaaaactatatatatatatatatatatatatatatatatatgtgtgtgtgtgtgtgtgtgtgtgtgtgtgtgtgtgtgtgtatatatatatatattttttttttttttttttttggcagagtatcattctgtcacccaggctggagtggagtggcatgatcttggctcactgtaacttctgcctcccaggttcaagtgactctcctacctcagcctcccaatagctgggattacagccatgcaccagtgcacatggctaatttttgtatttttacaagcaatagggtctcaccatgttggccaaactggtctcaaattcctgaactgaaatgatctacccacctcagcctcccaaactgggattacaggcatgagccactgcacccagtccaaacaacatttttaaaaagcttcctgtagttcttctttttcttaagaagtttccttttactttttatccatttatttcatatatgtttttattgcccctccagatacatagtgggactcttgtattttttgtgttgatttatcttcatggatattttaggaagaggttgggacaagttacaataggactggcaacaagatgccatttaaaacaggaagttcccagagtaagtctcatggtgttgtgacatttaaggcaggttctgagaggtttttatgtaagggtccctttctgtgctcttcaaagtctgcgatattgctacagtgttacccagtcccactccccccatgaaagaaaaaactcaagacagtggccacatctattcctcctccttttgtctaatgcatgttcttgcatgtgcttggatggggagggctgtatgggatcctgtgctgatgaccaccactcattcatggtgccccaagcatgaaaacaaagaaagggctttctcagcggtgggagattgttcctctagcaaatactctgagaggtctggtccttttaacctggagagagttgccagacttgctcaaggagccacatcccttccattttaaccactttctccctctgcaccatgtacaaataccatgccccacacccatagacattgccggctgcgcaaacctccccgtgtaccttctactagataccctcatcagaggaacttagagattgatcttaccatttcttaacttgtccaaatcttctgcagattttataaatttctcttcaaactggaagcagaaacagtaaatacgttcttgttagttcattctattatagactgtggccttgaatggccccatctggtgcatcatttggagaatacaagatttctgagtttggcagggtacacagagggggctggtcatggccatttggaaatttagacctaattcattgagaaaagtgcatgggtcacagcacatagctgctaaatcttttagttcacttcaactccaccctgatatgaatgtctatgattaggtcatattttgagggggacatcactggagaaaaggcactgagcagttcttctagttatggtgttgtcatatcttaggaaagcctgtgtctccaagtgagatcagaccacaaccttgtgtgtccccagcatgaggcatgccatgggctaatggctatcaaacattttgccaccaaggagcctctgctgtaatttgtatcgccccacttctcaggaaccctgctaagtgtgaaataggtcgccactgttgcacagctttcacacttgcaactgtaattttctcttctgaagtacgaggcacaatagggtaaaattctcaatttaataaaggaattagggtcccacactagcattatttttaaggaaaacctctggtttctgatgtggttttgtggcattggggaatgcttgtgtgttctagaagcctcctcccctcattttaaccacgtgtttatttctctgcatcctcatagacacgtaggctgccccagggcagggactgtgtctgtcttgttcactatctccatgaccgagtacagaacctggaattaataagtgctcaagtaaataattgctgtgaatgtagtcaatctttaataggtagtttgttacaatccactcccttccatctctcatttgtagtttgcattttacctctaattacaatcattttttaatattatgcatttttatttttttattgtggaaattatgaacatgaataaatataaacagaaaagcataatgattctccttatacttctcacctagaatcaataattatcaatcaaaaccaatatggtttcatctatatgcccacctacttctcctcttgtaataattccaaggaaatcccagatccatatgattaatccttaaatacttcaatgtgttttcctaaaacacattaactattctaaagacagccatagtacattatcacacatgaaatattaacaataattatttcatgtcttcatatattcaatcgatattcatgtttctaattgtataaatgctataaattattctttacagtttgtttaaattctaatccacttaagttctgcactttgtgattagtgtcttaattgtattttaatatgtttgcttttagatgagaagaaattttaagaattaataggtcaaatctgttcatctttttcttaattacagtccatttttatttaaggcacaatgcttcagtaagcaacatctcatagtttctgtgggaaaagtatgtgataacacaattttaaatccaacttaagatgacctaactcagaacctacctctactccagctgcagccaggagccaccgggtggactccattctgccccgtgcattgaagtagtggagcttgggcttctctgccatgatagcagtctcctggaggtttctctaagcctgaatgaatgaatgaatgaatgaataattgaaacgatagaatcaaaaatgtactttaggatatgtagttgaaaaccaccaacaatactgaagaagaaccttccttcttcatgactgtgttggaggagttcctggaatgttttcttggctcaaattgttacccagcagtggccaccctcagattccagcaaaccagtctcaagtcttcattggctaactgtgacttttcttggcagcataagaggtgagagtatgtggtaaaaatacatgtataggagttattggaagaggaagaattcaagaactaatatttattgaaaacttcctagtgatccttcctcaatgctagtccctttcaatattttatatctttaaccctccttatagtcccgtgaaatgattgttatctcaattttttagttaatgaaatggaacatcagagaaatacaatgttcacagtcacactccggttggtgatggacatgaatatctacaccaaggactaaaatgaagtcactcctggaagccagctgggtgaaggccctgggaacccatgaactggccatgaaaccagaggatgtcactgacagggaggaccggcagggagctaagtcactcttcacctctttgactgtgagactacatttgatcaaaaccagaaattaggcctcagacttgtttaactgtagctagaagatccaaaatctatcaacagacagagattgttaatccctgcagcttttgtaattctgtattctaactctatggggtgcattttgttttataagctggaagaagagatgttgctgcattaattttgcaatatggaaggagctagcatttgttcaacatcagttacacactggtcattcttctaaacttctcttcgttttatcctacaaaaatcacctaagatgaatgcagttgttattctcattttacatttgaggatactgaggtttttaaagtaactttctcagagtaaatgatggatcgggatgcagactcactgctgttaaaaaccaaggactgagtcttattttctatgttagtgtttctgaaatatgcatggtaatctttcagtagattgtgaaagcccattacttttaaaaataaaatagaaaagaatagaaaatgtcagtgagcatgacatgttgaaaggtaagtaatgtttgatgagttgttagtttcagttatttgtatattgtgtgtacggatgtttgcacgtgtgcatgctcacttgctcattgtaaatggttagagagaaattgactgggctcatcagtgaagtttgatagcccttgctctatcccaggctgtttgggaggtggaacatagcagagtatcagagaatgaaaaccagtggctgcagggacagatgcaactaattgtatcatgaatgtgaatggaagggcacaggactcattgaaagcaggagttccagtgccaagacttaggaacagttgcgttttctctccaaacccccagctctgatatttaacattaagattcttcttgcaaagttttgtggttgttgagtgtggaacaaaaatatacttgcctttaacaactaatgtatttatttatttattattaattttgagatggagtttcactgtttttgcccaggctggagagcaatggcgtgatcttggctcactgcaaactcagcttcccaggttctagtgattctcctccctcagcctcctgagtagctgggattacaggcatgtgccaccacacccggataattttgtatttttagtggagacagggtttcagcatgttggacagtctggtctggaacgcctgacctcaggtgatccactcgcctcagcctcccgaagtgctgggattacaggagtgagccactgcacccggcctcaactaatgtatttctaaaaaggtatgtatgactaaaattaggcatcaaaatcttttaaatgtctcattttaaaatatgggagtcaataattaacctttggaaagtaaagaattctttgaaatcatactgaatcaactcacctgttttgtcatgagatattttgacattgtactttctatgataactccaggagcaatttaaagtaacttgggaaatggaaatagcataatttgacagagtgaaagggagagtgaagttcagatgaaagcatggggtatgcttgtttaattgttatcgactagagttcacagtgttgtaattccaatccccaaactaaactctcttagccattgattgaggatcatgtttcaaaaggaagtgaaattttatcttacataatattttatcacaacactcctgctgataactagcatatcactttctcaatgtgaggtttccaagggtcaggctaagactgagacataggttaccattgagctttgttgggtcaacagaaaatgagaaccagagagctcaaggatttgccatgggtcacacacacatgctcctcattcatagtcaatatctagggagtgtgtttaccttccgcaacaaccctgggaaatggctcctattatccaaattaaagatgggcacactgagtttcagagagctaaagcacctgtctcatgctgcacacttggtgagtgttgggtcagccttaacttctgattgcaggtccagagcttttccactccacctcataacctggctctcagctcctgtctgagaagttgttttgtattttcctattaaatatatattagccaaataaatgttggaaggagaggacgagaggggaacatctaattcctgagttcctcctgttagcaacttttcaggggcttgcttggaagaaaaaattgataaaactgtgactttctctgatttgacaacctaaaaatcagagtgagttgaggactagtataattactttacatcaataattaacttacatcaattaaaaaatgggcttgttttgaaaggaatataagctctcataattccaggagtaaattaaaggagttacatttacatctctgaggtggtcccaatgacactgtttcttatcagagagaagggagaatgagataaactatgactccttccattatgagattcataaatgcagtaggttgtttaatctctgagcctcaattttctcttcttagaatagagatagttatttctacttttgagggttgttgagaaagttaaatgagataatgtacaaaaaattcatagtaggaacacagcaatgggtgtttgctcttgtcccagtgcttggaagatgggtgagtctctggacatattgagtagcccatggatcctctttctttgatctatctatccatcaattattttactgaccaacaatctatgtatatgtatctatttataatctctgtctacccatccatgtatgtattattttatctatcaatcgttctatgtatctatctctttgtaatctgtctcttcatcatctattatctgtcttgtatccatttctctggttctctatattttgttcatagaactcgagtaggaataagattttatatgaatccagacttatatcaaatctgtcatatgatggctctctgtttctctctctctttcctttttagctcctgtacagaagatattgatattcactaatcagtccacctggattaacaggaaattttcagtgaatgtccaagcagtggggcacatcagtaacacagccttgcttagccccatgaggtcatgtagtcccatggttctcaaccagggggattttgctcctctgctccagaggacattgagcaaggtctagagacattttgggttgtcatatctgcggggagggaaagggggttacaaatcagataggtagaggccagggatgcctagaaacatcctagagtgagcaggacagatctccattcaaagaattacacagtttaaagggcagcaacagtcggagcctctttcttagctatcctctatattggccatgagttggtagaactccagagacagaatatgacttgtctttgagctaattagtggcaaaggctcaactagaatctagttctcctgacattcaaactaatttattctaattatactaaacctgagttttgtattttcacagccaatatagaattacagtgtcacaatttacaattgtgtgttgactacttacacagagaaataaatttttgcatacattgccacttcttccagcactgattattctcagattgtttaaaatgctaccatttcttttttctcttcatgtcattgtttcccataccattaaatgctgaagccctggttttctaaattcttcatttttacaattctgtaaagatgtatccaacagaaaagaaataaacaattcttgaactgtcacccaagcacaccaagacggcacaatatgagtaaaaacagacttttccttgtgctaaggacacatattagcatatttttctaggaggctagagaggagggtgtgaggcaatgtagagaaatttataagatcagtacttactttgttaaacgctgtcaccgtcctggctcgacaactgaattccaggtcctaatgtatttataagctctttgttcctctcaatagttctctcccactgaaagaagagtcaagttagggaaaagccactcccacacatttcatggccaaggggccacctactggattctaagacatgaggcaagtgatctgcttatcagaagacactggttaatgtgttccttttcaaggttggcaatcaaagtttacacaatacatttcaccgagattttgctctttttgcaagtcagcagaaactggctttttaaagatgctttttttcatgagttgggtgcaaagactagggcaactgaaaaatctctattgtgagcatagctgggagaggatgtctgtgaagggcaagctgatgccaccgttttcttactgggttgccaaataaaatataggacatccatgtaaatgtgaatttcaggcaaacaatcaacaattttttagttatagctatgttccaaacacggtatgaaaccagattatactgaaatattatttattgtttatctgaaattcacatttaggtgggtatcctgtattttatctgacaaatccagagaccctatttgcatatgctatcctctttgcgtcactcaaattgcccataatataacaaatctgaaagtattcatcacctggattcatcaattgcaaataatcttatttcacctataccatgtagggggttatgttggcccccaagaaagataggtccatatagaaatccctagatcctgtgaacttgatcttatttggaaaaaggctctttgcagatgtaatgaagtaaaagaatttgagatgagatcatcttggtatatctggataggccccaaatccaatgacaattgtcctcacagcagagagaagagaagacacaacacacagggggtgaggtgctggaacacagaggcagaaattagagtgatgtggtcatgatccatgaaagtccagaaaggccaagagcccccagaagctagaagacgcagggaaggattcctggaaatcacttctaatccaaacacgctggcacaatgacacaccagggaaaaataattttgcatatagttacttatatgtaattcgcatataccatctgtatcttcgcagccaggcctgagtggcactgaaggaactgagggaaggcttatgcccgggtccccacagagccttgaggagagtgaggatgagccaggagcacatgcactgtaagggatgacaagttggcctgagagcagagggtgggtctgtttgctcttcaatatttcctcaccccttacaaaactgagggatccatagcagacagaaaggttgtttgaaaatgcataagaaaaagtgttttcatgagaaataaaatggatgtcaaggaaaaaagaaaatttcattttgccattccccagaatgataactgttttcttgtgcagaatgtcagaagtaaatttctatacatgactttctgataggccatttgacaaatgttgcaggacaattcttgaaaaagtcaaacaaaccacatagtctacattttacttttttactaaatttttaattccaagaaaatttatggggagtttggaaatctgatttcatatcagatactaatgaaaagaaatcaattttaactaaatctggtcataggcattttactatgtaattagcacataatttttaaaaagtttattaacttcacaatagccacaaccaacatttagataaagcaatttattgttgcaaaactttagaatattggtattgcatgttcttggcatccatgcctgttttatcaaaccttgaaaatctttgttgcttcttctaaacctttcgcatttatgggaagctccctcaggctgccaggctgcaaaaacttcttcactgtggggagtttgctgattctgattttcagggcccgcaatgcacaaagcacagcctcagagtgaagccaagggctaacaccaccattaacacaacccagggaatctgcgcccctcctacacaaagaccaactaagttccctctatcagcaccagtagggaggcagaaagagacactacgtgagaaatgaagataagaggaagaacatgcagctcactagcattttcccaaaaaatgtctttaagactttattcagttcagtcttcctaccctcttccttacacatgaatcttgtagattcatggctcttgtagaagatgagaaagaacaatgtgcctgtgagatagcacagatcagtctctaagcagaagaagtgaagatatgggaaaattgagctagaaatgaaaatagaaaatgttaaagtcaaaccatgggaccactttttcccatagagagatatagctttcaggggcagcgtgttgggagagctgtgcacaaggaactcagttatctgacagcaagagccagagcataaggaaggaaccagatggaaagggccctgctcagacacacttggtgtgggaagataagggcatattgggataaagggcatcacagagaactcaggaacagaaaccacagtgaaataaagggatgaggagagatgctgagtcctgggtccttggcattataaaaagcgaaatattcttggggtagcatgcacatgtaatttccttggcataacaagaaggcatttccatgcctcagaatcaggacctggaagctcattttggagacctggggggccctgaagacctggagaaggctgaggtcagaatgtggccagttcaaggacccagatactagatcccaagatgggagatgaggagctgcctcttgaggactgggaaatgggtcaccttcagcagagggaagttggagatgaggctggtgtcaagctcttccacgtggtagagaagtttgaccaggtgaatgtcagcccggctcagcttgtggccaacgaggtagtcttgtccatggctcttcaacacctggagaatcagaggaaacagatcaggaacacatgtgcagtgaggctggggcctctgcttctccctgagtttgtccaggctgactctccctctcccacctctgcttccttactgggcaggtgcaaagatccagatctttctccatgttacctgattcagtgagagagtaagaagtgtggctctgcttactccttgtttggagcccaggctcccattttctcctctcattccacatcactatggcatccacagcacccacccagcttgcatcttccacatgggccaggggcttttcccctgctgcagcatgtcctgtctgccccaggccctacagtgtgcagccctgatgttcagtggctctacacactctctctccagtctctcttgggcagcgactccaccttcatgacagcactcttctcccacgagtagactatttcagaatcctcatttctcctcatctgccctcctcatttcctgctctgggatctgaaataagcctgggtgaactttaattcatcctctttcttgcaatggtggttcttactgctttgactatgttataatctgcatgccactgtgtcccagggtgaactgcaaagatgtctgcaacttactttgaaatgcacaataataataataataataataataataataataataataatgtgtttgagtgaggcaaacaggggtggagtgactgacacgtgataaatcaaagataaaaggttaactttgctctttagatccttggtgtatatatgttcataaaacatttctttggactacaccagatctatacatttttaataataaagtttttgagtgatatatgatatttattaaaatatctcagcacattgacatcataaataataaaaagagaaaacatatggcaacactgatttaagataatagtttgacaatacattttcagactatgtatacatacaaacgtatggataatgacttggtacacaaacaaaacaacttcaatgctatattgtaatatacattgttcaaatgcacatatcacaggctatttggtagaactcgtagaattcttattcacagtctatttttataccatgccttgggagtcaggtgctccattaacatcaaggaaagcttcttggaagtgaaggtcaatgccccaaaaatacacaggtactattttatttttctgttgccttgtgttatggactgaatgtttatgtttcccaaaaattcatatgttgagatcctgacccccaaatctttagaagagatccctaaaaaatatattctttcaagccattagtaggtgggggtttcaggagatgatcaagtcatgggggtggagctttcatgaatgacattagtccccttataaaagggttctcagagaactcccttggcatgtttgccatgtgaggacatagccagagattggctgtctatgatccaaggaacaggtgctccctagatgtgaaatctgctggcacattgatcttgtacttcccagcctgcagagctgtgagatagaaacatctgttctttaagctacccagtctatggtattttgttattgcagccaaactgctaagaaaccctctaaactcttagtgcccttatagactaaacagcttctatcatgacccttacaacagtcaaatacaccagcattggccaataactgccagcttccctaatttttgcctctattttcaatttatgaccaaccacagaaagcaaaatatggatctctgactaatcccatagaaatccacacttctagttagccagcttacagcatccctaggccagcaatcaggacataactttttctaccatgaatctctcagactttcctgcctacctctgaatctctgataaatgcaaaagatggcggctgacttcctttctatagcaagctctgtataaacaccttttgcttattctcatttggactgtcttcacttccacagtttttctggaagttgcaacaagacatggtctatgttgcccgttgccatggaccccatccgtcaaccaggtgctgtatccacaaaggctccttgtgccttgtggcaagtcagcacctgggctgaactcttttctctttgcattgaactctttcactttttattctcaggttggtccttggttttggtattggttctcatctgcttagcatcctttgtagaatcaggactttcttttcatttcttttgtagtctttcgtgttacttttttttgtcgtgcgatctaaaggtgttatttgtcataaaagaagcagcataagagcagaggcccaggagcctgtttttcaagatagcctcacagtacattaagtttgaggttctcactggacctctttccatttgtcacactttgctgtgggtcacccctaaaaccgaatgaagttcttctctcttgatttttggttcttgttgttctgcaaacttggcagtgccagacagaaacatcacagtttccacttgaggcagagtattgactgtgactttagatttactttatccttgttaggtggtaatccatatatctgactgaataattctctattgtagttttgaggcttaaatcatgtagccactaaaaagctgaagaaatgcctagggcgagatctggggaaggggcatggaccttccatgccttccctggacaggccaccctccaagaagctccacgtgttcagctatccagaagctcccaggtacagtttcaaagacaggaaaataatggcttgttgttccctctgatcagggcaagctttgcatctttttcctcaggtggatgcaatgagcaatgaagaagcttttcactcaaacctgccctaccttctgtatacatttcgaccccgtaagacaaaaataaccaaactgctgagtgccttctgccttagattttatgtttaaacacttgagaccgtgaagcattaggtgacaggaaagtaattcagctccactgcgtgccttttatatgctagtcattaggctatgatttttataaatatatttacatttatttctcagaacactctactgtgatagatttatatctaaaatgtttgttatacacatgaccaaatacaggtacaagaaacatcggtgacctgtccagcgtcacagtcatgagagaaattagtggaatcactgcaagtaaccactgatgctacaaatagggtttgctcactctgctgtggtttgttttacacataagccctgccatttacataatcccaagacagcctccccagcacagtgatctcgaacgtgtctgttttcctctctcatcatactacaaatcccaggctcacttttatgcccaatattagaagttcttaaaaaagaaaaaaataaaattaataaaggaaaaactaggaaataaggtatgtctttaaaagatacccctaaaaaatatattttttcaagcaagctactaattttcaaaaaacaaaaaaaaaagaagctctctcaattattttccataaaacattgttccattaccttttccatatgatgttgtccaattctagtcatgattgtgtttcaagacctcacctaatattcccatggtaatgtgggaaaattgtttacatagtaaaattggtaaacatggtaaaattattcatatagttaaaaccagtgcatagcataggacatcttctttcttctcatttcaaactgtgtttcctacaaaacttttatttatttatttattttgtttatttgtttgtttgttttttttgagacagagcctcgctctgtcaccaggctggagtgcagtgggggcaatctcagctcactgcaacctctgcttcctgggttcaggtgattctcctgcctcagcctcctgagtagctgggaccttaggtgcacgccaccacccccggctaatttttgtacttttagtagggactgggtttcaccatgatggccaggagggtcttgatctcttgaactcgtgatccacccacctcagcctcccaaagtgctgggattacaggcatgagccactgtgcctggccctgtattttatttttctttgagacagagtcttgctctgtcacccaggctgcagtgcagtggtacaatcctggctcactgcaacctccgcctcctgtattcaaacgattctcctgcctcagcctcccgagtaactgggattacagacacctgccactacgcctggctgatttttgtattttgagtagagatggggttttgccatgttggccaggctgatcttgaactcccgacctcaggtgatctgcctgcctcggcctcccaaagtgctgggattacaggcgtgagccaccatacctggcgaatacttttaaataacagctttattgacatgtattcacatactataattgccaccccttaacagaatattattcagtaatttttagtacatttacagaattctgcaaatactgtcactgtctaattccagaacatttttatcacctgggaaagcagtagcacatgctttggcagccattccccattgtcccctttctccagcccctgtcaacaactgatttcctttctggactcaaatggtctggatggttcatacaaaagaattcatgttacatgtggcctttggtgtctggtttcttttatggaacatgttttcaaggctcacccatgttgtagcatgcatcagtacttcatcccttttcatagcccaagaatattccattgtctgctacagcacaacttgttcctccattcatccatgggtggacatttgggttgtttccaccttttgcatagcatgaataattctcctatgaacatttctgtgcatggattagtgaggatgtgttttcctttctcctggatgtagacctggtagtggaattgctaggtcattggtaactctatattggacttctcaaggaactgccagcaaaggaggagacccctcctcccagctttgctgatgcaaaatcagtctggctgcttaggtctgtatcaaatgctgcactttaggtaatcctggtatcttgggcaccagcctctcaaaccttagtcaagtggaccagttcatacaactggctggaaacttaggttcctggtcaccattcttggaattactggaacctgagattcagctcctttgcagcattctctccccaggccttcatctaccgactctcaaacattctatgccttgtcctaagctgttggctggagtccagcctctgaagtcccgagcacctggaatcatgattccccatcctcctgagttcatggttcatcagcgtttggaaacctttgtcagggtgctggatccataggctgcattgtcttctagaatcacacttgcctgaaccctccccatattcactcttttctcatctccatgggactctgcaatactggacaccagcgtatatgcccaaggcccagcctgctgctagtcgtgatgctccttccacggtcctgcccactcacagaaggaccgaaatcactctgtgttctctgttgatggaagaacaaaaaatatactatatggggctctctcctttatgtctttcccacacaggttgtatttgctggcaatgtagttgagaatggctctggtctgcatcagcttcatcccgtcaatctcaaccattggcacttgctggaagaacaaactcccatctttagaaaatagaaaaaaaaaaaaaggcagagtgaaatttctatgaatcccaccctttcaggatgaaaaagtggttgtggaaatgactaaatgtataaaatgaaaaaaaaattgcctggcaactgttcaaatgaaataggaacttatttttagcttctggaagtgctttttcttatcaagcgttcttttactttttatactgttacttcatttatgtttttatttcccatccagctacagaataggtcgcttgtattgtctgtgttgatttattttcatgatatcttaggaagaagttgggagagactgcaacaggtcaccagccagatgccatttaacatgggaatttctcaaagtaagtctcatgctgttgaagacattaaacacagttctgagagaagcttctatgtaggctctttgtgtgcccttcaatacccccattagacagtgtgtgcagggcaggctctgtgtttcttaccccatggcttctaccctggctcatgtccctcctcaccctgtgacctggacttccaaccaagtcaacactgtctcattatctaagcagacaatattgcaaagatatcaccttgtcaaacttataatagaaacaattcaaaatggacctatttcaactccttttgtctaaaacatgtccttgcgtgtctttggatggggtgggctatatgagatcctgagttgatgaccacagctcactcatggtgccaaaagcaggaaagcaagaaaagggatcctcagagtgctggagatggttctccagcaaatacaaagagaagtctggccctttttagcctggaaagagttgccagacctgctctaggagcccatcctttccattttatgattttctccctctccaccatcaccaactacaaccctacacacatgtaagcattgctggctgttcaaacctccctgtgtaccttctactagataccctcctcagaggcacttagagacttgatcttactatttcttaacttttccaaatcttttgcagattccagaaatttctcttcaaactggaagcagaaacagtaaatgggctcttattaattcattccatagcactgtagacctttaaccttgaatggcttctggctggtacataatttggaaaatataagatttctgagcttggcagagcacacagaggaggctggtggtggccattttgaaatttacactagatcatcgagaaaagggcatggatcacagcacatagtcgctcaatcttctagttcactttacttccaccttgatcgctcccatgtccatgattaggtcatgatttgagaggggatgtcactgcagttaaaggatcatgcagttcttctaattatgatgttgtcatatcttaggaaagcatatgtctctgagtgagatcagaccacaacctttgtgaccccagcatgggtatgccataggccagtggccaccaaagattctgccaccaagggccctctgctataatttacatcagcttagtttgtaggagccctgctaaagttgaaataggtcatagctgttgcacagttataactcttgcaattataattttccctcctggagaatatgggacacaatagaatagaattctcaatttcaggaaggaattaaagtccccacagtaacattatttttaatgaaaatctctggcttgtgacatggctgtgtgggtttaatatcactgttgtcatgtcctggcttcttgactttggacacattgttaaatctctctgtgtctcagtatcctaatctatgaaatgggaatacttatggtacctatgttataggttggtatgaagattaaatttcaaagtcatgcaaagcactcagaaaagtagcaagtgtgtaagtgctcattaaacatacactattaggattctgaagtatggctgctatttcatatcatccttaaaaaaattaaatcaatctaatattgatgaaaatatactctattgctgatctatatcagtgatttaaactttgaaataaatcacaccttgtcctgagtgtagtcactttggttggaatggcagccagcaataaggctgtctcaatctgatcagaagctctgagtggatgcaggtatttaatacaactatgaaaaccagttattgcataacaatgcagttgacttaataggcagaatctataaaaataaaagtcaaagtagacacttaccaagatttcctgtatttcactgttgatatgatctggtaccaatcttgactctgcctcaaaatagctgtgtgatctgggaatcatcacttaacatcttcaagccttagtttcctcatctgcaaaatggggatagaatattttcttaaacagaatattgtaatgttttcaaaatgcatgatacagggcctgacccgcgtgcatcaacatcaagtaataaatggtagttgtgtttgcagtggttacttatagtttaatggagttctttacggtgaaagttcaggaatttgggggtttctagcttgctccatggaacagtttgttgtggatctatgatcgcacaggaccaggatgtggagatcatggggggtgtgtgccagcaattaataaagcgtccaattcaggacaaacctaaggaacggtgggtggtcctggcaggagggtgaccgaggtggggtgggattggcaagtgggatgtgcttgtgaggctgaggactgggttgtgatcatcagccttagggcactgagaccccagaagcctgagcaaggtctgcagtcagccctgcccccgccttcagtcaagctggttggaggccagggagtctgggttcctcccagccttgcccctccctccctcctgctgaactcttcctacccgggctctgaacacatccctgagctgtagagctgatgtctgggtgacagggtattcattcatacaaagaaaacaacctggaatggcagtgtttggatttcttgtgtgcttatttcttcataggattgagaaagggtgaggctaaagtcccaggccctcgtgaagcaatgaagaaagtgccttcccaaggttcaggcccacacggcgctgtgaggctgaaggggcgcgctagaacttcctttcacaggatgccacctcacctgaaaccctccttttcggctgccacccgagggacaagatctcctgagtctgtccatgagttaccccgaggaaaaccctcaggcagcccctgagggactctgttctggacttggaagtgtttttctcagtgacacctctagagggcagcactcaacggagtcccacagacacctcccagcatttcctgctcaaacactggaaggatgacctggtaacgctggggactgcttgggtgttctcctggaagctcctgattttaatcacctgtttacttgtctccattcttataggtatgtaggctactcgagagcaggaactgagtctgtctcgttcactgtctatcatcagaacctcacacagcacctggcacttagtaggtgcacaacaaaataatcatcgaattaatatactcagtctttaacaggttatttgttataatccactgccttccacctctcatgtgtggtatgcattttaactttacattcacttcctgatatacattttatccccttattacataaatttctaacatgtataaaaataacacaaaagtatcacgaccttccttgtattcctctcatagaatcagtaactaccaatgttattgaaaagagtcaaactctgtaaaatatttggagatttattctgagccaaatatgagtatctagtgcctgagatacagccctcaggagattcagagaccgtgtggtcgaggtggtgagggtacagcttaattttacacattttcaggagacatgagacatcaatcaaatatatatagatgtacattggtttggtatggaaaggagggatactggaagtgtgggtttccaggttgtgtgtagatttaaaatttgtctgattggcagttggttgaaagggttaagttactatctaaccacctggaatcaatagaaaggaatgtctagtttaggataataaggggttgtagagaacaaagttttaccctgcagatgaagccacctggtagcaagtttcagagaaaatgattgtacttgtttcttatcagactaaaaaagtttgttctgttagtaattccaaaagagatgaggtataatgaggcttgtccaaccccctccacttcccatcatggcctaaattcatttttcaggttagctttggaatggccttgctgaaaagagagatccattcagatggtcagagtgagggagggagcttagaattttatatttggtttacaccaactaaagccaatgtgttttcatatacatgcccacccacttcccccatcttgtaataatgtaaggaaatcccaaataccgtatattccatccttagatacttcaaagtgtttccctaaaacataaaaactatgattccagcaaaccagtctcagattccagcaaaccagtctcatgtgcccattggttaaatgtgaccattctcgccatgctaagaggtgcgagtatgtggtaataatgaatgtagggaagttagtgggaagaggaagaattcaagaactaatatttattgaaaactttcgactgatccttccttccccaatgctagtctctttcaatatgttatatcttgactcctccttatagtcccatgaaatgcttgttattatctccattccttagttagtgaaatggaacatcagaaaagttaaatgcaatgtccgctatcacactccacgtggtgatgaacttgaaaatccacacccaggacgaaaatgaaggtaggcctagaacccacccaggtgaaggccctgagaacccatgaagtggctgtgaaaccagaggatgtcactgacaaggaggaccacctctttggctgttaggctgaatttgatgaaaagcagaaattaggcctcaggcttgcttaactgtagctcgaagaaccaaattctttcaacagacagaggaccctaatttcttgcttcttttggttttctgtattccacctctttggggtgcattttgttttataacctggaaaaacatgttgcctcatcaactttgcaggcttgaataggagatagtatctattcagcatcagtcacacactggccattcctccaaatttatcttcattttatcttacaaaaatcacctaagttgaatgttattattattctcattttacaactggtgatactgagatttttaaagcaactcgtccagagtaagtggtgaatctgggattcaaacccattgctattcaaaaccaatgactgagccttattttctgttagtgtttctcaaatatgtatgctaattttccagaaaattgtgaaagctacatattttttaaagaaaataggaaagaataaaaaaataccagagagcatgacatgctggagagtaagtaatgtttcatgagtttttagtttcagttacatgtatgttatgtgtatggatatttgcatgtgtgcacgttcatttggccattgcaaatggttagagataaattcactagggatcatcaaggaagtttgttggcccttgctctatcccagcctgcttgggaggtggagcatagcagagaaccagcaaatgaaaaccaagtgtacagggacaggccataaataattggatcatgaatgtgagtggaaacacacaggactcattgaaagcatgagttccaagacttaggaacagtggcattttctctccaaacccccaactctgttataacatattaagattcttcttgcaaagttttgtggtcatcgaggttgatacatttgtacaaaaatatacttgtctttaccaacagatgtatttctaaaaaagtacgtatgacttgaatttagacattaaaatcttttaaatgtctacattttaaaatgtggaactcaacagtctaacttttagaaagtaaataattatttgaaacatacttaatcaactcatctgtcttgtaattagagactttacacattgcactttcctctcattggaaatggaaatagcatgattcagcagaaggaaagggagagtgaacctcacagagagtggggtgtgcttctttaattgttatgggctagagtgcacagagtgattcaaatcgcacactggcacccttagccattactgaggatcatgtttcaaagggaaatgaattattattatctcacataacattttataataatgctctcgcttacatgtaacatatcaccttcactatatgaggtttccaaaggccaggccaacactgaggcaaaggttaccactgagctttgttgggtcaacagaaaatgagaaccagagaggctcgaagatttgccatgggtcacacacacattctcctcattcatggtcaatatctagggagtgtgtctaccttctgcaacaaccctgggaaacggctcctaatatcctaattaaagatgggcacactgaggttcagagagctaaagcgactggcccacgctgcacacttggtgagtgttgggtcagcttgaactccttctgattgcaggtccatagcttttctactccaccctgtaagctggctctgcttctatctgagaaattgtttcatattttcccatacagactccattaaccaactaaagattggaagggaagggcgagagggggacacctgaatctcgagttcctttctgttagcaacttttcaggagcttgattggagaaaataataataataaaaatgtttctttctctactttggcaaccctaaaaacttaaatgagttgagaactagtataactgtattttcctcaactagaaaatgggcttgttttgaaaggaatataagtggtgaaattccagtagtaaattagagttaatttactcttggtccctgggtggtcctaattattgcttcatatcagagagaagggagactgagataaatcacaactccttccattatgaggttcataaactcagtaggctcttcaaattctgagctcaagtttctcctttcaaaatagggatagttatatctatctttgagggctgttgagaaagttcaatgaaatattgtatataaaatttataataggaactgaataatgagagtgacctcctgcccccacttcttgggatgtggatgagtctctcggaacacactgggtagcacatgagtctcctctctctttctctcttaacccatcaagctctggtaaaaataagattttatatatatctagatttcttttcgaataagtcatataatgagtctctttttttaaagctcctatacagagattaatgatagtcactgatacagtcaacctgggttaacaaagttttcagtgaagtttcagggaggcctgacccatcgttaacacagacttacttaactcctagactgcagcagacctggttcccaggttgttttataacctggaaaaacagacgttttataatctggaaaaaggctcccataccctgcacctggtgggcctctctcctcaggccaggcctagctaccacccactccctgctctgagcactgtgaacctgtcctgttcccaggccctctttgcataaactccagtggagtgagagtgagcctcactgcttctctctccagctattcatagctcttgggcagggtctcactctcaatacttgatgaaaatggttgctcctctacagcatcctgttccttacctgaaaatgcagacattttgctaacctttcttctatttcttgttttcagcatatttccttcttttaaaaagtttcattcaaactgactaacattgattgagctgtttcggtgtctcaagcaatagtgatggcttgtagcagaaaaatatttggttggatttggtctctgccctaaagtggtttagatctagtcagaataacaggcttctggccaactgacagaacagaatgtgctcagcagtgatttcactttaaaggattcctagaaatttcaacccgggaatcatgattctgttaaccaaggaaatcagagaaaggggagaaggctgccaggctgagaaaactgaggactcttgcccttctgcccaggtgggctccttctttccagggtagcatctcaatctgcaggttcagtagattttgtacctcccaaatgtctgccttcctacccttcaaat

SEQ ID NO: 847 - DNA, 23093 bp, Homo sapiens
tcacaatttacaattgtgtgttgactatatatataaagaaatttttgcatacattgccacttcttccagcactgattattctcagattgtttaaaatgctaccatttcttttttctcctcatgtcattgtttcccatacctttaaatgctgaggccctggttttctaaactcttcatttttacatttctgtaaagatgtatccaacagaaaagaaataaacagttcttgaactgtcacccaaacacaccaagatggcatgatatgagtaaaaacaaactttttcttgtgctaaggacacatattagtgtatttttctaggaggctagagaggagggtgtgaggcaatgtagagagatttataagatcagtacttactttgttaaatgctgtcacctttgtggctggacaaccgaattccaggtcctaatgtatttataagctctttgttcctctcaatagttccctcccactgaaagaagggtcaagttagggaaaagccactcccacacatttcatggccaaggggccacctactggattctaagacatgaggcaagtgatctgcttatcagaagacactggttaatatgttccttttcaaggttggtaatcaaagtttaaacaatacatttcacctagattttgctctttttgcaagtcagcagaaactggctttttaaagatactttttttcatgagttggatgcaaagactagggcaactgaaaaaaccctattgtgagcatagctgggagaggatgtctgtgaagggcaagctgatgccaccgttttcttactgggttgccaaataaaatataggacatccatgtaaatgtgaatttcaggcaaacaatcaacaattttttagttatagctatgttccaaacacggtatgaaaccagattatactgaaatattatttatcgtttacctgaaattcacatttaggtgggtatcctgcattttatctgacaaatccgggaaccctatttgcatatgctatcctctttgcgtcactcaaattgcccataatataacaaatatgaaagtatccatcacctggattcatcaattgcaaatattctttcttcatctacaccatgtagggggttatgttggaccccaagaaagacaggtccatatataaatccctagatcctgtgaacttgatcttatttggaaaaaggctctttgcagatgtaatgaagtaaaagaatttgagatgagatcatcttggtatatctggataggccccaaatccaatgacaattgtcctcacagcagagagaagagaagacacaacacacagggggtgaggtgcaggaagacagaggcagaaattagagtgatgtggtcatgatccatgaaagtccagaaaggccaagagccccccgaaactagaagacgcagggaaggattcctggaaatcacttctaatccaaacacgctggcacaatgacacaccagggaaaaataattttaaatatagttacttatacgtaattcacatataccatctgtatcttcgcagccaggcctgagtggcactgaacgaactgagggaaggcttatgcccgggtccccacagagccttaaggaggagagtgaggatgagccaggagcacatgcactgtaagggatgacaagttggcctgagagcagagggtgggtctgtttgctcttcaatatttcctcacctcctagaaaactgagggatccatagcagacagaaaggttgtttgaaaatgcataagaaaaagtgttttcatgagaaataaaatggatgtcaaggaaaaaagaaaatttcattttgccattccccagaatgataactgttttcttgtgcagaatgtcagaagtaaatttctatacatgagtttttgataggcaatttcacaaatgttgcaggacaattcttgaaaaagtcaaacaaaccacatagtctacattgtactttttactaaatttttaattccaagaaaatttatgggcagttcggaaatctgatttcatatcagatactaatgaaaagaaatcaattttaactaaatctggtcataggcattttactatgtaattagcatacaatttttaaaaagtttattaacttcacaatagccacaaccaacatttagataaagcaatttattgttgcaaaactttagaatattggtattgcatgttcttggcatccatgcctgctttatcaaaccttgaaaatctttgttgcttcttgtaaaccttttgcatctatgggaagcttcctcaggctgccaggctgcaaaaacttcttcactgtggggagtttgctgattctgattttcagggcccgcaatgcacaaagcacagcctcagagtgaagccaaggactgacaccaccattaacacaacccagggaatctgcgcccctcctacacaaagaccaactaagttccctctatcagcaccagtagggaggcagaaagagacactacgtgagaaatgaagataagaggaagaacatgcagctcactagcattttcccaaaaaatgtctttaagactttattcagttcagtcttcctaccctcttccttacacatgaatcttgtagattcatggctcttgtagaagatgagaaagaacaatgtgcctgtgagatatcagcacagatcagtctctaagcagaagaagtgaagatatgggaaaattgagttagaaatgaaaatagaaaatgttaaagtcaaaccatggggccactttttcccatagagagatatagctttcggggacagcgtgttgggagagctgtgcacaaggaactcagttatctgacagcaggagccagagcataaggaaggaaccagatggaaagggccctgctcagacacacttggtgtgggaagataagggcatattgggataaagggcatcacagagaactcaggaacagaaaccacagtgaaataaagggatgaggagagatgctgggccctgggtccttggcattataaaaagcgaaatattcttggggtagcatgcacatcagatttccttggcataacaagaaggcatttccatgcctcagaatcaggacttggaagctcattttggagacctggggggccctgaagacctggagaaggctgaggtcagaatgtggccagtccaagggcccagatactagatcccaagatgggagatgaggagctgcctcttgaggactgggaaatgggtcacctttagcacagggaagttggagatgaggctggagtcaggctcttccacgtggtagagaagtttgaccaggtgaatgtcagcctggctcagcttgttgccaatgaagtagtcttgttcatggctcttcaacacctggagaatcagaggaatcagatcaggaacacatgtgcaatgaggctggggcctctgcttctccctgagtttgtccaggctgactctccctctcccacctctgcttccttactgggcaggtgcagagatccagacctttctccatgttacctgattcagtgagagagtaagaagtgtggctctgctcactccttgtttggagcccaggctcccattttctcttctcattccacatcactatggcatccacagcacccacccagcttgcaacttccacatgggccaggggcttatcccctgctgcagcctgttctgtctgccccaggccctacagtgtgcatccctgatgttcaatggctctacacactctctctccagtctctcttgggcagcgactccaccttcatgacagcactcttctcccacgagtagactatttcagaatcctcatttctcctcatctgccctcctcatttcctgctctgggatctgaaataagcctgggtgaactttaattcatcctctttcttgcaatggtggttcttactgctttgactatgttataatctgcatgccactgtgtcccagggtgaactgcaaagatgtctgcaacttactttgaaatgcacaataataataataataataataataataataataataatgtgtttgagtgaggcaaacaggggtggagtgactgacacgtgataaatcaaagataaaaggttaactttgctctttagatccttggtgtatatatgttcataaaacatttctttggactacactaggtgtattcatttttaataatacaatttttgactgatatatgatatttattaaaatatctcagcacattgacatcataaataataaaaagagaaaacatggcaacattgatttaagataatattttggcaaatacattttcacactatgtatacatacaaacgtatagataatgacttggtacacaaacaaaacaacttcaatgctatattgtaatatacattgttcaaatgcacatatcacaggctatttggtagaactcgtagtattcttattcacagtctatttttataccatgccttgagagtcaggtgctccattaacatcaaggaaagctttttggaagtgaaggtcaatgccccaaaaatacacaggtactattttatttttctgttgccttgtgttatggactgaatgtttatgtttcccaaaaattcatatgttgagatcctgacccccaaatctttagaaaagatccctaaaaaatatattctttcaagccattagtaggtgggggtttcaggagatgatcaagtcatgggggtggagctcttatgaatgacattagttcccttataaaagggatcttagagaactcccttggcatgtttgccatgtgaggacatagccagagattggctgtctatgaaccaaggaacaggtgctccccagatgtaaaatctgctggcacattgatcttgtacttcccagcctacagagctgtgagatagaaacatctgttctttaagctacccagtctatggtattttgttattgcagccaaactgctaagaaatcctctaacctcttagtgcccttatagactaaacagcttctatcatgacccttacaacagtcaaatacaccagcattggtcaataactgccagcttccctaatttttgcctctattttcaatttatgaccaaccacagaaagcaaaatatggatctctgactaatcccatagaaatccacacttctagttagccagcttacagcatccctaggccagcaacctgcaatcaggacataactttttctaccatgaatctctcagactttcctgcctacctctgaatctctgacaaatgcaagtgatggtggctgacttcctttctatagcaagctctgtataaacaccttttgcttattctcatttggattgtcttcacttccacagtttttctggaggtttcaacaagacatggtctatgttgcccattgccatggaccccagccgtcaaccaggttcagtattcacaaatgctccttatcccttgtggtaagcccacacctgggctgaactcttttctctttgcactgagctctttgactttattctcaggttggtccttggttttggtattggttctcatctgcttagcatcctttgtagaatcaggattttcttttcatttcttttgtagtcttttgtgttactgttttttgtcatgtgatctaaaggtgttgtttgtcataaaagaagcagcataagagcagaggcccaggagcctgtttttcaagatagcctcacagtacattaagttcgaggttctcattggacccctttccatttgtacaaactttgctgtgggtcatccttaaaaccaaatgaagttcttctctcttgatttttggttcttgttctgcaaacttggcagtgatccagacagaaacatcacagtttccacttgaggcagagtattgactgtgactttagatttactttatccttgttaagtggtaatccatatatcagactgaataattctctattgtagttttgaagctcaaatcacgtagccactaagaagctgaagaaatgcctagggcgagatctggggaaggcctggacaggccaccctccaagaagctccatgtgtttagttatccagaagctcccaggtacggtttcaaagacagggaaataatggcttgttgttccctctttgatcagggcaagctttgcatctttttcctcaggtggatgcaatgagcaatgaagaagcttttcactcaaacctgccctaccttctatatacatatcgaccctgtaagacaaaaataaccaaactgctgagtgccttctgccttagattttatgtttaaacacttgagaccgtgaagctttaggtgacaggaaattaattcagctccactgcgtgccttttatatgctagtcattaggctatgatttttataaatatatttacatttatttctcagaacactctactgtgatagatttatatctaaaatgtttgttttacacatgaccaaatacaggtacaagaaacatcggtgacctgtccagtgtcacagtcatgagagaaattagtggaatcactgcaagtaaccactgatgctacaaatagggtttgctcactctgctgtggtttgttttacacataagcttagcgtgattcatatggctaaagccctgccatttacataatcccaagacagcctccccagcacagtgatctcgaacgtgtctgttttcctctctcatcatactacaaatcccaggctcacttttatgcccaatattagaagttcttaaaaaagaaaaaattaaaataaataaaggaaaaactaggaaataaggtatgtttttaaaagatatccctaaaaatatattttttcaagcaagctactaattttcaaaaaaaaaaaggagttctctcaattgttttccacaaaacattgttccattaccttctccacatgatattggccaattctagtcatgattgtgtttcaagacctcacctaatattcccatagtaacatgggaaaattgtttacatgggaaaattggtaaacatggtaaaattattcatatagttaaagccagtgcatagcataggacatcttctttcttctcatttcaaactgtgtttcctacaaaacttttgtttgtttgtttgttttgagacagtctctttctgtcatcaggccagagtgcagtggtgtgatctcgtctcactgcaacctccgcctcccagattcaagcgattctcctgcctcagcctcccgagtagctgggattacagacacctgccactacgcccggctaatttttgtattttgagtagagatggggtttcgccatgttggccaggctggtcttgaactcccaacctcaggtgatctgtctactttggcctcccaatgtgctgggtttacaggcgtgagccaccgtacctggcgaatacttttaaaataacagctgtattgacaagtattcacataccataattgccacccctttatagaatattattcagtaatttgtagtacatttacagaattctgcaaatactatctccgtctaattccagaacatttttatcatctgggaaagcagtagcacgtgctttgacagccatttcccattgccccctttctccatcccctgtcaacaactgatttgctttctggactcaaatggtctggatggttcatacaaaagaattcatgtcacatgtggcctttggtgtctggtttcttttacagcacatgttttcaaggctcaccaatgttggagcatgcatcagtacttcatcccttttttttaaattttattattattatactttgagatttagggtacatgtgcacaatgtgcaggtttgttacatatgtatacatgtgccatgttgatgtgctgcacccacaacctcgtcatttagcattaggtatatctcctaatgctatccctcccccctccccccaccccacaacaggccccggtgtgtgatgttccccttcctgtgtccatgcgttctcattgttcaattcccacctatgagtgagaacatgcagtgtttggttttttgtccttgcgatagtttgctgagaatgatggtttccagcttcatccatgttcctagaaaggaaatgaactcatcattttttatggctgcatagtattccatggtgtatatgtgccacattttctttttttttttcctttttttttacttcaagaaatattttatttatgaacttttttttcttttttttaattatactttaagttttagggtacatgtgcacattgtgcaggttagttacatatgtatacatgtgccatgctggtgcactgcacccactaactcgtcatctagcattaggtatatctcccaatgctatcccttccccctccccccaccccaccacagtccccagagtgtgatattccccttcctgtgtccatgtgatctcattgttcaattcccacctatgagtgagaatatgcggtgtttggttttttgttcttgtgatagtttactgaaaatgatgatttccaatttcatccatgtccctacaaaggacatgaattcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctaggtctagatccctgaggaatctccacactgaattccacaacggttgaactagtttacagtcccaccaacagtgtaaaagtgttcctatttctccacatcccctccagcacctgttgtttcctgactttttaatgattgccattctaactggtgtgaaatggtatgtcattgtggttttgatttgcatttctctgatggccagtgatgatgagcattttttcatgtgttttttggctgcataaatgtcttcttttgagaagtgtctgttcatatccttcacccactttttgatgcaattgtttgtttttttcttgtaaatttgtttgagttcattgtagattctggatattagccctttgtcagatgagtaggttgcaaaaattttctcccattctgtaggttgcttgttcactctgatggcagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttgtggttttaggtctaacatgtaagtctttaatccatcttgaattaatttttgtataaggtgtaaggaagggatccagtttcagctttctacatatggctagtcagttttcccagcaccatttattaaatagggaatcctttccccatttcttgtttttgtcaggtttgtcaaagatcagatagttgtagatatgcagcattatttctgacggctctgttctattccattggtctatatctctgttttggtaccagtaccatgctgttttggttactgcagccttgtagtatactttgaagtcaggtagcgtgatgccttcagttttgttcttttggtttagatttgacttggcaatgtgggctcttttttggtgccataggaactttaaagtagttttttccaattctgtgaagaaaggcattggtagcttgatggggatggcattgaatctataaattacgttgggcagtatggccattttcacaatattgattcttcctgcccatgagcacggaatgttcttccatttgcttgtatcctcttttatttccttgagcggtggtttgtagttctccttgaagaggtccttcacatcccttgtaagttggattcctaggtattttattctctttgaagtaattgtgaatgggagttcactcatgatttggctctctgtttgtctgttattgatttataagaatgcttgtgatttttgcacattgattttgtatcctgagactgctgaagttgcttatcagcttaaggagattttgggctgagacgacggggttttctaggtatacaatcatgtcatctgcaaacagggacaatttgacttcctcttttcctaattgaatgccctttatttctttctcctgcctgattgccctggccagaacttccaacactatgttgaatagtagtggtaagagagggcatccctgtcttgtgccagttttcaaagggaatgcttccagtttttgtccattcagtatgatattggctgtgggttttgtcatagatagctcttattattttgagatatgcccatcaatacctaatttattgagagtttttagcatgaagcattgttgaattttgtcaaaggccttttctgcatctattgagataatcatgtggtttttgtctttggttctgtttatatgctggattatgtttattgatttgtgtatgttgaaccagccttgcatcccagggatgaagcccacttgttcatggtggataagctttttgatgtgctgctggatttggtttgccagtattttattgaggatttttgcatcaatattcatcaaggatattagtctaaaattctctttttttgttgtgtctctgccaggctttggtatcaggatgatgctggcctcataaaatgagttagggaggattccctctttttctgttgattggaatagtttcagaaggattggtaccagctcctccttgtacctctggtagaattcggctgtgaatccatctggtgctggactttttttggttggtaagctattaattattgcctcaatttcagagcctgttattggtctattcagagattcaacttcttcctggtttagtcttgggagggtgtatgtgccaaggaatttatccatttcttctagattttccagtttatttgtgtagaggtgtttatagtattctttgatggtaggttgtatttctgtgggattggtggtgatatcccctttatcattttttattgcatctttttgattcttctctcttttcttctttattagtcttgctagcagtctatcaattttgttgatcttttcaaaaaaccagctcctggattcactgattttttgaagggatttttgtgtctctatttccttcagttctgctctgatcttagttatttcttgccttctgctagcttttgaatgtgtttgctcttgcttctctagttcttttaattgtgatgttagggtgtcaattttagatcattcctgctttctcttgtgggcatttagtgctataaatttccctctgcacactgctttgaatgtgtcccagagattctggtatgttgtgtctttgttctcgttggtttcaaagaacatctttatttctgccttctttttgttatgtacccagtagtcactcaggagcaggttgttcagtttccatgtagttgagtggttttgagtgagtttcttaatcctgagttctagtttgattgcactgtcgtctgagagacagtttgttataatttttattcttttacatttgctgaggagagctttacttccaactatgtggtcaattttggaataggtgtagtgtggtgctgaaaagaatttatattctgttgatttggggtggagagttctgtagatgtctattaggtccgcttggtgcagagctgagttcaattcctggatatccttgttaactttctgtctcattgatctgtctaatgttgacagtggggtgttaaagtctcctattattattgtatgggagtctaagtctctttgtaggtcactaaggacttgctttatgaatctgggtgcgcctgtattgggtgcatatatatttaggatagttagttcttcttgttgaattgatccctttaccattatgtaatggccttctttgtctcttttgatcttttttggtttaaagtctgttttatcagagactaggattgcaacccctgcctttttttgtttctcatttgcttggtagatcttcctccatccctttattttgagcttatgtgtgtctctgcacatgagatgggtttcctgaatacagcacactgatgggtcttcagtctttatccaatttgccagtctgtgtcttttaactggagcatttagcccatttacatttaaggttaatatttttatgtgtggatttgatcctgtcattatgatgttagctggttattttgctcgttagttggtgcagtttattcctggccttgatggtcttcacgatttggcatgtttttgcagtggctggtactggttgttcctttccacatttagtgcttccttcaggagctcttgtatggcaggcctggtggtgacaaaatctctcagcacttccttgtctgtgaaggattttatttctccttcacttatgaagcttagtttggctggatatgaaattctgggttgaaaattcttttccttaagaatgttgaatattggcccccactcttttctggcttgtagagtttctgccaaggcatcagcagttagtctgatgggcttccctttgtgggtaacccgacctttctctctggctgcccttaacattttttcctttgtttcaactttggtgaatctgacaattatgcgtcttggagttgctcttctcgaggagtatctttgtggcattctctgtatttcctgaatttgaatgttggcctgccttgctagattggggaagttctcctggataatatcctgcagagtgttttccaacttggttccattctctccgtcactttcaggtacaccaatcagatgtagatttggtcttttcacatagtcccatatttctggaaagctttgttcattactttttattcctttttctctaaacttctcttctcacttcatttcattcatttcatcttccatcgctgatacccttgcttccagttgattacattggctactgaggcttgtgcattcgtcatgtatttctcgtgccacagttttcagctccatcaggtcttttaaggacttctctgcattggttattctagttagccattcgtctaatttttttcaaggtttttaacttctttgccattggttcaaatttcctcctttagctcggagtagtttgatcttctgaagccttcttctctcaactcatcaaagtcattctccatccagctttgttctgttgcgggtgaggaggtgcattcctttggaggagtagaggcactctgatttttagagtttctggtttttcggcactgtttattccccatctttgtggttttatctacctttggtctttgatgatggtgacatacagatgggtttttggtgtggatgtcctgtttgttagttttccttctaacagtcaggaccctcagctgcgggctgttggagtttgctggaggtccactccagaccctgtttgcctgggtatcagcagcggtggctgcagaacagtggatgttggtgaactgcaaattctgctgcctgattgttcctctggaagttttgtctcagaggagtacccggctgtgtgaggtgtcagaccgcccctactagggggtgcctcccagttaggctcctcgggggtcagggacccacttgaggaggcagtctgcctgttctcagatctcaagctgcatgctgggagaaccactactctctttaaagctgtcagacagggacatttaagtctgcagaggttactgctgccttttgtttgtctgtgccctgcccccagaggtggagtctatagaggcaggcaggcctccttgagctgcggtgggttccaccctgtttgagcttctgggccgctttgtttacctactcaatcctgggcaatggcgggcgcccctcccccagcctcgctgccaccttgcagtttgatctcagactgctgtgctagcaatgagtgaggttccatgggtgtaggaccatctgagccaggtgtgggatataatctcctagtgtgccatttgttaagcctgttggaaaagcacagtattaaggtgggagtgacccgattttccaggtgccatttgtcacccctttctttgactaggaaagggaattccctgaccccttgcacttcctaggtgaggcaatgcctcgccctgcttcagctcatgcacggtgcactgcacccactgtcctgcacccactgtcccacactccctagtgagatgaacccggtacctcagttggaaatgcagaaatcacctgtcttctgtgccactgactctgggagctgtagactggagctgttcctattcagccatcttggctccaccccttcatcccttttcataccccaagaatattccattgtctcctacagcacatcttgttcctccattcatccatgggtggacatttgggttgtttccaccttttgcatatcatgaataattctcctatgaacacttctgtgcatggattagtaaggatgtgttttcctttctcctggatgtagacctggtagtggaattgctaggtcattggtaactctatattggacttttcaaggaatggccatcaagggaggagacccctcctcccagctttgctgatgcaaaatcagtctggctgcttaggtctgtatcaaatgctgcacttaggtaagcctagtatcttgggcaccagcctctcaaaccttagtcaagttgaccagttaatacaactggctggaaacttaggttcctggtcaccattcttggaattactggaacctgagattcagctcctttgcagcattctctccccaggccttcatctaccgactctcaaacattctatgccttgtcctaagctgttggctggagtccagcctctgaagtcctgagcacctggaatcatgattccccatcctcctgagttcatggttcatcagcgtttggaaacctctgtcagggtgctggatccataggctgcattgtcttctagaatcacactcgcctgaaccctccccatattcactcttttctcatctccatgggactctgcaatactggacacaagcatatatgcccaaggcccagcctgctgctagttatgatgctccttcaacagtcctgcccactcacagaaggacctaaatcactctgtgttctctgttgattgaagaacagaaaatatactatatggggctctctcctttatgtctttcccacacaggttgtatttgctggcaatgtagttgagaatggctctggtctgcaccagcttcatcccgtcaatctcaaccattggcacttgttggaacatgaaactctcatctttagaaaatagaaaaaaaaaaggcagagtgaaatttctatgaatcccaccctttcaggatgaaaaagtggttgtggaaatgactaaatgtataaaatgaaaaaaaaattgcctggcaactgttcaaatgaaataggaatttgtttttagcttctggaagtgctttttttcatttataaatgtttattaaatgtcagtaatttttacaaagcaaatatttatagcaagaggcaagtgttttgcaaaatatgtacaaaagtaaaaagctgtaatgaactagcaattcattttataaaatcaaaccattctctccacttttagacctcctttagaaaaaatttgttgtccatcctgaactaaagcactgacaaaaaaatttacaattatcagataatgtgcttagttcctggaaagttataaaaagatatatgtaaaaaaaaaaccctaaaccacaagtattttatagagctaatacaaatcatgttttgttaagtacagtatctatgggattattacaaaatatacttttctataaggcttcttgtggtaaatgtgctctcaccagagtagtatagaaaagccatttcaaatgttttgcgattctgccttcaagtaagaggtaaaaggtaaatgccatagtttgttgcgctgttgcatatactttgcaagaattaatctctacccctttctttcctagtaccatcaaataggcatgattaagtacaaatgtatcacttactatggcaagaaatattataaacaaaccaaatattataaaacaagccaaagtcacataccaagtaagttgtacatgactttcagtgatattcaccgactgaaacatttatgcatagtgagttccagcatactctgatccatctgtaaactttcatcaacagcagatttgtataggtcacaaaactctcctcatcaagacataaaatattgccatatcattcatgctttcaaaacaatgatccatataagctcttgcatttgaaaccaggtatttagacctgaatgctgcaagagtgaacataacttaaatgctaactatacattcaagtacagacataagagtgctagtggtacaaacactgtacttcaaataatgttgttaatcacctaccagcctaaggctagtatctacttgatggaacttgaaaaagccacaaagtccaacttgtttaaaatgttcagacatagacttatacttaaagctctagtatacatttattaagccctaacctcgtaccataaaaaaatgggcatgtgctatatttgggacatgcagacacacccacgcccacccacaatctctcccctcctcctgtttactagactgaaaagccaccctgtatcctatcattaaaaaaaaaaaaaaacagtgcttttagtcaagcagcacaacacaaggacggatcatctgtgattaacagaagagaacaccttaaaataatgggggagagacaaattaactaggtactaagtcagatttccaagtgaaaaagacatgagcaaaacttctggtcttaattcctcaaataaaatgaaaataaataaaatggtaacagagtgactttctctaaattttttagggagtttgttacaaacctttgggctttacaggcatgatttcatggattcaaacacgaaattaacactgatatttagccttctcatgacacacacagaaataccattgctgcaaattgcaatggagcgaatcttgtttcaaatggcttagtttggggttttgtctaaatgtatcattatataatgaaagcaccaattagagggtttctcaaatagtgatttgaattttaggacataacagtataacatggtagctttattcttcatatataaacaaggcataattggatgtgtaatatgctgaaaatacattttatcaaaagcataaatacaagtatttgggtacacattgatcctgttatttcatttatgtttttatcccccatccagctacaaaataggtcccttgtattgtctgtgttgatttatcttcatgatatcttagaaagaagttgggagagactgcaacaggccaccagccagatgccatttaacatgggaatttctcaaagtaagtctcatgctgttgaagacattaaatacagttctgagagaagtttctatgtaggctctttgtgtgctcttcaatacccccattagacagtgtgtgcagggcaggctctgtgtttcttaccccatagctgctaccctgactcatgtccctcctcaccctctgacctgcacatccaaccaattcaacactgtctcattatctaagtctacatcattgaaaaaatatcaccttgtcaaacttataagagaaacaaattcaaaatggacctatttcaactccttttgtctaaaatctgtccttgaatggggtgggctatatggcatcctgagctgatgaccacagctcactcatggtgccaaaagcaggaaagtaagaaaagggcatctgcagggcgctgcatatggttctccagcaaatacaaagagaagtctggccctttttagcctggaaagagttgccagaccggctctaagagcccaccctttccattttatcgattttctccttctccaccatcaacaactacaaccttacatacacaaagcattgcttggctgttcaaacctccctgtgtatcttctactagataccctcctcagaggcacttagaggcttgatcttaccatttcttaacttttccaaatcttttgcagattccagaaatttcctttcagactggaagcagaaacagtaaatgggctcttgttaattcattccatagcattgcagacctttaaccttgaatggcttctgtctggtacataatttggaaaatataagacttctgatcttggcagagcatgcagaggaggctggtggtggccattttgaaatttacactagatcatcaagaaaagggcatggatcacagcacatagtcgctcaatcttctagttcactttacttccaccttgatcactcccatgtccctgattagggcatcatttgacaggggatgtcactggagttaagggatcaggcagttcttctaattatggagttgtcatatcttaggaaagcatatgtctctgagtgagatcagaccacagcctttgtgtccccagcatgggtatgccatgggccagtgaccaccaaagattctgccaccaagggccctctgctgtaatttacatcagctcagtttgtaggagccctgctaagggtgaaataggtcatagctgttgcatagttataactctggcaattataatttcccctcctggagtatatgggacacaataggatagaattctcaattttaggaaggaattaaagtccccactgtaacattatttttaatgaaaatctctggcttgtgacatggctgtgtgggtttaatatcctgtcatgtcctggcttcttgacttcggacacattgtagactccctctgtgtcttagtatcctaacctatgaagtgggtatacttatggtacctatgttataggttggtatgaagattaaattacaaagtcatgcaaagcactcagaaaagtagcaagtgtataataagtgctcattaaatagacactattaggattctgagagatggctgctgtttcatatcatcattaaaaaattaaatcaatctaatattgatgataatatactatattgctgatctatatccagtgatttaaactttgaaataaatcacaccttgtcctgagtgtagtcactttggttggaatggcagccagcaataaggctgtctcaatctgatcagaagctctgagtggatgcaagtatttaatacaaatatgaaaaccagttattgcataaaaatacagttgacttaataggcagaatctataaaaataaaaatcaaagtagacacttatcaagattttctgtatttcactgttgatatgatctggtaccaatcttgactctgcctcaaaatagctgtgtgatctgggaatcatcacttaacatcttcaagccttagtttcctcatctgcaaaatggggatagaacattttcttaaacagaatattgtaatgttttcaaaatgcatgatacagggcctgacccacatacatcaaggaataaatggtagttgtgtttgcagtggttacttatagtttaatggagatctttatggtgaaagttcaggaatttgggggtttctagcttgctccatggaaaagagtttgttgtggatctatgattgcacagtagcaggatctggagatcatggggggtgtgtgccagcaattaataaagcgtccaattcaggacaaacctaaggaatggtgggtggtcctggcaggagggtgaccgaggtggggtgggattggcaagtgggatgtgcttgtgaggctgaggactgggttgtgatcatcagccttagggcactgagaccccagaagcctgagtaaggtctgcagtcagcccttccactgccttcagtcaagctggatggatgccagggaacctgggttcctcccagccttgcccctccctccctcctgctgaactcttcctacccgggctctgaacacatccctgagctgcagagctgatgtctgggtgacagtgaaacagggtattcatttgtacaaagaaaacaacctggaatggcagtgtttggatttcttgtgtgcttacttcctcataggattgagaaagggtgaggctaaagggtttggcccacaaaaccatttttctctctaggcctctaggcctgtgatgggaggggcggtaacaaagccctgggcatgccctggagacattttccccattgtctttgctgttaacatttggctacttttgcaaatttccaaacttttgcaaaaggagcagtatgttcataactgagacttttgcaaatttctgccactggcttgatttcatcccctgaaagtggggttttcttttctaccatatgatcaggctgcaatttttccaaacttttatgctctgcttcccttttaaatataagtttcaattgcagattgattcattcagattcaatgacagatttcagatcatgtctttgggaacacatatgaacatatgctgttagaaagagccaggctaaatcttgaatgctttgcagcttagaaacttcttctaccacataccctaaatcatctctcaagttaaaagtctcacagatctctagagcagaggcacaatgccacgagtctcttcgctaaggcatagcaagagtgactttcactcccattcccaaaaggtttctcatctccatctgagacctcagcctggacttcatggtccatatcactgtcaacattttggacagaaccattcaactagtttccaggaagttccaaacttaccctcatttttctgccttcttctgagccctccaaactgttccagcctctgctccttacccaattttaaagcagcttccacattttcaggtatcttcataggaatgtcccacttttctggtaccaatttcttgtattagtccattctcacacttctataaagacgtatctgaaactgggtaattgataaagaaaagaggtttaatcagctcacagttctgcaggctgtacaggcgtctgcttctgtggaggcctaaggaaacttacaatcatggtggaaagtgaaggggaagcaagcacatattcacatggctgtcaggagagagagaatgaatgggaaggtgctacacactttcaaacaaccagatctcatgagaactctataagaagaaagcactagggggatgatgtgaaaccattcgaaaacaccccatggtccaatcacctcccaccaggccccacctccaacactggggatgatgtgaaaccattagaaaacaccacatcgtccaatcacctcccaccaagccccacctccaacactggggatgacaatacaacatgagatttgggtggggacacagagccaaactatatcaggtgtcatatttttttcctgtgaattattttatagcctggacaggtctcacatctggatccaaaaggaggacatcactgaagctcctaatctttcctttatatttttccccactattaaacatttattccaggacattgttgacttatattctaatggcaccatacatattagctgggttcctttaggtgcattttaaaaactagctataaggctgggtatggtcactcacacctgtaaacccagcactttgggagacagcagcgggaggatcacttgagccaggagcttgagtgcagcatgagcaacatagcagaccatgtctctacaaaaataaacaaattacatcaggtgcaatagcgtgcacctgtggtcccagctactcagtagactgagctgggaggattgattgagcccaggaggtggtgattgcagtgagccatgattgtgccactgctctccagcctgggccatggagaaagaccctgtctctgaaacaaagcaaaacaaagccagttatatgctgcagtaattatttagttattctatcagcttctgaattttaatacttgagaagtcatgtagtctgcagattccaaaccacaaaatattttgctcccataccccagaggacattcagagtatctggagacattcttggttgtcacatcaaggcagaaggtggtgggtagtgcttcaacataggtaggtggaggccggtgatgccttggaacatcctatcatgaacaggacagcccctgaacccaaagaattacccatcccaaggggtgccaagggtaagatgagagacttttccttagccattttcaaggtttgctgtgagttggttgaaccctagatagagaatgtaacttgtcatctagctaattagtgggaaagactgaatcagattctagttttcctgacattcagaaactaatttattcctattataaatcaaccttaattttgaattttcacagctataaagtattacagttacttatatacacattgtgtccctactaaattgtgaggttccgaaagagcagagaggtctcacagtatgtttaacacagtgtattgcacatggtagtattacaatatcactgatacttggatagatcacacagcaatgctagacattttagcagtcacagagagttctataatttcatcttttgaacttccttgatgagaaaatcaaatgatatagaaaaaattaaatagaaaaattaaataatagattccagataatggatcaaccaatcctgattatcagactcaattttctacaatttcacagaataaataaagatatgggtgtggctcactgagtagacccagaaggactaagaaaagaggaatttggaaagagcaaggttatcaggcaagtgtttaattgggcaaaggacaaggattaacagatatttgttgaatcaggaatctgaaaattcacaagaagggcattattgtttttaattttgttaatcattaatctaggtcatcttgctttatagaactaaaagttctaaagacttaaattcacctgtaagttctagaaaactgctctcaaaacattctgcctccctttggagcattacaatcttaaagaaatattgaaaagccaatggcatcaacacttgacaacaaatcacaaagcacttcctgaaagaagcattaatgtgtgatatctaccatcaagttgcaaattagacttgtgcttggcaggtgttggtggctcttttctcagcaggagatggaggtttggagaagcaactgcagacatggaactgt

SEQ ID NO: 848 - DNA, 24779 bp, Homo sapiens
tcacaatttacaattgtgtgttgactatatatataaagaaatttttgcatacattgccacttcttccagcactgattattctcagattgtttaaaatgctaccatttcttttttctcctcatgtcattgtttcccatacctttaaatgctgaggccctggttttctaaactcttcatttttacatttctgtaaagatgtatccaacagaaaagaaataaacagttcttgaactgtcacccaaacacaccaagatggcatgatatgagtaaaaacaaactttttcttgtgctaaggacacatattagtgtatttttctaggaggctagagaggagggtgtgaggcaatgtagagagatttataagatcagtacttactttgttaaatgctgtcacctttgtggctggacaaccgaattccaggtcctaatgtatttataagctctttgttcctctcaatagttccctcccactgaaagaagggtcaagttagggaaaagccactcccacacatttcatggccaaggggccacctactggattctaagacatgaggcaagtgatctgcttatcagaagacactggttaatatgttccttttcaaggttggtaatcaaagtttaaacaatacatttcacctagattttgctctttttgcaagtcagcagaaactggctttttaaagatactttttttcatgagttggatgcaaagactagggcaactgaaaaaaccctattgtgagcatagctgggagaggatgtctgtgaagggcaagctgatgccaccgttttcttactgggttgccaaataaaatataggacatccatgtaaatgtgaatttcaggcaaacaatcaacaattttttagttatagctatgttccaaacacggtatgaaaccagattatactgaaatattatttatcgtttacctgaaattcacatttaggtgggtatcctgcattttatctgacaaatccgggaaccctatttgcatatgctatcctctttgcgtcactcaaattgcccataatataacaaatatgaaagtatccatcacctggattcatcaattgcaaatattctttcttcatctacaccatgtagggggttatgttggaccccaagaaagacaggtccatatataaatccctagatcctgtgaacttgatcttatttggaaaaaggctctttgcagatgtaatgaagtaaaagaatttgagatgagatcatcttggtatatctggataggccccaaatccaatgacaattgtcctcacagcagagagaagagaagacacaacacacagggggtgaggtgcaggaagacagaggcagaaattagagtgatgtggtcatgatccatgaaagtccagaaaggccaagagccccccgaaactagaagacgcagggaaggattcctggaaatcacttctaatccaaacacgctggcacaatgacacaccagggaaaaataattttaaatatagttacttatacgtaattcacatataccatctgtatcttcgcagccaggcctgagtggcactgaacgaactgagggaaggcttatgcccgggtccccacagagccttaaggaggagagtgaggatgagccaggagcacatgcactgtaagggatgacaagttggcctgagagcagagggtgggtctgtttgctcttcaatatttcctcacctcctagaaaactgagggatccatagcagacagaaaggttgtttgaaaatgcataagaaaaagtgttttcatgagaaataaaatggatgtcaaggaaaaaagaaaatttcattttgccattccccagaatgataactgttttcttgtgcagaatgtcagaagtaaatttctatacatgagtttttgataggcaatttcacaaatgttgcaggacaattcttgaaaaagtcaaacaaaccacatagtctacattgtactttttactaaatttttaattccaagaaaatttatgggcagttcggaaatctgatttcatatcagatactaatgaaaagaaatcaattttaactaaatctggtcataggcattttactatgtaattagcatacaatttttaaaaagtttattaacttcacaatagccacaaccaacatttagataaagcaatttattgttgcaaaactttagaatattggtattgcatgttcttggcatccatgcctgctttatcaaaccttgaaaatctttgttgcttcttgtaaaccttttgcatctatgggaagcttcctcaggctgccaggctgcaaaaacttcttcactgtggggagtttgctgattctgattttcagggcccgcaatgcacaaagcacagcctcagagtgaagccaaggactgacaccaccattaacacaacccagggaatctgcgcccctcctacacaaagaccaactaagttccctctatcagcaccagtagggaggcagaaagagacactacgtgagaaatgaagataagaggaagaacatgcagctcactagcattttcccaaaaaatgtctttaagactttattcagttcagtcttcctaccctcttccttacacatgaatcttgtagattcatggctcttgtagaagatgagaaagaacaatgtgcctgtgagatatcagcacagatcagtctctaagcagaagaagtgaagatatgggaaaattgagttagaaatgaaaatagaaaatgttaaagtcaaaccatggggccactttttcccatagagagatatagctttcggggacagcgtgttgggagagctgtgcacaaggaactcagttatctgacagcaggagccagagcataaggaaggaaccagatggaaagggccctgctcagacacacttggtgtgggaagataagggcatattgggataaagggcatcacagagaactcaggaacagaaaccacagtgaaataaagggatgaggagagatgctgggccctgggtccttggcattataaaaagcgaaatattcttggggtagcatgcacatcagatttccttggcataacaagaaggcatttccatgcctcagaatcaggacttggaagctcattttggagacctggggggccctgaagacctggagaaggctgaggtcagaatgtggccagtccaagggcccagatactagatcccaagatgggagatgaggagctgcctcttgaggactgggaaatgggtcacctttagcacagggaagttggagatgaggctggagtcaggctcttccacgtggtagagaagtttgaccaggtgaatgtcagcctggctcagcttgttgccaatgaagtagtcttgttcatggctcttcaacacctggagaatcagaggaatcagatcaggaacacatgtgcaatgaggctggggcctctgcttctccctgagtttgtccaggctgactctccctctcccacctctgcttccttactgggcaggtgcagagatccagacctttctccatgttacctgattcagtgagagagtaagaagtgtggctctgctcactccttgtttggagcccaggctcccattttctcttctcattccacatcactatggcatccacagcacccacccagcttgcaacttccacatgggccaggggcttatcccctgctgcagcctgttctgtctgccccaggccctacagtgtgcatccctgatgttcaatggctctacacactctctctccagtctctcttgggcagcgactccaccttcatgacagcactcttctcccacgagtagactatttcagaatcctcatttctcctcatctgccctcctcatttcctgctctgggatctgaaataagcctgggtgaactttaattcatcctctttcttgcaatggtggttcttactgctttgactatgttataatctgcatgccactgtgtcccagggtgaactgcaaagatgtctgcaacttactttgaaatgcacaataataataataataataataataataataataataatgtgtttgagtgaggcaaacaggggtggagtgactgacacgtgataaatcaaagataaaaggttaactttgctctttagatccttggtgtatatatgttcataaaacatttctttggactacactaggtgtattcatttttaataatacaatttttgactgatatatgatatttattaaaatatctcagcacattgacatcataaataataaaaagagaaaacatggcaacattgatttaagataatattttggcaaatacattttcacactatgtatacatacaaacgtatagataatgacttggtacacaaacaaaacaacttcaatgctatattgtaatatacattgttcaaatgcacatatcacaggctatttggtagaactcgtagtattcttattcacagtctatttttataccatgccttgagagtcaggtgctccattaacatcaaggaaagctttttggaagtgaaggtcaatgccccaaaaatacacaggtactattttatttttctgttgccttgtgttatggactgaatgtttatgtttcccaaaaattcatatgttgagatcctgacccccaaatctttagaaaagatccctaaaaaatatattctttcaagccattagtaggtgggggtttcaggagatgatcaagtcatgggggtggagctcttatgaatgacattagttcccttataaaagggatcttagagaactcccttggcatgtttgccatgtgaggacatagccagagattggctgtctatgaaccaaggaacaggtgctccccagatgtaaaatctgctggcacattgatcttgtacttcccagcctacagagctgtgagatagaaacatctgttctttaagctacccagtctatggtattttgttattgcagccaaactgctaagaaatcctctaacctcttagtgcccttatagactaaacagcttctatcatgacccttacaacagtcaaatacaccagcattggtcaataactgccagcttccctaatttttgcctctattttcaatttatgaccaaccacagaaagcaaaatatggatctctgactaatcccatagaaatccacacttctagttagccagcttacagcatccctaggccagcaacctgcaatcaggacataactttttctaccatgaatctctcagactttcctgcctacctctgaatctctgacaaatgcaagtgatggtggctgacttcctttctatagcaagctctgtataaacaccttttgcttattctcatttggattgtcttcacttccacagtttttctggaggtttcaacaagacatggtctatgttgcccattgccatggaccccagccgtcaaccaggttcagtattcacaaatgctccttatcccttgtggtaagcccacacctgggctgaactcttttctctttgcactgagctctttgactttattctcaggttggtccttggttttggtattggttctcatctgcttagcatcctttgtagaatcaggattttcttttcatttcttttgtagtcttttgtgttactgttttttgtcatgtgatctaaaggtgttgtttgtcataaaagaagcagcataagagcagaggcccaggagcctgtttttcaagatagcctcacagtacattaagttcgaggttctcattggacccctttccatttgtacaaactttgctgtgggtcatccttaaaaccaaatgaagttcttctctcttgatttttggttcttgttctgcaaacttggcagtgatccagacagaaacatcacagtttccacttgaggcagagtattgactgtgactttagatttactttatccttgttaagtggtaatccatatatcagactgaataattctctattgtagttttgaagctcaaatcacgtagccactaagaagctgaagaaatgcctagggcgagatctggggaaggcctggacaggccaccctccaagaagctccatgtgtttagttatccagaagctcccaggtacggtttcaaagacagggaaataatggcttgttgttccctctttgatcagggcaagctttgcatctttttcctcaggtggatgcaatgagcaatgaagaagcttttcactcaaacctgccctaccttctatatacatatcgaccctgtaagacaaaaataaccaaactgctgagtgccttctgccttagattttatgtttaaacacttgagaccgtgaagctttaggtgacaggaaattaattcagctccactgcgtgccttttatatgctagtcattaggctatgatttttataaatatatttacatttatttctcagaacactctactgtgatagatttatatctaaaatgtttgttttacacatgaccaaatacaggtacaagaaacatcggtgacctgtccagtgtcacagtcatgagagaaattagtggaatcactgcaagtaaccactgatgctacaaatagggtttgctcactctgctgtggtttgttttacacataagcttagcgtgattcatatggctaaagccctgccatttacataatcccaagacagcctccccagcacagtgatctcgaacgtgtctgttttcctctctcatcatactacaaatcccaggctcacttttatgcccaatattagaagttcttaaaaaagaaaaaattaaaataaataaaggaaaaactaggaaataaggtatgtttttaaaagatatccctaaaaatatattttttcaagcaagctactaattttcaaaaaaaaaaaggagttctctcaattgttttccacaaaacattgttccattaccttctccacatgatattggccaattctagtcatgattgtgtttcaagacctcacctaatattcccatagtaacatgggaaaattgtttacatgggaaaattggtaaacatggtaaaattattcatatagttaaagccagtgcatagcataggacatcttctttcttctcatttcaaactgtgtttcctacaaaacttttgtttgtttgtttgttttgagacagtctctttctgtcatcaggccagagtgcagtggtgtgatctcgtctcactgcaacctccgcctcccagattcaagcgattctcctgcctcagcctcccgagtagctgggattacagacacctgccactacgcccggctaatttttgtattttgagtagagatggggtttcgccatgttggccaggctggtcttgaactcccaacctcaggtgatctgtctactttggcctcccaatgtgctgggtttacaggcgtgagccaccgtacctggcgaatacttttaaaataacagctgtattgacaagtattcacataccataattgccacccctttatagaatattattcagtaatttgtagtacatttacagaattctgcaaatactatctccgtctaattccagaacatttttatcatctgggaaagcagtagcacgtgctttgacagccatttcccattgccccctttctccatcccctgtcaacaactgatttgctttctggactcaaatggtctggatggttcatacaaaagaattcatgtcacatgtggcctttggtgtctggtttcttttacagcacatgttttcaaggctcaccaatgttggagcatgcatcagtacttcatcccttttttttaaattttattattattatactttgagatttagggtacatgtgcacaatgtgcaggtttgttacatatgtatacatgtgccatgttgatgtgctgcacccacaacctcgtcatttagcattaggtatatctcctaatgctatccctcccccctccccccaccccacaacaggccccggtgtgtgatgttccccttcctgtgtccatgcgttctcattgttcaattcccacctatgagtgagaacatgcagtgtttggttttttgtccttgcgatagtttgctgagaatgatggtttccagcttcatccatgttcctagaaaggaaatgaactcatcattttttatggctgcatagtattccatggtgtatatgtgccacattttctttttttttttcctttttttttacttcaagaaatattttatttatgaacttttttttcttttttttaattatactttaagttttagggtacatgtgcacattgtgcaggttagttacatatgtatacatgtgccatgctggtgcactgcacccactaactcgtcatctagcattaggtatatctcccaatgctatcccttccccctccccccaccccaccacagtccccagagtgtgatattccccttcctgtgtccatgtgatctcattgttcaattcccacctatgagtgagaatatgcggtgtttggttttttgttcttgtgatagtttactgaaaatgatgatttccaatttcatccatgtccctacaaaggacatgaattcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctaggtctagatccctgaggaatctccacactgaattccacaacggttgaactagtttacagtcccaccaacagtgtaaaagtgttcctatttctccacatcccctccagcacctgttgtttcctgactttttaatgattgccattctaactggtgtgaaatggtatgtcattgtggttttgatttgcatttctctgatggccagtgatgatgagcattttttcatgtgttttttggctgcataaatgtcttcttttgagaagtgtctgttcatatccttcacccactttttgatgcaattgtttgtttttttcttgtaaatttgtttgagttcattgtagattctggatattagccctttgtcagatgagtaggttgcaaaaattttctcccattctgtaggttgcttgttcactctgatggcagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttgtggttttaggtctaacatgtaagtctttaatccatcttgaattaatttttgtataaggtgtaaggaagggatccagtttcagctttctacatatggctagtcagttttcccagcaccatttattaaatagggaatcctttccccatttcttgtttttgtcaggtttgtcaaagatcagatagttgtagatatgcagcattatttctgacggctctgttctattccattggtctatatctctgttttggtaccagtaccatgctgttttggttactgcagccttgtagtatactttgaagtcaggtagcgtgatgccttcagttttgttcttttggtttagatttgacttggcaatgtgggctcttttttggtgccataggaactttaaagtagttttttccaattctgtgaagaaaggcattggtagcttgatggggatggcattgaatctataaattacgttgggcagtatggccattttcacaatattgattcttcctgcccatgagcacggaatgttcttccatttgcttgtatcctcttttatttccttgagcggtggtttgtagttctccttgaagaggtccttcacatcccttgtaagttggattcctaggtattttattctctttgaagtaattgtgaatgggagttcactcatgatttggctctctgtttgtctgttattgatttataagaatgcttgtgatttttgcacattgattttgtatcctgagactgctgaagttgcttatcagcttaaggagattttgggctgagacgacggggttttctaggtatacaatcatgtcatctgcaaacagggacaatttgacttcctcttttcctaattgaatgccctttatttctttctcctgcctgattgccctggccagaacttccaacactatgttgaatagtagtggtaagagagggcatccctgtcttgtgccagttttcaaagggaatgcttccagtttttgtccattcagtatgatattggctgtgggttttgtcatagatagctcttattattttgagatatgcccatcaatacctaatttattgagagtttttagcatgaagcattgttgaattttgtcaaaggccttttctgcatctattgagataatcatgtggtttttgtctttggttctgtttatatgctggattatgtttattgatttgtgtatgttgaaccagccttgcatcccagggatgaagcccacttgttcatggtggataagctttttgatgtgctgctggatttggtttgccagtattttattgaggatttttgcatcaatattcatcaaggatattagtctaaaattctctttttttgttgtgtctctgccaggctttggtatcaggatgatgctggcctcataaaatgagttagggaggattccctctttttctgttgattggaatagtttcagaaggattggtaccagctcctccttgtacctctggtagaattcggctgtgaatccatctggtgctggactttttttggttggtaagctattaattattgcctcaatttcagagcctgttattggtctattcagagattcaacttcttcctggtttagtcttgggagggtgtatgtgccaaggaatttatccatttcttctagattttccagtttatttgtgtagaggtgtttatagtattctttgatggtaggttgtatttctgtgggattggtggtgatatcccctttatcattttttattgcatctttttgattcttctctcttttcttctttattagtcttgctagcagtctatcaattttgttgatcttttcaaaaaaccagctcctggattcactgattttttgaagggatttttgtgtctctatttccttcagttctgctctgatcttagttatttcttgccttctgctagcttttgaatgtgtttgctcttgcttctctagttcttttaattgtgatgttagggtgtcaattttagatcattcctgctttctcttgtgggcatttagtgctataaatttccctctgcacactgctttgaatgtgtcccagagattctggtatgttgtgtctttgttctcgttggtttcaaagaacatctttatttctgccttctttttgttatgtacccagtagtcactcaggagcaggttgttcagtttccatgtagttgagtggttttgagtgagtttcttaatcctgagttctagtttgattgcactgtcgtctgagagacagtttgttataatttttattcttttacatttgctgaggagagctttacttccaactatgtggtcaattttggaataggtgtagtgtggtgctgaaaagaatttatattctgttgatttggggtggagagttctgtagatgtctattaggtccgcttggtgcagagctgagttcaattcctggatatccttgttaactttctgtctcattgatctgtctaatgttgacagtggggtgttaaagtctcctattattattgtatgggagtctaagtctctttgtaggtcactaaggacttgctttatgaatctgggtgcgcctgtattgggtgcatatatatttaggatagttagttcttcttgttgaattgatccctttaccattatgtaatggccttctttgtctcttttgatcttttttggtttaaagtctgttttatcagagactaggattgcaacccctgcctttttttgtttctcatttgcttggtagatcttcctccatccctttattttgagcttatgtgtgtctctgcacatgagatgggtttcctgaatacagcacactgatgggtcttcagtctttatccaatttgccagtctgtgtcttttaactggagcatttagcccatttacatttaaggttaatatttttatgtgtggatttgatcctgtcattatgatgttagctggttattttgctcgttagttggtgcagtttattcctggccttgatggtcttcacgatttggcatgtttttgcagtggctggtactggttgttcctttccacatttagtgcttccttcaggagctcttgtatggcaggcctggtggtgacaaaatctctcagcacttccttgtctgtgaaggattttatttctccttcacttatgaagcttagtttggctggatatgaaattctgggttgaaaattcttttccttaagaatgttgaatattggcccccactcttttctggcttgtagagtttctgccaaggcatcagcagttagtctgatgggcttccctttgtgggtaacccgacctttctctctggctgcccttaacattttttcctttgtttcaactttggtgaatctgacaattatgcgtcttggagttgctcttctcgaggagtatctttgtggcattctctgtatttcctgaatttgaatgttggcctgccttgctagattggggaagttctcctggataatatcctgcagagtgttttccaacttggttccattctctccgtcactttcaggtacaccaatcagatgtagatttggtcttttcacatagtcccatatttctggaaagctttgttcattactttttattcctttttctctaaacttctcttctcacttcatttcattcatttcatcttccatcgctgatacccttgcttccagttgattacattggctactgaggcttgtgcattcgtcatgtatttctcgtgccacagttttcagctccatcaggtcttttaaggacttctctgcattggttattctagttagccattcgtctaatttttttcaaggtttttaacttctttgccattggttcaaatttcctcctttagctcggagtagtttgatcttctgaagccttcttctctcaactcatcaaagtcattctccatccagctttgttctgttgcgggtgaggaggtgcattcctttggaggagtagaggcactctgatttttagagtttctggtttttcggcactgtttattccccatctttgtggttttatctacctttggtctttgatgatggtgacatacagatgggtttttggtgtggatgtcctgtttgttagttttccttctaacagtcaggaccctcagctgcgggctgttggagtttgctggaggtccactccagaccctgtttgcctgggtatcagcagcggtggctgcagaacagtggatgttggtgaactgcaaattctgctgcctgattgttcctctggaagttttgtctcagaggagtacccggctgtgtgaggtgtcagaccgcccctactagggggtgcctcccagttaggctcctcgggggtcagggacccacttgaggaggcagtctgcctgttctcagatctcaagctgcatgctgggagaaccactactctctttaaagctgtcagacagggacatttaagtctgcagaggttactgctgccttttgtttgtctgtgccctgcccccagaggtggagtctatagaggcaggcaggcctccttgagctgcggtgggttccaccctgtttgagcttctgggccgctttgtttacctactcaatcctgggcaatggcgggcgcccctcccccagcctcgctgccaccttgcagtttgatctcagactgctgtgctagcaatgagtgaggttccatgggtgtaggaccatctgagccaggtgtgggatataatctcctagtgtgccatttgttaagcctgttggaaaagcacagtattaaggtgggagtgacccgattttccaggtgccatttgtcacccctttctttgactaggaaagggaattccctgaccccttgcacttcctaggtgaggcaatgcctcgccctgcttcagctcatgcacggtgcactgcacccactgtcctgcacccactgtcccacactccctagtgagatgaacccggtacctcagttggaaatgcagaaatcacctgtcttctgtgccactgactctgggagctgtagactggagctgttcctattcagccatcttggctccaccccttcatcccttttcataccccaagaatattccattgtctcctacagcacatcttgttcctccattcatccatgggtggacatttgggttgtttccaccttttgcatatcatgaataattctcctatgaacacttctgtgcatggattagtaaggatgtgttttcctttctcctggatgtagacctggtagtggaattgctaggtcattggtaactctatattggacttttcaaggaatggccatcaagggaggagacccctcctcccagctttgctgatgcaaaatcagtctggctgcttaggtctgtatcaaatgctgcacttaggtaagcctagtatcttgggcaccagcctctcaaaccttagtcaagttgaccagttaatacaactggctggaaacttaggttcctggtcaccattcttggaattactggaacctgagattcagctcctttgcagcattctctccccaggccttcatctaccgactctcaaacattctatgccttgtcctaagctgttggctggagtccagcctctgaagtcctgagcacctggaatcatgattccccatcctcctgagttcatggttcatcagcgtttggaaacctctgtcagggtgctggatccataggctgcattgtcttctagaatcacactcgcctgaaccctccccatattcactcttttctcatctccatgggactctgcaatactggacacaagcatatatgcccaaggcccagcctgctgctagttatgatgctccttcaacagtcctgcccactcacagaaggacctaaatcactctgtgttctctgttgattgaagaacagaaaatatactatatggggctctctcctttatgtctttcccacacaggttgtatttgctggcaatgtagttgagaatggctctggtctgcaccagcttcatcccgtcaatctcaaccattggcacttgttggaacatgaaactctcatctttagaaaatagaaaaaaaaaaggcagagtgaaatttctatgaatcccaccctttcaggatgaaaaagtggttgtggaaatgactaaatgtataaaatgaaaaaaaaattgcctggcaactgttcaaatgaaataggaatttgtttttagcttctggaagtgctttttttcatttataaatgtttattaaatgtcagtaatttttacaaagcaaatatttatagcaagaggcaagtgttttgcaaaatatgtacaaaagtaaaaagctgtaatgaactagcaattcattttataaaatcaaaccattctctccacttttagacctcctttagaaaaaatttgttgtccatcctgaactaaagcactgacaaaaaaatttacaattatcagataatgtgcttagttcctggaaagttataaaaagatatatgtaaaaaaaaaaccctaaaccacaagtattttatagagctaatacaaatcatgttttgttaagtacagtatctatgggattattacaaaatatacttttctataaggcttcttgtggtaaatgtgctctcaccagagtagtatagaaaagccatttcaaatgttttgcgattctgccttcaagtaagaggtaaaaggtaaatgccatagtttgttgcgctgttgcatatactttgcaagaattaatctctacccctttctttcctagtaccatcaaataggcatgattaagtacaaatgtatcacttactatggcaagaaatattataaacaaaccaaatattataaaacaagccaaagtcacataccaagtaagttgtacatgactttcagtgatattcaccgactgaaacatttatgcatagtgagttccagcatactctgatccatctgtaaactttcatcaacagcagatttgtataggtcacaaaactctcctcatcaagacataaaatattgccatatcattcatgctttcaaaacaatgatccatataagctcttgcatttgaaaccaggtatttagacctgaatgctgcaagagtgaacataacttaaatgctaactatacattcaagtacagacataagagtgctagtggtacaaacactgtacttcaaataatgttgttaatcacctaccagcctaaggctagtatctacttgatggaacttgaaaaagccacaaagtccaacttgtttaaaatgttcagacatagacttatacttaaagctctagtatacatttattaagccctaacctcgtaccataaaaaaatgggcatgtgctatatttgggacatgcagacacacccacgcccacccacaatctctcccctcctcctgtttactagactgaaaagccaccctgtatcctatcattaaaaaaaaaaaaaaacagtgcttttagtcaagcagcacaacacaaggacggatcatctgtgattaacagaagagaacaccttaaaataatgggggagagacaaattaactaggtactaagtcagatttccaagtgaaaaagacatgagcaaaacttctggtcttaattcctcaaataaaatgaaaataaataaaatggtaacagagtgactttctctaaattttttagggagtttgttacaaacctttgggctttacaggcatgatttcatggattcaaacacgaaattaacactgatatttagccttctcatgacacacacagaaataccattgctgcaaattgcaatggagcgaatcttgtttcaaatggcttagtttggggttttgtctaaatgtatcattatataatgaaagcaccaattagagggtttctcaaatagtgatttgaattttaggacataacagtataacatggtagctttattcttcatatataaacaaggcataattggatgtgtaatatgctgaaaatacattttatcaaaagcataaatacaagtatttgggtacacattgatcctgttatttcatttatgtttttatcccccatccagctacaaaataggtcccttgtattgtctgtgttgatttatcttcatgatatcttagaaagaagttgggagagactgcaacaggccaccagccagatgccatttaacatgggaatttctcaaagtaagtctcatgctgttgaagacattaaatacagttctgagagaagtttctatgtaggctctttgtgtgctcttcaatacccccattagacagtgtgtgcagggcaggctctgtgtttcttaccccatagctgctaccctgactcatgtccctcctcaccctctgacctgcacatccaaccaattcaacactgtctcattatctaagtctacatcattgaaaaaatatcaccttgtcaaacttataagagaaacaaattcaaaatggacctatttcaactccttttgtctaaaatctgtccttgaatggggtgggctatatggcatcctgagctgatgaccacagctcactcatggtgccaaaagcaggaaagtaagaaaagggcatctgcagggcgctgcatatggttctccagcaaatacaaagagaagtctggccctttttagcctggaaagagttgccagaccggctctaagagcccaccctttccattttatcgattttctccttctccaccatcaacaactacaaccttacatacacaaagcattgcttggctgttcaaacctccctgtgtatcttctactagataccctcctcagaggcacttagaggcttgatcttaccatttcttaacttttccaaatcttttgcagattccagaaatttcctttcagactggaagcagaaacagtaaatgggctcttgttaattcattccatagcattgcagacctttaaccttgaatggcttctgtctggtacataatttggaaaatataagacttctgatcttggcagagcatgcagaggaggctggtggtggccattttgaaatttacactagatcatcaagaaaagggcatggatcacagcacatagtcgctcaatcttctagttcactttacttccaccttgatcactcccatgtccctgattagggcatcatttgacaggggatgtcactggagttaagggatcaggcagttcttctaattatggagttgtcatatcttaggaaagcatatgtctctgagtgagatcagaccacagcctttgtgtccccagcatgggtatgccatgggccagtgaccaccaaagattctgccaccaagggccctctgctgtaatttacatcagctcagtttgtaggagccctgctaagggtgaaataggtcatagctgttgcatagttataactctggcaattataatttcccctcctggagtatatgggacacaataggatagaattctcaattttaggaaggaattaaagtccccactgtaacattatttttaatgaaaatctctggcttgtgacatggctgtgtgggtttaatatcctgtcatgtcctggcttcttgacttcggacacattgtagactccctctgtgtcttagtatcctaacctatgaagtgggtatacttatggtacctatgttataggttggtatgaagattaaattacaaagtcatgcaaagcactcagaaaagtagcaagtgtataataagtgctcattaaatagacactattaggattctgagagatggctgctgtttcatatcatcattaaaaaattaaatcaatctaatattgatgataatatactatattgctgatctatatccagtgatttaaactttgaaataaatcacaccttgtcctgagtgtagtcactttggttggaatggcagccagcaataaggctgtctcaatctgatcagaagctctgagtggatgcaagtatttaatacaaatatgaaaaccagttattgcataaaaatacagttgacttaataggcagaatctataaaaataaaaatcaaagtagacacttatcaagattttctgtatttcactgttgatatgatctggtaccaatcttgactctgcctcaaaatagctgtgtgatctgggaatcatcacttaacatcttcaagccttagtttcctcatctgcaaaatggggatagaacattttcttaaacagaatattgtaatgttttcaaaatgcatgatacagggcctgacccacatacatcaaggaataaatggtagttgtgtttgcagtggttacttatagtttaatggagatctttatggtgaaagttcaggaatttgggggtttctagcttgctccatggaaaagagtttgttgtggatctatgattgcacagtagcaggatctggagatcatggggggtgtgtgccagcaattaataaagcgtccaattcaggacaaacctaaggaatggtgggtggtcctggcaggagggtgaccgaggtggggtgggattggcaagtgggatgtgcttgtgaggctgaggactgggttgtgatcatcagccttagggcactgagaccccagaagcctgagtaaggtctgcagtcagcccttccactgccttcagtcaagctggatggatgccagggaacctgggttcctcccagccttgcccctccctccctcctgctgaactcttcctacccgggctctgaacacatccctgagctgcagagctgatgtctgggtgacagtgaaacagggtattcatttgtacaaagaaaacaacctggaatggcagtgtttggatttcttgtgtgcttacttcctcataggattgagaaagggtgaggctaaagggtttggcccacaaaaccatttttctctctaggcctctaggcctgtgatgggaggggcggtaacaaagccctgggcatgccctggagacattttccccattgtctttgctgttaacatttggctacttttgcaaatttccaaacttttgcaaaaggagcagtatgttcataactgagacttttgcaaatttctgccactggcttgatttcatcccctgaaagtggggttttcttttctaccatatgatcaggctgcaatttttccaaacttttatgctctgcttcccttttaaatataagtttcaattgcagattgattcattcagattcaatgacagatttcagatcatgtctttgggaacacatatgaacatatgctgttagaaagagccaggctaaatcttgaatgctttgcagcttagaaacttcttctaccacataccctaaatcatctctcaagttaaaagtctcacagatctctagagcagaggcacaatgccacgagtctcttcgctaaggcatagcaagagtgactttcactcccattcccaaaaggtttctcatctccatctgagacctcagcctggacttcatggtccatatcactgtcaacattttggacagaaccattcaactagtttccaggaagttccaaacttaccctcatttttctgccttcttctgagccctccaaactgttccagcctctgctccttacccaattttaaagcagcttccacattttcaggtatcttcataggaatgtcccacttttctggtaccaatttcttgtattagtccattctcacacttctataaagacgtatctgaaactgggtaattgataaagaaaagaggtttaatcagctcacagttctgcaggctgtacaggcgtctgcttctgtggaggcctaaggaaacttacaatcatggtggaaagtgaaggggaagcaagcacatattcacatggctgtcaggagagagagaatgaatgggaaggtgctacacactttcaaacaaccagatctcatgagaactctataagaagaaagcactagggggatgatgtgaaaccattcgaaaacaccccatggtccaatcacctcccaccaggccccacctccaacactggggatgatgtgaaaccattagaaaacaccacatcgtccaatcacctcccaccaagccccacctccaacactggggatgacaatacaacatgagatttgggtggggacacagagccaaactatatcaggtgtcatatttttttcctgtgaattattttatagcctggacaggtctcacatctggatccaaaaggaggacatcactgaagctcctaatctttcctttatatttttccccactattaaacatttattccaggacattgttgacttatattctaatggcaccatacatattagctgggttcctttaggtgcattttaaaaactagctataaggctgggtatggtcactcacacctgtaaacccagcactttgggagacagcagcgggaggatcacttgagccaggagcttgagtgcagcatgagcaacatagcagaccatgtctctacaaaaataaacaaattacatcaggtgcaatagcgtgcacctgtggtcccagctactcagtagactgagctgggaggattgattgagcccaggaggtggtgattgcagtgagccatgattgtgccactgctctccagcctgggccatggagaaagaccctgtctctgaaacaaagcaaaacaaagccagttatatgctgcagtaattatttagttattctatcagcttctgaattttaatacttgagaagtcatgtagtctgcagattccaaaccacaaaatattttgctcccataccccagaggacattcagagtatctggagacattcttggttgtcacatcaaggcagaaggtggtgggtagtgcttcaacataggtaggtggaggccggtgatgccttggaacatcctatcatgaacaggacagcccctgaacccaaagaattacccatcccaaggggtgccaagggtaagatgagagacttttccttagccattttcaaggtttgctgtgagttggttgaaccctagatagagaatgtaacttgtcatctagctaattagtgggaaagactgaatcagattctagttttcctgacattcagaaactaatttattcctattataaatcaaccttaattttgaattttcacagctataaagtattacagttacttatatacacattgtgtccctactaaattgtgaggttccgaaagagcagagaggtctcacagtatgtttaacacagtgtattgcacatggtagtattacaatatcactgatacttggatagatcacacagcaatgctagacattttagcagtcacagagagttctataatttcatcttttgaacttccttgatgagaaaatcaaatgatatagaaaaaattaaatagaaaaattaaataatagattccagataatggatcaaccaatcctgattatcagactcaattttctacaatttcacagaataaataaagatatgggtgtggctcactgagtagacccagaaggactaagaaaagaggaatttggaaagagcaaggttatcaggcaagtgtttaattgggcaaaggacaaggattaacagatatttgttgaatcaggaatctgaaaattcacaagaagggcattattgtttttaattttgttaatcattaatctaggtcatcttgctttatagaactaaaagttctaaagacttaaattcacctgtaagttctagaaaactgctctcaaaacattctgcctccctttggagcattacaatcttaaagaaatattgaaaagccaatggcatcaacacttgacaacaaatcacaaagcacttcctgaaagaagcattaatgtgtgatatctaccatcaagttgcaaattagacttgtgcttggcaggtgttggtggctcttttctcagcaggagatggaggtttggagaagcaactgcagacatggaactgtctagttgtatgtcccttttaccagtcattgggaattcccaagtctgtgatcttgccaaatgtaagttcacaataattgtgtgttgattacttgtctagaaaatgtaactttagcataaacacctacttttgctctggcaatgatcatattctcagatgacctaaaatgacattgacaggtgacagtgtgctggcagccctcgcagccctcgctcgctctcggcgcctcctcagccttggcgcccactctggccacgcttcaggagccccttcagcccgccgctgcactgtgggagtccctttctgggctggccaaggctggaaccagctcccttagattgtggggaggtgtggagggagaggcatgggtgagaacctgggctacgccaggcacttgcaggccagtgcgagttccaggtgggtgtggactcgccaggccccacactcagagtggctggccggccccgccggccccaggcagtgaggggcttagcatctggtccaacagctgctgtgctcaacttctcgctgggccttagctgcctccccgccaggcagggctcaggacctgcagcccgccatgcctgagcctctccccctaccccgccccctgactgtgggcttttgcatggcctgagcctccccaacgagcgctgccccctgctccagggtgcccagtcctatcagcggcccaaggactgaggaatgtgggcacatggcacgggactagcaggcagctccacctgcagccccggtgtgggatccactgggtgaagccagctgggctcctgagtctggtggggacttggagatctttatgtctagctaagggatcgtaaatacacaaatcagcactctgtatccagctcaaggtttgtaaatgcaccaatcagcaccctgtgtctagctcagggtttgtaaatgcacaaatgggcactctgtatctggttactctggtggggaggtggagaacctttatgtctagctaagggatcgtaaatacaccaatcagcactctctatctagctcaaggtttgtaaacacaccaatcagcaccctgtgtctagctcagggtttgtaaatacaccaatcaacactctgtatctagctaatctagtggggacctggagaacttttgtgtctagctcagggattgtaaatgcaccaatcagctctctgtaaaacagaccaattggctctctgtaaaatggaccaatcagcaggatgtgggtggggccagataagagaataaaagcaggctgccccagccagcagtggcaaccagctcagttcccttcgacactgtggaagctttgttctttcactctttgcaataaatcttgctgctgctcaccgtttgggtccacactgcttttatgagctgtaacacgcactgcaaaggtctgcagcttcactcctgaagcctgagagaccacgaacccactgggaggaactaacaactccagaggtgccacattaagagctgtaacactcacgcgaaagtctgcagcttcactcctgagccagtgagaccacgaacccaccagaaggaagaaactctgaacacatctgaacatcagaaggaacaaactctggacacgccgcctttaagaactgtgacaccgcaagggtctgcggcttcattcttgaagtcagtgagaccaagaacccaccaattccggacaaa

SEQ ID NO: 849 - DNA, 196103 bp, Homo sapiens
ttgaagagtgaaaagaatagatgtgacatgaatggacagatgaattaggaggcatacagtgtaataacacaaagaaattattgtgggttcatatctaaactccatcagaaaatatattcatatattctgtaacatgaacacatttaatctatagtggttgttctcagagtaacagaaaaaaaatattcttattattaagttcactttcagaaaaatataattaaaaaccacataggacaaggagagacaaagaataaatttccttgaatcatctaaaaataaatgtatcaatatagcaacataccactgtgggctcttcatccttcctgcttcattaattacagtccagtgacacctccatgcccagtcctagctaaaaatcatactctcaacactaaatattaagtctcagattctgacaagtatgttcatgtcagtagttacaacaagcaaaatatgtgaaatcaggattatagctgtgggtgctagaagtggattctctgtcctattattctccattttcacacaactacacatccatccatcttccatctttccgattctgttctgtgccctcagaggttgacacccacaggccaaatcacttgggctcccttgtcctgcaacctccagttgggttttgacaaggggaggtaccaggaggtcaatgggtacagacggaggggagagagagagagagagagagagaaattgactggggcttccctccatccttcctggccctgcttgcttgaaatctctggttccggtggggactgcaaccctctaggatttaccatccaccagatgtcccttctgctagggctccaattctcattagctctgggaacagcatttattcctcttgtccctaaagacctaacaatagtaacagcttcgcaccatgaatagttcaggtgtcttgacatccttctttgttttttttaaaactgttttcttcagcctcctatctgagggtactgttttcttctggaatctgaactgacacaccctggaattacagggttatgtttccctgaagggaagggtgacaataggaagtactaatgaagatatttccccctcaggatgacatatgctctctaatttagtgactctcccacccccccaccaccccccaccccccaaccccatgaggtcagcatggaggcaccagaggacatatttacaattcttggccttcaccttgatgaaagcagcaatcttggggagagggagaatggtaaggaaaaactgccgaggtgcaagctgtttcttgaccctgtgcccatcctgagctgtataagattctcagagcacaggaaaagaaagccagagccagggctgagccaggtggaggaggggagggctggaagcctggacctctgggaggtgctgccccgccatgtgccctgagggccttgatgtgggagcagaagagatggcctggtgtgtccaagacagtgagggcctggttccagcccccgctcttccaggagctaaaaagagcctccacatcctactgcactgaaaagaggagttggccttgctgaagggaggatggcccacaggggctcacagggtcagggcaaagggttgctcttggggaaagctgcaaggaggtgtgaactggaggcagagctgctggaacacatctcagatgccaaccttaacagcgaagacgcatcaggcatctcagccccttcgggcagacagagacactgtgctggatggtgggacgctgcccatgacacggctcactgtgagctcccgacttagattcaatgccagaaacaggggcagagaggccaatggctgaatagaggagacttccaatctgaaacgcttgagtgtctctcccggtgggtaagattctggtttttacccttaggtggaaggtggaatgggcacactagaacactattcttttctccctctttgtgagcagcttcttcgataaaaacagtctatttttttcccaggtgcacccaagtgttcagtggcttcagtgaataaagtcactggaagatatggggctcatttctatttaattagatataacttttcattatcattattgtgaacttggctttaaattatgcaaatatatataaactatacattatcacttccctttatttaatcctttatatatatatgtatttattcctttaaataaatatatacatatatttattcctttatatatatgtgtgtctataggtctgtgttttcatggccatacagtgggctgcaggccactttgcaggaattcttcctacctaccacacttactgcttagcacacaggtgttcaaaagacatctgtaacaaataactaattacacataattgtaaagtaaagtaaagctagaccaaaatgacataaaatctgaatcaatgtttccatgcagaaaatcctagctttcactacagctttattcatttcatacttatataaaatactcatggtatttttccacatacttagtgctgagttacactcatgtttgctttccattctctgctgtctttttttaataatacagaaattttcatacaaaaatgtactgaacacgtgtagtagcattatagaatcagagcagtagctgcaaatgatttatgaaactatctactctggataatacaacagtgctatacatacacaattacttcataaaatatggaatacaaacatgaataggaatgcctatgacattcaatgtgttttgtcggcctttaaaaacttatttctgaacacagtggcttttcttcttctttaaaaaaaaaaacacattctatcagaatccatctaaactatttcagagatgtgaaaagctgtcatatttgcaaagaccaacagagaaaaaggtattacagttatccattccacctcttgatgccagttaaatatctttgggagctcatttaggtttctaaaagagaagatcatgcaaaatgcttattttaggtctccttaatggagactgaagaatgttatgcagctctctgcgttttttttttctttttatgtctaaattatttgacttctttaaacctttcacctggatacttttcaagttttccacatgcatctttaatagaggaggcctggaaccaaccaaacatagattagaacacctcacttctctaaagttaacctttatcgggcaagctcagtcactcaagaaagagtcaagagccaggatgtagacaaaagaccactgagctgccacatcttcacaggaccaactaacaggcaacagaattgcaccaaagcttgaggtctgtaacctgtactcagatccatcgtaacccacttattctttttgtagacaacctaccaacaaccattaacaaccttgtcttcaacctatacattaacaaaataaaatgcatgtcaggacacagatgacagtacctaaacaccaatagcaaactggagctgatggtggagctacatccacagacatgcactaaagaagaatagatttttttttaatggatgcaatcagaactccacagttttataacttctgaaaaaaagagataatatatttatctagtacttcttatacatgatttttatagaagaaatcgtttaattgtatacacatatatcaacataaaaaaaaggccacagaaatgcaaaaacttttttaaaccttccaatgaccaggaagatatgcactatgatttctcctttgtgcatcaagcgctttgggagctaaagaggcttgccaaagtaaagtagcgcgtccatggaagagagaagaccagattccaggccatttaacccccaaggctactgatctttgtagtatagtcaaagacgcagactcagcattcttaaacttctgattgcctttcactcacttgcctgctcttgcctcctaaatatatgtctgttcttaggaactgtatttggtctttgtagtagtcagtgagggatgccataaccaaacactactgacagggcggcctagacaacagacactgattttctcgtggctctgcagattgcaagtccaaaatcaaagtatctggacgtttggtttctcctgaggcctcctgcgttggtcttcagatatccattgtcttgctgtgtcctcacatagccttttctctgtgtttgtgctctcatggtatttctgccttttcttaaaagcatgccagacctattacattagggcccaatacttacagcctagtttaacatgaattgccttggtaaagaccctatctctaaatacagcctcactggggaggttaaacttcagcaaataaattggccggggcggggggggggtgcagaattcactttccctgaaaggcatatttattctcaatgcttcgattatatctccaatatgatgtacaccaaacctgtctcttcaggtctcaggtcttatttgtgctacagtcacaaatgtatttccaactacctacgcaatattctcattctgatatcctgttagactaaacttgtatcaaaccaaactcattggcatcctggtcaaagacattttcttttctcgtgtccttgcattaatcaatggtttgatttggtttgaactacttttcactattcctgtcttcctcatttctccagccgataagcaagtcttactgataactctgttcaaaatgtgtttgcatttagtcattttatcctccccctctaccacttgagtaaaggccttcataacctcacacctgaaagagcacgataatcatctaccaccttggacccaaggtagatgctcaaccttatttaatgccctcctattgtgtatgagaggaatccattaataggatggtatgtcactcttattgttaggttatgttataagacataggtagctttaagaaaggattaacctaagttagacttaacctaatcaagttaccccttaaaagagacgtagctcatcctggtgaaggagacttcaatcatgagagaaattcaacaagaaacagattgttcattgttagctttgaaaatgaagggagcactcactgtggcacggaatgcaggcaggtgacagtccccggggaagagccagtgaggaatggagtcctcaatcctacaaccataggaattgaattctgccacagctacctgagcttggagaatgaccccaagctcctaatgagatttcagtccttattgacaccttgatttcaatcttgtggcactccaaacacagaacacatctatctatgttatgccaaaacttctgagctacagaaatggtgagatcaccaacaggggtctctttaagactctagatatgtggtaagttgttacacagccatagaaagctaacattacttggttaccctctaattcacctcccactgccacatttatatttcttgttcaattagttcattattttggtgcccttttaccaacctcattgaacattatcataatgctaagggcctatgggtgagtattatatgccttaaacatacacacacacacacacacacacacacacacacacacagacacacacacttcccagagaaagcagttacgtgacttttggaaacataaccaaactgtcaaaagaacataaaactagttactcatatttggaaaggtaattcagtactatttgttctgctatggtgtaaaaaaaatccacaatattttaatggcaatagttattaaatagtgaaaatctagcagcatttacatcaactaatgttaagttccataagtactatgcccaaatattattttatcccttatcatgttaattcctgccattgaaacttacacccagttttcaaagaactttgatttttgcctcacctaagacagcaagtctattcccccaatttggcaatacaaaaacttttgtttcaggcaagccaatgttctcagtgctccactgtgcatctctgttcaatgcgattcctttcagaaccacttatgaagaagaattcctctccatcaatccaaacctttgagatgcatctatgcatctatgaacttcttgttcataaattcattaattaacaaacatgtactgaagtacctactgggtatactagaaatgatgagatgctttttcattggaaattggttaaaactaataaagattaggaagctgtaaaaaaaaattagacaaagatctctatgcaagaatatcaaattatactggtcaaaattcatctctactttacaaaagatgtctgtaaaccacaggaaggagacattgtttttaaaagtatacatgtatagttggctatcttttgcttaacagagaaggaaaataagaaaacatttgcttatctttaagaaaacaagctcaggaagagtaagctggaaacatggcgttgatggaacacaagtggtggatggaggtagtggagggccaggaggaggcaatgggaggataggaatgaggagggaggcagccttctctgcagggaattttttgtatagattttgctcctggaaatatgttaaaggtccaaatacattcagtcaacaaaggcaggacaatcctataactgaaaacatactgaaacaaataaacctaattatatctcaaatggatatcattacctctgtgaagggagaaaaaaaaagaaatagaagtaatccaagtgattataattcatttggaataggccttttcctcacctctgaattgcaggggttgttggtatttaagtgattgaaggtcgtctcttatgttgccgcaatcccctattattttggcaggactcatgactcgtctaaatagtcagttttcatcttttatttatgctgtttttttctcctatgtacacactatagaaatggaaacttcactgtagtaaacttttccctctttgttaatgaccactgctggcctaaaaatgttacctttattttaacactgctgcctatggctattagaaaaagttgtttcacacataaacatacttcttggaaccaaaaactttccatataactaaaatgtaatgcttgactcatccagttctatctatctatctatctatctatctatctatctatctatctatctatctatctatttatccatctgtccatttatctatctatccatctacctgtctatctatctatacttcccccacacttatatatgatcctcttttaacgacttggggaacttttcaacattttgttactccactggcttttcacacaaatggggaaaagacagacttaagggtaccagataaacaaaaattactaaatagctaagagcaactgtctcaagggtcctggggacctggaggccctgctgccaatgctgggacccagcacctccactccagctgctgctgccagatgtgagtgccagggtagtcagatgtgttgtttaactcaagtgaaaatggaaatccaggtttttagatgtaatcaaacagtttccaaatattggcattcaattcaagatatttatttctaaactatctgagggccactcccaacccatctataggtcacattcagctgctgaggacattgtgagacctcagatatggaacaacaaagccaactagagatacctaagcaccaagttatgtattacaaacaagatttgcacacaagggagaaataaaactgggagcagaagtggaaagtgctgcagaaggaagacttgaactgaatttagaaggaaaacactacatcttagagtatagaaaataaaagggaaaaaaaagtttgccaatatgtcatggctaattatgccctcagtgtctttgtaaacggaagtgccaggccactattcactgaaacttagcttggttttaccaaacctcgaaaagttaatattatgatacatccagaaagatgaagataaacatgacatgtttataatgtgatttccccattctacctctaattttttaaaaaaattatcattgctttttttttaaagttgtgagtatgtttcatataatgtttctgatcttttctcaatgtccagttgtttttacttcttgctgggtcagagtataattcttgaacgagcttcgctcttatttccaaatgcttttagaccatgggtccaaaaagccatattagctagaattttgcataaactgaagataagaaaactatgagtgcatgacattcttataagaaaaatgttttggtttttagtttcctaattaagttttgttaaatcaatgttgtcagctctgacttctagtgtctctgtgtcactagcatttgattgctgaataagtattattttggtgtattttaaagtattattatctgtcacaatatatatgattttggaactatttgtaagtatactgaaaattctatatctaaaaccatatatacatttatcatatagatacacctatctatagtatctatatctgttttagatacatattttacatatatacatgttaatgtcatgttaatgacatgttgatatcatctcttttcttttacatgttttaatctttttcttgctcaattcccttgactatttcacaatggaaataaaaaagaagttcttaggaccaaatcttctataaccttattacacaattgggttatttctattattttttaaatatatggaaaataatcttcataagttccctttctcccaaatagtatattgtaaatattcttatacaattaaagatgggtcagaaaaagaattctacaagaagtaaccctaaatgaaccctagtctacataacaaaagatgtacaatggtcagagatggcctgactgagggtgtcgggtaatttggtaatgctggttcacaagaaatgatggttctaaggggctgcagggctggagagagtaccagacacccctctctgtggaggccactttctagtaaatgatcagctggtgttaacccctatggggcaatttccaatatgagtaattacttcttgtgcatctaaatcttccctgaatgtgcagctgggaatactttcattacatgttattctttccacaccataaattaatccctacacgtgctgtagatcccctgtgaatctcaaaaaggagttgcgaagattaatcatttaatttgtgtgaattgtgtgaaaattgttttcccctggctctttgagaagctcagtatatgctcagctgcacacaacggaagtatttgaacaaattaatttactgagcaactactatgtgtccggtactacgccaggcagtgggagaatgaagaaaattattagacaatctctgacttcaagggatttattagctagtaacaaaactgaaatgacatggttaggccacaacctcaaatgcctatggccaacgaggcagagctaagagcaactgtttcaaaggcccaggcacgctgccaatgctgaggcccagcacatccactccagctgatgctaccgatggacacgatcaccagtgtgtccaggtgtgttgtttaactcaagtgaaaatggaaatcctgctttttatgtgtaattaaccagttctccaatgttggcattaaattcaagatttgtatttttaaaactatctatctgtgggccaatccccacccacctataggtcacattcagctcctgaggacattgtgagaccatggatctgaaacagcaacaacaaaaccagctagcgggatggtgtggtggcttgtgcctgtaatcccctcaatttgggaagccaaggcaagtggatcacttgaggtcaagagttcgagaccagcctggccaacatggtgaaatcccatctccactaaaaatacaaaaattagccagtcatgctggtgggcgcctataatcccagctactcaggaagctgaggcaggagaatcgctttaacccaggaggtggaggttgcagtgaactgagaccatgccactgcgctccagcctgggcggcaaagagacaccgtctcaataaaaaaaaaaaaaaaaaacaccaactagatataactaagcagcaaattaagcaccaaattatgtattatgtacataataaattatgtattacaaacaagatgtgcatatatgggaaaaatgaaactggaagtggaaaatgccacagaaggaagacctgaactgaatttggaaggaaaatactatacctttgactatagaaaatgtaaggggaaaaaaacagtttgatgacatgtcatgattaatgatgctctattgcatgctaatacaatggagattatcctaaatgatggagacatgaccttcacagaaaaatctggaaggcactgcaaacattgaataattttcatataaactcagatgtgaacaacatccatgctcccaaacatttctccgctagtaataagaagatgattatgaaaatgaaaaccttgttcctttcagctattacgatataaaaagtggttattgttaatacattgtgagatcaagagtgttatacagacaagaatgatgaccctaacatttgctttcaagatgttttgaaatatttgtcaagctggtcattgtgtggagatgacatttaaggattaaaggctctttgcaaactcccctctcctggccatgcctggcctatgcaggatcctttctaataagaaaggatgcaaatgcatgggtggtgacaggcacgtggccttcttcaccgtcactgctaccaggaaccgagggatcactacacatgtctcagttgtttgtagcccctcagggtcaggaaacacctttcaaatccacgttttatttcctgatcgatgaaatgcagccactgtggcatattcatgcatctctgctaagaaagaaataatattcatgcatctctgctaagaaagaaaagtcaaaaatagaaggggaaaaaaaactttttgtgggaagagagaaactggaacaaaatgggttggaataaaagattgatgaagaggtattcaatgcttgcagggaaaaaactgggaaaacaattgatgtcaggaagctttagataagacactcaagaatttcattttaatatttattgcttgtagtgaaattgatcggtatctccggcatgatgaggtcatgaaagaagagattgatgcaggcaaattcattatttctgcttctgttctttctgttttgatattagtctattttctcccaataaactatcctattgcatacctcccaacttttgccatttgtggtaatgtaattttcctgtcatcttttatgaaatactagagtacccatctgttgtacgggtagggataaaatagcttccttcagaagaaaacactgactgtaaacagccaagccccatgaaagacaagtgaatcttctagtggtcctttatcagattatattttctggtgccagggcagcccatcttgcttgaccttttttacttatgtacatgagaaaaaccgtgggtcctaatcagtcatatgataatattctgggtttttttttcctagcatagttattcaactaagatattttaatgcaaatactctgatttcaatttattgaaatcaaggaaataaacataaaaaaatggaaacaaacaatgtaatttagtcaggtatcttgaaagatcaagcactacattatgtgtctcagagactggcttcagaagtcagccgctgtcctcagagacatgactgaccttaaaacgcaggtgacaatgataccccttttcctcagagattgtagcaaatcccaactcaaaatctcacaaaaacaaatcacaacaacagagtctcactctgtcacccagcctggagtgcagtggcatgatctcagctggctcactgcaacctacgactcccaggttcaagcgattctcctgcctcagcctcccgagtagctgggatcacaggtgcctgccaccatggccaactaatttttgtatttttagtagagatggggttttaccatgttggtcaggctgttctcgaactcctgacctcaagtgatctgcatgcctcagcctcccaaactgctgggattacaggcgtgagccagaaaatcacaactctatccagaagatgctcctgaatctgacatccagggggataggatcagctgccttcttggatgtggtgaagggatctttatctcagctgtcttgccgaataagcacatggagctgatttcgattgtgcactgcagatcagcaaaaatctttctacttacactgtgcgtaagctgtatggaaaaagttgtactgttgaaattatttttaatattatcacattgtaattgttagattagattttttttaacttttaagctcaaaggtacatgtgcaggatgtgcatgttagttacataagtaaacttgtgtcatggagttttgctgtacagattacttcatcacccaggtattaagccaagtatctattagttatttttcttgataatctccttcctctcatcctctgccttccagaaggccccagtgtgtgttgttccctatatgtattcatgtgttctcatgacttagctcccacttatatgtaagaacatgctgtgtttggttttcccttcctgaattagtttgctaaggataatggcttccagctccatccatgtccctgcaaaggacatgatctcattcttttttatggctgcatagtattcaatggtgtatatgtaccacattttctttatctagtctgtatgagaatatagacgggaagacaaagagagagtaatgaaagataagagctaaagtcccaccaaaccatcttaatttttgccaccaacttaggatacttccctcatgtcacatgtcaaccaaaactgcagctgtctgatccaccgtctcatgtccaggccaggtggcctctcaacatctgtaataccataatagcttcttccttggatgccctgcctctaccaggccagttccccaccatagccagagggccgaagtcctagcaggtgccatggtgacggaagcagaggatgccagaagcagaggatgccagatgcagggtcaggagctgaggaaagcaggcggcctgcagcaagaaaatgggtccctggagcctgcaggagcaacagccctgccgacaccttgttttctgcctggggcattctgacctccagaagtctaaaggaagaaatttctgttgtttaagttcccacgttcatggtaattgtggggtggggggagcggggagggatagcattaggagatatacctaatgtaaatgatgagttaatgggtgcagcacaccaacatggcacatgtatacatatgtaacaaacctgcacattgtgcatatgtaccctagaacttaaattataataaaaatatatatatataaaaaaaagcagcaatgggagactttacagtactggatacatgaaggttttatgtacaatttttaaaaactagtgaattcaaaacaactgacatacctttagggtcaatgaaatttgaaacaaccacagcaaatactttgttagtgtccatattattacataattattaataacattaagtataccatcttttcagtatttaagtgaaaatttacaatcattcagtaaggaaagttttctgatgaccatagcgttctttttacttggtaactgaaatagtgaaaacagaaaatcataaaggctatctttttccaacaaagccctgactggaaagaaataacaaggtcatagtctctgctaacaagggcaactaactttcctgtaacagttgaagttttgttatagtggtttgaaagattgctgatttataactttgagatttaaaacacttgctataagaatagatttgttaaaatatttgttgtagcaaagaaaaatagctgtgaaagatgcttcctgggagatggtttgtacctggcaactcataatcattagctcacaatgacttcactgatctgggtctaatcaaagcatgaggaatctgaaaatcagaaacatagctaagttattctcccctgtaaaatctattatacaggtgaaaataaaagttactctaacgacacataatctcaacttgtttaagtaataataatttttttcctttttttttttttttttttgagacagagtctcgctctgtcgcccaggcaggagtgcagtggcacaatcttggctcactgcaacctccacctcctgggttcaagcgattctcctgcctcagcctcccaaatagctgggactacaggtgcgtaccaccatgcccagctaattttttgtatttttagtagagacagggtttcaccgtgttggccaggctataaataattattatgtcatattcttaagactgctcagtgcttagggtgagaaagccttcccaagggagggtctgttctctcctgcctggtcatagggcatagtacatctctctccatttattttctattctttgagacaattattcctcatgttccaatattctttttcttttcactgtctttctgtcttgaataaatctccaacatcccccacaactatcccttttaagtttcagatacccagacaacaaagcacataaccaagacgcttgatcacacacacgtgcatgcatacacgtacacacttatacaccatgcatatatgtgtgtgtttgcacacaaaaatcttgcttcgcaaacagaaggcggcatgtaaataactgcttggaactcattggcagataaagaaacagaggagatgtcaattatttaagataacaaatgggtcttttctcttagtattgctcccctgccagagcaggttcaatcttaagaattttacctttatcccacccctctgccactgtttcattttatggccttaggactgtcatttggcttttccttgaccagttctttccataagacttgctggcctttgtttcctttctgatttttactgttctcttgtccttgctgccctcactgtaactggcttctgttcatttctccaacctgtcaagagcatttagaatcccattcctacccagctaggttctgttgccccatctgactttacgacatcctcatgcaaggtgaccatgtactctactccatcaccccagtcactgacgaagagccctgggcacagggctgacccaggcgatacaacacctgtgtctgccaagttaatggcattccattattaattactcgttaggagaaatgtgtgggatgacaggggataacacacacctctaacattcccagacatcgaagcaagcatctcatgggcttctgtggaagttcatttacataagtggttcttgatcctgatcttgtagaggtcataaagcctttgtggatcggataaaagctatggattatcttttcgaaaagctgtgcacacacacatgccacagcattttgcataaaatttcagaagattcaaggatttcccttgaagtacatctctagaactcctggagtttagaacattcaggttaagagtatctagtgaaggtaattttaaatattgtagcatctacattatctttaaaagaaatgtacactagatgccagaagaaaatataatttgaaggattttctttaatctagatgatatcacatatataccttaaaaataatcttgattgacctatgctctcaggccaaagaaagaattattcatgcaatcaaatgaaaatgatttttttctgctgtaaaaagtaaaattattttttaaattgtggtaaagtacacatttcatacaatttgccatcttacccatctctaagtgtacagttcagtagtgctaaggaccacagttgtgcagccaatctccagagccatttcatcttaaaaaactgaaactctatactcattaaagcattacacaataactctcaatctcccccttaacccagtccctagcaaccaacattttaccttctagtctctatgaatttggctactctaggtagttcacagagtatttttctttttgtaactggcttatttcacttagcatcatgtctcaaggtctttgttgctgcatgtgtcaggatttcatgcgttttcaagggccgaataatattctattgcatgttgcatgtatatactgtatcaatttttttttatttttttgaaatgtagttttgctcttgttccccaggctggaatccaatggtgcgatcttggctcactgcaacctccacctcccgggttcaagcaattctcctgtctcagcctcccaagtagctgggattacaggcgcgtaccatcatgcccggctaatttttgtatttttagtagagatgggtttcatcatgttggctagactggtctcaaatccctgacctcaggtaatccacccacaccagcctcccaaaatgctgggattacaggcgtgagccaccatgcccagccgctgcatcagatttttgtttatccattcacacatcaatgattacctggattgtttccaccttttggccattataaataatgctgctgtgaacgtgggtatgtaaaatcaaatttttagcaaagaaatcttactgctgtgtaaatactattgtttgttttaaatttttgaaacttttaaaaatcatttcattgttaggcacaactgacaaaaagagaagtacacaaaacaactcaatgagtcatcaggtagcaaacagtcatatcgccaccacccaagtcaagacacaaagaaggtttccatgtagcgcttgctctctgaggtgtgtctactacacaacacagagttcccatgcagaattaatctggtctccccaagaatgctgccagacagagattagtaatcccatgttctgggttgagtaaagggaagcttagagaatgtcttacaaggtcacatagctagtaagtgatagaaataggattctaaacatcagcctttttcaccccacctccacatgggttggactacatagaggccagctggtgcagtaaaacacatcaattatattaaaattatccagaggtataaatgtgactcatacttggttaatgaccacattgtttatccttttgatattcttcattgtgacttctgaccactgttctaattttgccctttagagtaatttaaacagatgccttaacatttccacatgcaagatcctaagtagctaaagaccgtgggcacatccccaggaagactcattcccaggaattctccctaggttctctcagggaacggcatctccaggcaacttactcccctgactgtcctcttgtggtcacattagtgtgttaacacccctagtaagtaaaggtatgtccagaactgacactgaattttagatgttcactatcaacccaacgaacagttcattcactcattcaacaaatatttctttagagctttgcactattccagactatacctcctctgacaatgctttgattaatgcagggaaagtcacaggcacatttttctactcttgccacactgttgtcttatactgaacatgggatcaagtaaaatctgtatgcgtttcacaggaactactgccaaggaaggtccccagcatcctatatttatataattggtttttcgaaatgatctttgtgctgtcttcacagtagatcaccagggtttcatgtggtaatatttcaaaattagtattttggtggttgatcaacagaatccaataatattttttaaatgttttttcagactttaaaagttaaatttttatatctgtttagaaagaatcctttccttccttatatgcctctccttccttaaaaacaaacaaatgaagtgtgtataattgttctctgttgttatggtttgcatcttatagccatgaactctaacgaccgacttcctatgtgctaaaagtggtaattgatctaactgcattacaatttttcaatataagcaactagttattgaagtggcttaatttggcaaggaaacacctaatgagtcaatggctttattcggttaattcagtgaaaagtgctaatgattcagaaagtttaaggagttattgtaaggccgcctgtaggaaagtactaataaccaagctatgaccaactgcctcaaaagcagggttgccagggtaggcaacttaggatacaaagcactcagtgaaatttgcatttcaaatttgttgttcatctgcaattcaaatttaactggttgtcttgtgttttatctagcaactctattttgcagccttcaacatagcaatgattaattaacaggagatgttaataccagatttacttctccatgggcattcactacccacaaaaaaggtagccaacgtattttgatgtttgacttctgcaaaattagaagacataagtcttttttggaaatggcttaaaaatagaaggggcaggataaaactgcagatgccaactgtcattttccactccatccattcatttcataaaattatacagccagaaaaagatcatttagtccaaatctatttacttagaaatgtcacaagaccaagaaagtatcttacttttcaataattcctcagaatctgacttcgcatctactcaacctatttcattttggatgctgtaaggtcttcagagctagaaaggatgctgcagtaaatctggccatcaggcagctaacaaagagggcacaccagacagcagacaatgggctaatgctggagatggccctggaagggcatgggtcaggttctatgatgtcctggtgatagaagtattccaaggctggacagttctgcaaaagggataggagctggggaaatcaagaggagcagtggccaggaaaaatgtgcgtgacttaggcatacaagatgtataggaccatgaaaaatgggaaagcaaaactccataagaatttttggtaggctgctagttttttaagttacattccacagccggatgtgatagagtcccagtcatgatacctcatgtcactggccaacagggttgattgagccacaaccaggcttatgaagttggctttgcccctactcactgcttcagctgaatatctccctaaactgaacattctggtaaaaatgacatcttcctagaaataagaccaatttaagcataggtgagattcacagtctataatagagaaaaccataatttatgactttttataagctaagtttatcattgctaacactgttctttctttcatgcacacattccaccgacaaacagccaaaaattttaaataaaccaaaaggattcaatacatattcacagttctagacttattggctctagaaattggggccttttccttttgttttatgctaattaggcttgaagtcataatttcccttaaacacatgagcactattaagcgccaattctggggtatttaaagagttacaaagagagtgcaaaaggggaaaaaaaacatgaatacgacctcattcctttctttaaaaggatctcagtatagttaatgaaataagacatatttatatgaaaagttggcatatattgcctgtgcttttatgtaaaagctgcattagtataaaaaacagtaaagattatagaaattcaaagaatccatatcacttttgataggggtgctcaaaatttcattgcagtaaaaaaaagagggaattgaacctggacttaaacagttaagattcaagtaaaactgattatttgagcatctactcaacggggagagtaggcttattcacatatattctctaaatttatgtcatttcattcaaacattaaagcatatcatttaccaataaagcctcaaccatttacttcttccatatttcatatataggtaatgatatggtttggctgtgtccccatccaaatctcaccttgaattgtaataatcctctcacatcaagggcagggccagctggacataattgaatcatgggggcactttccccgatactgttcccatggtagtgaataagtctcaagagatacgactgttttataaatgtgagttcccctgcacaagctctcctgcctgtctccatgtaagacctggccttgctcctccttgccttctgccataattgtgaggcctctccaggcatgtggaggtgtgagtcaattaaacctctttgctttataaattacccagtcttgggtaagtctttattagcagcatgaaaacacactaatacaggtaatgaggtatgctagtagaaattaagtttgtactgtgtttgttttccctatgtcttgggaacagatgtatcagaaactcacacactcactcgattggggagaaacgtggggattctctctacaaagagcacaatcactgaaagtagtctgcctgaaggatagtgtcctatttcaactttgacatgtgatggctcctgagggtagagcattgaaaagaaggcaaaggatggtcgagatacatcccattcacctatttccctgtctcaagtaaatgtatatcctgggaaggacagacagacatgtaatagggagaagtgaggtggctggctacattcagttcagtaattgaatatagatacaggtattggttctgaagtttttttaacatggtaaaatatatatataatctacctttttagtcatttgtagttgcacagttcagctacattaagcatattcacattgttgtccaaccaacaccaccatccaactccagaaatttttaattttcccaaactaaaactccatacccattaaacactcacttcctgattcctacccctctccaggccctggtaactgctattctattttctgtctctaggaatttgactacttgagtatctcataaaagtggaatcatacgatatttctgtgtgactgcttatttcacttcgaatattttccgagttcttccatgtcatagcatgtatcaaaattttattcctttttaacggtgaataataatatcagaatatgaaaaatgcctacagcagcaaaaagtaagccaaatagatgtgaagccaacaaagggcctccatgttatatacatacataccacattttatttatccacttattcattgatggacatttagctactatgaattatactgctatgaacagtgatgtacagatatctgttcaagtccctgccttcaggttttgggggtatatacctagaaatgaaattgctgggtgatcatctatatttcagttgtgtggaaccaccatactgatttccacagcggttgcaccagcaaagtacaagaatttctatttctctacatccctgttgaactttttacttccttttttgttgttttgataatagttatcctaatggatgtggtacttcactgtggttttgaccagcatttccctaataattagtgatgttgagtgtcttttactgagcttattggcgtgattatgaagatttgaaagttacattttataaacatagcatcaatccaggcaggccaaagatataacatttgtgaaagcaaaaacgaattgaaaaaacacaaacaggtgacttttcaatgccattgatcagcatgctacatttagtacttaaatactgaaaaagaaacttaaaaatccaaatatagaataaacggttaagtgtattacgaagcacttgtcacaaaagaacactaagttataaaagtaggaagactggtaggtaatacaccaaaatgtttaaggtggttatttttaagtgtgtttcataagtaagctttgttttattctttacacagtcttcatccttggcactcaagaaatatttcctgattaagtcacaaattgatttttttataatagtgtgtaattacgaaataagaaacaaacatatttgttttaaaaggaaaaataaagtaaactagtaaattggttctgctgtacattagaattgtctagggagcttttaaaataatataaatgtgtggtacttctcttcatcaaagatcagaatctttgggggtggaggagcccaagcatctgtaatattaatacacaaagaaagttgagaactactgttgtggaaaataagaatgaattaggccctttggaagtgttctcttcatcgtccgttgctgcagttgattaaagatgaaccactcaaccagcctaaattgttgacccacaaaaccatgtgcaaactataatagctgttttaatgctctaagttctgatgtggttacttacacaacaacaaattattaactcacttaaaattttccccaataagggcttattgtgtgttaggcacaatacaagtgcgtaacattcattatctcattaaattgtcctaacaaaccaataaggaaaatacattatttcaaatgaaaataggcttgggatgcttacacagtttgctctttagcatccaattccaatcactaatatactaacatttgcctaatataaattagaggaaattaagagagacaaattgcaagatattgcattgtaaatacataatacatacacaaatacacaaaaattcattgtaaataattcatcagcatgcttatttttcaactaatgtaaacactcaacattaggtagtcagttaggtatgcctttggcataactgaataatatatataatatacattgtactcattaggtaacttctcatcattcatcctacttccacccacttaccctgccaagtccattgtctatgactgcacactccatgtccatgtgtacacattctttagctcttacttataagtgaaaaaatgagctatttgtctttctctatctgacttgtttcacttaagataatggcctcccgttccattcatgttgctgcaaagtacatgattccatgttttctatggttaaatataattttattgtgtatatctgccagtttctttatccaatcattcattgatggacacttaggttgattccatatctttgctattatgaacagtgctgcaataaacacaaagtgcaggtatcttcttgatgtaatgatttttcctttgggtagatacccagtagtggaattttaaaactgtaatagaaatacaaaaagccaaaaaaaaaaaaaaaaaaaaaaccaagcattttaagatcaaacaagcaaaaaaaaccaaaaaaaaaaaaaaccccacaaaatttcaagatacttcaccaaaaaaaaaaatatatgaaaagcaaataggtaaatgaaaacatgtgcaacatcattaaccattaagaatgtgcaaattaaaaccattaagacaccactacacacctattagaattgttaaaaataaaaagactatttcaagaattggccaggatattgtgctgctaattgggaatttaaaattatataaccactacaaaaacagttttgcattttcatgaaaggctaatcatatacctcatatggtctagccattccactcttaggtattacccaaaagaaatgaaagtttattatgaaatattgaaaaaatgaaaatgcatttctaaacaagccttgggtaaaagaagaaatgaaaatggaaattaataaaattcaaaagtgaatgaaaatgaagacataacataacaaaatttaggggatgcagctaaagcaatatgcaaagaaaattttttgggactaaacagaaaaaagtttccaattgtcttcacattccaccttcacaaacaaaaaatgaagagcaaatgaaaagcaaagcaagaagaaaaaagaaaacaataacgatcaaggtgaaaaatcactggttgagaaaacagaacaataggaaaaagaccatgaaaccacaactttgttctttttgttgatcaataaaaattatactgtcttgtcaggctgatcaggaaataaagagaaaggatacaaattaccaatgtcagaaacaagagaagtgacaacactacacattgtagagataccacaaggataagagaatattctgagcaattttctacctataaatttggcaacttagatgaaattttacaattcctgtaaaggctaaacacaaggacctactaaatttcaagccagagagaaaagaaaacttgaatagacttatgtctattgaagaaactgatactgcattaaaaaacctcaaacgaagaaaacttttaggcccagatgtcttcactaatgaagtctatcaaacatttaagaaagaaaaagaagcaattctacacaaatgcttgagaaaagtgaagacaaggcaatacttccaatttattttttttcagccattattactttgatacaaaaacaagacaaagatattgtgagaaaagaaaaccgaaaatgaatattccttaagaacacagaaatgttaacaaatagaattcaacaatatgtcaaataacgatacattgtgactgaatggggtttcacccaagaatgcaagtttgatttaacctttgaaaatcaaacataatttaccatggtaagagagtgaaaaagagaaatataatactctcataaggtttaaaataaaagcatctgacaaaaatctgaagtctgtcttatacagtcccacagcaaattaggaaaaatagagaactttctcaacctgataaagatcatctatgaaaatctacagttaacattacatttaatgatgaaagattgtctactttccctctgagattgaggccttaatgttaagtcttacaacttccactcaacattatactggagctgatagccagtgcaataagtcaagaaaaataaaatgcataagattagaaaaaaattagaaaattcctattctcaaatgacttgattgcctccatagaaatttctatagaatctaaaaaatgtcattaaaactaataagtaaacttaacaattatctcggttataaagtcaatatacaaaatatctaaaattggaattaagaaacaccatttacaatagatcaacatataaaatacgcaaaaataaatttacaaacagtttgtgtgaattgtacactgaaaagtataaaacattgctgagtgatattaaagaagaaagacctaaataaatggagcagtatttgctctggaattggaagacgtaacattattaaaatgtcattattccccaaagtaatctacagattgtcaatcaaaatcttagaagatggtgatagaaactgacaagctaattctaagattcatgtgacaatgcagagaacctgaaacaggcaaaaacattttgaaaatgtagtacaaaattaaaagactaacaccatctgacttcgggtctcattgtaaagctacagaaatcaagacaatgtggaattgacatcaagataaataaatatatcaatggaacaaaatgagggtaaattcaaaaatatgttgaccattgagcttttgaccaagtatcaaaggcaatttaattgataaaggacggtcttttaaacaaatggttctagaacaattgactatccattataaaaatatgaactatggtctatatcttgcatctcttgcaccatatataaaaatgaacttgattcacaatagcaaagacttggaaccaacccaaatgtccaacaatgatagactggattaagaaaatgtgacacatatataccatggaatactatgcagccataaaaaatgatgagttcatgtcctttgtagggacatggatgaaattggaaatcatcattctcagtaaactatcacaagaatgaaaaaccaaacaccgcatattctcactcataggtgggaattgaacaatgagatcacatggacacaggcaggggaatatcacactctggggactgttgtggggtggggggaggggggagggatagcactgggagatatacctaatgctagatgacgagttagtgggtgcagcacaccagcatggcacatgtatacatatacatatgtaactaacctgcacaatgtgcacatgtaccctaaaacttaaagtataataaaaaaaaaatgaacttgaaatggatctcaccaataaatgtaaaatctaaaactgaaaatttgaaaaaccacttatagaaaaaaacataagagaaaatctttataatctttgcttagacaagaatttcttagataataatacaaaaatctataaaaatctataaaagacttcatttattttgactgtcaaaataaaaaaaattaaagacttcaaatttaaagatttttttaaaaagccaaatattgagagaatatcttgcaaatcacatatttgatatatgatatattcttgtatctaggatatatataaaaattttcaaactcagtaagaaagcaaacaatcatattgaaaatactaagaaaaagatttaaacaaacacttcatcaaagaaaatacttgagtggcaaataagcatgaaaagatgtgcaacatttttagtcattagggaaacgcaaaataaaaccacaatgagatactactacaaacctatcagaatgtctaaaattaaaaaggctaatcataccaaatactggtgaaggttgggaataactgaaactcccatgcaccgcttctgggaacataaaatggtaatcagtttggaaaagattttggtgatttttacaattgagacataagctgatcatatgactaagctattctactcctagaaatgaaagcatatgtctattcaataattagtacacaatattcagagtaactttatttataacagtgcaatagccaaaaatgtgataaaaacaaatgtcaatcaacaggtaaatgggcaaatactgtggtaagtctacacacctgtatacaggtgtgcaactttctagtgtgtagatttaccacagtgtttacccacttacctgatcatttgtttttatcacattaaatataccagcaacatgaaaaaattttaaaataattatgtttaataaaacaggccagagtaaggagtgcattctatattattccatgtaagtacattatagacaatgcaaactaatctagagtggcaggaagcagattagcagcttcttgaggctgggaaagagtggggaaggtgccgcaaagcagcacagagaacttcttggggaatttctgtgtttactgtcgttactgtggtgatggtactgaggtatacaaagacactaaaattcacaaacatttatatgccagatacatgcagtttattgtatgttgattatgcctcaataaatccacatgaaaagaaacccaaattaacccaaaattatttgtaggggtaaagtaaatgcattagaatacaggtagacaaggagatactggaaatcttgaacagtatcagtaatgctttgctaagcactggcacagggggtccacaggtgcgcagggggtccacaggtgctcagttcataattctgcttcacaacttgcacacacactataaactctagtatatataaaatagtaaaaatattgatccttatatacaattaaaatggcctctatttcacaatgacaaatatgtgtgtatatgtgtacgtatctatgtgtaagtgtatatgtgtacatgtatatgtactggaatgtgtatcggcatgaaggggaagaataaaaataaaaataaaatgacaaaaatgtctcacatgaaccaatggcaatattgtgtcctaaactagtgagtatgactaattcaacttttgcatctgatgtaaaacaaaacaaaacaaaacaaaattactactgttgctttaatccactgggtgatttcccagtaatttaatttaaaaaaactggcattaagaactaagcagaacgaggatattttaatttggaaaaaaaaatccataaatacacaagtaataacattattttaaaattaaatgactgatttcagaaggaaatgttttcaacaactttattagtgctagagccctcatgccacagctcctggaagacttcaggctctcaatttaagctctttgaatgtaaagagagccagacaaacagcttttcttctgtaacactccatttggctggttaacacaagttatcgattctgggatttagggttgccaaatgctttcttaagagctctgtgctattgactatcctcgtttcctctgcacttcttttcttagtcttgggtaaaatttaaaactctttgtaccatttttcaactcatctcgacggaaacagcctcaatttactataaaaatgtcaatggctcactagtgacctaacctcaaaggattgggaacgctgcctcagacatctcttttctatgttcccagggtctacagaggctctaccacaacaagatggggaagcccagtctgtaatccagcaggacagtggaatgctactggtgagacctacaaactaagtctgcagcacagtcctgcagcttccccgaaagctcagcccaacaagcttcctgaatttcacattcattttacacaacatacatgttagtagatatttttaacgtacatatgtctatttaggggaaattattagcatcattattgccaacttacaagttattattttgcaagttttatgccctttagaagtgactttgtaacagtttaaaatattattttctttaggtaaagagtcatatttgaaaaagagtaagtcaaacaaattgtatacattttataaatttgttgaaaaccttattcttagagactgtaaagcaatggagatctttgcaaacatccgtggtcatgtctaatggtgacggcacacataatagccaatcagagctcagtaaaacataagccagcaaatcagaggccgctcatagaaggagtccaaattcctttactgcaggatgaataacttgtaaaatcctaacattcacattctaatcctctgaatgaatgctgagtagggaggagacgaagcttagaagcaaaaggaagcttgcatcctttgatgtcctctattgttgaagttacaacaaattaagacaaaaataatagttatgttagaagacaaattaaatacacgaatcataaagtagaaagaatttttgaagaaatgatattcagcgttcccagggattataagtcaggcaaaattaagtcatgcagcattttaatgtaaatattttgcatgatacatttacccacaggcttatcctaaagcagtatgtttgcacttttatcatttgccttaggatgaaaaaaaatcaatgaatttaagagttttaaacctctttaatatttgcacaatattagatgtgctataatctcatataaaactacctcctagagagcttttgagaattgcttttgcctggggtctctggtactaatacttcaagagattagaaacatcttacttaagaagagttttctttttgcccattaaaatcaaacaagctttgttaaacactgaggcagaagagattcataaatcaatgatactcccctgaactgcccaaggtttgcatcatagattaaaaaccaatctcagaattgaaaaagctacagtgccacatatctgtcacaacactaatttactgaacttaggaagaaaataacactagcatagatttaaatagttttctatgcaatatgcaatgaatcaatgtactgacttgcttggggtttatgaaaacaacaactgacaatgaatatcatcctaagtaaagagaggagttatggtttaaaatcatgtgactacacaattcctacatttttttaaagaataatttacatcaaaatttttctctaactctaccctattatcacagattcttttccttgcattcttttcaatactatttatctgctatgaataatatttccatgtttaaagcattctattattttatgacctaacaaactccaggatttaaacaatgctcatctaacaggaaataccgcccttccaatctaaccttcatatgctttcgttttcttccttttcttctctctgaacatggaaaatgagtgccatttctatgctgaatattgatcaggagagaaaaatatatgaggtgtgagttatattgtgactacggtgattttccatccactcagtattacttatcgtgtcaatcacttaatcctgcagcataagttcttttttgcttatgatggaaagttttgttgtgttttattttttatttttgttttttgaaaaaagacatgagcaatctgattttctttggacttcacaaaatccaagaaagaagatttactgaaaattcatttcttaaaaaatgtgaggtccttgacaatggtcttctctacagtttcaatgttaggttttgaaaatgtgaggtccttgacgacggttttctctacagtttcaatgttaggttttgaaaatgttaggtccttgacaatggttttctctacagtttcaatgttaggttttgaaaatgttaggtccttgacaatggtcttctctacagttttcaatgttaggttttgaaaatgttaggtccttgacaatggttttctctacagtttcaatgttaggttttggtcatctctgagcgtgcataacatgaatggaaagtttttttcggagatcagaccgttatgatttttggaagtgtttcctgtcaaggagaagctcatggtctccaaggtcttatctttctactgggtggatgggccaagggaacacgaagaagcataatggagctctgtctgagagaatcaccagagtcttccccagcgtttctcaatggtctacaaacaggtctgcgggcttggatcacagacggagatccaagatgggcatgggcatttacgtgggcagggcaagcgacgctggccacactgcaaggccctcaacgttcccacgtgaaaaaagaaattgttcctcaaacagcaccactaggtcgggtgcggtggctgacgcgtggaatcccagcattttgagaggccaaggcaggcgggtcacaaagtcaagagatcaagaccatcctggccaacatggtgataccccgtctctactaaaaatacaaaaagttaatgggcatggtggtgcacacctgtagtcctagctactcaggaggctgaggcaggagaatcacttgaacccaggagacaggagacagaggctgcagcgagccgagatcgcaccactgcactgcagcctggcaacagagtgagattccgtctcaaaaaaacgaacaaacaaaaaacagcaaaacaagcacacgtgagaagccctgcttgttctgtgaacacagtcatttctgcctttccttcacagtaattcaaaagcatttactgaacaacgaatgtgtattagaacttacaaagatgggtgaataagaaacagctccttccttcaaaggtctccctatctacgggagaaaagagaccggtaaataaagggccgtgcagacgtatcttataagtgctgagctagcagcaggacaaacgaataaaggaagaaatggcagctctgatattaaagccctcagctcctcctggaaagaggaaccaagccttggtgaagcttcagagaagaaggaacaattaaaacaggctccagggatgaggagaatggactggatggaggaggagcgagcggctgccaaggtaggtgtgcctccaagcacagaaggcagccaatggtcatgcccggttcctgggccagagagcaggggggtggtaccaggtggtgctagggcccctgctacatggctggagtttctcttcttctctagttcattccatgttctaaacacaacaaatcacattgcctccaggtgttaggaccaagaatattaaggtcctgaaccaaaatgccaatatttggtaaaatggcattccctcatttatatatataagtgcgtatctgtatgtgttcgggtacttctataaaatctgccagtttttaacttcctaaatataatggctaactcttttattgtagacaaaataactaaataattgcacagacataatccaacatcatgggtttgattttcttaagggtagaacagctccagccatataaatgcagtgtgtgagtgaaaatgaggacggaagagcgggtgcagcacgggggacccagcagtccttgagccaaggtctggaccctcaaaagcagtggacgtggaaggtggtagctccgatagccagtgggcatatacgcacagagagcctcactctccagctccaaagccttccatatcgatggctccttttagcactacagggtcctaaggagagatgtcaaaaatgtttaacaaccgttgcagcagtaccgggttggaagggactccgtaagcaagttcctacctcctgagcatcaggtctggccttggtgatggtttttctctgtcaaggagattttcagcatttgcagtacattaattttatgcatgaaatttatcttcatgtactgttcctttgtttatttttgagaggaatataaaggggaactaagaacaaacttttgctcgaagccctactctagaaagaattctagagtaacaggatctctaaatttcaaaggaagccaaaaaataaaaaaataaaaaaactcaataattttgtacattttatatatgttttggtagaataaaataaatcctgtaaaaccacagaaaggtaatttaagtacttggaaatctatgtcaatatagccaagataatggaggtaaactaacctggatcagagaaaacaaaagttggaaaacactgagggatcatcttgtcggcctatcagaaacggtatccaatctacaacatcacagcaagtcaacatccgatttcttcttaaggctttccaacagcaagaactttgccatcttacaaggcagtccatcctatcaatgaatagctctacgtcttagaaagttcccctcaggaaagaaatctggtcctctatacctttcatctatcaatccaagttctgtcctctggtgtcctaaagagcaagtcaggtcttttgaaaaagatgtctcttctcatatttccagtgcttatcatgtgcctctataattatgctcttttccatggtttataagcacattgctgatgtgatgtggggtctctgcattttttcttggtgctgtcttgggaagcggcatagtatggtggtatcttctgaaactgcagactccaggcccaaatgggctgtggaaaggggaccttctttatacatgtacataagttctgagcaataaaaaattttattctatctggtatttgtgcagtagctttttataaaagaaagcaaacagcttcacctttgtttctgttatatatcctcctgttggttcagcgcataattccaactataaaggctgaaactgaattctagatattgagtctgtcactcagggcatccgttgttcctgcaagctcagaaccaagtctgctatgcattccttctgtgttttgtacaagcagatggaaaatgtctgaaacaaaaagaaactaaacaggtagtgctttcacatgccactagagatttccttctacttcaactgtgccattgtatttaagtgaagttctggaagttacaaatccccctgttactctgctgtcctatgaaaggctatgaagaaggtgcatgtgtgaaagtgccagctgcttcactgacacactcaccttcacagcctaagcaagggtgttgatcccacttgacacatcaggaactcgtgttgtggaggcattcaacagcccacctaaagccactgagtgggtgggaggcaggtgagtgactgcaatacagaccccaggggtccttcacttacaaacacatcaagagaagacacagtgttgatgcccagatatatcgtttcaggttttccatcactctattacgattttagaaataattttaggcagggcacactggctcacacctgtaatcccagcactttgggaggccaaggcaggccgatcacttgaggtctggaattcaaggccagcctggccaacgtggtgaaaccccatctctattaaaaaaaaaaaaaaaatgccaggagaattctatcacaagaagcacaaggatgatctgtgccccgccataattcaatcgctcccaaccaggcccctcctccagcaatgggaattacaatttaacaggagatttgggtggagacacagagccaaaccatatcaaccatcaatcctaaacagtgggtttaactttcctttcaggtctcagaaaagtacacaggacaataaaatatgcccgcttcatcatttcatttatgtatccatcccttcattctttcatgctgtaaacaacataaactgtagctcattcctttcttctgctctatgaaaacatttttacagcttcccatctttcttcctacttatccttggttacttgtcatttcttcagcatttgtacttcccctttcaaaatgtgagcttggtggacaccacctaaattggttttgttagatatcaccccatttttctttctgagtatcatcacatgtcagtaaatagttggaatttattcttccagaaccttaaatcaaattccttcagaggatctagaccctgccttttctagaaatgtggaggccagttttcctaaaagccatagtacgtgtctgattgacctggcattttctttcttgctgactgagacctccgtagcggtggggttattgtctctgacactgcaactcagtatggaatatgtgttccccttgtagcttcctccaccatttttgagaatgcatgttaaccaataaagtcaaaactttaatgacttttagtgggatgtattcagatatttgttcattcaataagtattgatcaatttcttgcaaaatgccagtcttgtgacctatgtagttaaaatgtcacccctactcttccttcccaagaactctgccatctgctctttaaaggttacaaatgctggctcagctcaaccagaattaatccaggcatgtggtttctttggctaacatgttgcattacaaaacgaagtcatttctccaaaatttcacatacaagatttcacatacaattccaaattattaattcctcttgaaaaactggaagacaactctgagactatatatccatagggccaaaaccagtgagagacaagcagcagcttcccctgcagaaaggttttatttctccatgtgaatgaagataagttctccaggagcagtgtcaacacagcacacaacctggcctgcgcccctctctctcctgagccctgtaggcatccaggtttatacctcctgccctaagtaaagcctcaatcctcctctcctttaggacgcacataaattatttctgccattcctgctcccttggattggtaaattatcgtatcagtataaacccatgccatcactagcccatatggcccttcatgaaaaattggaaaaaggcaccctaattctactttatatccatctgttggaaaattgctgtgaattactgattttgtcatatgaagttacatggcttctttatcccagaaatttatcataataaataaccaatagcaaatcttggaatcgcactgtgtgaatggtgtccctccacatgagacactggcaggcagggcccagacagcaccaacatccacgacagcccccaacccacacctgcttgtcacctactacagttccatccaatagcaccaccaccaacacttccactgccccacacacagcttcatgaaggccattatgccaaggggaggttttttccttccaactattatttctatgaaattttttccttctaaaatttgctctccaaatattttaccctgcacagggctctacatgctgctatttgaaagaccagtagcagaatcttcactaaccttccaaacagatattttgagataatattaaggggactttatttccatagtttaaagaaatattttgccctgttactatactttttcctattttgaattttaactagagaaagagacccatatattcttgatgtgaaaagggacaagttactctttctctgctactctctttttataaaaaataaagcaaataaaatgccacattaaaatctttttttttttttttttgaaacagggtctcactgtccctcaggctagagtgcacatgcaggcacacctcttgtcattgtgcttcaagttgttgtgctttgaagatactgcattttttaacaaattgaaggtttatggcgaccgtgcatcaagcaagtccacaggagacattttgccaacagccatgtgctcacttcatgtctctgcatcacattttggtaattcatataatatttcaaacttttccactatcattatatctgttattgtgatgtatgatccacgatcactgacataaatatcgtctagttttggggcaccaccaaccatgcctatataaaacagcaaacttataaatgttacatgtgttccgactgatacgccaactgcctgttagacactgtctctgtctttctcctcaggtgtgcctcccgatagcctgagacgcaactatactgtattagaccaattaataatgctacgacggcatctaaatgttcaagcgaaaggcagagttgcatgtctctcactttaaatcaaagctagaaatgataaagctcagtgaggaaggcacgttgaaagccaagacaggctttgcaccaggttggctgtaccaacaagttagtcaagttgtgaatgctaagaaaacttcatgaaggcaatgaaaagtgctactccagtgaacacacaaacgaaacgaaagcaaacagccatattgctgatatggagaaagtctgagttatctggatacaagatcgaaacagccacaacattccctaaagccaaagcctaatctaaagcaaggccccaactcccttcaattctacgaaggctgagagaggtcaggaagctgtaaaagacaaggttgaagctagcagaggttggttcatgaggattaaggaaagaaactgtctccatcatgtaaaaatgcgaggtgaagcaacaaatgctgctgtagaagctgcagcaagttatccagagcatctagctaagattggatacaccaaacaacagatattcagtgtagagaaaacagccttttattgcaagatgccatctgggactttcatagctagagaggaaaagtcaatgcatggcttcaaaacttccaaggacaggctgattatcttgttaggggcaaatgcagctggtttaaagccaatgctcatttccattaaaatcctagggcccatcatgctgaaatttctgtggccatgctctataaatggaaaaacagcctatatgccagcacatctgtttacagtgtgttttaccgaatattttaagtgcactgttgagaactccagctcagaatattactgcttattgacaatacaactggtcacccgaaagatacacaaggagattaattttgtttttatgcctactgactcaacatccattctgcatcccatggattaaggagcaattttaacttgcaagtcttattatttaagaagtatatttcataaggctatagctgtcccagatattgagtcttcttatggagcttggcaaagatctttgaaaaccttctggaaaggattcctcatcctaggtgctctaacaacattcatgattcatgggaagaggtcaaaatatcaatatgaacaggaattagaagatttggattccatctttcaatgacttactcctcagtggaggaagtcactgcagatgtggtaaaaataacaagagaacaagaactagaagtggagcctgaagatgtgaccaaattgctgcaatctcattacttgaatggatgaagagttgtttcttatggatgattttgtttttgtttttgagacaagagtcttgctctgtcctccaggctggagtgcagtggcctgatcttagctcactgtaacctccgcctcctgggttcaagcgattttcctgcctcagcctcccgagtacctgtgattataggtacacggcaccacgtttggctactttttttctttttcttttttttttttaattgttgtatttttagtagagatggggtttcgctaggttaggcagggtggtcttgaactcctgacctcaggtgatctgcctgcctcggcctcccaaagtgctgggactacaggcatgggccactgcacctgacctgtaggttggttttgagacataatgctatcgcataattaatagactacattacagtgtaaacataacttttaaatgcagcgggaaaccaaaacactcatgggttgcactttcttgctatatttgttttaccgtggtcttctggaatctaacctgtagtatctctgagggtgtgcctgtaacaataccagagttcattttttctaaatataccttttgttaaatcaccaccattttcttaaaaagcaatatgtttatgccaacaacatactcagagtgagattaaattctttaaaagaagttgactttttgaatgtaataaacttaatatataataattacatcaaactgctcttatttctcctattttatcgctcaccagtgattttgataatgccttcttctcctcacccttctacacagttcaaggccaggcctgccattccttcagaggtagagggctacacaactggtaagtccatgccgagtgaagcgagggtggccaactcttccagcaaagagaggggccctgggacttgagactttaagtgctgaaacaggaaacgtcctgggtaaactggggaggattggtctcacttaagggcaactagattcaagtaattacagtgattctgccacacaccttggctttctctgagcagtgcggcccatctcacactggaatgcgtgatgctaaagaacctctacagggtaagcaagggcagcaaggacaatggaatagttgggctccatctgtgaaataccagagcagcaaacaggagtatgagaggtttccataacactttctgaagactgtttgtcatttttccacttatctaatcaggtgttttcataaaactcaacagaatatgtatacaagtataaaatgtatacaatgtatacaagtataaaatgttcatattactctatcttcacctcttcttctttttcactagaaagatgtcacactctcaatgccaatttcagtctatgttacagctacaacgatacctcctctctctggaagcctcaggggaatgtctgggtaatggagagcaccgtatccacactttacaattttaaaacttaaagccacacatctgcggcacatgacagtgccaactgccaagtactgaactgacagagattcacaccataatgctaattctctgcacaaggaaggaataaaagtatgtgtcaaaaatctgaaaatgattgatgcctgccatctcatcaagactgtctgtcacacgatttcgattgatgatttgagattgcatgtgagcgggacgcaggtgctgcaggttgcctaactagctcaacacttattctcaacaacacaaagacaaattaatctccacatcagaatactttccataaagttcattagactttactacatctacaaaaggcttgaggtggttggcctaatctcagggatactaaattcctaaccatagaggacagctcaacaaatcagccactttcaaaggtactggtgagtccaagagacccaaaaatgtgagaagcagtgctctggccattgtgaaggcactgaattgttttcatcactgggggagaacatatctactctcagataaggatatccctggattttctggctgtccagttgagactgctaaggactcggtcagaggtgtaattagaagaacaacttgtgatttcagtgattatttctaaagcacacagtactgtttaaacatgactcttatgtatcttgtgactacaaatattgaattagtaaactctcatctctaaaaaggaaccccaaatattgacttgaaaataaccacttttagccacaagattatagatgcaacctgttgaaccatttagtatgaatctgcctaattaagcaagaggatttcaaataaccaaatatttctattataaaacacaacccaaaataacagttaagaaaagttatctcacctcccccatcctcacataaccaaggtatttgaaattgttttaatatttgcataaatatttaaaaagtttcacctttaacagaataggtaactagacgatgcctcatcttttctcagagttcaacacatttggacccattctttagatgaatgcacttgtttataaaaatgtgtgatgaatgtcactacattagcacgtaatagataatccaagttattttcagacttaatcagttgtaagtaaagtgtgagggatttgagaacacagagagagggctggtggctctgcagctcctggtcaacatggaaaatatgcagcatttcccgtggagcctctcagtctcgctggcagctgcaggatcagcaggtctcgatccatcatcattcctccttggccccatacgggctgtgaggacacctgggtctaataacagaagctaatcactcggcagtcatttatgaaagagacataggaatggaaagaaaaccaggaaaaatgaaacagatgaatacaaaagtacgctgaagagactgatgttaaatggaatgggattataggatattttaagaaaatgtgagagtattacaagtaacaaactacttctaatagcaaaatattgccataaaaatacattattaatgttacataatacacaatatttcattataacatattataaatgcatctttaaatatctttaaagttttaagaggataaatctaaaaattaactttccgataagtttggaacatgcatagaatgtagagatttaactttgataaataactctgtactaggacagtggcccgggagacagaaggagaagaagcatttgctcctgacttcaaggttcttaccatctccaggagagacaaatgtacaattataaccacagcaggagatgataaggctaataggtaaatctaaaagaagtagtctctgaaaaagagtgttctctccctctccctctccctctccctacggtctccctctctttccacggtctccctctcatgcggagccgaagctggactgtactgctgccatctcggctcactgcaacctccctgcctgattctcctgcctcagcctgccgagtgcctgctactgcaggcacgcgccgccatgcctgactggttttggtggagacggggttttgctgtgttggccgggccggtctccagcccctaaccgcgagtgatccgccagcctcggcctcccgaggtgccgggattgcagacggagtctccttcactcagtgctcaatggtgcccaggctggagtgcagtggcgtgatctcggctcactacaacctacacctcccagccgcctgccttggcctcccaaagtgccgagattgcagcctctgcccggccgccaccctgtctgggaagtgaggagtgtctctgcctggccgcccattgtctgggatgtgaggagcccctctgcccggctgcccagtctggaaagtgaggagcgtctccgcccggccgccatcccatctaggaagtgaggagcgcctcttcccggccaccatcacatctaggaagtgaggagcgtctctgcccggccgcccatcgtctgagatgtggggagcgcctctgccccgccgccccatctgggatgtgaggagcgcctctgcccggccgcgaccccgtctgggaggtgaggagcgtctctgcccggccaccctgtctgagaagtgaggagaccctctgcccggcaaccaccccgtctgagaagtgaggagcccctccgcccggcagccgccccgtctgagaagtgaggagcccctccgaccggcagccgccccgtctgagaagtgaggagcccctccgcccggcagccgccccgtctgagaagtgaggagcctctccgcccggcagccaccccatctgggaagtgaggagcgtctccgcccggcagccaccccgtccgggagggaggtggtgggggtcagccccccgcccggccagccgccccgtccgggagggaggtgggggggtcagccccccgcccggccagccgcgccgtctgggagggaggtgggggggtcagcccccgcccggccagccgccccgtccgggagggaggtgggggggtcagccccccgcccggccagccgccccgtccgggaggtgaggggcgcctctgcccggcggcccctactgggaagtgaggagcccctctgcccggccagccgccccgtccgggagggaggtgggggggtcagccccccgcccggccagccgccccgtccgggaggtgaggggcgcctctgcccggccgcccctactgggaagtgaggagcccctctgcctggccaccaccccgtctgggaggtgtacccaacagctcattgagaatgggccatgatgacaatggtggctttgtggaatagaaaggggggaagggtgggaaaagattgagaaatcggatggttgccgtgtctgtgtagaaagaagtagacatgggagacttttcattttgttctgcactaagaaaaattcttctgccttgggatcctgttgatctgtgaccttacccccaaccctgtgctctctgaaacatgtgctgtgtccactcagggttgaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaaaaaaaaaagtagtctctgatttttgcaattttatttcgtgagaaccaagaaaatcagaaaagctctctaattctatgcattttgtcccaattactcagtttctctatttcaagtaaattggatataacacttgaataggattctgccttgataagtatttatccaaccttattctaaagtttaattcattgttctgaaaattggatgaaaaaagtgaacttcttaaaggtttgtgaataaaaaatatatagtcaaaccataatgaaattcttcctgaataccaatgtctagacatttccctgtagaaaactggcagatatctaatagagtattgcttctgaaaattaactgtgtagttctgtggtacaaaatcacttgtaaaaaatctcctggtgtcaaaacagcatggaactggtaccaaaacagatatatagaccaatggaacagaacagaggactcagaaataacaccacgcatctacaaacatctgatccttgacaaacctgacaaaaacaagaaatggggaaaggattccctatttaataaacggtgttgggaaaactggctagccatatgcagaaaactgaaactggaccctttccttacatcttatacaaaaattaactcaagacctaaacgttaagacctaaaatcataaaaaccccagaagaaaacctaggcaatacctttcaggacataagcatcggcaaagacgtcatgactaaaacaccaaaagaaatggcaacaaaagccaaacttgacaaatgggatctaattaaactaaagagctttgctcagcaaaagaaactatcctcagagtcaacaggcaacctaaagaatgggagaaaatttttgcaatctatctatctgacaagggctaatattcagaatctacagggaacttaaacaaatttacaagggaaaaaaaaacatcaaaaagtgggcaaaggatatgaacagacacttctcaagacatttatgcggccaagaaacatatgaaaaaaagctcatcatcactggtcattagagaaatgcaaatcaaaaccacagtgagataccatctcatgccagttagaatggggatcattaaaaagtcaggaaacaacagatgctgcagaggatgtggagaaatagaaacacttttacactattggtgggagtgtaaattagttcaaccattgtggaagacagtttggtgattcctcaaggatccagaatcagaaataccatttgacccagcaatcccattactgggtatatacccaaaggattataaatcattctactataaagacacatgcacatgtatgtttattgtggcactgttcacaatagcaaagacttggaacaaacccaaatggccatcaatgatagactggattaagaaaatgtggcacatatacactgtggaatactatgcagctataaaaaaggatgagttcatgtcctttgcagggacatggatgaaggtggaaaccatcattctcagcaaactaacacaggcacagaaaaccaaacactgcatgttcccactcataagtgggagttgaaaaatgagaacacatggatacagggaggggaccaacacacactggggcctgtcagggggtggggggatgggagtggatagcattaggagaaatacctaatgtagatgatggattgatgggtgcaggaaaccaccatggcatgtgtatacctatgtaacaaacctgcctgttctgtacatgtataccacaacctaatgtattaaaaaaaaaaaaactcctggtgtcacttcggccattcaaagtcaaatgttcttctaaatctaggtattcattaaattaacattgtagagggtttgctttttaatgaaatagttttttttgaaacctcactaattggtatagtgactcttgcatggctcttccatcggtatacatatttaagtttgaattattgctaaatcctctttgtgaataactaacttggccttgttctttagttctgtgtcaacctatttggtagaaagtggcaaaagtagaggcaagaatatttcaaatcatgcaagtgatgctgaactcagtttctgtcatatatttaagcacatctgattatggccaacgtttcccttcaactttcactctacatgattgcaatatagtttttccacgagtaagtgagaagtgcagataatactttcaaaacaaaacaaaacaacgttggtgtttaataagaccctgaataagctattgatctgtgaattagcaccaggcacgatgtgaagtagtttacatatattatctcatatcaccttcttaataacttaatgaggtgctattatgataaatattatagggtgaaaaggactaatcattaagaagtcaggtcacttgccaaagtttacatagtaagtaagtggtggacctgggattttgactcattgattaattgacacgacaaataattaagtgtctactatgcaccatgcagtgtgctagggagggaagaatcatttacttactcctcagtgactctaaggcagatttaaggcacggcttctctaagctcttgtgttgtcatttgccgcatgacacagacatagaaactagagtgattttcctccttgtcaagcccaatcatggtgatgattttaaaaaatattattaatgattacctttggcttctaatccctaacgtgatatacttatctactgattacagaaatctttgcttagttttattttccaagcaaacacaaaatatgatggtaggaaaaaagagtccaggttgctcctttcataaaatcttattcctaggtttctctcttgtggcactttaaaaaaaagtatccatgaaagccaaggattgatgtaaataaccattaggaagagcttaatgttgacaagtagaagtcgagtttgttttagaaaaacaataggaaaacctgttatatactgtctgcaatgctaaataaatatttctcatcagaagaaatatctgcttattacatttttgtcttcctgattagtatgctttattcctgacatcaacttgaaaaaagatgcaataaatgagaagtttaaataacacaggtataagactgttaaccttgggatcaagggattatttgttaatatttttaaaatgataatacctttatattaaggctaggttctagacgcacctcacattctccacccctttctggctttgcagaagccatgactgggtctgtggaataaagccttagccatcccgtgtggttgttgtttgctactacagcagtagccatagctcttaccctcccctaggaacagcaagttgcattgctatcctggtttcccagaaacagtaataagaaaagagtaggaagtataatggtagactacatggtggcactagtggtggatcaggtgaagtatattggatatctgagactagatggggtttttttaagtgtacttacataggatcaaacaacatttaactttctgaatatgcatttagtaagtataaggcacaagttgtttctgtacattcattttcatggaaggggtgtgtgtgtgtatgtgtatgtgtgcaagcatgctcacaagtgtagaagacagggattatagaagtaaaataataatgcaagatatgcaaaatttaaacagttaaaattttaggaaacctacatgatttctaatgttgcaagataagaaagcttctgctaaaaccaacatatacaaaaacgttacttatgaaatacttttgtagagatttcacccatgagcaatagaaaaaaaggaaagttatttaatatattagaaaaccctaagaaacgtggtctgtggtcactccctctctggcacctttaccacagtgatgacagagctatgcggaaaagaatttctgtgccagttcagccatctgctgttggctcacaaatggagttaacagtctaaaaggaaagtttgttttgaggtgccattcccatgtgcatacaatccacaaactgcagtgtataaacgtggctcagtctaataccaagttaagacttggtttttttgaagagcatattgcacagcattttctggaaatgctcccaatattagatacatgtcacattcgcatagaaacatatggtcttcaatgtgcaatctcaaatcgtctacagagactctgcaatcagagattccctgttttaccttccttttataagtcaattttcacttagcaaactatcacactgtggtgatttggaggcattattttaattcctaatgtaaatttacttttaacagatgtgattctatgaatcatatagcagcatatgatattagttattagctgaaatgatgccaaggggtgttacgtgctggaaactagagcaactgagccaaaccaaggtcacccccatcactgccctcacagctgggtcagggaggtctggcctggcccttgtccattctgaaggttgagagaaaaatggcgtctttatgatgccccctgcccaccgagatactcagatatatttcgccctgtccttgaagcagccccactactactaacagtggctctgaaaatgtggacttgacagatagtacctgtcactggctttctatccaggctccattcctttctgggctgcaggtttgaaaatggatgtgccccagggaacctgaatacagtgagttcacacacaagcaggaaagaagtgagtttcttttggtttgggttgaagcagttgctcaaacgtgataggcagaagaggtaaggatttcactgtgctttaacaaaatgcttccatggtaatcagtcctgtatactgtataatcactatacagaaacaaagtgtgcaccaaaaggtaaagaattttcctaggacaagaccgcagctccacaaacaaccaaggaagctgttcagaaacctctttctgtgctctcttactcccctgagttcatccccaggccccagggcctcccattccagatgtgaagaggtgaagaccacgcctggaataactccgaatacaacacaattgctcctcacatatcagctgttcttttccctgttcactactgagaaaacatagataaatcacggcactttctgtctagcattgaaaatggtcattttaagaatcagggcagatgttggctacacacagaaagctgcccaagggtaggcttgaagcaaaataaattaagaaacccatcatgtactcttgagtgcagggaaacaaactgataatagcaacaagtatgcatccttttcaagtaaagataatgagtcaacctgctgattgcatattgtggtgactgaatacattgtgcaatgattaacaaaagaactgattgttcgtaattcaaggaatatctttccatttactgaggctttacttaacctctagcaatagttttgtcaagttattcacaaaggccgtataaatcttttgttagattattccaaggttcagcatatttttgatgcacgcaattttaaatggtagcttagaaaaatcacatcttctgcctgttgttagcatacagaaatgcaattgatttcagtatgctgaatttttattcagcaaagttatacattctcttatgaatttatatgacttatcgttatattcttttgagctttgtagtcacattagctatgaataatgataggttcttactttccaaccttgaaacttgctatgttttgaatgtgtccctcaaatttcatatgttggaaacttaatccccaaattcgtatgttgatggtatttggaggtggggcctttgggaggtaattaagattagataaggccatcagagtggggccctcataatgagactggtggctttataagaagagaaaggagatcttagctggcatgctcttgccctctgccatgttatgacacaggagaaaggtcctgaccagataccattgccacgttctaggacattccagccttcagaactatgagccaaatgaactcttttctttgtaaattacccaggctgtggtattctgttgtaacaacataaaacaaagacaataacttttgttcttttactagccatattcctttcagtggactggtcataatgaatataatcgtgttttttcccaatcttaaaaataacctttgagcatttttgccgtattttccacagtttttaaatagatctttttctattagattaatgaaaatttggctgggttcagtggctcacacctgtaatctcagcactttgggaggcaaaggtggatgaattgcttgtgcccaggagttcgagaccagcctgggcaacatagtgaaaaatctgtctctacaaaaaaaaaaaaaaaaagctagccaggtgtgatggtgcatgcctgtagtcccagctccctgggaggctatggtgggaagatcacaggagcccaggaggccgaggctgcagtgtgctgcaattgtgccactgtactctagcctgggtgacagagtgagaccttgcccccatacccccacccccaaaaacaagaaaaaaaaagtcctctatttctagtttgatacgtttttaaccatgactgcatgagaaattttttaaaatactttttcagcatctactgagatcatgtaattgttttaatctgtcaatatggtaaattacattattgattatttatgtttacataacatgactatttcatgttactccagacaggtatatctggaataaatcctagagggttgtgagatatatatctatggatatatacatatatctatatatgtgtctatatctatttctaaatttgctttcctagtatttgtagtcatatcatcctttaacaacattttaatttcagatttatatttgttaagtgtacttttttattcctaatattatttgtgtctttagtatttttttcttgatcagtcttgtgagatgtgtatctattttctttgctttttaaagagcaaactattatatttattatatttattttatttttttctttgttgatgtctggaattatttttattattttatttatccattttctttaggttctttctgttgtcttttttctgacatcttatgttggatgcttagttcactaattttcagcctctgttcctttctgatgaaaaaaaaataaagctcaccaattttccttgaagagccattatagccacacatgtaaaaggatcaatttttagtatatagaattttttttttattttgtatttttctacattaataataccatctaatttcctttatgatttcttctttgatccattagttacttaagaggttttcttaattttcaatatgggttgacctagttaagttttctaacttcatttcattgtattcaaagaatactgggtataagaaattaatctttggctttgatgattcttgctttatgacttaaatatgtgtgtttgaataaagagaatgtattatttgtgatgaatatcacatttataaatttgtgtcagatatagtacttatgtatatatatatttttatatagcatttgttaattttattgcttaaattttatctatggctccctcttatttcactgagacaaatagatttagaaatctcccattacattgctgaaatgatctatttcttcttttaaaaagagcttcaagctcattcatatttttttggtaattattttacttgaaacaatggttttgaagatactggctatcaagcattgaaaactaacaatccctaagagacagaaacaaataaggtgagtcttaacattactccaacttactgccttgagagcgtttccaggctggggcctaaggctaaagtgaggagataaagctgagagttgagggagacgatggcctccaaatttcacaggacaaaatattggtgagaggtgctcagagacagagtgtcagagatctgcaaagacttgttcaagtttatgcatgtgagaaaactaaaaagaacctacccaaaaggattagagataacagtgtcagggacccacgagggtaaggaacagtgcctcttatacccaccagtgaaactgaaaaccttgctggttcacagagcattgagtagaatacacagagtggccggcctctggtgggcaacagtaagtcctagactgacccttattccagttctgcctaacaaccaacaacgtgacctggaaggataaaactatttccaagtaacttaactcggtcccagaacaacgaccaaaaatatctgtagaagagaaaaaaacatatctaataatccacaaagcataagtcacaatatctgatatccagatattgtggtcaacagaaactgacgaggaatgcaataaatacctatattagaaaagaagatctcaaatcaatgacattttctataatataaaactaaataaagaagaacaaattaaatccaaagaaagtaaatcagagtcaaaatcaattatataaaacagggatggacaaattttttctgtaaagtgtcagacaataaatattgtcatctttgtaagtctcctatggttttgttgcatattcttattatttctttttacaaccctttaaaaaagtaaaaatcattcttagatgcaaggccttacaaaaacagagctaaatttggtctacagactgtaatttacccaatactgaagtaaaaagcaaaaaagaaaaagagagagagaaagagagacagaaattctaaaaatcaacagcaaattagttgagatagtacaatagataaacatgtaggcagagagagaagacataaattataacatcagcaaaggcaaaggttacatcactacagattgtgcagatattaaaaatataaagacagattatggacaattttataccagtaaatttgactacttggatgaaatggacaaattctttgaaagacatagtcagtcaataaaaaagagataataacctgaatagaatttgttgaagagactgattttgtaaaaacctttcagtgaattctagcaaatatttagggtaaaaattacatgaatctacacaaactttagcagaaaattaaaaaggaatgactggcctggcacggtggctcacgcctgtaatcctagcactttgtgaggctgaggtgggtggatcacttgaggtcaggagttcaagaccagcctggccaatatggtgaaaccatctctactaaaaatacaaaaattagccaggcgtgttggcatgcgcctgaaatcccagctacatgagggggcagaggcaggagaatcgctggaacccaggaagcagaggttgcagtgagctgagatcgcgccactgcactccaacctgggcaagagagtgaaattctgtctcaaacaaacaaataaacaaacaaaaaatgaatgactactttccaactcaatgaagccaccactgccataataccaaaaccagataaaatattacattcctcagaaacagataaaaaattaacatttttcacaaatgaaattcaacactgtattttaaaaagtacattatgatcaagtagagtacattccaataatgagaggtgatgcaaaacgggaagagaagtaaacttccttgccctgataaagagaatctatggaggacctacagctaactttatagttgacggtaaaagactgaaggctttccccttaaaaggaggaacacagtgaggatgtctgctcttatcagttctattcaacattgtactggaggttttagtcaatgcaataattccaaattaagaactccagataaacaaaagacatcgaggctgggaaagaagaagaaaaactgtattccttcaaagatggcatagtttctatgtgaaaatcctatgggaactcctaccagaagtactaagtgagtttagccaagttggaagagaataagctcaatatacaaaattaattgtatttctacatactagcaacaaactgttggaaattaaaacgttaacactaccatttaccacatcatttaaaaaaatataaaacaggaaaacatctgaccaaacaacagaaagaaacagaagagacattgaaaacccaaaacaaaacaccactgagaggaaataaagtagcctcaagtaaatgaagtatgttatgttacaggttagaagactcagtgttgtcaaaatatcaatactctccaaattcatctatagattcattgcaatcctaatcaaaatcacaacaggctttatttatttattttagaaactgacaaagtgattctaaattttatagagtaacacaaatgacctggaatatctaaaacaaagttagagaacactactaaatttttagaactaatcaagctaccgtaaaaaagagtacgttattggtacagatacagacaaatagatcaatagaacagaagactccagaaacagacacaaacatgttgacaactgatcttgataaaggagcagaggctattcagtgcagaatgaatagtcttttcaaaataccatactgtagcaattagagattgatatgcaaaaaatgaactttgatttctgctttacatcatatacaaaattaacacacaattgatcatagtcttaaatttaaaacctaaaactatataacttctagaagaaaacaaaataattcctttatgaccttgggttaagaaaacactttttagctaagatccccaaagcatgaccaaaaaaaagagcaaagttacaaattaaatgtgttaaatttaagactttctgcttgtgaaatatactattaaaatatagaaaagacaagtcacgaacttggataaagcatttgcaagttatatatctgataaagaggacttatgtctgtaatgtagcacatgcagaactcaatggtaagaaaacaactcaccatcctgggcaacagagcgagaccctgactctataaaaaataaaaaaataataaaaatccaagcaaggtggcatgtgcctgtagtcccatctcttcaggaggctgagatgggaggatcacttgagcctaaggaggttgagtctgcagtgatccatgatcctgccactgtactccggcctgggccacagagcgagtctacgtttccaaaaataaaaataaaaaataaaacaacccaataaaaagtggaaaatgaagaaaacaacccaataaaaaaatgggcaaaagatttgaatggacactgcagcaaagaagacatatagatggcaaataagtacctgagaagatgcccagcattactttctattaggaaaatgcaaattaagaccacaatgagatactactacacacctgtcaaattgaataccttttaattaaaaggtagaccaaaccaagtgttgtcaagaatataaaacaactagaattcatctatgtttctggtctaaatggaaaatggtacaactactttggagaagagattgccattttctttgggaccaggacatttcgcagggaagtatttgcacaagaggcaaaaaaaagcacatgactacacaaagaactgtatacaaatgtccagctttacatgtactcgtcaaaacctatttaaacccaaatgtcagaacagataaacaaactgtagtatatatttatgcaatgaaataatattcagcaataaaaaggaaggcacttgcaaaatacactgtaacatagatgaatctcaaaatgattgtaatggatgaaagaatccagtcaaaatgtatataccctgaggtttttgtgtgtgtttgtgtgtgtgtgtgtatgggtgtgtgtttattaaaatatatgtaacttttctgctagagtttttttcctgtggtataaaaacaaggtagttttcctaccacctttgagtagataagtgtacttaacattaaatgccaaaggtagacaccagcaagcttttgagccaccccctccggacaccagagtgctacttattctaacataccctaccgggtcagatacaaatgaaagacagactgagcaggggacacagagctcagtaatattgacagcggggttcaaaaggatttgagacatggacttcacaaacagcagcaccgtaggtctccctgaagcactcccagtgaattcctatggttggcaatatctggaagatctctgcacccaggtcatcccaccagggggccctgagaaccagaactactttttatcactgtgcttcacgtagtctatgaagcagaaaaggcagattacggcaggttgtcacaaagaacaaggtgagtcaaaccgcaggactgcctttacttaagcatacaacagaaaaggctgtgtgtcaaactttctgaaccatttatcttttatagactgctgaagactgttgagttcagcgtctcttaatccaaagcgctgttttagaaaagataatctacgtggcaaaaaatctggtcaggtcagtgtgactgcgcatcctggggccatcttgattatgaaaaactctaatatgggaggagagagactttcagtaacaatcactcaggggaaagcaatggcatcaccctgaagggcatggattaacagataaatagtgaagcaggttaaaatctaacagtcacattcctgtaaaagatatcttcatctcacgtctaattattttcttttccattgctcttctctaattagtacttgcttagtaatggaagcatcgagaaaggacagagagagtattataattctagcaatagaaagctagacacctcattttctagatttgattacacatcttaaaagtatccatttttccccaaatttacatggcacctataatggcataatttaaactttaagtagataagatgaatagatggggactgaatgcagcgtgcttactttaaaacaaaaatgtgggttccttatttcctaatgagtaaacagaaatagaactttcctataattttcaatgctgtattttattttgattatctttactagtatgttgaatgagaagtttttcacacaccaatgtccactgcaaatgtttttagaagttctcactaagtggtggtagcaggccaatgccaccatgctctcaacctcatcgtgtggcaggttgatttagtcagcttcccatattttccaagttctgcttttatttccatccccttaagcaatgaaagtcacaccattagagttggctctaagctacctagggtaagagtggacggttagcagaaaatacataagcaataaccaaatctaatttttatctttctctcgaataggcagcacaaaaattactggaactgctaaaaaaaaaaaatgaaattgagtgctaagcatttcagcagctattctttcacatatattaaatgctatttagctattatatattatgtacataaaataaatgttaaatgctaaaatgttaaattttaaaaactaagtatacgtatatgaataaatttttaaaaaaattcatattcacatatgtatacttaattttttgaagaatattaaaggtaagacaatatagagacatgaataatacacaatctgcaaaaattaactattggattaatcaactatgtagtttaccttgtacatagttcctggaatttttggaaagtggcatgatataatagaaagagtccagacattagaattaggtagactgatattgaaaccccacagcctacttgattttgagcatgtattacttaagttgtagtgtcctcatctgtgaaattccatataaatctaatgtggggattgaccaattttatgtgtctgtagtgtcagtatttgctagcacatattggctagcaaagaatgtacagtttttaatatgcaaatctgctagaagtagggacaaactgcacacttacaacttaagcatgcaattctccatagcttttatgatgattgcagttatattattattttatcgttataagttccacaagtttctttgactatccgaatataaccaaactagtttcctttatctcttcatatgaaatgggtgtatttgtctagaatttaattctgcagcatatggaaatttgcctctgcaatgttatgtattcctgtgacattctctggaccattctcaaccgaagaggaaggtatacacaccattccttgatttttaaaaacttaacaataaaagaaaactaagagagtggttgttatcatacctcggtatttaaaatagcaaggcaaaagcataaatcctctgaccatttactcacaattgctcatgaggcagatagtggcaacttttaagaagacaagatgagaataaaattgcgtcacaaagcagtctcttgattaccaatattaaaatcatttgtacttatcaggaacaatggggagatcagaccttctaactctaaatgagtaatataacagattatagtctctattttggccagaatcacaaaatgtactttttaaagtatactttaaaaatatggatcatatgaagtatgcataaaaataagatggcatttccacctctaattagcagctggaaaagctagagtaagtgtatggcaaatctctactatggccaattatatttccaatgaagcaataaagcatacatttattacataatttaacagatatatatattttcagttccttcctcccttcgttatactgaggaatcttcctctggacagtgctatcctcagatgttttactctttgtattatttgtctttactgtgtctatcaaccatcagcaaaccattaattgaataagttgacgtattagcttttatatttttgaactaagcaaataaattactagtttatttatgcagttatccttatttggagactcttaaaatatcatatgaaaggtttttttttaaatgcaaacacaatttacttttcctcagtcaattaaaaaaataatattgttactctcacttaaaagaatatacatcaacaacagaaatactcattaaatggaactatgtcaggctctgtgggagattagaaatacaaagcctataagacagtctacaggtttgaatttctctttaaaaatatttattatatttttctgttttcatagaattagagaataatatatagtttcatgttatattgataatagagaaattggactttatttacaatttaattataggtgtttgaaattatgttctaggctagagatctaaaacataattatgttttagatctagaacataattatgttctaggctagagatctaaaacatagatctcacattatctatttaattaagagactttttaaaaggcaagatatgagaactggaacttaaattttaacaccatctgtaatctatctatctatctatctatatatatataacaatttagtttttcattttgtgtagatatatatacacacacacatatatgatttctgggaggagtcaggaaatacctctaaacaatacatactgtctctctaaagtccttcaccaattacttcccatattaagtactgaaacaaaaaccatttacctaactgcagctgtagtagcaagaagaaaagcccatttcttcagcatgaataaaaggcaaaagtaagcaggaaagtgggttggagatgaaaaaagaaattactcaggacaaactgggtatttccttttgaaccaaattaaaaaaaaaaaacatggtcaattttgatggattctaacattcatctcagggaccctgagtgacataaaggaaaccaagtcaggaacaatgtctctgtcttcggaagtctcctgtgaagcagaatttgtttacaaggtaaaggattaattaggtttaccttaactgatctatttgacaaaaactcaaatgtaaattattaagagcaaagatcaactcatcaaaagaaatgaagattctgcatacaagtgcccagcagatccatctataggttgatacagggagtacttatacaggagtcttgttggtcctccagtatacagggctatctcagacattctgtgtgagggcactgtgggcactttacacctgccacattcagagacaaggccaaaaccaccaacgtgacctttattatctcccttaaatgtagatttctgtaattaaatatcttctacccttggtcactactacttagcaggattacgctattcaataaattgactacgtaatgtagaaagcagaaaatgttcttgcagctttaatcttctctaactgaaagatgctaatctttctactctgtggtcctaaattgtgccccttgctgctttcatagccgtccccccacccccatcccatttcttccagggccatcatttcctctttcaggacaagaaatgactacagtgttccatgaatataataccatggtttacaccacgataagagactgtgtttcactatgattgctgtaaggtggccacatgggccccagactaccatagtagactacaatatttaagaaataatctaatatataatacatttttttttgcttggtcaaaacaaagtttaaattaaatattaaaatcacataaagttattttgaggatatcaacaaactgattctaaagcttatatagagaagaagaagacccagaaaagcctacacaacactgaaggagaacaaatatcattggtaccacccgactttaatgcttactataatgtcacagtaataaagtgtgattattagtaaaaaaaaaaaaaaaaaaaaaaagataagatagacaataaacaaatcaatggagatcccagaaatagatccacacaaatacagtcaactgatctttgacaaagaggcaaaggcaatagaatggagaaataatcatcttttcaaaaaatgatgctggaacaaatagccatccacatgcaaaaaatagaataaatcattacagtttacatccttaacaaaaatcaactaaaaatgcgccataaacttcaatataaaatgcaaaactataaaacatggagaagataacaaataagatcatctagatgaccttgggtttgctggtgattttttacatgtaacaccaaaggcacaatccatgaaagaaataattgataggcagggcttcattaaaattaaagacttctgctctgcaaaagacactctccagagaatgaaaagccgagtcacaatcagagagaaaatattcacaaaatatatatctgataaaggagtagtatccaagatatacaaagaagtcttgcaactcagaaacacataagtaagggacccatttttaaatggtcaaaagagttaagcagacatcctaccaaaggaaaaataaagaaataaataaatacagctggcaagtaagcatattaaaagatgctcaccatcatatgtcattatggaattcagaaataaaacaaaattagatagtactgcccacctagttgatggctaaaattcagaacactgaaaacagccaatgtcagtgagaatgtggagcaaaaagaactctcattccttcctggtgggaatgcaaaacgttatgaccagtttggaagatagtttggcagtttcttacaaaactaagcagatttaccatgcaatccagcaatcacactttattcatatctggacaatacctggaaacaagatgtccattaatgcatcagcaggtgaatgaacaaactctggtttatccttacaatagaatattatgcagcaataaaaagaattattgagtcaccaatagatatgaaggaaatttaaatacatattgctaagtgaaagtctgtctgtaaaggctatatactttctggctctaactaaaagatatttggaaaaagcaaaactatatatagaagcagtgaaagatcagtgattgccacaggttcaggggaaggagggagagatgagtacgtggagtacagggtatgtttagggtagtggtgctcttctgcatgacgttataacggtggatacatgccattagatatttgtcaaaacctacagaatgtacaacacaaagaatgaagcttaatggaagctatggactgtagttaataataacgtatcaatattgcttcaccaatttaacaaatgtaacacacaaatgcaagatgtgttaataacagaggaaagtgtatgtgtgtgttgggggagaaatagggaaaatctttgtgcaacttttctgtatgtacaatttgtctgtaatcctaaaattacagacaaaagttagtttatgaattttaataaacagtttggaatatttttcgaaatctttatttttcacttgccatactgaaagttacctggcatggttcttttcagccttgtaagcaatcaaaatatttccacaatctaattcaatcaagcttggtattttactgtttgaaaatcttagcattatttacagatttaaggtatttctattccttctttttaaaataataattaaattgtttaatgaaagcatttctgactgtaaacgtttaaatgctacaaatttacatttctctgttcataaaagaacttatttttggtttcttatctttaagacaatgccacattcatgataaaaatatacttcaccaattttgaaatagttctagtagataactattaaagatcattaaaaactcttgagtggatgcattcagttctctaaatctagagtgcagcatatcataaagtgtctcctatccctatcttatcattttagatttttttctccaaagtagtgctcactatcagaaatcaccttgtttaggccaggcagagcagctcacgcctgtaatcccagcactttgggaggccaaggcgggtggatcacttgaagtcaggagttggagataagcctggccaacatggtgaaacctcctatctactaaaaataaaaaaattagctgggtgtggtggcggctgcctgcaatcccagatactgaggagactgagtcaggagaatcatttgaacctgggaggtggaggttgcagtgagccgagattgtgctactgcacaccatcctgggtgacacagtgacacactgtggcaaaaaaaaaaaaaaaaaaaaatatatatatatatatatgaaatcactttcttcacatatctgtttacttgtttcctaaatcatctctcccaattccccagcccatcagccccataggaacagatgtacttggaagtgccacagcagaggaaaaccaccaggtaaataaatatttgggaggtgactgattgaataaattaacttatctagatttggtttgtcaaggacattcggaaaattaggtagaatttagctccatgaatgttgagaaagttgagttttgagagccctaacatggccaattcattttacagaggtggaaaatggggctgacagatgttaactcaccttgtccaaagtcttagtaatggaatcaggaaaaaattcaatcacttgacttttaaccaataatcttttttactacaagagttaatttgctaatgaaatctcctcagtattttctcaaaacagaacaaaaccatgagttaagtattcctttttctttgctataactaaatataccttttaaaattaaaaaaaaaaaaacataaacatggttataagtgatcttatttcctgcatttgaggcagctaaaccagtatttcccaaaatgtcttaatacccacttcttgatctgctgcaaggaaaaatattgttcagtggtcaaatacgttcaagaatcatgattattatatagagaatagacgtttgcctcttaatggaattggaaaattcctacagtaaagatacatgtttagttaagggttggctaaactacttcactgtggcatcctctcttcaaagaacccatcaatattctacagaacaaatatgccatacaacacatttttatccgaaaatcttttataattggcttatattattgttttattcttcaaaatgttttctaaactgtctcagttctcgtcccatgtcatacaatattttataatttttcaaattctcacttttatgttctcacttactaaaatacggcaaaatataatttatatatacatatgtgtgtgtgtgtgggtgggtgtgggtgtgggtgcgggtgtgggtgtgtggtacctggaacacaataagtggaaaaatttgtttcctctgtcttatcgcacccctttaaaaataacacaaacagaaagtgttctttctaatagtgcaacttacggtccatttattttttaatatttgttatttaatccatggcactcacttttttgaactgcagtaaggtgttcttcaacaattcctaatttttctgtgaatcgtttacttggacaatgccacattcacatatacatcccctaacatttgcatttattcagtttccttttaaaataagtgctaaacaaattaatggattttgaaggagaaaggctttcctttcaaaagaatggtaacctttatgtagttgtttttagatatttcctataaaacctgtctactctcgatacagtcagacatcttttcttcttttttaaatattaaaaataagcacataaaataagtcatttgttctttaaaaaacaaacaaaaaaaccaaaaaacaaaaaacctacaaacacaaaatcatgtaaaccagaaatctttcacagaggtcaagaagtcaaaagtaaacaccgacaatgaaacaccgacaatggtaagatccttgtgaggctctcgctccacctttctcattacttctatgtttccgtggcacaccacgggccagtgcttactaagacctctgcttagcgatggagttagtgggtctgcacctctgattgtgctgggcatgagacatactgattaaaaatggtaaaaggataaaggaactggcctttgagagacaacatggatgaatgatgagtttttgaattaaatttttgacagctttgatctttactgaaaatttaaatgaaaaacaaaacaaagcaaaacagagttccaggattttagaagtgccttttatcttaagtgaaatgttctcatcagaaactttggcatcccatccagtgcctttgatgctggctgtgaaacaagacaatccatcttcttagctgggaagacaggcccttcaccacccaggaaaccataacttgtaaacatcagtcaagttcagatggctacatttttacttcagaagttcgctttgcatttggagtggctcattaggggaaaagagagagagagagaaagggttatggaccaaagtgtgtttctcaaaaaattcatatgttgaacccctaacccccaatgtgatcgtatttggaggtagggcctttcgaaggtgattagggttagatgaggtcacgaggatgaggtcacaagccaggattggaaagcttgataagatgaaaaaaaaagagtgagctttctactctgtgtgagaacacagcaagaaggcatctctctgcaggccaggaagagaggcctcaccagcaatcaccttgatcttgaacgttccagcctccagaactcagagaactaaacatgtgcgtttaagtgcccagtctatgagactttcttttatagtagctggagcagactaataccgacagaccaagagagagaaaatggagagaaattttctggcttgtcttttaattattctttatttataaaaaaagccacattgatttttgcagcagtgatgcaagtgtgctgtgcataggtttgatgttctgctcaaattaagtctaagtttttccactaaaggaattatagtgttaatatgccaagagtcctatctgctcacgtacttccagtctctgtaaatacgtgcagcctgatatcaaagcaaaccttgaggccattaactataacattcttggagaaacagctgaagacctactaagaaaaaagtaccaaataaccaaagctggcaattacaattccaccccgaaaagaaggaaggcatgcatatgaattatgaaaaatagggactgtgcagctctcagattttcaacaatgaattgctcacattctacaccgtgtgtgttaaatgtttaaaagtaaaagatcccaaacattttgccaaatatgcagtgttccaaagggaagtatcaaaaggatactcatttataaaattatggttcagtagataaattataaggcctcaaagaacatgctgttacttctacttgccaatttataaattgactcaagtcttcatttaatttatgaaaaatcaaatcatctcaagaatgttttcgttatttttctctaccatgtaaaatatatgttttgtatgtttgataagttgtatcctgtcaattttagaatttagctatttggaacatataaaccacatttctacaactcaaaatagtataatgcttagttacctatctttaaaaaagtaatagtaatgcactgagatatttgggggtgggaggtggcggacacaagtttaactttcaaaaataagggccgtgtaaaataactgaaaaataatcctatttgaattaaaattgaataatattaaaaataaatttctactgaaaattacacctgtttctctattttatttttcttccttttaggatagcagaaaattctgttagataaatcagactaacatgggagacattgtaaatattaagaaacaatagtaggaagaggcggactcacattcatcttgctctttctgctattcccttccaaaaccaactgtgaacaagcactcagggtggccagggtacgtgaggaagcctcctctagcccagaaaaaaactttatttcacaaaaagttatccttcacaataaaaaacactattctataaaaattgtttcccctggccaggcgcagtggctcacgcctgtaatctcaacgctttgggaggctgaggcgggtggatcacgaggtcaggagatcgagaccatcctgactaacacggtgaaatcctgtctctaataaaaatacaaaaaattagccaggcgtcgtggtgggcgcctgtagtcacagctactcgggaggctgaggcaggagaatggcatgaacccaggaggcaaagcttgcagtgagccaagatcacaccactgcactccagcctgggtgacagagcgagactccttctcaaacaaaaaaaaaaaaaaaaaaaaaaaaaattgtctcccctgacttgagttatgggaaagagggttagcttcacttggccctccatgcccctgcccaggcacgtgtctgtattagtgttctgcagaggcaattcaaagtacattgtccaaagcccctctttgaaaatcttttgatgctgctgtaattcaatttggtttctatgttgaatctgaagttctgtgttactactaaccccctttctgtaggaaaaaaatgtatttttctatacaaacccatatgccatcgaggtacctgtatttaatatacctccatttagtagctaataaatatgtctatttgaaaactatttattcttccatacttaatcatagtgaactataaatccaaacttgacagcacaagaaaagtgacatttttcttctttcatttctatgctactttttccaaattatttcttgttctttttaaaaatgaagcaaagacatcatcattgttactattatgccttcagttaacaaaaaccttttaaaaagattatttgaaatgcatatgtaatatgcatgactacgttaacaggattatatgctattagatattgtgatataaaattacaactcactgggagatacagtcctctttgggcctctctcccttctatacatcttgctggacttgccaagatcaaaaggtcctgcccgcttttaacagactattactcagggttgcttatgcaactggtaacctaaagagataaggcaaggtcttcccctagacaaaaggcttgcatgcggcttgctataacagtagtcccagctcagtattcaccggctgtgatgcaaatccacccatgagtaagttccctctgagccaattgcttcattccctgcacacaagctgctgcactgctgagcactgtgtaataaagccctttgcctttggccccaagactcacgtcttccaccagcagcctgatacagtagcaggctcactgatttgtaagaggggtaaaatcaaaccccagacttgataataccatctacacagacattcactggtatgattcaagaatataaataactggtattcaatgtatccaaaaacaatcatgatgaatatttcaccaatgcattgctctttaaaataatacccaaataattatctgtactgtttccataccttgacctttcaactggacttttccttaatttgagcttttttgagttgtcatcagtgtcgtggagacttgcgccttccaattacacagtggtgttcaaacagaagaaattccaaacttttcttccttttgactataactaccctgggagtaaaatgtcccccaaataaaaacataaaataaataaaataaaagaaagaaagaaagtatctacttggcaagtgggaggtcagaagaaaaggggcttcaaacatcaaagaaggttctcaaaatactctttcaaatgaagaaagccccacgctcggtgccttatcttgcaagctcacatggccagacagcaacctttaaaggattatcttaacatgcggcgagctgggccctctcatgtgttctgaaatttaaaccagaaaatggctgcacaactgacatggttgtggggtgtgaaggggaatcaggaagagggaggagaggcttacatttccagaatgagccagagttcagataaagatatttgtgtaaaaaacaaagcaaccaggaatatgatcctgggctgtcaatttgtagaatacaatctaatacttatacgccataggtagtcacagaagttataagaaactacaagccctaaggcattttttagaatagaaatctctcttctccctctctctctctctctcttttttttttttttttgccaatatgtagtgtgggattttctttggctaaaaactgttccaatttccctgttttctaaatatactttactaagcatttttttttacaatcaggagtattgtaacctttgtatattttatcaataataaaataaatccataatttaaaaaaatcacacaaaagtgtataaagtaaaaagtcaaagtcccacatccccacctctgaatttcacctttatctgtgtgtatatgtatattttgatattgtattttgtaagtgtattgttctgtaatgtgctttttcatttaatagcatgattcacattcttccatgtcagtaaatacagagctttctatttttttcatgtctagacagtactttacaagatgattatattcagtaatgtatttaaccattcccctactgatgaatgttgaaatattttcccctaattttttactgtttcaaaatcaaaaatatgtacatcaacttcaagctttttactatagcccgtggactcttacgtgatttactacctgtctttgtcttcctctggaacttcttataccaaatctttgtgcccctggcctttcttccatgcctgggctaagccaaccttgtctctgcatctctgtggaatgtcctgtcccaaggtattggcgtggtggttcctgctgtctcatcactcgctccaaggttacttccttggtgaggtctttctagagctcctgttctacacaatctaatttatccttagtcaatatcttttataccttctcggtttattttctgtacagcacccatcaccctctggaataatcttgttcatgtatttcttactgtttactgttttcatgtaagatttttctctggtatgctctaatgtgtcctttattagaacaatgtctgccacatcataggctctcaataaacgtccactgagaagatgcataatggaagtatacttcaacttggattgtagcacatttacacaaatatttccattagagagatgcctcgaagtaaaattactgcccaaagatttgtacacacaaaatattgatgggtacttgccatgggtactgcaaaaaagctttaatggcaatttatattgtcaccaatattatggcaacggcccttttcccacaaatgcagttttataatgccaatttgacaggttataataatttttttgtaaattaaaaatcaccttgttctaaagaatctttttacatttatcacatttgtgttttatctccaaattaatcattgttgaaaatcttttttattcttttatcttttgggattacagaatgtcattctagttttcttccattattatacaagattgaaaggattttggttggctttcttagatcttatatccaaatgggatttattattatatgtggcataataagaactattattcttttaaaatgtattaattgtcttttgcttattaaaaaatagtcatggtggacatttctttaaattttcaaaaataaacacagaaaagaaaataaaaatcaccccaatagaaacttgcctgatttctttccactgcattccctgtaaaggtgtgttaatagaaatgtttctttgatcatacctataaagtggtgtttataaaaatgtttattcccggccaggcacgatgggtcatgcctgtaatcccagcactttgggaggccgaggtgggtggatcacctgaggtcgggagttcgagaccagcctgaccaacatggagaaaccccgcctctataaaaaatacaaaattagctgggtgtggtggtacataatcccagctacttgggaggctgagacaggagaatagcttgaacccgggaggtggaggttgcggtgactagagattgcaccattccatgccagcctgggcaacaagagtgaaactccatctcaaaataaaataaattttaaaaaattaaaatgtttattcccttatacaacattccctcatactcttttgtatacagtttgatatggtttggctgtgtccctacccaaatctcatctcgaattgtagttcccataatccccatgtgttacgggagggacccggtgggaggtagttgaatcctgaggccagttacccccatgcctgctgttctcatgatgtgaatgagttctcaggggagctgatggttttatcagggactttttccccttttgctcggcagttctccttgctgccatcatgtgatgaaggacatgtttgcttccccttccaccatgattgtaagttcactgaggcctctccagccatgcagaactgtgagtcaattaaacctctttcctttattaattacacagttttgggcagtcctttagagcagtgtgaggacaggctaatacactgttttttcgcttatgctatgaacattttcttttgaaaatgtgatttttaataatggtacagtatcttaatgtgtatgtgtattgtaatttgtatgagtgtattttaatggttcctattgttctacaagtaattcctttttctgttattaaaaattaacccaccaatgaaaacccatgctcataaaatctccaggaccatctctgatttcattcacaggatagattcctaaatgtggactcaataagaaaaggagtataaattatttcacagctcttttcaggccttttacaggcaggttgtgtgtactatttaaagtactattaatcccaccacatacaagatgtattaggtacttcttaagagtgcactgaatataagaaatctgttacaaaatgttagcagagcagaaagagaaaaaaagaaagaaaaaagggatagaatgagattagatcacctggtaaactgtaggaaacagctactgcccccaggactcaggaaactcaagaaagtactttatcagaacttctgagtgctgagtgcatgccaggacccctgaggatgggccgactgagtgggtagaaaccaccaaggcactgcctcccagtcacggaggagtggcatggagaagggatcacagacacttccagaagcaggagagagggaagggtagaaaagagaaaatgacagcgcctttcccctgacctgcctttggatccactgagcagatgtcacaggaactcgctggcaagggcatctgggaaatacagtttcctcccgagccaagcattgcggagcagcacaaagggcgtggctggggaagggttgggagaacagggaatcactctcacacccaagagtgcatggagcatatctgggtgtctacacaggtaagagagtgaggggtcaaaaccgggcttcttatgactctaaaatgtatttttagagcagttaccaggagagctgacattgttgaatctacctgagaagccagaagccagactctttgtattactacagaatgtgattccatgctgttgccaaatgccaggaatttctacatcgactgccatcaggacatggaagtctcattgtttcttaaaacgcaactattcttgaagacatggaaggtcatccttcttacatccttacatccttctttctgtggccctcctaggcttgtcacgagtcagcacgaatcccaaaggtaccagcagcacagaagctcacactctgtcatcagagctgggttggcagtgacagaaatgcttatgcaaacacaggctgacttctcactgaatgtatagaacatctaggaaagaaaggcaaaggatttaggccaaagcaatacctcaatgcagacaactaactagtggcagctagctagtcacctgctctcaactcttcaacgtccttcaaatattttctctaattgatatagcataatttgtgatgccaacaaccaagtgttttttcacaattacagagagccaaacctgtgtctctgctgctcccttaggctacttataatattggcctagttctcttagctgtcagcacaattaccttgtgattaaaaagataacatcaataggaatttcttttttatcagctaagccatggttacatgttgcatggacactagcactcattaccccatccatattttggtgagatttttgcccatttccttcgttttcacagaaaatgaaataaagcataagcttgttggttgcaaaggtgacatatagtaagtcaaataaacccataatgaagttcccttatacttcaggttagcttcaaaatcccactcaaatatgtatccaaaaagaaataaaacaggaaactttctggaataagttcttttgttgctatttttatattgaattggcaaatgtcatttcactgtctgaggtcaagggaacacaagggaacaggcagttctcgaaacagaaaagttggaggtgctgtgccgtctctagctaagaaaactctagttctatgaaatatcattccacctgagaaaattttcacatgattaaaagataacagtgccataaatctacccttgaacatcaggtgtgactcttactatactacccaatgtcttttaaaaaatatttagatcattagccaatttgtgtgggtgatacaattgtacacattccacaaaaatatcagccatttgtctagttcagcatctggtaatgtcaattaagggttttatttactcacaaagagaaaaaagtaaagatattagtttcaaattaagtccaacagtctattgagtacgtagtttaaatgtatttcagctcttcatcctccccagggcagagatcactggcagaaattagcatccacggataggaaccaacaacagggtagctgatgatgtttaggtgaactcccctctttataataacagaaataaccccttttcccctacaaagcccgtctacattttgcatagcactaaggatggcagacctaggagctgagttagccaaccctgaaggtatcctgcctcaagacttgtggctatttggaaaaataagcatcctcgtcatggggtcagtggaatcggggcagtttgctggagtgaaagcccccaattaggtcaccctgtacttgtcatcaagaatgagtacacatggcctctctatcatcaagtggccacctacgctttttgagtggtaattcttgaaatatggttttctctatgaagaaagcttttctctccatagaaaaagcttaacagcaaatttcactgtagtcgaaatgtttcacctttctttcctttttgatgtgatcgtcagctcttgactgcatctcgttttctcatgcctgctttctttctgctgtcagtcacaatcctttgtgacaaggtgggatcacctggcagatgatttggatgttgcctctcatggagatatatctcattgaccctttcgaattcagagatttttttttaatatagaaaaaaaggcatagcattttaacatcactaactaaggcaaaagataaggacactggactgaaaaaccaaggatgttgtataaatattcgtccttgtgtcactattttattggcttgaggtatccaggaaacaacttcatttccccaaattacattttattaccaaacaaaagatgaaaaaagtactacttatcccattaaactagcataatggttactttaattggaggggtgggagagaaagaaaggtgaatctacttagatttcttggagaaatgaacttacaaaaatggaagctggtggcaaagccaaagtgaaattcacgtttacttattccatgcaatatttctctgtccaacctatgtaaagcactacaaatgaatacagtcatagcaactaattgagttatcagcatctccagagtagatgttactagtatgtcctggcatatgaatggtagtattatgtgggatattagtagttcactaagagtcctataggacttcttgtgtctggaaaaagagtttagtgagtgatactgaaaaaccaacagcttggctcacgggcatcattgaacaaatggtactgagcatggaacgcagctactcagaacttatgagccaaatgggtgttttccgtacatggcttcttgtccagaatgctactgctattagcccaatggccatcactggttatcaaacatcctgacccaagtcaaagccagacgaagacagaaggccatcgtgggaaggtgaagcgattcatgcttagggcaagataattatttggtatcctttcaatccatttgttcaacatttgctcccaggagaggcgggatgcttcctggggacagattagagaagaagggacactgctaagtgctcatgtattatttcaagcagttcactctgggccccgacccaaatcctcaggcaacaaagcagcaccctgcaggtaataggaactgtcttctttagaaagcagtgtggtgaccaggtgttgctaatcatcagagtctcttggtgactcacagccgccctcatgcagctttgcgagttctgactgccaacacacacaggactcttcctaagtattatttcagctgaattctgggatgtgaacatcagactttcaaacccggctttctcactttctactggggtgaccctaaatacaagttatttcatttctctggactcagtttcctcatttataaacatgagaataacattatctactccactggttgctgtgaggaccaaataaaataacacaattaaggtgttatctggtatataataaccattcgataaaacttagcgattattatttatggcatccattccacaatggtactcaatggtactgtgtacactgcctaagaatcctaacctttatttttgctccactcatcacttctatttccagttctgtgatgccaacaaattgggtaattgtacagcagcatgttattatgtttcttcacctccccttcttactatgggtcccttctccgccttcctcaaacatggcagccctgtgggatgttgaggctcttgaggctcctcagtttgaaatgaatgagcttgctgaagtggaaacattagaagggcatgattggcagattattttgctccagcaccttcttgacagaagtgcacaaagctcttcaagaagatggagctgctgccagatgccctctgtccagcctcctggaagcccaggagaaagctggagtggacgccatccttctggcctcctcctgaaggacatactggtttccttaatttcttttctactttttgtccttcagtctgttgtccctgcacagctatagagaaaacaaggattacagattccatgtcgttttgcagccagggaacatctttggctagagatttgacggaagtcagtgccaagtggctgtgtccctgtaagcagtccattatttctaatggtctatttgcatgcaaacctccaggccagaggcagaagtaaacatcccagaaacttgtccctggagactctgggacactctcatttacacgctgtgctccattcacggcgctgagtttactcacacgtgctacacatgcgatcctcacgacagccctgtaagatggtattagcatctccattttatcagaagaaaaataacttccgagagggttaagcaatgggtaaacacggacataaatatggcaacaagagacactggggactactagagaggggagtgagggaggagggagggttgaaaaactaactattcggtgctatgctcactacttgcgttgcagaatgatttgaaccccaaagctcagcatcacgcaatatacccatccagcaaacctacacaggtaccacctgaatgtaaaataaaagttgaaattataaaaaattgtaaattacaaataaatgaataaataaaattttttaaaatacagttaagaaggggactttgcagtctggtgtacctgacactaaagcccgtgtatctttaccatatcatgtttaaaaaatcattttcaagagaggcaagaaatttcagtggagaaaaagactgagtatgtagaatggaagattctctagatgtgttgattttgtttatcacggtgtcaactaccggaggagtaggcaattttatgtggatgtagaccatgcacctttatcaggagtactttttcaggtcaattcccttccctagcactaaaaataattaatagatctctttgagagactaagacagtgaggagaaagtacatttacctaccacaactaatgagacctgaataactggaacagaatatttggaaaaaaataatggtttaaatggttaacgatgtgtaactagtaatataatagctacttcaacggagctttcatgtaaaacagaatttcattgcaagtttaagttttcttttgagaaaaatttggctatgtaaaggtgagtttggcaattttaagtttacaacttattggtcaataagtagtagtaagcctcttttgtgtttgttgagttaataaactatggttcttggacaatttctttgttggatgttaatctataactcttatttgacctgttatttgacatttctaacctcttccttaaacattaaccagaaccctgagtactttcttttccaacacgggtaagggattgattttttttcttaatttcataacttatgaagctaaaatgtgcaatattttgactgagtgaattaggaattcttgttgggatttgggaaaaagaaagttatgagaaactgatgactgcctatgtaatacttcctttataggaaattcttaatacccttatataggaaattttaatacccttcttacatatcttttgttcctggtgacatagaagaacaagtttaacaacatcttaagaaagaaaattattaaatatttacagtcacaaacctttgttcaaaaaagcacttaaaaattatatttaatagagtttaattgagtaaagtgaatcacatagccctcaaactagaataggtttagagagactagtgtttttgtgtggtcaaagaagacttatggaaaaaaaaggaaaatgatgtacagaaaatggaagtcaggtacacaaacagttgtattggttacaccttggtgtctatttgaactgctttgaagaatttgtcacctttcagaggccaaaacttggtgatcttcgtgattggaacaagaggaggttatagcctgattacacagtttactctgtacagggaaaactttaggccagacttaaaatacgcaaggaggcagcttaggctaaatttgctttaacaattctctctttatggtcaacctccaaaaatcatgaggggttaaccaaaactctaggcactgatgacattttgtcactattataaacatattcacacagttttaaattttattgggaagtagttggatagtgggttttgtaaagtgaaaagaaggactttaggttacttttctgtaaggattagagtagaaggaacctctgtgtgttgaaattttttgattttaggagataaaacctggtctgctatagtttttttttttttttaagttttagtttgtttatgtgatatttagtatgagtgactttagtttggtttggtctggtcggttggagcctagtacatgagtttagtcaaaagcaatagcctcttataattttatgttttatttatttatttgtttgtttgtttatttatttatttattcatttattggataggtgagagggtgacccaaactttactgttggcttcgtggtacttttagctattattattttcagttttcggtctcagtgtgtcttatatgttacagtgacttgttgatcactttttggagtttttgttgtttgggttgaagagggaccagttgacagtttatagatgtctgtatgtaaacatttgagaaaatatagtattttggggaggctactattatgactattaggaagataatattaagagtttgaaatatggtttctggtcagagtctctatgaatcaattaaaattgaagagttttaaacgtgagttagataaatagtatttgttttagccaagtagtctgttaatctctcacaattgaatctttataatttttatgtataacaaaaagtgttcataacaaaacagattctttttgtgtagtcaatggataatctagtgtgattttattattaggaacaattttagtaacagaatttagtcttttgtgtaacaatagtctttgtagtagaatttcttatggagtctattatgagggatgcatttataatgactgtcccatttattttaaactatggaaaaagagacctaataagtcatgtatcctgagaagagtgaaggacaaaatctttaggccaaacgttataaatagaatgaaacagctttagactaaacttcatgtaacaccttcaagtgtgagccacagtgatgagtaaccagggtctcaagctggtattttttcaagcaaaaaatacttcaaaaaagccactggagtaggggtggggagcgggtaagaagatccatatctgcttatcaactcctgtttttttttttttccatttctttttgtatttggtgtctacaaaagagccttaacatggtttaataaacatgtgtcatagactgcatggagttgcttatgttgtttcaggatacttaaaggaaatgctcactggaacgttctagattttggatttggaatgttcacccagttaagtatactgtaaatattcaaaactccagaaaaatagtctgaaatacagaacacttatggtcctatgaattttggatagggatactagacatgtacttacaaaatggttttgaaaattccttagtacaagaaagactctgccaatctgatacaaatatggctttgtacacacacacacacacacacacaaacacacaccccactctctctctctagatatatatacatatatatacatattaacatataacacatatacacaagtaaatatacttttcactgaattttgggtggacatggacccacggttcttgtctgggacatcagctactaggtctgagtcccctgtctgtgccctgtgcatctgggaatgtgtacacactcttcaaaactccagttaatcaccatcctccctgggaagcttccatgctagaggattgaggaatccaactcttgagaaacaagaacatcctcttcagctcttcattctaatacttagcagatatcatagtgttttcttagttgggagactagattctgtctccctcatttgccccaacttcatgcccactggagctccagacacccactggaggaggcagtgacaacaggatttgcctccaaagaacacagaccgcacccttgtgtgaataagggaattttgttactcctgattactttacccatcctagaatacgctgaatttagccataaaagaagttgaaaaagatactcagaagaagaaaaaagaacactagagtggcaaattgtattatattaccagttttacacatatccacatggatccttatgtttgtggggtccacagcctgaccactgtaatccctcacattcatgtttccccgccgtgtagaaaagctatacagggtattcctgctgtacacgcagccactgtgcaaagatgaccctactctccttggcactgaggagccgaagtcatcccctgagagagaggcagcctacaaatgaatacctggggccaggggcctccagagaggggagttactacaccaggcaatgcttctctcccagacagcttgaatattaaatgtgtaaacatactagacagcaaagtagtgccgaaaccaagaaatggacacacggagagagagggggaaagggaaggggagagggagggagtgggagagggagacggagagtgagagggaaagggagggggagggggaggggaggaggagagagagaggcagaaggagaagaacagggagagggagagggagggaggggggagggggaggggaaagggggaggaagagggggagagggagagggaaagagagaggtaggaagagaccacgaggagagaggaggaggaagacaaagtaaaggcaggaggagaagcccagtctgggaggtagagacagcaacaacttgagtcatgcgctggacacagtgcccacttagcaggaaccgctgcagctacagatgggtcccaaatcatgaacgaggacgttctggttgcacttccatcctaagaggatggtggagggtgatgctttttgtttcttactcatttccctgtgcatccatacagttagccaataccctctaaagtaataaaagtgtatttctgctccgagtaacttggttgaactaatattcaaatccaaatctgcagactggtaggctgactaggctatgtgaatgtgtaaggaacacagaatgtgcatacaaattccatacagacagagaggactgggctggcattaaggaagaccagtcacttcagaggactggccaagaggccagtgacaccacgctcggtgacaccacagctcttctcatggtttcaaccccagaggcagatattcttggctgccttcttgagtgccctgacgggggccactccttttgtctctttctttgatttctctgggtgcagactaaaattctccttgaatctagttcaaactgtccaaaagaggggatctattcagttcgattcatcacactggatggagttcttagaccaacacacgccacaggcccatggccagcctacagatcggctccctgatgtcatgccatggccatggaaagactgaaccatcacagaaggggctgccagcactgggacaggcatgtaagtcatatgagaccatctaccttggtcaaccaggcagtgctaatcgggagagtaagaggacagcacggagattagcaacccaaagcaataccccagcaggtattagagttgaccattggagcttggcatgttttggttattaatactccaaactattcatgcttaaggcaatgtggaatttcaagtgaaagccagatggttcttgggcaagaggaggaaagaaaaacaaagcatcatgtgcttgggagaacgcctagtaaaacaagaggatcccagtctctcccagcagagtgtgggcatcgttcactccctttggtacaatccattccctttctcgtcgggattcacacagcatggtcaaaggcaatactttaacatcacgaaatcaagctaggtttacaaatgtaaggtaagagataaagaaagaccatctatctggagttcttttctcccctttctttctatgtgtagaataaaaggacagagaagagacagaaatttaaagggaaacaaggcaagtgctgaaataaacctgccatctattttaagtgaaacaatttatttgggtttcaagaatacttttttctgtctctcgttcttcctaaatcccagattatcagtctaatcgaagatcataaaggagatgacaaaacaattatcagagagaaaactggattccacttagcagcggctaccaaaagtacagtttaatgtgttttcaatgaggtgggcccctgggggcctgaacacccacaggccaacggatgtttctatgtaagaagagcaacgtcatcagcaaaagcaatttcccacttttattaatccagtttattttaaggcatgattattcaagctttcgtctgctatagttagtcttgtattttcaggataataagactggtgaggctagttatcaagtgcctatgcacagaattcaaatggcctttgttctacctggcagtctcaagaactgttaaatgagcttaaactttattacaagaagaaacagaacatgctgagtgaaaggtctgcttagttgcttaccataaaaccacaactacttaggaaacttatgctctgcatattctaaacctgaaggagcctctaatggggcatttggggtcagttttaagatgattcctcaaaaatgcccccaaataagacctggaaggggattccacacttggctgtctctgcagagccacaggcaacaacacagaggtgccatgatttatttaatggaagcttggtagtgactcaatatcaagaactcaccttgagaagccacatttcaagtatctgaaaacaactggcaggcctttattcaaatactttaaatagatcaaagctgtttattctctaaactcctctccccttcttacacattttaaccaagtcaatgttttccttctatttctctcagaggtctaaacatctctaaactatatttggcctaaagttttgcttgaccacatgattttaagaactgttgaatttgagtgccattgccagggaagctgggaagatggctggataccagcatttacaaaggtctcatcactccatgagtgataaattcccatttctcacatggttcctatgggctgggagtaggagtcctcaattcattgtccttctgaaaggcccagatctatgaattgggagattacttgtattcagcagttacattttctactttttgtgggctttgaggagattagaaggggtaagagaaagatatttgacatacttctttctctacccctcaagactaaataaatactaactcaactatcttactacttcaagtttctaaataaatctcccattcagggtcaggctaatccccttaactctcctctccagtatcattctgatcccatccgacacctcccaaactgagcctcaatgcctttcccgcatggacccgcctctggctggtgaagccaaaggtcctgagagcatgcatgtggacagagctaggcaggtttccttggcgtctcctggggacgtcacatattatcctccattatgattgtcacagtacatggtatgagcagacaatagattttaaggcactttaaaaaaatgcttgtgtaaatgaaatggagcatttggattcaatttagtagccttatacaatatctgctttttatttcagagaagacttctgaggtagctgatgaacatgccggcagagaggttgaattccgaggtgaaccagtcattccaatccaagggagacagcgtttggaagctttaatgtaaacagaaaccctgcgggactcacttgtgcatacagctgtcaaaacaattcaatatccagagataaacagggtataagacacccactagtatattatactggaatgcaacatctttttaaaattatgttgccatattctgtactttatcgagtaccttccattttaatatttcatctaatagactgtaatttggcactttgggtagtaaatagtgaattaaatgctgatgtggcttattagggcaagtaaatttgaaatcaagtatagtgatagcattataatgtgacatgtcatcagtttacagaagagatttctcaaaggaacacagagttctgaatacatgggtgttggtatcatcatagagaacagcaagtattcattattcatttaggaaaggaaatgtgtacctggataatagtttaaagctatatatatatatatacacacatatatatatgtgtgtatatatatatatgtatatatacacacatatatatgtgtgtatatatatgtatatatacacacatatatatgtgtgtatatatatatatatgtatatatacatatatatatgtatcattaacatcaaggctgcatgaaccaatttgctttgcacaaagacacaggagaggtggtatcaagtagtggaaggagttgtggctttggagttaaagatactcattcagattctatcatttgctagatataagccttgagaaatatacttctgtgggcttcaatgctctctactgtttaaaaaaaaaccttgaaaaattccaccttgcagcattgttttcaaattgtcaatttcaactggcgctcagtgaatgggaggtgttggaaatgaagacattcagcacataaataaggaagtaaggtgtttaagagtctgtatcactggacctatgggcagtctttctgggccactgtcaagcctccctttttgagaagctacaacagccacatgggagagtccagcgaccagagtggccgccgtggtccagataaggaaaaccgccatggattcagccagacttagagcaggatccgcaggcgaaccgttcttcctcttccagctatttctggataagcccactgtgtcccttcctctgcagagcacacctgcatctttgattccccaccttgaagtccttgtcctttcctagcctgagtcattccactcagctcaaaagacagtgtctgggcatcgtctccattggaagacagttcctgatgtttcctaaagttctctttactcccccgtcacatcctcatagcatgcagcaataaatagaaattaccctgtttttcaattatatttctataactattgttgccctcctccctttcagtaatgtaaaaaattttcacagtatcttctgtatcctaattttccccactcaattcgatttttgagatgaactggcagctgcctattaccttttactttttcctctctaagtgatacttttagtaagcaatttacagctacctccaaggtgaatttgtgtgtaacttaattacattcacttataccctcattataattacagtagcttaaaatccccatctgtggaacaaaagatgtttccatttatcatgtttctattgtgtataagctgtccttaatattaaacaccacaatactctcaaaagatgagactatctctggtaaatgctatacctgtcccccccactatctctttataaatgcctcagttaaaaatgatatgtttttaccattacgcacttttttctgatttttttttattagtccaaagaaataaagtgctaacaaatagctgggtggatgaagtgagtgaggccattaatattctatactgatagttaatatacattctcttttccacattacgtccttagacttcaggcataactccaagtaaaaattcaacagaataaggaaaactgcattcattagtagaattgtttttctttttcccttataacacagcacaattgcagatcaggagacacacaagcagacctcccagactcgtgggtcacacttagggggttattggtcaaaaatttctggatatctgctttctgagaaagtagcaagattttgctggcatttactttttgataattaaaactagatttttattttatcctataatcggtagtattctcccccactcagagtcataaataaggttaaatagtacaagacgtatttagtcacctaatgatgctgatgatccatctcagccaaaacaaatccttaaaaccaggcaaataatattaatctcacaaaagaagcaactgttaactagaaatggaaatccaattaaatacatttcctgaataattaaataataatgaaaacttgaggaacatgtacaggcatacctcagagatactaagggttcagtttctgaccactgtgtaaagtgaatatagcaatacagggaggcatacaagttttgtggtttcctagtgaatagaaatgttacatttatacaatgctgtagtctattaagcgtataatagcattatgtatataaaaacagcatacaaactttaatttaaaaatacgttattgctaaaaaatgctaacaattacccgagccttcaacaactgtaatctttttgctcatggaaggtcttgctttgatattgatgactgctgactgactaggatggtggttgctagaagttgggatgactgtggcaatttcttataaaaagacaacagtgaagtttgctgcactgattggctctttctttcatgaaagatttctccatagcatatgatgctgatagcattttacccagagtagaatgtattttcaaatttggagttaatcctctcaaaccctctcaaagccactgctttatcagctaagttatgcagtatctaaatccttggatgtcatttcaacaacgttcacagcatcttcaccaggagcacattccatctcaataaactgctttctttgttcatccgtaagaagcaactcctcacctgttcatgttttattatgagattgcagcaatttggtcacatcttcaggctccaatttaattctagatctcttgctattttcaccacatctgcgatgacttcctgtgctgaagtcttgaagacctcaaagtcatccatgaggactggaatccacttcttccaaactcatgttaatgttaatattttgacctcttcccatgaatcacaaattttcttaatgacatctagaatggtgaattatttccaattaacttttcccagttccattagaggcatccctacctatggcagttatagcctaatgaaatgtatttcttgaataataagacttgaaaattagaattactccttgattcatgggctacagaatgaccgttatgttagcaagcatgaaaacaacattcacctccttgaacatctccatcagagctcttgggtaaccagctgcatcatgaatgagtggtaatgttctgaagagtcatttttttctgagcattagggcacagtaaggctcaacagtggacttaaaatattcactcgagtatgccctaaacacaggtaccatcatccaggctgtgttgttgcatttacaaagcaaggtcagagtagattcagcataatccttaagggccctaggactatcagaatggtaaatgagcattagcttcaacttaaagtcaccaggtacatttgcccttcacaaaagggcaggctgttcttggaagctttgaagccatgcattgattttttctctttagctatgaaagtcctggatagcatcttccaatagaaggctgtttcatctacactgaagatctgttgtttactgttgtcaccttcatcgatgatcataaccagaacttctgggtgacttgctgcagcttctacatcagcacttgctgcttcaccttacatgtctatgcagtggagatggcttctctccttcaacttcatcaaccaacctctactaccttcaaatgtttcttgtgcatcttcctcacctctctcagccttcatgatattaaaaagagttagacccttgtctgaatcaggtcttggctcaatggaatgttgtaactggcttgaacttctattcagaccactaaaatgttctccacatcagcaatgagactgtctcacattcatattatttatgtgttcactggagtagcacttccctcaagaatttttcctttgcattcacaaattggctatttggcacaagaggcctagttttcaacctgtctcagttttggacatggcttcctcattgagctaaattattcctagcttttgatttaaagtgagagatttgcaactcctcctttcacttgaatgctcagaggccactgtaggattattagctggcctgatttcaatattattttgtctccgagaatagggaagcccaaggagaggaagagaggtgggggaactgctggtcagtggagcagtcagaagacacacattaagtttgccaccttgtaagggagcagttcatcgcactccaaaacaataagatcaaagatcaccgctcacagatcaccaaagcagataaagtgataaactttaaaatattgcaagaattaccaaatgatagagatagagtgagcacatgttgttggaaagatggtgctgctaatagacttgcttgatacagggttgccacaaagcttcaatttgtaaaaaaaaaaaaaaacaaaaaaaaaaaacactcattatctgcaaagcatgctaaagggaagcatggtaaaatgagctgtgcctgtgataccagcaaatatttattacacgctgcatttctttaaattgtcttatatggcgggtattactttttcctatttcacaggtcagaaagctgcaatgcagagaggagaaatgatttgtttaaggaagtagagtaagtaggcatcagaggcagcattacattagcttcgaagtctttattttcactaaaataccctgccttcccctcccttttgttgctctgtgtcccactttagtatgaaggggcctatgtttatatcacagtaaagtcatgacttaagtagttttagacatagtatttcccccctcatgaaatttaactcctgcagcctattctatttctttaacaaagacatacagaatcatattaattatctttttaaaaaacctgaaaataccatcaagatacttatggaactcacatgaaagtgaaatagggagtatgtccccattccctcaaggaattgagtaataaactaagttttaaccaccaatggtagcaggtttgcatgccacttcacccagataacataaacacaccagttatctgcaacccctgtacgcccaacatggtataaagcaaaaagagaaccatttaacagcttttatattagctagtcattccagtaataaaacaggaagacaatcatacataaatgtcaccacacaaaaactttctctattacttattaataaccaacctgataatatcattaacggcttgtagagctaattgcggtggctttttactgctccctttgatatgtgcactatcctgaggaggataacatctgttagatctaactcatcccaaacatcaaatgtgacaccgtggtgtttaaataacttgactgcgcgctatttcagcaggtcctttcccgctctcctttctcatcttcacaaggctgaccacaggcagaggccttcctgtgctcattactgagtttcatgcagacacgatggagtgggagggaaagtttattaccttcattctgcttgaatccatccctgactttttggtccttcacagatttctttgggaaaataaaaatgatatattgttttctgaacaaaaggaaattaatttcaatcttttaaaaaccaacttgaatgttattcagttcggttttttccctaaaaaaaaaagtttcagattccaaagtttttcaaaaagtaacttcaaatttcatctatgtcaaaataagtaaaataggtcctcttgtcctattgagaatgacaagctcagtataatcttggaaaaatcaatttctataaatgactaacccgccaattgtattttgattttttttaaaaaaagaggtgcctatgcagatgcaggatacatataaatatagagtcaaccatctcctagtgactcaatcattaaatatttagctgacttaaattacactgcatgcatggggactacagttaatgacgatgtattgtggaaaatgctgagagactggatggtgtgttctcccagcaaaatgctaactaagtgaggtaatacatttgataatttgctaaatttaaccgtgccacagtgtctgtctacttcaaaacagcacgtggtatataataaaaacatataattttatgtcaagtttaaaagtatatttatactaaaaattaaactcatttttaaccctatagtttatgtgaaactatatgttatgtaactgaaatattttcacctaatgtgaaatcttgtctctgctcctgccacaaaacagaaacatgagaaagtccactcgtacttgtcagaggtgggttctcttcatcttgctgattcctctggtgggtctggtaaggctgagcttggtgttccctggactcccagaatggtttgggtccagcactgggctggccctcaggaggctgccctgcacatccccgtgcctgtgctgggttccgccccagcctgtctgtgaaatatgcgtgtacgtacgtgtgcacatatgtgcgtgtatgcatgtgtgtgcgcaggtataagggacagagacagacagatgaacacagatggagaaagaaaaattggtaggttgtattgagattccaatcaaaatctaaaatatgattttatagtttcaaactcaatctaaaccttttttgcagggtaatgttttatgactaagcagacgcagaagtcactctcaaataaatatagactacgtcaataaggtaacattgcattcaattatctccccaaggcagaatccctgtcttttctaaatgatgtaaataccttgttctctgtgtccacaatttaaaatggaagttaattaaaaagtcgacttgagcagggaccccaaatatagattcatttatttatttatttttaagttacacaaaagtattactatactagggtgcacactacaaaatatgctaatagaatttttgaagcaatgatgtgaataaaatgaatgaaacattttagaaggttcataaaggcaacaagaattgaaaatccagtaattacacactaagaaaaaataagcaaaaaaaaaaaaaaaaaaaaatttctccaaccaaatgtttactggaaggctgtgataatttttatactaaaggttattattctcaacaaaagcttatttttttccttagtaatagttcttaagctcaatttacaagcacaaattctctaatcttattgtgagaaggctgttacgaataatttttgttgttcatacagagaaattgagaaacaacgataataattgctcaaattattgaagttaagaagaaaataaaaattaatggtctagtgtttattcttataaaccctcctcacaacacacacacacacacacacacacagagagagagagagagagagagagagagagagagagagagagagagagagagaaattttccacttgtctgcaaatagtccctaaggttcttagccaaggtgtgtacctcaaagtctaaagtatgaagacttaaaagtggaatcaacagagcattttatcatgaaagccacacaagtgtggtatctgaaatggtgttctaaacatccttcgaatgctgccttttcttcaccttattgccaggaaaagcacagaagaatgcgtcaggtggaaatctgcatgggaggacaagcaatgaaacaaggtggcctctggctgagtagatgcactcactcattcctccaaccagcgctgtctgtgctaactccatggcggaattcctctgagtgctggggaacacaacagtgaacgtgacagacaaggtccttgtaaaacacacggtctcgtggggaaggcagagccaacaacacaaaaatattctctgcaaagcagagaactgaggtaaactcgtgtggttgtcagtgactggggtgttattttaggagaaggctgaattcatgcaattcttgagttaattatgttcttcgggctggccctggggactgcagtggcaatggaccaggtttcattgcaggaggagggtgttggcagcgactctgggcagtgtggggctaggccgaggaaggcgcctgaggagacagacacccttcctctctgacctctagggcccaggtccagcttcccaagacacccagcacaaggaaagctccaatcgtcatctttcatttctatcaagagtgacacttacggatctctaacaacgtttctatccaattttgggtctctaactatgtttctatcctgatgaaaaaagccagagggtttaataagaaaatgaaaattaaatgcactacttcctcacttagcacacagcaaggttgaggggcagcttttctgagcctgaccctaggaatttcctaactcaggtcaaaaggtgactgactcccaagccaaaggtctctaaggacaggtgtgttaataacaccactgccatgggtggagctttcagaggtctccaaggacagatgtcttaacaacactgctgccatgggtggagcctctctgtgccacgtactgtgctcggggagggacatgaaccacctcaccctggacccctctctcttctccagtatctgcattacatgtgcccagggggcccttctctactctgctgggatgccagcatctggcccagcatctggcacagaacagactcagcccaaatgtagaatataaagtcgggtatgggggtctgatgccctggcaaaggaactgaaagacttacccactgtccagtccaaagtccctaaaagaaagtcacagaggccaagaccccagacactttttgtccccaacacccaaagcttcattttaaaatcctttcagttcctccagaaaaaaaaaaaaaaaaacaaaaaaacctgaccctcaattcttagacattttatgtaaatgaggagaaagtaaggtgctagcccttcccgatcacttcttgttttgaatggatgtgtgagtcctgccaaagtgcaggctagtttgtgttctccaaatgcctcctagctcagtgagggtggtgtgcgcagggctgggatgggccacacaacatataggagcccaaatagcaagaaggcagttggagcacagcttaatcctgttgaaagaagccaccaagaagagctggggcaccggtgggtgcaggtgatgagcaaagctaccttcttccctaggtaatgattgcccatggggaaataatcagtaattcttcatctaggaaaatactagttgctgttcagagcctctgactggaagtgaggcatttccaagtatcaaacaatgattaaaagaaataaaaaacctttgcatcttggcatgctcatttaagaaagaaaacaaaatagacgtacacacagcccatttgcattccctctacccagtctaaaaggtgtccgatgattcattttaatcatttaccaatttcttggtaaccagtgtgtattgcagcagatacttggcaaaagcatgttaatttgctactaatatctgtataaaccagacattaatattctcaatttacaaataagcaaccagaacttcagcgaagataagtaacttagccaagattatccttctaataagtggtaaagctggaattcaaacacaggcctagtggagtccaaagctttccccactcctcagtaaaaagctaaacaaacttcctaattttctgagcttcctacatactctttgcactagggtaacaaccccatggctggctttattgcagagtttctctgcactggcatttggcctttgcctgtctaattttggctagttgcataagattctcacttagtgcaggctcaaggtgagacagtatttttgttttttcttaggtttatctctggagattgccaatgcttgcaagaatagcaatgctatcattaacctaataatgttggattaacttcaagagctgggtaatagcgccaatgttcatttcccgtaaatgttggaaactcctttaacctcatgagatcctacataacgtgggaaagagtccagttctgactccaaaatcttaataattcactctttcgttaactgctttttaaaaattaaatgtataacaccaaatagtgaaaaataataataatcagtttgtacctaaatttctttaaagaaatttttagttttttaaagaaatctttccaatgattctgactttttggaggggaatgccacatggtgattatactgctaaggtatatatatatatatatatatacacacacacacacacacacacacacacacaccttatatatatatatatatttggatttttttgagacagagtctcgttctgtcacccagtctggagtgcactggcacaatctcagctcactgcaaccttcgcctcccgggttcaagtgattctcctgcctcagcctcctgagtagctaggactatagatgcccccaccacgcctggctaatatttgtatttttttagtacagtcggggttttgccatgttggccaggctgatctcgaactcctgacctcaactgatccacccacctcggccttccaaagtgctgggattacaggcatgaaccacaatgcccagccctgctaaggtatattaacggtcagtttagtattatttgactatttgttaacataataggagtaaaacttaacactttttagggtagagatggtacaaaaaattaaagtgtaataaatataaatctataaaaacagaagttaaataagaagaaatcttctggggaagaagaaataatagagtatagattattcttaacgtaagtcaaatatttgataaggaccacaggcaccttcttttaattcagatgctgaattttctttagtcctagaaagaagtgttgttagaattccaaggatatttggatgaaacttcgctgtaaactcacgtggaaactattttagctggccacagatgtgaaactaaaaatgttgaaatacttatttcaagtgcatctcgaaaatctgcaatgacttcctcctggaagataattttcttactacgcatgcttgacatggatttcgaacatctgcaatgacttcatccaggaagataattttcttactgcgcatgcttgacgtggatttcgaaaatctgcaatgacttcctcctggaagataatcttcttactgcgcatgcttgacgtggatttcgaaaatctgcaatgacttcctcctggaagataattttcttactgcgcatgcttgacgtggatttcgaacatctgcaatgacttcctcctggaagataattttcttactgcgcatgcttgacgtggatttcgaaaatctgcaatgacttcctcctggaagataattttcttactgcgcatgcttgacgtggatttcgaaaatctgcaatgacttccttctggaagataattttcttactgcgcatgcttgacgtggatttcgaacatctgcaatgacttcatcctggaagataattttcttactgcacatgcttgacgtggatttcgaacatctgcaatgacttcatcttggaagataattttcttactgctcatgcttgacagctgggtctccacactgcatcacttccaggctcctttcacacagccctcctggcattctgcctggaaatatgtcatatagcaagtttcacacttttttaacatacttgcaaaaaatcttaggttagtgctaacctaagattagtgcattgtttctaaaaggccaacgcattacatttttcctgagaataaatattgacaactccaggatttaaatagtgcacttggctaagattatggattttaggtagtctgtatatctttatgatattgtcctatgtattttaacattcttcacttttcttagtactgccatttcatgatttttttttccttttggatgctattgattagtacataaattccttggttgtacaccctgttttcattgctaatccagtagaagaaaagcaatatgcccaaaatcttttacaaaaaaaaaagctttcttgcatctgctgcttgcattctttgtgtgatacagtattttctctcattattgttggtcttcaaaggcaacaacagcataaggtctgctcaggccagagggcctcctgatatagtcctcatggagaccacacagagcctttccaagaggtcaaaggaggccagaagtttttggttctttttctcctaacttttatgttcatcccaggtaagcctccatctccaatctctgtctactagaatctatacacaagctggtgcaccagcttgcctgctctcacttgccttcctttgatgataccataatgtctctgattctacaacttaatttttctttcactcaagtctagtccagtagatacacattcctgttatggcaaaagatcatgtactgctatttatggaactgtaatttattctgtacttataggtgaattaggcaaaccaataatgccagcaaagcatatagattgaggccaacatttgcagtcattagacaaagtggactcagccactatttctaagtctttagtttggcctaatacctaatgttacattgatgccatactgtaagctccttgaagtaattttctacatttttaaaactcagcctatcattgctaaaataataaaaattctaatgcaagttgctctttatttctattacctgtaaggacacttgtatttgagaatacacacttgaaatgagttaaatataccaacatggatgtttggcttcaaagaccaggagcatgtcggatccgggctcactgctaagctttctctgactaggcatataaatcaacatcttcagtgcttttagggccaccatgcagcaattccatgatgcttggctcaagctctgcgcatctcacattagtcctcctttcacccaagctggctccagtaattgggtgactgttctggcagaatcatgtgctaccatttaaagtgaactagacaaccagttgatactgggtgaggataggagattcttttttttttttttttttttttgagacagagtctcgctctgttgcccaggctggagtgcaatggtgcactctcagctcactgcaacctccacctccagggttcaaacgattctcctttctcagtcccctgagtggctgggattacaagtgcctgccaccacgcccagctaatttttgtatttttagtagagacggggtttcaccatgctggctaggagttggtctcaaactcctgacctcgtgatccacctgtcttggcctcccaaagtgctgggattacaggcctgagccaccatacccggccgaggctaggagattcatagaggacagagaagacattctaggcttcatattgaaattgtaaatgtgaacccataaacaagtcaatagagatcaacttttgcatgcacgatcttatttactcttacataataccaccaactaccacttaactggaatgtcataatgtagaatctagacaatctttattaaattattaaattagctagaatcactcaacatggtattgtggtaagagtaaataataaattttatctagcaaatttatttttggatatacattacttcaaatagttgtgtgaccacaggagcatcataactctcaccggttttttcttctgggagacagctaataaacaactttactacaatttagaaaataatcctttagatttagttaaaattaaaaacatttcatatactggtagctcaaataaaattttggttgctcactaaaccatattatttctcagacatgattatatggtcattttgattacaaaagaaatacaaagcaaagtttatttggaaaccttttcaaatgtttctacattgttagcaaagcattatatattttcaaaagtatccaaaattttttttgttacactgtagtaacttataatctagcttgtatttcctattttcccataatattaacaaacatttacgtatttgagaaagaattccttgaagcataatgagaatatacttgttcaaaaatctcgctttcatgttttcattttaggactataaacattaggtagttcagaagaggaggtgcaatgcaaaaggtcctctgcaatgctagggagctctgggcaaagtgagagcgttctgctttcccttagagaggtcctggcctaaaatgaacacgtacttccacgagcttcgggtgtgatacagaaatatgtatgactctatgtaatccttatcatggcgttcctaccaactcaaacatttttaaggttaactgagtactcgatgtaattgtaatacatccacctagtcactactacaagatagtctgtgtggctgcaggctatgaaggatagctttttattttttccttatcaaggtaatatttggaacacttcaaaaaagccatcacagtgccattatagatgaaaggcttcccggtagaaatttcatttcctatacctgtaacaggctttcctgcagaaatgatagcatatgtgatacatccaaaaggcttatctcatgaagtcccagtgaaatgtattaattttgcttttggaaaataaaaacatcactaatttactgagaactctgcaatgcagtgtaaattctgtacccaagaagtagagctcatcacttaagtgaatagaaaagtagcctatagatgttactgtggttatgataaaacacttttaaatcctgtatatgtttaaagtttaaagaaaagcatttgcatctcgttttcctagtgtaattaattggaccttgaatgttgtatgtttccctgtgatatttgaatgaaagccaggggttgtcttattatttgccttaatatctatttgcagtaaaaagctaacaaagaagtgtccaaatttgcaggtagtgaacccccatttaaaagatatactatctcaatcaactcacctatgtaactttattaatataaaaagagatatcctggctgagggcagccagaagttactctgggataactagccttcaagacgtacctcttggtagtcatactctagcataataccttcccacaatgaattatggctgccctgtgtgatcaatacaatataacagcagtaacaatatgtgctagattatataaaggaatgcagctgccacttgaacatttggattgctcatccaggggaagccagctgtcctgccatgggaacacagacactgtcctgcagaaaggtccaaacagagaagaactgaaggcccttggccaacagccagcatcaatttgccacatgcacttcagtttgccacagtgccaaccacattggaagtgaatcttctatcatcagttaagtcttcagatgaatgtagctcactgacatctaactgccattgcatgagatacccaaatcaagaatcgcccagcagtctctccacaattccagacctacgcaaaccatgaaagataatgcatgactattgtcctaggccatacgttttgaagtaactcattatgcagccatagacactgatacaaacgccaaagttacaagaaattctcctttgtttgcaaaaaaaaaaagaaagttcttactccagatgcccactgtcacctggggttgttgtgtggtttagcagtttgaatttcaaggtgcatatgctttaaaataaagggctggctctcaggcctagtctgtctagctgagcatacatataggactattattatctgagttattaacatttcttcaaacacagcattatccagtttaaattctgtcttcctcagtagacactaagttgtagaactcaggcactgtgctgtacccaatgcaccaggcaccttttctggtatacagtaaaagctcagtaaatgttggagacaggaatatgtcattcatatgtgaataattaaatgtagacaaagcgaatcgaatcatttcttgaagcctaatgagttctgggcaaggccttaagctgagttaagagttactattgcagagcttttgttttcacttccaggcagtccttggaatgctgctgggccattttgtttgtatatgtactaaaccagctgggattgtaggagttttagaatgttttgaaagaataaatttctctgaaatgagaagtggattgtcattttaggattcggagtagttgaggatgtgttcctcgtgtttgaacaggagtgcagtcagcattagtgttgtccagccctccttgctgccccaccacatagaatatcgagccagctagtccctttgtttttaggtgggacgtgtcactagttctggctaacaaggtggaacgatgggtatcacttcccagccagagcataagacgccaactcttccctgcctttgtgactgtggcaacttgtcatggtggagcctcgtgacaaggaccttgtctgtcgcgttcactgttgtcactcagtcagcctggagcccgaggtcccacatcgagcagacccactctggacccgtcgcttgtgttagaaaacattttttgttgttgtgtaaagccactggaactattggcacatttgttacagaaacataattttctgtgctgataaaggccagtgtaagatcgatataaattaatcaccctcccatatgcacatgcacacacacacacatttatacaaaagaagcaatcatatttactgtgtttttacctgcccagaattcttctccttttttggtaagaacaacttcactgacttctgagaaaccacaagtctgatgcatttaggttcaaggtgggctaacttatcccctaaacacacaggcatgaacacacacacacaatatacacacaggcatagggtttgactagggtgggcctatccacctgtttagttcccatggccatagtggtgttggagatagtatgcaaccgaggacagcgcaataagggtcactcctatgacttttgctggaactattaagaaagaggccttctcttcccactaggcttgctaactgatagaatgtaagcctgaagcttatggtgcctttctgtcaccaagaggacacagctgacttaatgaagtaaattccagaaaatttgcttaattattgttaaatgattctgtgaactctcttcatttagcaactgttcaggaaggtaagaaaaagaagcaaactcgggaatatcaacagatttgagatgtctgaattaacttcgagcacctggattaagtcatgtctaggccaacattaatgccaggaactcaaatatttaatccaacaatctctctttttttcttacgccagtctggctggatttctgcttcttgtaattgaaagagtcctagctaatacatcttctatatgcacacggctgtactagatatttggaggtagatggaaatgcagaagccgaagacaagcaaatataacatggtccttgcttcagaaatttaaaatttgtttacagggacaactataataaatgaaaagctaaacgctccaatccatgagctcttccagcagcgttaaggaggtctagaaaagctacttatttcctgcactgtcaccgctgacattgagtgttagggaactccttacccatttttattgaggcagaagagcacactcggcagtagaaatgtaagattttggccggtcacagtggctcatgcctgtaatcctagcactttgggaggccaaggtgggtggatcacttgaggtcaggagttcaagaacagcctggccaatgtagtgaaaccccatctctagtaaaaatacaaaaattatctgggcatggtgactcccacctgtaagccaagctacttgggaggctgaggcctgagaaccacttgagcctagtacctggacgttgcagtgagctgggatctcaccactgcactccaccctgggtgacagagcaggattctgactcaaaaaaaaaaaaaaaaaagaaagattttctcaaatttgtggaaaagaaactaaacaaaaattcactatgaatcaatttactataaaagttctatttaacacttgcaacataaagcaaatactttaaaattaaaaatcccagagtgctatgtaatacaaacatgaaaaacatataaaaggcttctagtatcatttcctaactaacatctggcttactgaataaagctttataacatcaacttcatttttccacagttattatcataggtagttataatgtttttcttaaaaaaatgaatatcaacacaaatttgctgttataaagagtaagacaacttcagccagatctttctctttttgttttttttttttgagacagagttttgctcttatcacccaggctggagtgcaatggcacaatctcggctcactgaaacctctgcctcctgggtgcaagcgattctcctgcctcagcctcccaagtagctgggattacaggcacccagcaccacacccagctaatttttgtatttttagtaaagactgggtttcaccagttggccaggctggttttgaattcctgacctcaggtgatccacccgcctcagcctcccaaagtgctgggattacaggcgtgaggcactccacctgggccagccagatcttttaacttcatcaggatcttcactttattttcagggaaacaaatatgcaaatctccttttctctacagtaatctgtgtgtatattacatgatgtggcaaatgatacattcctgcttgccacaactaattttcactaatttctccagatattctatttaagagggctattttctaatgggcaatctttaatattgatccagtaatttaccatacagactcaagaaaaagaaactgaagatgtaaatttttacttcagcaaaataccttcttcacatgacttaaaacataaacatgattatcaggaagtattatgaaaaatgggactatgaaaaatgggacaataaaaattctcctagggaaacttccatcaacaagaggggacggaaaaacagcattttctctcaccaaggaacaatcccctccccattttttttcatcttgttggtgaaactctaaaatgaatgtgaaagccacataagcaacagcaattgggtaggaactgtggaaggaagccagagatattgtcatggagagacatcttcctgaaagtgaggggaacactgaggggtcaaaatcagaatggggtaaaccaatgggtggatagctccactagaccaaatttggtttagagtaacagaggaggcaggtgaaaattaataatcacacagcaaggccacggttggaagaagcagtctgtatccatgaggcagagagtaagaaagtgagcaatactagaatagcaggtggactactgctctacgccccaccacatacaggacacccctccacaatacatgtccatgaaacccaagtattcaatgttgaataacacatacacacacacacatgcatgtatgcatgcatgcacacaatctatacaaacatactacaagaaaaagtctatttatagactaagaaatctcatcagaaaaatgttgttactcaacagaactctctggcaacctattctagtaagaaatgaaaaccaaacaatgaatcaaccaagcagttgtgtccatgaaacaagacaacagagcagaaatacaagagctggagacataacagagaaacttaaggaacaactgaaaaaaaaataaaaataagatgtgaagtgacacaaaggtacaaactcactgcaaaaagcactacaaggaaaaagatagaaaaaagaacaatgagctaaacggcctgtatgatttggaaaaaaaagaaatcaaagaagaggctgggcacagtggctcacgcttgtaattgcggcactttgggaggccaaagtgggcggatcaccttaggtgaggagtttgagaccagcctggtccaccatggtgaaaccccatctgtactgaaaatacaaaaattagctgggcatggtggcaggtgcctgtaatcccagctacttgggaggctgaggcaggagaattgcttgaacctgggaggtggaagttgcagtgacctgagattgtgccactgcactccagcctgggtgacagagcaagactctgtctcaagaaaaaaacaaacaaacaacaacaaaaaaaaaaaacaaagaagatttgaatctacatatggaaataacactttgtaataaaaggaaaatgacctgtagacaacaccagattataacttattaaaatgatcagtttgtggtttgtggagcaaaagaatcttctggacagccaagcagaaagatcaattcacttatgtggagaaataaatcagacttgcctctgactttcccacagcaacatgtaaatatcaaaaaaaaaaaaaaaaaaaaaagctaaaatgacaccagtaaaaaacacaaggaaagagtgttccaagaaaagtaatacagcatgttgaatattgttctcaaaattttttggaaaaaaccgaactatcattagcttaataatagaactaagactgaaatcattgtggattttagggtaatggaaaacagtttagtgcactttgtcctgactgtaaaacaacagcatttctttaaaatgggaggtgaaccagaaaaggtagatgggtgggaagcagaggaagtacatttcttaaaacagaggatacatcttttctcaaatgcttatggaacagtcatttccttgaagagactgcatatcaggccccaataaaatatgaattaatttgaatgagggaactactatatacatcatactctgagtacaatgtaatatacacttagaaattaataaagcaaaaataacgtgttattaatttaaaataattattttaagcaattcttgaataaaataggaaatccaaatgagaatcacagaatatagtaaaaacattgatgataatggaaacgcaacacaaggcaacccacgctgtgcatctgaactgatgctcagagaaaaattcatagttgcaaaagcaagtgtttttaaaaacaaggaataaaaagtatgttttcatgccaaaatgtggcaaatggagacagaactacgattaaatatatataaacaacataaccataaaagtcagaaaaaaagaatattaagaaaaaaatagaaattgctgaatcagaaaatgggcaaaaagagcagaaacatcaaataaactaaaaagctagttcttcactgggaaaaaaaaaaacctatgcagatactccttgacttacaataggtttatatcaccataaattcattgtaagttgaaaataccataatctgaaaatgcatttaatacatttaactatggcatatcatagcttactgtagcctactttaaatgtgttcagaacacttacattagcctacagctgggcaaaatcatctaagaaaaagcctatttttataataaagtgttaaatatctcatgtaatttattgaatactgaaagtgaaaagcagaatggctgtgtgggtagttcaattacggttcctactgaatgcctatcacttttccactattgaaaactcaaaaaatcatgtcaaaccatcataagttgagcatcatctttaagcaataaacttcaaactaatataaggaaagagaaagaaaatatacaaaattaaaataaggagaatggtaaatatgagggaaagaactttgcacaattctttgtaaatttattaacttgaagtaaatgaacaactttataagaaaatagaatttatcaaaattgagtcaagacaggaaatctcatcagaccaatttccacagaagcaaacagttattttggactcgataactttttaaccagctttaagcaacttctagagattattctgagtatttcaaaccacagtgttgccgggtgaagtggctcatcccagtaatcccagcactttgagaggccaaggcaggaggatcacctaaggccaggaattcaagaccagcctggccgacatggcaaaacccagtctctaccaaaaaacaaaaattacccaggtgtggtggcacacacctgtaattccagctactcgagaggctaaggcactagaatcgcttgaacccagaaagcagaggttgcagtgagctgagattgcaccactgcactccagcctgggtgacagagtgagactctgtctcaaaaaaaaaaaaaaaaagtttcaaaccatagtgtcattccgataagcagtattattccagcgtttgccaaccatgctcaggcatggagagttaaggaaattaatagccatatgtacttttctccaaaaggaatctatcggaacacaaggccgttcccacactttccacttcccactcacagttgcccccctactccctcacggtaaaacaaatgcagaagtctcactcttgagggctcttagcttaattcattgtctcggggtataagactttaggctgacccccaaaaaaggaaaagttaaaatatgtgtgtccactcagcctcctttaactaaagcactatacaataaatcataaatagtaggggtttgtgtctttccttgtcatatatatatatatttcttttatttcctttttttttttttaagacaaggtctttctctgttgcacaagctggagtacagtggtgtgatcacagctcaccgaagcctgaagcctcaaactcttggcctcaagtgatcttcctgcctcagcctccttagtagctagaatgccatcatatctgagtgattgttttttagctttcttagagacaaggtcctgctgtattgcccgggctggtttcacactcctaggctcaagtctcgggctcccaaagtgctggggttacaggcatgagccactctgcctggccctgtcatgcatatatttctgttaagggtatagggatatctggccagtgttgggatggtctggactcagatacccatgaagatctcatctagtctcaaggctttaaacaccgtctggattctcactcccagatttatatcttttccgccttgctttgttctcaacataactggccaacttcttctcaacattggtttacagcatgtccatgaacgtgaaattctttcaactcacaaggcccaacaccatctggcgcctttcgtcacttgtagctcgcctccagctctcctcactcactctggcctccagcctctcctgccagcgaatgcttgcccccttggagctttgggcttgctgctcctttaatctcattcttccccatgcagccctgtgcctcactccctcacccgggctgcgtctttactcaaatgccttcttgtcaaagaggtcgaccactccgccttatttagaactgcactctctgcttcctatccccagcgagttttatttttatctacagcatatatcaccatctgaaataccactgtgcatatctgatggatttatcttgtctgtcgtcagccttttctctttaaaaggaggctccaagagggcaccggtgattcctttccattgtgtgaagctgtaacccccacacctaaaacacagcctgacacaggtgtcagaaatagttactgaatccctggaatcatcaccgtattcctggattcaggaatggggaaaaaagtgttccatctgaggacagaactggatcaagttccaaagcagcctcaaagtttggatgggattggagtggggagtgacacaagtcgttgtaattacatgggcggggaaatcatggagttttgtgggaggaaggccaatgtcagaagaacgtttcagggaaatgggtccaggtggctcacttatcatcattaaaaagctatgcaagtttttacttctctttctcctctatccataaagtcctggtggtgaaggcttacctgtttttttcatggcattaaaccgaaccattcacttcatgattttgcctggtatcccagtaggtcttccctatcctaatacataaaatagaggttggttggcaatttgctgcttcatctgtcagtttagaaataatcctttttggccgggtgcagtggctcatgcctgtaatcccagcactttgggaggctgaggcaggcggatcacgaggtcaggagttcgagaccagcctgaccaacctggtgaaacccccatctctactaaaaatacaaaaattagccgatgtggtggcatgtgcctgtaatcccagctactcaggaggctgaggcaggagaatcatttaaacacaggaggtggaggttgcagtgagccgagatcgcacgattgcactccagcctgggcgacagagtgagactctgtcagaaaaaaaaaaaaagaaagaaagaaagaaagaaaatccttttttcttttcctcattagcaaagagctcagtgcttcctccaaaaggatattgggtctagaaatttgccaaatacctgtgagcatgtcctttaggattccaaatagtacactcatattttgaaatttggcaaaggcttgaaaccaacacttatgggtttttggtttgtttgtttcactcttgttgcccaggctagagtgcagtggtacaatcttggctcactgcaacctccacctcccaggttcaagcgattctcctacctcagcctcccgagtagctcggactacaggcgtgcaccaccacacccagctaattttgtattttgagtagagacggggttttgccatgttgggcaggctggtctcgaactcctgacctcaggtgatctgcccgcctcggcctcccaaagtgctgggattacaggcgtgagctactgcgaccggccacttctgattttttaaaaagtgaacatagagccacacaccaagtaaggaaatacttttagcagcatagaatccaacgcttgccttccttcatagatctctatatacacaaaatagaaatgaaaccaagcactaggcctatattattaatgcaagaagtgtttgcttgggattggatgagcaaaaatgtcataaaaacaaaacaccatgaatgtttcacaatatgccccgctcagaggtcagcccctccatgtgtcctgcagagctcctgaagcctttaagagacaactcaaaaaaggagtgaggcagcctgttctgacacttggacgtcttccaacgcagactttcagtattatttttctaaacatcctaaatctctagtgagaacatggaatagactatttctgtaatggcagatcttacaaaagagaaacaacttcccgaaaacatgcctatgtccagtcacagagaccaagcatcaaaatcacctgcaggggtttctctaagtcgccctcacacatgcttggacatctgtatgaattcaatgcacagtaaatactcctttgagggtctcttatggacaagacttcgagagaagaataagatacattctgcctccaaggaactcatcatctagtccacggtgtgtggtgatgggaatgcagatgccaggtgctatgaagtgaaccgtgtcacccccaacatttacatgctaaagctctaaactcagatacctcagaatgttttgggggacacggcctttaaagaggtgatcaagttaaaatgaacccattagggtggacccgaatctaatctgaatggtgtccttataggaaggcaagattaggacaggagagatactggcgttgcaggagcccagaagaaacgctacgcgggggtgtagtgagaatgtgccatccgcaagccaaggagacaggcctcaggaaaaaccacctgctggcactgtgcactcagagtaaaccccgagtgatctcagagttctagactccagacctgggagaacatataaaccacgcagtctgtggtatggcggccctagcaaactaactcacctgaatgtaaatatacaactacaaagcaacaaataaaaagatggcaacaacaagcaagcaatggaatggaccctcctgctgggctgaacatcaagacagggatttagaaccagctttacacaaggagcatcatttttccctaggtatgatttttatccaattcactttgattaatgacagctaccatttagcaagggctttttatgtgccaggcaccaaactcaacacttttcatgcattcacttactcaaccttcactgcaaccatgtaagatcgttgccattgttattccaaatggacagatgtggacactaaaacagagaggtaaattttgacctttgctgaagtcagatggctgcaagagttggaactagagttcaagtccaaagagtccaactctagaatccttagaaccactgtgcatactgcatgaacagtactcttaccttctctagtcaagagttcaatgtgaactttattccagaaaaacacaccattcaacatcttcatcaaatattataaagaatgcagtacttagatatagactctctatgcagcatttcctagctacatttgacctctctgtttcaatgtatctgtgtagcaaatattctatgaaacacaatttcttaattattgacctcgttgtgtctttaccagcactgtgactataccatgtggtgtgagagtcactccagtgaataaacacagactgaggtcaagagtctaatcattaccaaggccctgggaaccctccttgaagagaagagataggagcgcactatccaccatgaaaagttgaggtaggtagcaaagtcagtgtctacaccacccgccagcttctcctcccctcttccacacgggtgcatggctgccaccacttcctgatgggaagcttttcagaatacagataacatcctcactctcctgcctccctccccaccccagtatttttatttagtagatctggtatggctctaggaagctattcttgaaagtttaataatgattccaactttctgccaggtttaagagccataataatgttgaccaaaattgtagattttccaggatactctaagctttgataattttgtgcggacagttactagatcatgtgatctaaacgagggttggaaatacccccatttatattcccaggcagactttcccttgcccacttccaaagcaacctagactttgggactactctattccctcactgctcttgccctcactcacttaaaatacttttatctaatacaaaggtgctagatgttgacctgattgaagtagagctgttaagaggtaactgaagcttcagctaaataatgccagggggtaacattgtccagggaaactgttcaccagcagacctctgttgctcctgatgtactccaagttattttcagtttagcctttcataacgttgtacaaagaggctttattcataaaacagtagctttggttggcctcccacatcgtgaaaacaaatgtaatatagtaattaagtgtgctgatatgttatcattgcaaatgtcaagttcattgtagcagatgtgtcaactgaagatcactacccattaaaatcaaacaaccagtaggccccaaactcaccatctgatttcatgcgtcaacttcaatgcttaagacagtcaatcacaactgtcttccatgtaattgtcttaaaattattacataacaaagaatcagatctcaattcttatcacctgctagtcataattaaaatgtgaatgaagggctaatgactgacacagttacagggtataaaatactttcacaattttacttccccaaatagatggcattattattaagaaaaattactcaaaatgtgaaataaggaaaaaaacgactgatgtgttaatgtcttgctagagcaaagctcactaaatctccttgaactctctagagaaatgtaacttggttaaacttactacattttctattcatttgggcccaggtattttacacattttaaagtttgggttcctaatttaaaaaaaaaaagtgataaaatcagatgactaatatttttatcaagttaaaaagttttattatccagtaggataataaattagccactatgatatctacatcttttcaattttatttcagcatttctttttcatctgactatataaaattcctactctcatatcttcttttgaaccagttttgtcatcctgctgattccctcattagtagtcacatggatcttatgaaaataaatataatatcccattagaaacatatctgctactagtcggggtacttacataaagttgcagcaattatcagaaaaaggtaatatgcaagtctcctctaaaatttcccaactatattcagaaaaaaaaaacaaaacaaaagcttaagtgactgcttaggtgaaaataagacttccagaagaatgtctgtcaaagttgtaccaagaacattttgaaaatacaggttaattcaaagaagcactcacaaaatgccctcaatatgattttgagaggaattattacaagtggtatgtattcttgaaagccaggtttagggtacatctctaaagcagaataggttgttttcaaattgctaggtcattcaaggcctttaaaccactatattctatccataatttgcaaacgtaccactaacttacactaaagagatagtgagaaataagttcttgtggaagcaatttacacatacagagttgactataaagtcctaggcactttggcaaacatgcttaggggtggaaagtttcttttttggtaaagatcccatagattactatttacattttagcatcatctaaacaatctggaagctcctgaagctcatgtctcatcttcaccatggacacaatcacatattcttactctaagcatctctcatttttattctagttgattctcattcttcattcttcgtaaatgattataatgaatcctctgcctcttccttcccctcttcttcacctcactttcccctcccctcccagctttccctctgccttctcctcccctccccgctccttgtcttccatccctgcctctcccactccccctgtctctctgacactgttgtctccaaccacacacaggctccctgggtttctttcacaaataaaggaacgatttgcatagatggggtaatgtgcatctgcttttgtggtgtaccttccattcttcctttcttctgggaatagtaactccctcccttttcttttcttttgtattttttttttatagacagtgtctcactctattgcccaggctggagtgcagtggcacaatcataactcatgacagcctcaaactcctgggcttctgcgatcctcctgcctcaacctcctgagtagttggaactacaggtgtgctctaccatgcctgccatatttttttttgagagggggtctcactatgttgcccaggctggtctcaagcttctggcttaaagtgatcatccagccttggcctccccaaatgctggcattacaggtgtgcaccaccacgcccagacccctctcccttttctgtagcacaccccaccctcaccccatgcacttttgcatgattatcaatatgggttgaaccacatgaaattgccaattttgtagatcaaacatgatagaatattagcaaatagaatcatgagattgaacatatccttttaataacactaacgtattcagtattttatcaagcatataatttaaagttgtattactagttataaatttaatatttacctctttcaagcccaagcacaaaatatttggtttgtttaaactacatcatgtaggatgaaattaatacctcaagtgggattctcaacacactaactagaaacagctctcagagaagataattcaaagacgaatttaaaatcaatcccacagcaagtaaaaccaacttttttaccaagtagttcagtcacatgggagcagcggaatcagtgtgacattttcttttcacgggatatgtgcaaccatgctgtttaaaagggaagaaataagataagctgattttatttccaccagtgaaaaaagttttcaatacagcagctttcatcgactcagcatggctaacaaaataacattatcaatgaaaataaaataatagatcagctgcacaatctaggcatttttgtttttagaggccttctctaacatttctctgtagagatctgtgaatgcctggttcctgtgaatgaaaaccaccctgctgttttttctgctcctgctgagagacttgcaaagaataaaatctttttttttttccagctggagatcaattggtttgaggactgctctggcccccaggaagtattctttgcccccatggggggaagagatcctcagttccccaccctgaccagagtttgcccccattggatagttttcaaagctgaatccagaaacagacctaaaagcatatccaaaaaatgtgccactgaaaaacagctaacgattcacatggaaagtccacaccctccatctagccgggtctcctcctgcctcccttggggaagaagggggagaatgccctttccaatttcgctcgactgaaagcaagggctgtgtctgtcccccttgctgaaaagcctccttttgtttttcttttctactgtcaggaagcctgcctcagaggagtggacaatgcataccaatgaggaaaggagagcagaggtgattgaaagtgaagataatttttccctgtcatttacaggctgcttctcaaaccatgccccttttgtgattccacttcaaaacacattcttgccaactctcatccaggaggcttttccttagtgatctgctccactatcttggagtttggcttctgttatcacctgaggagctgaaaagcgttcagattcaaggaagcctctcctctgcccaaatcagcagaatttaaggctcatgaggatgaggactgtgacagggaagaaggaggtgacagggaaaggaaatgatactttagcttatttcattgttgaatggagcaaagttgaaaatgattcttctggtgtctctccttaaatcttggggtattgatacagactcatacaaaaatgaaaaggagagaaatgaacatattcatatagtcctttggggtttcacagtgatctacctacagcgacatgttattttaaattacaataatctatttaaagagaaatatggtggaatttacttttaaaaaggttacgttgcagggatgttttaaaagataaaaattaaatggcaactcaaaaaatatctgtcaggcatttaaaaatggatttcaagacaagcatttgaatcctactttacaagaagtgactaggttaattaggaaaataaggtatcttctgataacagtaaaccttgagatacatgtgtagctcttataccggaatgaccatgaatcactaacaaatttactttctagacaaaagatggaccacttagacagcacagtataagaaacaaggaatgttaaatgaagcttaacatcatgtaacagatgttaggttttctcctctcccccaaggaggactgtaatactgttggagatgacacttgtcaactgtgcaatgtgtgtgataaattacagaagcaaaaacataatattattatttaataatccattttaaatatcactgtcatttaaataccacctgtaagaaaagttgtataaatttggcaatgaaaaatacacaatccagaaaaaattacaattaaggatcaggtttttctttgaatatagttataatttttaaaaatcccttatcacttttattaactataattattaggagactggagacaaatataaccattgaagcaaactgagtacctttcaagggccaccgtctttttcctctaacctcctcaggctcacatccccacctcaccccaccacatttaaattactttaaaaacactaaaaaatgtttcctatattagaaatttgaatctatcaaccctgatacttctttagatcctggaactccctttgctttaaacacaatgtccaactattgagaaagaaatttcccataaagaaaaccatagtatttctttggtcacagctgagaggcatttttttttttctgatctggaaaacaacaatcacagaaagcaggttgtttgcaaaatgagatcttaatttacttaaaaacagaatagtaagatgaacctactaaaagtaacaccatagcactgctacaaatgatttacagttgttcacattactgccataatattggaacgataaatgacatgccaaggggctcaaagtaaatttctggagttgaactgcacaaagcaaattgctgagtttgtgtcatatcctaccgtgaggatggcatatctagagcaaggctcaatctagaaggtgtctggactgaggattctagggtacgatgaataacaaatggaacaaagatgtcacccacaggaagtggggactacgggactcactgtggacacctaagccaccgcctccctatgcgatgaaaatctgttcttcatagcaatccagtatacattcaaacaagcagaagaacaacacggggtaagggctacttaactaacttatattatcctattttccatggaattccagcaatcataagaaaaagttccatcttcttggttttgaatgttttaaattaaaagaatttcccttcccaacactacaaatatgtacaatgacacattaaatacaactgtgctttctaaaacctgatacttgacagagagctcttcttcaaagctcaactgcaagttaaattttactgcttatcttttgtttatcaccaacaagaaaaaaattgagcttgagaactgtaagcttataactgggtaaattatgttttgtataagaaatacaagtatccatatttggattacttttgtatagatgggatatacaaaggtgccgacattacaggactgaaaaaaagagccaacttgttttgcattaaaacatttttttaaactttcaaaacaataagagactagtggtctcttaaacacagtttaatgaatttatctctggcaatgtattgtgatatgtttgtgtgataaacctgataccatgaaaacatgaaaataatttctggaatgtttcatttcttaagcaaaaatttcttaaatatgaaaattgggggcttcttctgtgcagtaataggtaagaccagtctggtctgaagcccatatcaaatatttcaacatttcatgcctatataattggctttaaaagactaaaaactctctgtacagtctgttttttttattgttgtttttctcagtccttaatatcctggagtcagaacaaatgaagaagccccatcagcttcagaccacgacacacagcttgcaagagtaaatgatttatggagctacaagcatgagttatgagggagcggtctacatatttgcgttgtgtagctatgcagggggaaagagacaaatgagattcttgaaacatttgtgaaatatagaaaggaagaaaatagaaaaaagttaataagctgcctcagatagtaactaattagatagcaaggtattactgacaaaatgaaacaagaacaaaaggcaacaaaagttggtttagggccaaacattatctgtattttcacttttggatctctactcatttcctttttttccatttcattcaaaaaactattgtgcaaatcaccattctattgtcttctaacattgccgctattttcactggattttattcaatttaggaattaaattaaaagtttcaacatttccagtcatgttattctttcatgttttttgccttaaggagtagaccatagacatcacctattttaatagtttcatctagtccagaatcggcacttggagcttcaagctgggggttagggagaaagcacagacacaggcaggctgctatgctgggccctaagggcaatgtcaaactcaagattgcagatacaggctgggcgcggtggctcacgcctgtagtcccagcactttgggaggctgaggcaggtggatcacttgaggtcaagaattcaagaccagcctggccaacatggggaaatcctgtctctactaaaaatacaaaaaatcagccaggtgtagtggcaggcacctataatgccagctactcgggaggctgaagcaggagaattgcccgaacctgggaggtggagactgcagtgagctgaaatcatgccactgcactccagcctgggccacagggtgagactctgtctcaacaataacaacaaaaaagatttcagatacagagctgttggctttaggaaatgcacagaacttactgctccataatacaaacaaaactttaaaagggtgatgactgattccagattactcttgcttttatcttaagctaatctctgtgttaggtaaggacaagcaggtttgaacggctgttaggacaaggcatcattgtctacaggtgttatgatgaccatgaagattagaaagtagtgaatctgccgggcgtggtggctcacacctgtaatcccagcactttgggaggccaaggcggctggatcacgaggtcaggagatcaagaccatcctggctaacatggtgaaacccctatctctactaaaatacaaaaaaaaaattagccgcgcatggttggtggtgcctgtagtcccagctactcgggaggctgaagcaggagaatggcataagcccaggaggcggaggttgcagtgaaccaagatcgcaccactgcactccagcctggtcaactgagcaagactccgtctcaaaaaaaaaaaaaaaaagtgaatctttgaagttttaaaataatgctatctatggatagaataaaataatcagaatggaaagtgtaaagatgacatatatatagtgagcattcttaaaactgattatcattgatgtccatctattaattaggctgccttacaaaggaacggattttctatcactggaggcactgtatatttttataacttgttcccaaacttatgattttacagaccagtaaaatttctgttcttttatttaagaaaattaagatatctgatgctaaggaacagttaaaattttcactgatttctgagagatggcaaaatgctagtaaacaacacctcttcaaaaacaataggattctacttccttcacttctgaatgtttctgaaatcgaagatgcggcagaaccatcaattccaggttcaccttgccggcaaccctgcgtaatagacttagcgtagctacaattggttgtgcctacgcaaaaatagccaactggggaaagttatttggactggtaacactagaaactatttaaattttaacacgagtgtcacaccactttgtttaaatgtgttcaaacagaagacacaatgtggcaccgaaatgcagcaattgtgtggaggcaatcaagtatcacagggcagataatgaattcaataaaggcagctgaaattgccaaatcttcaaaaggtagaaacagatcgtgtgaagagtatcactcatgtatctaaatatctttatggtgaaagcttcctactttaagagtagctgttcaacacttagtgatatgtgattaagaggtaattaagaagttaagaaggccaggctcatggctcacacctgtaatcccagcactttgggagggtgaagcgggtaggtcacaaggtcaacagatcatgaccatcctggccaacatgatgaaacccgtctgtactaaaaatacaaaaattagctggacctggtgacacccatctgtagtcccagctacttgggaggctgaggcaagggaatcgcttgaacccgggaggcagaggatgcagtgagcccaaattgcgccactgcactccagcctggtgacagagtgagactgtctcaaaaaaagttaagacaacctcaaatttaaataaagaaatgtatttttagaatatattattcagactattctgactaatgggagatcttcataggtaatactcagcaacactcgttaataggcatctctccatttgaaagactgcaaaacgctgaattctgttgtttagtgcactgaattttaatcatttaaaaattgtgatgtctttaaatcaggcatgccatctccagttctcagtggctccactactttccaatatttgacctccagtatcatgctttaaaataccggcctggcacttgtggacatttgtgctaatggcccttggtttccatttataccactgccataacaatgacaaaattgtcgagggtgagtatttgtttgcacattctgtcctattttcctaaataatatattttttaaatcctcatttaagtgctttccatattttcccaccatttgaatcccccagaccccacctctacctggtgacattcaagataatcgtagcagagcagctttagctgtcaagaagtctgtcctttgctaagaggtggtaaggatggttaattattctgatcaagtctattcggtctgtgccaagaagaaaactatgtttctggaggtaggatggaagcaaagtcactagatttccttccttctccttttcatattccttacaagttgctgagtaagtatattttatttggaagcattttgataaattcaattaaacctgctgccaggctgtaagaatttttctgtgtgtagtttgtgggcagaacatcatcaatcagttttctccaccatttttggtttctagactattcctgtagttaaataaaaagtatatttactatattctcaaattattttctttctgctctttttcttaataacttacctacttactgacacgtgattggggacagacaatattttacatttctacaaagcattttatctcatttttctatttctaaaatgaaaatttgagtaaagatgtacatccttaaattctgtacacagaaaatatactaaaatgaatcaacttaataatcaattaaagaaattttttatttaaaaatggataagaatgtgtttgaaatatatggttcagtcttaaactaaacacaaagcagttctcctaactaaacagctgttttaaatctatagctcttctgctccagcatcctaacagctggaggaaattagagtccagagagacatgtgcataatttgaattaaacagatgcgggctgtgaagacaatcaaacaacacagggtaagagatgcaaacaatattactgaaactccaaggagtttttattttttattttcataatgatggcaaatgtggccatagttgtgatacaaactacctacccatcctagtaaaaagtcgtgactttttttcaaaagtgcaaaaggaaacatgccaaattctaaatcaaagccaggacagggccatctctgtatttttccatttatagcactcttgatgccacgcgttgactgtgagctaggggtcgctgcctttcctgcccccggcagccgggcatcccctgaggggatctgcatcctgcaaaacatgccaggccactcacaccatcacatgctggcagctgtgggggcagaagactgaggaagagtgagagatgaccagaagctgaagggagacatatgtaaagtagaaaaggagtaacttaaatgtcattttctgattcaaaatatgagtgacctgctttaatgagcaaaaccctgcatttaaagccacaagtagttcaagcactgagggccagatggtaccctttgaaattaaagcgctctcaaatggaacatagcagggaacctccctgtgcccgactgtgtaacaacacttctcccagataatgtccgttaacgtttatggctttcggtttctagctcagttcatgaacgtgtttacgggtcttctgttgagaaatcaagagttagtgtccacgtggcaggttttccaagacctaagtgtgaacgtgatcatcacatttcttccacctcttcaccttcatagtagacttttcaatactccatgaactcttgattactgatatgaagcacaataaatatagacaagcatttggaaaacagcctgagggttctgtaaatagctaaacattttaccacatgacccggcaattctactctaggtatacgcccaagagcagtaaaaacataggcctatacaaaagcctgcacacaaatattcatggtagcatcattcacgatactcaacaagtagaaacaacccaaatgtccatcaactcattagtggataaataaaatatggtacatacatacaatggaatattatttggcaataaaaatgaagtgcagattcatgctatgacatagatgaaacttgaaaacattgtactaagtgaaagaaggcaatcacaaaaagatatatattgtgtaattccatttatatgaaatgtccacaatagacaaatccacagaaagtaaattaatggttgccaggaactgagaaaagggaatgactgctactgagtatgaggttttcttttggggttgatgaaagtgttctgaaattgattgtggtggtggagtgaaaacgctcccaagatactaaaaaccatagaatggtatgcttaaatgggtgaagtgcatagcatgtggactgcatatcaacaaagttgaggccagcactcaaagagattgcagaacaagaattggagtgttcctggagcttcagatgtaggctccacgaaaaagtgatgaagagagagggacagacagtgtgtgtgtgtgtgtgtgtgtgtgtgtgtgtgtgtatgcgtgtgtgttgaggggggggatggctggaacctgtggaaaacacccattaggagggcagatggacccagtggctgatggtgtgcacggttcctgcacactcatgaaggaatccaagcacacccagggcactcctgcctgcaccaggggagctgcagggagggctcctgtcagcagaccactgcagcccccaaaagccccttctcaggaggaggggagggagaagccagctagaatcatctgcgagggtgtggggcaccaggacaaggacccaccctgtacccagtcccaccccccaaccctggaggtgtcacaaactgggaagcaggcacaagggaacatacaggtaggcaaggcaaagaaccagagacaaagcccattccttccttaggctccaggaaaagcaggtgcaagcaggggcggcaggggtgggaggggtgttggtaagaagatccaacatcaaattaacttcgacgttcgtattattgtcttggcttggatgttctaattacatccttaagactatgtctgtgacttctagtacctgtaaggaagtttgttaaagagtgaataaaaatgtcaggggaccttctgatttcccatccagggacagggaaaaattgctcttcctcaacaaaaggctggtgagagatgaaaatagttttgttttgattatattgcaaagtgttcaactttattataagatgtgtgattaataataatagctaaaatcaactgagcttaagaagacgtttacatgcatgtggtcagtcctcacaaaaacactatgaggtgtataaataaataaatgtacaagaataagacatttactattctcattgctcagatgaagaaactgaggcacactaaggttgagccagcaggtgcagggtcaacaagctggaacccaggaagttggttctgcagcccagtcctagccctggaactccacagtgcccacaacgctcccaagtgaaatatatgatggagcatctatgggaggtgaggttagggggattttactttttgaaaaatgctttttggtatttgaaatattctcatataaacatccatgacctataatgacagagagagagagacagacacagagatagagacagagccagagacagggacagggacagggacagggacagagaaagagaaagagagagagagaaccattttagaaagttgctggaccagggaatattttgcacaacatgaaatgattacttactatcctccctcctgatttgggaaaattttagaaaattacagtggaaagcagcagcccccaacctttttggcatcagggactggtttcgtgggagacagtttctccacagactggagcagggagatggtttcaggatgattcaagcgcattacatttattgtgcaccttatttctattatttgtactttgtaatatataatggaataattatacagctcaccataatgtagagtcagtgggagctgtgagcttgttttcctgcaactagatggtctcattgggagtgatgggcaacagtgacagatcatcaggcattagattctcataaggagcgtgcaacctagattcttcacatgtacatttcacaatggcggggaggggggactcctggtgtaaagcattatgtttaaaataccatagcctgagatcaaaattttaggcacaaatttaatcacattgaatcctttgtcttctattagttaaaaggttgtcctgctgccatcttggaatgagtgcaagttggaaaatctagatccgagggtttcacatctgagcatgcataacagtgccctggagagctgctaacagtgcagattgcctgcatccagccagcagagtcagggagatttcaggggagcccctgcccagtggaactcttaaaactgcatttataacaaccttcccatctcctttctaggagattcggatacagacagcccatggcaaatgttctgaggagtaatatggtattatttttaaaagctaacacccataaatactacattaaattaaaattcagggatgaatgaaggacttgtagctatgactctgtagctcagagacataaaaagtgtaagaagcaaaattattactcactaagagataagcaggaaaaagatggggacacttacagttttaacggcttacctcttttgtagagccagaaaagtcagcagcggttggaactctggtaacaatacagttttggtcttctacttatgtactctcttctctattactaaattttaaaaaccagaacagcaaacctaaatcaagcgatacagtcgagctcaaagaaagactgagctcaaatgccttacgtctgccccaagagaagctagcattgaactcacacatcctccctgtgagcacaggcttgccagccacagctcaccaccgctttcttatgacccaaactcatgtccagagatctctgattctccttaacagaactccaggtaatcattaataattgagaggaaacaggcttacttggaaatcttattatgcacgatgtttatcaataaccctccatcaggaaggaagcaacaggcagcacctgcgtggctgttttgtgccaggcactctctggatacttgcctaacattattaccctcacagcgccctgaagatcagatgttatcctgatttttattatccctgtcttctcaagtaaagaatctaggctgttaagaacaataactaatttacctgccatcccatgagacacagttgatggagctaagacccagggtggttccttgtgactttcaactttccctttgatattttggcctctcttaatttagctacatgaaatgttaacctattatgtactcttagttcaattttttggtttatttgtaatcagaaatgatacaatatggcaccttctcaatgagtccatcaattcatatcattgtctattaactcaggatggctagctactcattaacaaatgtctaccaaattcctccatggccttgctagatagtataaataaacaggagaagaacaacgcattacaggaaaacagcaacagtctactgcaaacaaggagaatcaagtaagtaaggcaaagacactaaaggactcaggaacatcattacataatgttgaccagtaactattaatataatgcaatataaaataggaatgcaaaggtattgactgaaggagctacaaaattaagagatattctactaaactattaaagtatgtattctatttataaaataaaaataatttatctaaataagttaaataggaagtaatatctaatttcagcaaggaaagcttatcttcaagtttagatgaagtccttaattacaagtaactatcacatatggctgctctgggacccacaatttgagctgagcagcagatcatggtttgccactgggaattctttagtcttgtccaggaaagattcttagaatctgcataatggaaacagttactaagacaccatgtatgtatgctttacttgctaacttcaaagagttctagagttctgttttcatattttctgagttattttgttttagcatgaaagtatatttagaaagaagggctacttaataatatttctttaatcaaattcttcatataaaaacttctggtccaaataccatttctgctagaaaaatttacctgcccctagtatacaacagtaacattgctgtcaagccagtgatgcatcattgatagaaatgcattggccacagcatgaaacagtatcacatggtagtttttatgccactgcacatgagctgacagccttacttgggtcttgcatgtagagctctcacagggcagggaaggtccagaatacagcaggtttgactgcacatcccaatattagtggtacttttaaaaaatgactttgggtcacagagttctttacgagtaagaactggggataattgagagggctcaggtatctgctacttttaaaaatggcttataggacattaagagtcataagaaggaggctgggtgcagtggctcacgcctgtaataatagcactctgggaggctgaggcgggcggattgcctgagctcaggagttcgagaccagcccaggcaacatggtgaaaccctgtctctactaaaatacaaaaaaattagctggacatgatggcgtgcaccagtagtcccagctacttgggaggctgaggcaagaaaatttcttgaacccgggaggcagaggttgcagtgagccgagatcgcgccactgcgctccagcctgggcgacagagcaagactccatctccaagagaccaaaaaaaaaaaaaaaaaaaaaaagcatcataagaaggaaagtaaaaatgattattcttctagtcgctttctggattctttgcctttcattgcttctatagtacatattaatattacaaagaaatctgaattggaatagacaatcatttcccttacatataaaaatgtaactgaataaagacattaccctaaccatcctggggttacattcctagatactcttggattccatctacaccttctcaactaagcacttacagatgtctggctttatatatgtacacatcagtaactagaactaagtgttgaggtaatgaacaacaaggagatgacagagtgactaactctggccatgatgaaaatggcagatctaagatggaaattatactaggaaattccccaatcctagaaatacagttggccttcctccctcccttccaccttccctccttccttcccttttcctctttcattttttatttcctttgtaagacatctagacaaagtttaggtgctatataactcagggacaatcttcagcttcattgtgtgagattttattcatgattgccttatcacacacaatgacagggagtaggagaaacctcatttgagtatataatctgctgagtgtgatgcaaatgtcagtatctgtggtatctttgcagttacaacccactggtttcctctattctcttaccacttagaggtgaatttctaattctaggaactggtcgtcatcagaaattgatgaagacttcaagacgttaaatcaattcagccactgctacatggtaccttatagaagagaccattaattatactaaataatgtctattcatttattcaacaaatatttatccagtgcctacccactggataaaaataaccaccctgagtgtttagatgaatgcctaatgacaagggtgatgcttatgccattctaaaagtgatgaattgaactgaacatttatttccacacaaaaacctacacacagatgtttatagtagctttgttcataattgccaaagtttggaagcaaccagcgtgtcctcatagggtgaacagataaataaactgtggtacattccattcagacaaggaaacgccattcaatgcaaaaaaagatatatgtgaccaagccatgaaaggtacaaaagaaacttaaatgaagattatcaagtgaaagaaggcgatatgaagaggcgactttatgattctatctataggacatcctggaaaaggcacagctataaaaagggtaaacagatcagcggttgctcagggtagagggaagaaatgggtgatgaggtagagcacagaaaatctctaaagcagtgaaaagactgcacaatcctacagtgttggatccatgtcactaaacatttgtccaggccctagaatgtacaacaccaagagtgaaccctaatgtagaggactggctctgagtgacaatgatgtgtcaatgaccagttgtaagaaacgtaccactgggggtgtgccgggcgtggtggctcacgcttgtaatcccagcactttgggaggccgaggcaggtggatcactaagtcaggagttcaagaccagcctggccaagatggtgaaatcccgtctctactaaaaatacaaaaaaattagccgggtgtggtcatgggggcctgtaatcccagttactcaggaggctgaggcagagaattgcttgaacccgggaggtggaggttgcagtgagccgagatcacgccactgtatcccagcctgggtgacagagcaagactctgtctcaaagaaaaaaaaaaaaaagaaaagaaaagaaatgtaccactggcggatgggggtgggaatgttgatagtggggaggttgtgtgtaagtaagggaatgaggttgagaattttccacaatttccacacaattttgctgtgaacccagaactgctgctctaaaaaacaagtttcattaattaaaaatcaaattgctgctttcaaggttcatggttcacagccacataggagatgggtgtcttagcctcatgtaaggtggagaattagaactaaaatccttatgtagaatggagtcctagaaaaccaatgactttcgttaaaggattgactagaaaaaaaaaaaatctacccatcagaacaggtagaagaaaacttattgacctgatactagaccttacatttgatggtttgtaatcagagatctgctcttccttcgacaaaaggtttaaccttatactatttatatagtccatttttcacaacgctgaaaaataaacataaaaaagtagttacacactgcatgccagagacaagcttaaaactatggtgaagagacacactgccagcctgccacgaagcagccccacaaagcccaagaactcacattctaacacagaaaccttgtgaaaatataatcttccaagggagagaagcaatacacccagtcaccatcaggattagttacctaagaaccacagacacagaattttgtacagatatcattaaattactatttttcaaatgattaaagacttaatggaagaacattgaaatataaaacaagagcaggattccatcagaaaaggcagtgacattggaaaaagaatcacatagaaaacccatcaatgaaatatccattctttgaatgccactgggaatgcaaaatggcccaaaaatggtacaactatgaatatacaactaagggcaaaagaaaggtatgattaaattacctggaatgcagcacaaagagataaagtgatgaagaacttagagaggaagtgagaggtactgaaaaaggaataaaaagtccaacatataatgaacttatattctagaattagaggaaaatgcaaaaggaagagaagcaatatttgatgacactggtgtatatttttctagaaccgatacgaatgttctcatacaggaatcacagtgaatacggaaagaaagccaaagctgaacgcatggatgtgatagcgactaaccacaaagatttgaaatgatttctaaagctgcaagagagaaacagattacctccaaaaatactgcaagtagactcatagcatacttaccagtagcaaagataaaagctatacgctatgtcttcaaaggactgcaaaagaataatctcaatatagaattatctttcctgtaattcagaaaataagacaagttattcctaaagaacaacaaggtgggtgatgtgaaatgccttgtcagataccgcaaattataataaaactatagtaatataacaacgtagtattggtgcagggaaagacaaatagacaaacagaacagagtagacggttcaaaatagatccaggtatacatagaaactatatatatgtcaaaggtgtccttatgaggcatgactgttcaatcatgggaatacacaacaggtgatccctgtgaagaaaataaaataaaactggatcttgcgtggacagcacatgtacacaaagataaagtccagttgttaaagacctatatttaaaaactaattttcttttttctgagacaaggtctggctctgtcacccacgctgtaatgcagtggcacaatctcggctcactacaacctctgcctcctgggctcaagccatcctcccacctcatccccaagtggctgggactacaggtgcaccagcttgcctggctaattttcatatttttttgtagagacgggtttcaccatgttgcccaggctggtgttaaactcctgagctcaagggatccgcccacctgggcctcccaaagtgctgggattacaggcatgagccaccatacccagccaaaaaccaaaactttaaaatgtatacaaaaatattctttaaaaatattcaaggccacaacatatgaaaactttcacattagacacagaagatacaaatcataaacaaagatgaagtaagttttccacattaatgtgggaaatcttatacatccaataacagcatcaaagttaaggagacaaaccagaggttgacaggttatttgtttcctacgttagccccaaaatactaatatacattgtgcattaaaataattcacattttaaaaccatcacaggcccatgagaaagtttggccaaagtatactaaatgctcagaagacaaaatgcaaatgaatagtaaatgtgaaaagatgcttaattgagaagtaattagagaaatgcaagttaaatctacaatgacagaaaagtttacaccagtcaggctcaaaatttaaaagtctgaaaatattaaacgttggcgaggatgtgaataattgggagttaaattgttatgatcacctagcagagcaattatttagtatctattaatagtaaagctgaagttattggtgcacaaataccacacccaggaattggtctagagaaagtcttatacctgtgcacaagacttgtataagaatgttcagtgcagcactatttgtgaagcaaaaaaattagaaacaccttaaattcccaatagcatgagaataaatccattgtgatgtcacacatggtatgctattcattagtgaacacaggtgacctactgctatatccactaacacgcattaatctcaaaatatgattgaacaaatatgttcagttgcatacaataggtaacatcatatcatttatttaaagtttaaaagcatgcaaattagcagtattccatattacttataggctggtaaataaatgtttttttttctttttttttttgatggagtctcgctctgtcgcccaggctggactgcagtggcgcaatctcggctcactgcaagctccacttcgcgggttcacaccattctcctgcctcagcctcccgggtagctgggactacaggcgccccagaccacgcccagctaatgttttgcattttttttagttgagacggggtaataaatgtattttttaaagtataaaaacatagttgataatgacaaatcccaagttcaggataatagttacctctgtagagaaggaagaaatggaacacaatcagagagcagtacatccatcgcttcagttttagttgtaatatttttcttaagttgaatggtgggcccactagtatttgtcatataattcccatattgttttccatccctggggttttgcaataacaattacaaatatgtatctccctacaaagtttatacaatggtttatatataattcattcatctttgacttgtaatggaaatctgacttgcacaggaagtcaagattgctaatgtcagacttgcaaaagaacaagcatgctaatcaaattcaaagtcactaatgtaatttccatgtatttctattatagttctcgatttagattctacatctaacctcatcttgactgagaatgtatgtatagattctcaaataagctttatctgaagaatgtcttactatatattatttggtagcactaggtatcaaacactgaggctcaaatttatatttctgttctgttctaacctcaacaacagacagataaacaaacttcctactggagatcgccacctaaaatttatttgaaaccttaaacctctcaaataaagtttatttgaactgcccctcccacaataacccattcctctttttcttccactctcctctgtgcctggtggcatcaacatctaacatgagttctatatctcacatagccaagtatcaatgtgtcatacttcaattttctctttcccttgcatctcacaatgcgtacatctgctagtcccattgacacaacctctaaaacatcacaaagctacatgtgtccctccattacaacgtctagtaccctagcgaagccccatgctccgtcccccaaacacctagactagcctcccaattagcctccttgcttccaccaacttccagccacacttacctcccttatggccttggcatgtgcttacctaatgcccactctaggtcctttgctccctctctctggaatgattttctgcagatattcccagggctggctcctttagctttcagctcaaacttcaccttccaagagaagcttttcctaaatttccaatataaggtagtgtcaccagtcctcagcctattttaattctttccaagcacttatcactaactgaaatttaccatttttattgctttacttgctttaaacctgaagattgtatttggttgcatgtaccggaatactgactacagaagtataaccaattggggtttatttttcgcatgttacaagaagtctaaacaaaagccatctagaactggctgggggctccctgatgccctcagcaacccaagtttcttctatccttctgccctgtccttttagcacgtggcttttatcttcatggcactctgactaaaagcattaataaccttcttgcacatggaatgcaggctccacaagaaaagggaccttgtctgtcttacccatcaccggaagaatgacaggtgctgtgttaacagcttgatcagctagagcagtgaaagaggaactcaagagtcctcaacctcagcatcattcctgcatcctgggagtcctgcaccacagcctccattcattggccctggagattctacccggatttctcttctcatgaagccctggccttcatggccttctttattggccctgccttagtccagggcttagtctcacgctacagtctcctaagtggcccgccacctgccccatttcgcctgccaccctgtcacacccacgacacaaactgatcatattcatctctagaactcttatgttttcttaaagtctgcactcaaatagaaagctccacaaaagtggggacgcaccggtcctgcttaccactgctctccaggcctaggaaccaggagtgcttgctgtggaggagacacttggcaagtatttattaacagaatccaaggaagcatctaaattcccgaagattatgtgcaaagcccctctgcgtttgacccggctcatcctcttcccggtatcaccttcctcattctcacttttgccatttgtttagtcacagcaaataattgtaattctaaagtagtgccagacctttgcatcttttattttataatatctgcataaaatattccttccttttaaaatcagaaatcttctgttcatcacttaattcccagcttatgattctcctcagcttagaggccttactgactcagcctaggggagcagacagtgcctcctggatgcagcactttgatgatgatgacgatgacgacgacgacgacgatgatgatgatgatgttaaaatcacaatgccagcaactgacatcatggggtgttacaacgtacaaggcactcttgtaagtatttctgtttggtgactcatttaacccttgtagcaaccccatgaggtagataacacaatttttctcattttaggagaggaactgaggcacagagacattaactaatgcaccaaaggtcaaaatggcataagctacattccaacccatgtggcccacctcctaatccatgcactatgacttgtggacatatttgtacactgtgacctgaaagattgttgggagcagggctcataccttatgatacataatgggtgcccaataaaagaccgttgagtgaacagattttaaaacaatcagttgtataaatacagaatggggaaactggcttacatatatatatatatatcttgtaaaaacagagttggggtttaaatggactgtatggctctctaagtcatatcattgatcctaaaaataaattacaggccacattaataggcagattataccaaggggcatgtagtaactccagcatagatcaggccactttgagaatctagtacagtcctctctctttagaaaagaccaaatggagttcgtccaaagtaggtaaaacatatggctgctaaaataggaagagaaataactgaagggcatatggattatcgtcaagtatctgagaaagtgttatgtacaaaaatttcttctgatttaaaagggcagaacaaatctaagggtggaagaacaatgtgctcagataaggaagcaaattccagttgtgtgtgctgggcccactcaggctgcctcctaagaatggacagggaacacctcttcccaacgccgccttcagtgttattatgttggtcccttaaaaaaaacagggctggcaggttttgcagggaaactccaaagtgacaatcagagctttgtatttatagagagtcagtttacctgcttatcactgcatttatcccatttagttgctaaaaaaaaaaagaaaaaaatggacttggttgccttgtggagaatggatagtagttgagccttgtggtgaatggatagtaattgagaatgcggcagagagagatgacttcgtaaccaacagatacatatcatcaatgcgcacagaaacttaaggaggggccaatgtgatacgcgaactgttgtcagtcctttacatttagttatttttaaatttatttttcaggaagtatctataaaaacactatatgtaaaactatttataggtcaggaggctgaggcaggagaattgcttgaactgagacccaggaggcagaggttgcagtgagccaagatcgcgccactgcactccagcctgggctacagagcaagactctgtctcaaaaaaaacaaaacaaaacaaaaacaaaactatttataggttaaacactctttataagtaaaactcatttatttaaagaaacagactgatatttttatagttctctcatcaatctcttctattaaaaacaaacaaaatactaaaagaaaactgccaatcattttgaataagagatggtccactacattcctccaccagaggcaagaattaaaaatttaccaagtcaagcaggaaaccctaaaagattatcaacaaatgtattatatttttcaaattcgtaatgcaaaatctataggtatgttttctaatcagtccaagactccaaagtaattagtgaatttattgccattttcaaaaagtaataccccttgatatttaagtttcaatagtatggttttaataaactgaaatgaatcattagaagaatttcccccctttatcataactgattaagtctattttaaagcttatatgccctcttcagggaaatctttaaaaatttccaattgtttatatcagtgaacagggctgaataaccaatgtataattggttaaatcagatacattatttccccctcaaaacaatgccattgagttgaaggcaaaggatagaaatgaactcaccagctatatacaatattatatgacataagcaatattaaagattggtatataagaaaccaagcttggctgggcgccgtggctcatgcctgtaatctcagcactttgggaggccgaggcagacggatcatgaggtcaggagttcaaaaccatcctggccaacatggtaacactccaactctattaaaaatacaaaaattagctgggtgtgttggcacgcagctgtaatcccagctactagcagggctgaggcaggagaatcgcttgaatccaagaggtggagactgcagtgagctgagttcacaccactgcaccccaacctggcaacaaagcgagacaccgtctaaaacaaacaaacaaacaaacaaacagaaaccgacctttaaaataaatacaaacacaaaaagattagtatgtatttaatctgcaaggctaaagccacacaactggatttcagtgtactacaaaatgacagatcatataaattcaaaatcttcattctgcttatcaattacagaggcaaaaatataactatttaagtgggtcttagaatgtattttctcttcagagtgcttcctgatcctcttgccctctattttacattcaagcgactcatgaattcttaggagaaatctgaaattacttcatgccccttgttaaacagattttgaatggtaagtactcctgcaaaattgctcccccaaataaaatttcacatacagatacattcagtgcattaaaaaagtaaactccattagaatagaatatagtattttcttaagataactgtttagacttaactcaaaggagttcccacaaatatattctgttctcagttagttcaagtgtggaataggcaatttggcatggggtaaatctgtccccttttgcaatgttttaaaacagaataaatcgtgggatgaatttactgcgcattacaaataaaatgtttatattttctttgtgaattattcatcaaattaaactaataacatgttaaaatttgcttatgtgtcagtcctttgtaggtaaaatttcatataacactcaaaacaaacatataaaatataggcattattactatctacacttcatatagatcagaaaaataaagactggagagcttaaatgacttgtccttcccagagagtctgactttagagtgattcatatctactgtacttcattataacagtgtatttgaaagtctagttgaactcttaagtgatttcatctagtgtatgacattcttgaagttttgacttctcatttatatatagcaataagcacatgtgtaggatggcatcataaaactcccttggaatgaaaaaaacatataaaaagttttaggctcctacaagaacagcatgtatctcaatgttcctcaaaatgagaattgactccaaggtacaaaacaggtaaactgaggaagcagatgttaattaaccactttagcaggttctgaagttcttagtgtccaaggtttaaataacactagaactatcttaaacaaatgtttgtgtttatttcctgttttctgaacaatgtttttgatgaattacgcatagatggaatgcaaacacacagacccaattccctttgaaatatgtaagcctataaaaatgagcagaaaatatccttggcaaaacctgcactgagctttcaaaagcccacatatttgaaattgagtttgtgatgtactcaaaacacaaacatcagtgggttctcgcattcctcatttctccctctaatgtcagaatattctattaatttaaaaagcagagttctgtgccataattagtctacatattaaatcttatctgagtgacacctctgaatgcaaagtatccagaacaaataataagacaagaaacattccatgcaaaataaaattcaatgacagaataaaatcttcaatccaatgcagtttacacaagtacacccacaaaaattataatttttcccaggaaatgcattccccaaatgaatgtatgcttctctgtgtgaagacatatatgtacaaaaggctaaaacattttttaaaaatccaaaaacaattgatactagaacactatactgacaccaactttataaatcatgggcttgcccaacaattcagtaaatacttgatgttctgcctccattcaaatgagtctgtgcatcctctgatttagcacatggccaaagaaagatctttcagcccatccttctgtgctttacaaaggctactatggcaatcttcacttgtccaatgtgaatttcagttaatttaacttctgctgctaaattgtttatgataattttatttttatcaatattaaacctaatatttgaaaaaaaaagttaacacaacatattaggccagactctcccattcccatttaattgtgttttctgtgtcttatgggcatcactaaagttatactttaacataaactattataacataaaggatcacatcccacacatttaacttcatctgccatttaacttatatctaaggaagatcaatgctggaataaatatttactaatggtaacttattaattaaagctatgacccaagcccatatataaatagaaaatgaaggagcacacatactcccatatgtattcatcataagtgagtttggtatataagcttcaaagaagtttctcatatacaatcttattgttccttgacagtcatctcaggcttgttacaatgacttagtaaaaagggaaaaaagtaaagatggaatttcagtgaatcatctttgggttcagagcttttgggtgtatagacacaacctctcatttcttaaattcttccctaaaggatgatgactgtattaagcaaaatctcagataacatcaggtcaattggatgatggaatcttagtccaataatggagacaacagaatatctgaaactaggacttcagtgaacagtaacacagtttcagtatggcatctcttctctgtcatttatcaggtttcctgtaccctaataagatgcatcctatgttaagagtttggagattggattgctgcagagtttcaccctctcacacattgcttgccttggaatgtgagtgtaatcacaatggaaacatctatgagatgagagcctattaaatgaatccacagactatatatcttcagcatcttataagctataagaatcttagctttttttttttcttcaagtctatgcttattgatggcaatcctcagagatgttttgtaagtccacatgggcacagaaatgtcaaggcttcctttcaaagaaaaataacatttctgagagttctgaattatgcaaagaggtaagtcattcagggatactttctgacatgtagaggcaaccagacacaaatagatgaaataacggtcttcccaaagtgagcatttgccctgtacagatgatcattctttgattctagactcggacacgtagcaacacttactagttcgtataataatgtacctgttctttggaggaactcaagaggatatgtacatttgcctaaataaaggaggccagcagtaagttccatttgcaaggcaaaccttcagagagaagatgcttgtatcagtcctgtagtgaatgagcatctcatttacatgaccaatctcttacacagaaataaatcactgcgtgactgtgctctgggtataatggtattgagcctggcctccttttatcttataatcagttaaaataggaactatattggtcatttgcagaattcttttatatacaaacaaaaaatcatggtggaaatgtattcagtgctctaaattgatactagcctctttctgttttatagtcaatagaaaaagcaatctctactaaaaatacaaaaattagctgggtgtggtggtacatgcctgaaatcccagcgacttgagaggctgaggcaggagaatcacttgaacctgggaggcagaggttgcagtgagccaagatcatgctattgcactccagcctaggcgacagagtaagactccatctccaaaaaaaaaaaaaaaaaaaaaaaaaaaatttgaataaattaccaaaaaaaaccatgaaatttcaataaatttagttcagaaatgaagccattacatccctaaattctattacataaatatgttactaatgtttactctataaccacagcagatcatctgtttccttttttttttttgaaacagagtctctttgtggcccaggctggagtgcaatggcgcaatcttggctcactgccacctccgcctcccaggttcaagagattctccgcctcagccttccacgtagctgggattacaggtgatttttgtatttttagtagagacggggtttcaccatgttggtcaagctggtgtcgaactcctgacctcgtgatctgcctgtcttggcctcccaaagtgctgggattacgggcatgagccactgtgcccgatctggctcatttatttcctaaaattataatgtatgactaacaaatcaatttaaaaactatgtacaactggagtacacaattgtcaagaactatttacttttgcttagtttaaatatttggtaaagagtttgcaaataaatactcatcatgtctattcagatctataatgtgctaaaaattctgtttaagacttcaagaaagaggccaggagtggtggctcatgcctgtaatctcagcactttgggaggacaagatgagtggatcacctgaggtcaggagttcaagaccagcctggccaacatggtgaaaccccgtctctactaaaaacacaaaaatgagccaggcgtggtagcgggcgcctgtaatcccagctactcgggaggctgaggcaggagaatcgcttgaacccgggaggcggagcttgcagtgagcagggattgtgccattgcactccagcctgggcgacagagcgagactctgtctcaaaaaaaataaataaataaataaaaaaaggcttcaagaaagaggcattaatgtctctataagttttactcaccctgtactcttagtatgaacaagtctttaaatgtgtctgctaatcaattaaattatttttctcatttcttatgttaaatatcactcattgaatacatactctccctttaaaagagagacaaatagcaagcttattttctaagaaagtgatagtttcaattcctctgtgaaagtggacagatatcctaggttttttttaaattcaactttatattaaaatgcttacacattctaacgcagttgtaagagatagcagagaaagatgccagctaccttttccccagcttccgccagtggtaacatcttgccaagctagacgttataattgtactataagcattgttacagtcagcacagaggacggccgtcaccaaagggtcccttctgttaccctttcacagtcgtaccctcctctcacctgcttccacccccttcagaactgctgggaagcatgaatctgccctccatttctatcattttgtcgttttgagaatgttatataaataaaattattcagtgtacgatctttggggatgggctttttccacacagcacatttcccctgagatccatccaagatattttgtatatcaacagtcggctccttttttactgctgagtaatattctagggtgtggaggtaccagtttgttgaaccacagatccactgaaagacatcagagttgtttccgtgttctgctaatgtgaataaaactgctataaacattcatatacagatttgtgtgtgtacctacgtcttcatttctctaggataaataactaagagtataactctgtcatctggtaaatacatatgtcattttttatgaaactgctatattcttttccagagtggttctaccattttatattcccagtagcaatttgcgagtaatccaatttctccacatcctcaccagcatttggtgttgtctttattttgtattttaatttacctactttacctattactctagatatttctttatacattcttaacttgtcatgctctactgcagttgctattttgtaggtcaagtttagaaatcttacctttccttgcatctgtgtttatgtttgcctgaaatgtttcttctacatgtagaactacattagacaatgctataacttttgctgcaaccctctaacataatttagaaaactcaagaggagaaaaacagtgcattgtatttaaccatatttttgcttactatgtttttccctccttcctagtgttccaaaattcctttttttgttgtttcatttgtttagaaaatttctttagccattcttttagggtaggtctgctggtgacaaattcgcttagtttttctttatctaaaaaaaaaagtattgatttgttctttcttcctgaacgacattttcactgggtataatattacaggttggcagttcttttctttcagcatttgaaaaacattgtgccacttccttctagccttcatggtttctgatgagaaatccactgtaattagaacaatgttagccctatagggaaggtgtgatatttctctggcttctttcaagatctaaaatttgtctttagttttaagaagttgaattacgttgtgtgttggtgtgggtttctttgggtttttcctgttttagattcactcagctttataaatccatctataactttatgtctcttgcaaactttggaagtttccaacacttatttctttgagcatttgcccaccattatcttctccttccaggaatcccctgacacaaactttaaatgctctgttggagaaccacaggtctctgaggctctattccttttttctttttccagcctaccttttctttgccatttggaccgtgtcatttctatgttccaacttccagttcactgactcttttctctgttccttccattcttatgtcaaacccatcagtgagtgttttatttcagaaatttcaaacaagaggctctccactcagcctttactagtgttggtggggacaaggatagggccgcagtttttctgttgcatttggctggagtagactggttattgtctaaatgttttctatgttgctaggcagcccctttctgagtcctctggataaaaaacaggccattgttggggatttcttccttccttcctttcttccttttcccttcccttcccccttcctttacccctcccttctctctctctctctctctctctctgcccctcccttcctctctgcttcttttttcttctcttttctttttgtctatatatgttgacatttcctggttgccagcttcttcagttccacatctgaggtaacgtagcaaaaagaaaactcaagaaattcacctctggattcttccttgggttctaaaatccctactctgtccacattcttctcactactttcagaatcttcctaagcttgtacagcggacccttgaataacatgggttgaaactgcatgggtccatttatatgcagattttcttctgcctctgccacccctgagacagtgagactaactccccctcttcctcttcctctttagcctactcaacatgaagacaaagacaatgaaaatcttgatgatccacttctacttaatgaatagtaagtatcctctctcctttttgtaatgctgttaatgttttctctagtttttttattataagcatacagtacatattacatatgaaaaatatgtattaatcaactgttcatggtatcagtaaggcttcccgtcaatagcagactactggtaaagtgtgaggggagataaaagtatacatgagttttgtctacatagcggttggcacccctaactccatgactccacgagtcaactgtacaatatgcaatgtctaggctttttagtgtagttgctgggaggaagagggaaaagtatgcctactccagcttcccagaagcaaaatctgtgccagatcattcgttttcaatgtctatattttttccattttcctttaattttttaaagttcttaaagtcttgccaataacaaaactgaacagatgagtgtgtaatgaaaataactatactctaacagtgcttctctaagtggcctgtggatatgctctcccagaactgaaaattctatgaaaattttttagatgtgacatcaattctattataatcttacaaataccctttgccagttaaatagacaaactcgctttttaaaattatgacatttcataagactgtggtctcaagctatagttccccaaagtacctgaggtgaggcactaaaactaatttcctcctcaaagaaggtgaaactaagtgtgagagatactgctcagtatgtggggtgaccattgcctcagttttcctaggacactcccaacatataattttgtcctggaataattattgacagggtcttcttttatactcacaatatctcattttgcatgataagctaatatatatgttcatatcacctatgataaagaatacgaaaccaggaggaagacacccagcaagcatagacaccaccccagccatctcttcttctcttcaggacaccaaggtgtatatttaacattcattaatggaagcattaagtagctcatatggaaggtccatcttctttttctcagcagcaacttattattagatattttgtgcttatactgtgaaatatagcacctgtaatgataatgggtaactaaatgatattgactaaatagttgtaaacatatgttctaagattatacaagaatatctaggatgctaaaattctgccagttgtacacttaaagaaaacatagccatcaatttgcaattacatgtgtaacttcctagtctttacagtgaaactcttctatgaacaaagtttgccaacttctcggcacctaaatcatttaactgtgatttaatagaagttccataagtatgaacctttctttttcagtgtcctcagacacaagttctcaacagccagctaggcatctccaaacacacgtactcagctggcatcaactcccatcatgttggaacaatgcagcatccttcccccaaccaaaccgggtcttcagacttcccatttccttctatggcatgacatttttctctagttccccaccaatgaaacttcaatgccaagttagtcaaggttatgtgaaatatagcccatattttattttttgtccaatcttcaacatctctcttcaggttctagaagaacaagaacccatcctttttggcaagcattctctatgctcattcccctattcctccatctacagaatcctacctcaactcaattcatccaagaagttcttcctggtgacttccaaccagatgtgttttctccacctttaaaacttcataatattttcaggtgcgatacggcagttatgtttcatattcttatattatagctattaggttgaacaacatgaaattgttgaacctgtaaaaatggcaatcccatatggttcaatctaatatttctctcggttttagggctcataaataaagagcagtctccatgaaaacaggggctgagttaggtctctcttttggatcccctgagaagcctaggacattggaagtgcttaagaagtgtttgtcaaaatagactcataaatcaacacatgtcttaggcatatatgtttgcaaagtcaatcatctgaagcaattagtctaactacatatgaaatcgctaattgttttatgaatcagcacaaatggcagtttagaacctgaaggttttggcaatataaaatgttttgattcaaggagctgttttaaaattatttatttgtgaaggaaacatccttggatttagaggttggcagatacagtgaaaatctttttagttgactgaaatagaaaaaaaaaaaatcaaaaccctttttagcacatgcacttcccttataaaaccaaattgcctgaaagcagaggccagcagtttgtgcacaacgagtatgtgcctcaacaccatcagcaggagatgcaatgcagaatgacaggaacaatttgcatttctgtagcttctttgtatacccaaattctgagagcattttacaaagccataaatatcgttacccacaagagacagggaaaggatgcagatacaaggacggactttgtgtactctgacccaggagcccccctgcgcggagcagtgatacccacacagctgtaaacctgagtgcaattaattgatgctggttaagaaaaggggaacatacatctgcagggtccttcacagtcacagggaccattcccagaaagcgtttcgtctttcttgcattcacaaagaatagcgtcaacaaatgttgagttgtatttgcgagtttccccaacaaaggacgggtctctagttctaggtgatggtggtattatcagtcacctcaccagtccccctaattcctacaaaaatcaccaatccgaatgacatgtgtgtagggctttcatggggctaggagcagtgggctgccagaagctctgctggggccaggagagaagagagcatcgttcacacttattacgttgcaggggcctatttccagggacaatgttactgaaccttggagaaattcatgcaaaggtatactgttgttgtgctccaggcttccttccccatcagctgcagaactgtgcgattctggtcctggccaaggagtgcccaaagctagttgccaatgggccccggagcccacacctcctctagcgcagcatagcagcagccctcactaacctccaggggtcacaattgggttacaaattcctcacagtgcagggactgagcagcctgattgggaacaatttattcgaatccttcttcgttaagattcaaatggaataagtaaggtagaaattgaacagacacagaaattgtgccttgctgctcctgtagtcagtagacatttattcactaagcctagctcgtgtgttctttctctctctctttctcactcgcagttgttcttccaatctttcctgcttgctgttttaatgcataattaagaaggtcagaattaatgaagcagtgtggagtaaagttcaaggaatccccaggcactatttattctattagatctcaggcatgaatgtcagattggcagcgcaggcggcatgagcaatggagctggcggcatcccaagaacggccgccaagggagactcacctgcacagtccagtcattcctcagctccttccctgcgaaaatcacacgcaactggtcagccggaaccccctgtcgcttagcaaccacctccttgagctggaagatgctggtgtcagaatcgacctccactgggaaaccatggctggagttgaacctgacaaacactgaccaaggaaattggaagggagaagagaaagtgagcatcactcgaagcccttaaatggtgatagcaacatttctcaaccgatttacccctcgcagcccttcagtgaatggtatatattttctttcacttacaacaaaaaacttaatgctatagagcaatatttgggaaaaacagagttagttacccacgagatttccctttcatatattcgtcagtgacctgcaaaccaaaattgcattctccctttgacatccatcctgggaaacagagagacttgagcaggacacttgcttgattggaattgaaagagtcccatgagtttattgaaaagactcagctctgacagcatgtacacactcacactccctccacagtgaccctcttaataaaaataggaggcgatgtgttagcactcaaggtatagcaatggaaaaaaatctaagctgctctatagaccagagtgaagacccactcggggctatggctcagagccctagacttgggtggtcctggccaaaatgctccactgggtctatgaagacaattatttgccctctttttggcagggagggggtggagacactagtgacaccatttgtcttattgaagccactgttccccgtgagacccaggctgcatcctctagtctgtctgtctgcatgccgtcttctcactgcacctgctgtcccacctcttcagcgtctctcactgccctttactttccattctttctctcactgcttgaagtcacgctctcatcacatcttttctagagtctcataatagcccccaactggagtcttgatccacgccatcacctccaaaaggccctacatagttctgcaaaatgagccttattaatacagagctatgtcacaccactcaaatcctttaagtctcacactgtcggctggtgaggaaagactccaagatccctttcatctagcacaaacctacattccagcattttcttcattaatctccatgtgtactcttttaaactaaatgctcccagaaaaaaaaaaatcacaaaaaactgctgcacacaacttcttgcttttattcatgacctccctccttctcctcttcctattgaaatcctgcctacctccatggcccacttcaaatgtgacctcccccaagaagcttctggctatcagctactgcaaaagcctgatcttccttattcagggcaccagtggcatttactatatatgtcttttaatattcaccacattcctcatggaagcaggatagcacacgggttaaaagaacatcctgaagcattaggaagacctatgaaaaatccccacagactcctttaattggcttaggatgctaggggtcaatctattaacctccctctttaggtctcagttcccttatcttgaaaacataaataaaccacagaccatattattcggttcattaaataatatttatagtatttaaaactatcgtcttgtaacatttaaaaataatggacatttagctgtttttgatatacattttgccttctttaaaagataacaaactcctcaagggcaagtgttattgtttatttactgctgtgtttcctttaaatgtagtactatagctaattatttctcaataccaatgtgagatgacccacctcatcataattataataatcattacaatgccaataataatcaggcacttactatgtgccagacattgtgctctcatatggtttttctaagcctcccagtgatctggtcaggtccctattattatccttattttacagaataataaacgaaggcacagggaatgggacccacttttctaaggacattaattactttctaatggaactgggtttcaaatttatttcaatctaactctaaagctcattccatttctactaaaataggcttcctgaaaccatctcagaagaaaagtccaggccaggcacaatggctcaagcctgtaatcctaacactttgggaggccaaggggcaaggatgacttgagcccagaagttcaagaccagcctgggcaacaaagtgagaccccatctctacaaaaaatttttttaaacaatcagcagggcgtggtggcgtgcacttgcagtcccagctactctggaggctgaggtgggatgactgtgtaagcccaggaattagaggtttcagtgagctatggttgtgccattgcactcagtcaccctgggtgacagagaccttgtctaaaaaaaaaaaaaaaaaaaaaaaaaaaaaaaaaaaaaagtccacatttctatccctcatgattaaaaagataacaataaaaaggctttatgacataaatcagatattccctatatgggtgtgcagtacaaataaataaaagctccagtgaggagctaagagcaaaggaccgtgaacaataaccatgaacaacatgggccccaaaacagacgtgacactccagtgagggcaggtggtccagatggcaccacaagaacaaaggcctgacatctctgaccagcacggaaagtgtttagaaaaaggaaggacgaccagtgacaaagtgctccaaataaagaaaattcatgaaaaatactaattacggaggaaaaggtgcttttgatacacttttaagtcaatttcatttgacgcctttgaaaatagaggggaagaaataaaaatgtattggaagccctgaggtatcttcacagcatcctcagatcagagaccataagacaaccaattcatcagaaaagacacatgacaagttaggggctatagggacaaaagatatgaccccagttctaaatttcattttctactagtgagaatagatttaaagtaaaacaccataggaaggaatgtgggaagaagtggctggaatttgtgccaaagctgctataaaaccagataaaaattccaggagatcctaagtttatgattttgctccaggggttcaaatcatggaactcctactgcaaggatgagagtttttttgtaaagggaaactgcaaaaaatattaaagatacctctgtccaactactgaaatcctaagtatatacaagttttttctataatagaaaagttacagatttaaagttacagtatttagataaatcataaatactacggatatgaatatttttaacagtaaatctaacatacaatataaatttaaaatggaaagataaaccaaatacataatatttgaccaactaaaacattcgcatgaataagaaaaaacatcttaagaaactcactgagttcataatcaagtgccattatgtgaaaaatggctagtgctgaatggcagtaatgtgatttgagtgggtctcaacctttttctgacatatgtgggaaacatgtcatgtcccatctgtaccagcccctgaactccagccatgatttccaaaacaggagtggaaggaagtacccagttctccccacctactacctctttaaagtcacagaaggcagaacgtctttagagctacataaagagaaatttgaatgctggttgtaacgcttgctaattttatgacaagttacctggccaccttgactgttagcttcctgatctaataaatcggtataagggatgcaacaccaatgtctgttacacaagatttattgagattatggatgtattagaaaatctcagaaagagactagtacagggcctatcctcctagtgctgggcaagtgtgtgctccaaaaatagttccctattctaggcacctagaggaggtagagctaatgaaagcagtgtcctttgcttgcatggtaactaagggagattagataggatgtgggtaaatactaaataaagtagccaatttttctggattctgctcctcttggtggacagaaaacttccagagaccaagagatatgatagagaatatggctcacctctactttctaaggtttaattacatatgaaaagcttggaaatgcattgttttaataattgttttgatgacgtataatatagtatcagaaacaaacaacataccagtaaacattatcaatcatgtgtattatcaatcaacatcataatgcactgataacaaaaaacataatgagatatatccagattccttttttatgatatccctaaccagggttgagaagtcccagagagtaaggaagtgaatgggtgggaagaggggaaagggttattggtggatgggcccttatatttcttttaagacaattttatttaccaagtctgaccagggtataaacttcataaatatagtagtcaatatcaataattaatgattcttaaatgattctggctgctcctcaagcagccattccgcctcctgcactgagaagagcaatgtcattcatcagcacagccccatcctccttgtcattggtcaaatgattggttcagggatgatgcaagccaatctgtgcctggcactccccttgttccagtgattgattctgcagaatacaggtgacataaggtggactaatcaaagtcatatccagaactgtcaaaggttcggtgaagtccttttagatggcaaataacatcatgtgatgcctcagacagttttgctgagagacccaaagaaaatcacagcccaagatagaccattaacatgagcacaaaaatggactcagtgcactgaaggcaggcaattcttcctcatgagagggtttcctaagctccgtgggatgttcggctccacctgcagcccagtaagtatcagaggcacgccccggttaattgcggcaacacaaaagtaactccacatgtttccaaatgtcccttgcctgggaagtttcttctgcacctttgagaactatcactaaatctagtattccctaactttagcaaaccaaccaacctgtcctcacaccctcctgcgattactaccccatttttctatatagaaattttcattgagaatttcttatcaccctggtctccatttctttattttatactcttccgtgagccaacacttgaagactgctcttggtaaagcaatgagctctacacttcaatcctgtcatcacatttcagttcttatcaggttgaccttccagggacattcaatatagttggcttctgttctcatcatcctttcttctcttggcacccgccagagaaacccttctggtttcccctacaaaagaggacatacttttgtagcttcctcttctggattctctccctttattggccctgcagattttggagcatcccaggagtctgaatctgtgtattctcccaggtgacctcctctaatcccgtggctgtaatgcaatggatatgtcatcaactcccaaatccttatttccagacttgccatctccctggacctttctttctctttctctttctttctcttcctccctccctccctccttcccttcctccctccctcctttatttctttcttttcctctctctctctctcccttcctctctctctctctctctcatctcactctgtctcccactatagagtgcagtggcacgatctcagctcactgcaacctccgcctcgcaggttcaagcaattctcctgcctcagcctcccgagtacctgcgattacagatgcccaccaccacacccagcaatttttgtatttttagtagagaaggggtttcctcatgttggccaggctggtctcgaactcctgacctcaggtgatcaattcgcctcagcctccctaagtgctggtattacaggcatgagccaccacacctggccctcactggaacttcagataattgcatctactagcatttgatatctacacggatgtccagtagataaataaaataaacattctcttcctacacctgtcttagtgctttgccttattcctaccctctttgatccatcaataaattttgttaacggtagtccttcatttctaacctaatctcatctacagcaatctatttccctacccaataatttgtggtggaacacaaatctctagaactgcatctttggactcatagctcaatgttaagtgaccttgcatgtgcaatttcatcttcattgggttgttataaggatctgcattattactagctacaagcatttttatagctcgttttttattttttaattgctatttttatgttttatattttattatttatttttatttttataactattacctgcatactcatttagcacttgagtatatgctgtatgataccatcctctagtagcttgtttcataattctttatttctgtctttgaagatctttgtgacaggaagcctcatttcatctccccacttatacatagaggccaggatttttgccttttataatgaattattaaatgctatcggatcaaccctcctgcaaaaaaactactataaaattgggacttcactaaagaaagcagattcttgaaaagccatagaagagtgaacaaaaaaaatgaagatttctagttagggggtccacatcaggagaagtacagttacgtaaagggagtgcccattctcacagctttaggcttgaagccaggtgcagtccgtgcacatggcatgtgggccagcaggcactttggttgcaaagccacagtttttctggctgaagaagcaaaacaccaagactgggacacctgcctccgaggagacacagaagaaaatgagtcagaaagagaaacccaaatttctatctatccacgtctctggctaacccctgaatgatgaaggtgcgttatcagactcaaagttgctcagctaaaggaaggatgtgctcaaggaggtgaagtataatgcccctgtgacagtaaatcccctgtgaatgtaaacgcccctatgactgtaaatgcccctttgagtgtaacacccctgtgaatatgaacgcccgtgaatgtaaacgcccctgtgattgtaatccccctgtgaatgtaaacgcccctgtgattgtaatccccctgtgaatgtaaacgcccctatgattgtaacacccctgtgattgtcttcctcctgaagaatacagcatggaaaggggaacaaaaacaacctcacagtggagaaacctgacaggcgctaccgcagccaggtgatcaaggtcaacatcaacagtggtaagtcatcttgatcatgtttacccttgacacagtgtgatgcaatgggcaatttatctctgtgggctttctctcaaaaacacataagcccagtctaatcttcacgaaaacatcgcacaaaacgcaattgagggacgttgtaaaaaacacctggccagcactgcgcaaacctttcaaggtcatccaaaacaagaacagtctttagaaactgttagagtctaagggcctaaggagatgagtaaatgcaatgtggtagcctggatggaatcctggaaaagaaaagagacattcggtaaaactaagaatatccaaatacagtttgaattttagttaataagaatgtatcagcattctttcattaatgataacagatgtagtataacaatgtaagaagtttaaaatagggaaactgggtgtggggtacatgggaactccctgtactatttttgcatctttttctgtaaaactaaaactgttgtaaaataaatgttcatatatattaaagaaaaagatctagatggagatcagacttgcacacaaagaacagattttcttttcaagatcaaccaaaataaatgtcttccaaaacaaacaaacaaagaaccaagggtcactggagaaaaaattacagaattcagtgtctccagtaattacgtttataatgtctgcgatataattttaaaagtatctaacatttcaaagaaccatgaaagtaaaccattctcggagaaaagaaaatcaagtgagacaaaaccctgaaatgactctaattttgaaactaggaaacaaaattttaaaggagctagtagtattactgtccttaaaggagtaaaaaaaaaaaaaaaaaaattgcaatgagtggaaagatatgacagataatcagagaaatagaaattataaaaaggaatcaggccgggcatggtggctcactcctagcaattttttgggaggcccacacgggcagatcacttgagcccaggagtttgagatcaacctgagcaatacagtgagaccttagctctattttaaaaaaaagaaaaaaagagagagagagagaatcaaatagaaattctagaactaaaactacaattgcctggaataaaaatctgttaaataaatttaatacccaaatggagattaaagaggaaagcattagtgaagaataaagaattgtttttaaatgaatagatgttagggacatattagataatatcaaatgatctaatatatatgttgttggagtcacaaagaaaaaatgaaagaatggggcagaaaaatttttcaaaaaataatgccctcaaattttaatatgtgatgaaataaataaatttacatattcaagatgttcaacaaatgtcaagcaggataaatatgaacgtgcttgtgtcaaggcaaatcatagcatagtcaaactatggaaagccaaagacaaggaacaagctttgaaaacaacaagaaaagtttgtctgtcacatacagggttaaaatgatgtaattaagggttaacttctggtcagaaacaatggagtccagaagtgacggcacaatattacagttcaggaagaaaacaaaaagcaaaaaatgcttgtcaatgcagaagtttatatccagtgaaaatatcttttaaaaatgagaataaaataaagatattttaagattaaataaaattaagataatttatcacaagcagactcatatcacaagaaatatcaaataaactcttcaggctgaagtgaaatggtacaagacagagattcaaatccacaagaaacagtaaaagcatcataagtgctaaatacagaagataattaggtaggaatttttttgctttattcaacataatttatttaatgcagatgactgggtaaagcagaaattctattccatggggagtttagaacatataatatgtatgccaagtatggcataataggtgcggggtaaatatgggtcttttatttattttatgaagtggagcaatattaacaatgaagaaactaagaagttaaggacagacattatatttcttatagtaaaaatcaaaatgaataaaaatattgacccaaaaagcaagcaaaaatcataatggaattccaaaaaatattgaaataatccttccaaaaagggcaggagataatgaagaatggaagaaaaatagagaggtagatagaaaaatacaataaactggtgaccagaactcaccacatcaataattacattaaattttaatgaagtaaacactccaattaaaaggcagggactacgtggacagagggaagtgggtccagctatactctgtctacagggctgcattttagatataaagacacaaatggtttcaaaataaatgaataaaaaatacgccaagtaaaatgtaatcataagaaggcagggatgacaatattattaatatcacaaaaaatagattcaaaggcaaaactattttgaaaaaacaaaaagagagaaacttaagactatgctgccaccacttgaaaaggtggatcgcaaggctcaagaatcatagcccaagccttcccactccttccctccttgaggtggaagaggtgcccggtactgcatcgggccagactgggaatgtcaaggtctcctgccacttccaggttccccggctggaaacagaatgaggacttcctaccctcctcagggagtaagagaccctggtcttagaacatagcaactgatgaggacatcgcgcatagcctcaaggaaacagctttggttctttgacgagggtgtatctccagtagaattccctcctctctctctttttccttctctctctccccaacatactctttttttattctttgattaattcttccacttttaaaattatttagtagaaaccacattaagggagatggagaatgagaggtaggaaaaaggcaactgaaaatctatataataagacgtgtatactgtggctaagaccatggatgttagaaccctctgtgtgggttcacagactagctctgtcccatcctaaccaactatgtaagcatgtcacacagtttctctctctcaatttattaccaacaaaataggcaataataatagtatctggccagacacggtggctcacacctgtaatcccagaagtttgggaggctgaagtgggcagatcacctgaggtcaggagttcgagaccagcctggccaacatggtgaaaccccatctctactaaaaatatcaaaattagctgggcgtggtggcgcacacctgtaatcccagctactcaggaggctgagacaggagaatcacatgaacccaggaggtggaggttgcagtgaactgagatcgcgccatggcactccagcctgggcgacaagagtgagactgtgtctccaaaaaaaaacgatgagaaagtggacataataataagggcaaaactctttggggaaggagatgacaaagaaaggagaagaaagactggatgataactagagagggtttgtgtcttataaggtatacgttctcagtatactttgtacctcatcaaaaataataatcatagtatctacctcctaaagttgttgtgagaatttaataaatcaatataagaaaggtatttagaagagtgcctaggcacattttaagtttcagcaattattgactcttaacttcaggtccaacatatagtgtaaaaattattgtaattatcacgtcagttgtgccatattaatgtttggttttaaaaatgtaccatttattttctttaaataagaaaagtgttcccaatggagctctattccactacactttatagtaaattgtaattggtctaaagtgtcgttagtatactgatagtgatatcttctgtttaaatagagctctcaattttcaaagtgcttttacagacattatctcagttaatcttcacaatagcactgaaagataattgggagaccatttactattcctatttttaaaataaagaaacagatgcacaaagaataaaagtggcttgcccaaacttcacaaggaaagaagcaggaaaaagaatcttgggtcctaaactccctcctctgtgtcagtggctttcacactggactgtatgttaccctgagggtatatgggacgtgccaatggaaagttctcctattcctcacacaccgttccttcaaacagatatgtctggaaacacatttatggctgtttcatgatggatcattttgtcccagcttcccttcgaaatcaacattctcccacttcacaaaacaaaggaatacactcaatctcccccacggtggctctggtgcaccaccacagggtgttaaaggagcatgccttgaacaactgggaacggggagcctcttttaacccaacccgttaactcacagtagagctttatttctttcagagtaaggtaaaggttggcattaggaacgatgatgtattttttagccatttcggactgtgttttcagcacgtgggttgagttaggctggtatgaatacagatacacagtaaagagggacaagagagatggtgatgttcatttaactctcatagctcttctaccccttggtattgccaaagaagtaattcctcctcagggaagttctcagaagatcagagctaagattgttgtctataatactgaagatgacggtatcttatatcacccaggagacaaactgctggcaaagttccatctcttacctaaccatccatctgtccatctgcccattcatccacacatccacatagccagccatccacccatccatccacctactcctctgtagtatagttatgcgttttgagaaatgcatccttaggcaatttcatcattgtgcaaacatcatggagtgtatttatgcaaacctagattatatagcctattacacacctaggctatatgatatagtatattgccccaaggcaacgtgtacagcatgctactgcactgaatactgtaggcaattataatacagtagtgtttgtgtctctaagcatagcaaaggtacagtaaaaatatggtactataatcttaagggaccaccatcatatatgtggtccctcattgactgaaatgttactatgtggtgcttgacagatataagatggctatgggggcccatttttttctgaaaaattaactcctattggctgtctgatttgaaaaagattggttttacatcatgtcaaaaggcggtcactttccacaaatggaatatgcagctccaaggttttgatttaaaaaatgttaaataaaataattttattataaatattgtattgacaaaagtgtattaaactgaagaacatttcaatttttcccaatgtttcaaaatttgtcagattgaacaaaatacctctaaatgatagaatggcaagaaaaattaagtgagttaaaaaaaactttataaaatatatttgatacatttcctagaaattgaataggtgaatgtctctatataattttgtccaagtaattagcttcaaattctttattttcaacaaaattaaagatggattcaattgggttataaattgacagatcactggagtaattatgacaaatattactaataaatttttgttacaattttgaagacattaaaagaatgaagttgctataataaaatctcttctattccaataaacttattagttagaacacgggcttacacccataacaatgaaaaggaagaacaaaatgatgctgaatccatttcattccagcaataagtaagattcatccacagacaggttaccatgcataaaaataagcccattcatctaattaagggatttatttctaatatttttatgcttagtaattatttgtcaaaaataccaagaaaccattcacccaaatatatatttatatttttaagtgatttgtatactaaaaatagcatgacacatcatgattcactagaaattaatactaaggcttatggtacaagagaatttaaaaatatatcataaactttaattcttatacatgtttttgttgcaaagatatattttgagatgatgtgtaaagatatttaaaacaaaaaatagttgattcttgttattttctataggctatagttgtagtctgtaaagtcaccacgaacagtaaactgctgaatactaaagcattgttcctaggggaaaaatacagggttaggttcctttgagcctctggttacaacattttcatccaccagtcaatacataaccttgttttatgtgtgtttctgtttaaagacagcttgtttattacattttattgattcattaacattgcactcatagccaatatcactataactaatgccttaactaggtttctataatgtgtatttctccacaacggacatcaccacctacttaaactcaggaacactagccagtacttcagtactatgcttggggccatttcgaacaatgaaatcaccaataaaaagcaccaaaatatgaaaaacatgacactacatagacctcaaagagggcatttgtttgcagtacgaaagttgaaacaagaaagcagaacactcaacctcaactgagaacatgcttattgagcaactcaaatcttcacaactctgccatttctgtgaatgaccttaaaagcttccagtactgattttggggcaaggaataattttaccatgttggtgaatttgcaaatatggaacccgtgaaaaatgaagattaactatattacattgggataaagttatgcaggagagtagaatagaaatgaaaaagtttgtaaaaaagaaacaatatcaaatttcagactattaaaaatcatcttttacatgtattattagcaagatgatactgaagggtaaatcatcagttttaatatcccccaaaaacatttttaaaatgatgcaattgctgtataatttaaccttaatatttataatctgaccatactgcaactacttaaacctataataaaatttttatatcaacttaaaaatgtgcaaggaagtatatggtttctcaaggtgttttataatacatatgagcaaaataatttcaagattactaactttagaaatagaagctaaaatcacaatgaggctgattaatacaaacaaagaaataaaaactacacaaaatcccaaacttaagagtcaggcgttgaaaccaaatagccattcagtgatgcagacacaaactctggggctcacactgtaatgagtgtgttgtgtttgtcttattaataatgatgaagtatttttttataaatactgctttgctcatttttatatagacaattttcaaacaattttatatttctcagttgcttcaatcaaaaagaggtttgtggccgggcgtggtggctctcatctgtaatcccagcactttgggaggccgaggtgggcagatcacttgaggtgaggaattacagccagtctggccaacatgacaaaaccccgtctctaataaaaacacaaaaattaggctgggtgcagtggctcgtgcctgtaatccaagctctttgagaggctgaggtgggtggatcacgaggtcaggagtttgagaccagcctggccaacacggttaaacccagtctctactaaaattacaaaaattagccaggcgtggtggcacacacctgtaatccccagctacttaggaggctgagacagggagaattgcttgaacctgggaggtagaggttgcagtgagccaagatcgctccactgcactccagcctgggtgatagagtgagactctatctcaaaaaaaaaaaaaaaaaaaaattacctgggtgtggtggcacgtgcctgtaatcccagctactcaggagtctgagacaggagaatcacttgaacccaggaagcagaggttgcagtaagccaagatcgcaccactgcactccagtctgggtgataagagcgagactccatctcaaaaaaaaaaaaaaaaaattttttttaaattaatagaggtttgtaagaatatctaagaaaaatatttcctcagacaggagcattactttaaggaaaagatagtactatataaatatattccactgttaaatatttccagtacgtgtcttttcctcccagagatgggacagcttgctggctctgtgagtaaaattaattagtcctagctttttgttgcctttttttttttttttcccagtggcagcttgtaactttatctcttttttttaaatatccataaattttccatgcaacaataggataaatttatttcactaattttaggataaagaaaatgaataaaattaaatgacttatattgagtaaaataaaagaagaggaagaaataaatgtttttgttttgtttttaagacagggtctcactctgtcactaaggctggagtatagttgcatgacatcggctcactgcatgcaacctctgcctcccaggctcaagggattctcctgccccagcctcccgagtagctgggactacaggcatgcaccaccacacctggctaatttttgtttttttagtacagacgggattcgccttgttggccaggcaggacttcaactcctgaccccaggtgatccaccctccttggcctcccaaagtgctgggattacaggcatgagccaccgtgcctggccagaaataaacgtttttattgtgagccaacagaaattactgattcatgcattaaaaatattgaagcagatacagtccaaaggcagcatcatattactgtagagatactacatgcaatctgcttggaagactgtgcatagtaagcacttattaggtagataatggcactcccctgaactgaaaacagaagttataaataatatttaaaatccaaaaacatgatggtactaatattagtacaagaaattaccaccttatatcttatattaacttagcaaaaattattaattaatatttaatgaaattgtcagttagatggtcagtaaaaggaagtctttggcccacagatcaaaattcacaatacaattttatccttaatctttaaatacaaaattacatttacgagcgtatttttaacttcgcagcagagatttaagccagtggcaaatacagaggctctcaagccagactacctcagtttaaatgtctgcttctcaactttcttgctttaataccttcaaaagtaaaatactgttcacatgtatcttacagagttgttataagtatgaaatgtctgactacatgtaaaattcttagattaatgcatagtatacagtaagcactcagtaaatgttagcagctactaaataaaaagtagccgcattttcaaaaatgattcggaactttctagtaatcaccaacattactttcagaagctctagttggaaatatttgttaaaatcttctcttaaaatctcaacagatagggagaaggtggaatctcacacactgcaggtgggaatgtaaaatgctaccgccactttggaaaacagtccagcaatccctcaaatgctcaaacctagagttatcatatgatcctgcaattctactcctaggctatatacttgatagaaatgaaaaatatgtccaaataaaaacttgcacatgaatgtccctatcagcattattattaatagccaaaaggtggaaaccacccaaatgctcatcaattaaccaatgatatatgcatgtgtttgttgtatccatacattggaatattactcagcaatgaaaaaggatgaagtgctggttcataccacaacctgggtgaaccttgaaaacattgtactcagtgaaagaagccagtcataagatgttgtatgattccattgatattgaatgtctagagttggcaaatctatagacacagagagtgcattagtgattgcctaaggtggtggtggacagtgtttggggagaaacaggagttactgctaaagggaagtgggtttcttttgggagtgatgaaaatcaaaattgactgtggtgatggttacaaaactctgtgaatatactaacaaacaatgaattttagaatttaaatgggtgaattttatagtatgtgaattatatcttagtaaaactgtatctcctccgctgtccctccctaaaataaaaccaaccaaatctctgtatacccatcacttattaaagtacttggcaaaacactgtgacttagtacttttgggataagcggatgaatgaatgtgcattcacttcactttaaatgttttttcccctattttcatctattagagaaaactgtaatcatgagaagaaacttacaaaatttgtaaacatcatctttcacatttagagtttgtttttataatgtgacaaagtttttctgttaaatatctcacagttgctgtacctagaagtgctttaagaacctgaaatagtactaatggtatgaaaaaggtagacttatatttcaacctttaatatagaaaatataatttgctcaaattactcacactgttctaatttccatatgctctaaagtaagtatgaataagatttagacctaattgctggtgacattaaaattcattcaattcttactgtcaacaaatatttactgaataagtaactatttgctaggcacagtgctagaaagtgatattacaaaaatgaataacacagcctggtgacagagatattacaacagaattatgtacaagaatatgatacatgctatattagggcttgtgccatgcgtaccacaccaaatgttttaagaatgaagagaaaaaaaaggaggctgggtgtggtggctcacgcctgtaatcccagaactttaggaggccgaggcgggaggatcacttgaggtcaggagttggagaccagtctggccaacatggcaaaaccccatctctactaaaaatacaataattagctggacgtggtggcacacacctgtaataccagctactcaggaggctgaggcaagagaatcacttgaacctgggaggtggaggctgcagtgagctgagattgtgccactgcactccagcctggaggacagagttaaagtgtctcaaaaaaaaaaaaaaaaaaaaaaaaaaaaagaaagaaaaagaaaagaaaagaaaacaaaaaaagaagagaccagcactttgggaggccgaggtgggtggatcacttgaggtcaagagttcaagaccagcctggccaacatggtgaaatctcatctctattaaaaatacaaaaattagccaggtgtggtggtgcgttcctgtaaccccagctactcggggcggggggctgaggcaggagaatcgcttgaacttgggaggtggaggttgcagtgagccaagatcacgccactgcactgcagcctgggcgacaggctgagacttcgtctaaaaaaaaaaaaagagacaatgaagaagagtggctaaaagctggagtagttcaaaatatttcagagataagggaaaatataggaatgatagagaaaaataagtaggggatttccaggtagagatttgttttttattgctacaggttaaagacacagtttaggaattactcttttagacaacaacagtgtattttcattagccatgaggttgtcagtattataggatggaggtatttacagtagtgagcagagagcaggcagagtcttatataactgtgagaactctggagctgtcccatgaaacttttaacgagctaaattttctattttacaaaaggacaacgtaaataattcatctttcaatattaagacaacatgttaactaatcaaaaatatcctggctatcacaaaattcaaaaggaaaatgtcaaaatatctacatgtttatattttgaattgaaagatattctaaaagttgtttcatgattatgaactgcacaatggagaccaatgtttggttcacaaatgtgtgctgttaattagattgagagtgattgtatatggtttctcacaaaggcatcttgagttcaaccatgtaaattgatggaattatcaaaacatcagacctatttcatttcaacctggcttttataaccaaggtgtgtgtgtatgtgtatggtgtgtatacatgtgtggatgtgtgtggatgtgtgcgtacatgtatagtctcccccaatataaatgtgaggctacattttcaggttaagagggctaatgtgtatcttgccttctcatcacaaattgttctacaagtccatccataatgataattatatccttcaatagacggctgcttacttcccaaattttaaactgaacaaaaatattacggatccaccagataattttaaatctatctacttgaactgcaaaattaggagttgaatgaaaaccttacttagtgcagtatgtttaaaactcatctttggctaggtgcagtggctcacgtctgtaatcctaatagttttggaggccgaggtgggtgcatcacctgaggtcaggagttcgagaccagcctgggcaacatggcaacatcccatctctactaaaaatacaaaacttagctgggtgtggtagtgggcgactgaaagcccagctacttgggaggctgaggcgggaggttgcagtgagctgagatcgcaccattgcactcccacctgggtgacggagtgagactccgtctcaaaaaaaacaattaaaaattaaaaacgaaaaaaaaaccacgtcatctttgagcatgttagtacttgctttgatacaaagggtctgcttgagtttgtattaaatcatttaactctccttgtagtttcctctgttattaaatgatgagaatgttcctaacctattgcaaatgattacttaccatggaaatacaaccacaattatactcaagattattccaagcacaaagttttgcatggaatcactgtaacattaacactgtctaataagaaacaaaacccaaatctttctgttaggagattattctccatgggtctccggccttctgcaatcttacctcactacctctatgctggactagctttccaagggggtttgtataggaagcatccttataagacaaaggtagtgtcttcctctggatcaaagggcagaagtgcttcctgtctgtcataaaagattcgggttccctgagctccgggttcctctccttttaacacatcctgctgtgtgtgcaggtgtcacttcacattgccctgtggaaactggggcctggagatgttgacaatgtgactactgctatggggcaagtaataaactatccagctccctgacccaggaatctcatgtcttggggccaatgtttggttcacaagtgtgtgctgttaattagattgggcaccagctgagtgactgtatatgatttctcacaaaggcatctcgagttcaagattggcatccatgaaactgtgagcagcctgcaagagggataaagtctcagatacttcacagttcctgacactgtctatcatttccttgacttaggcattacattcttactctctgaagctgttattttgttgttgtttttggggacttaataagcacattttaaagataaaaataaagcttaaactgaaatcaaaataccagtctttattttattttaatcaaagactgccctgacctttttttgagatgagatcatgaggtgacgtttaagctttgtaaatgcttatacataacaagtactttcaacaaaaaattctaacaattcttgatgccttatatgccagcttagaagaaatcaatcattgtttactttttcacttaaatttgcagatgctgattaaaaggcgattactattttttttacacttaggtctttctttaatcaaaattgactatatctctataaatgggaatcagggatctgctattacacaaaaatagatgtcaacatatgaaaattaaataaatgaactttgccactgccctgtaattaagtgataaagatttcattcacttttctaaggttttaatcatttatgataacttttattttcttaaggaaaaattgaactttgattttaaaaattctaaagttttcctaaaatatagcactaatatgtaatggagcaaactttcaaagtcacattctatttcattagaaatttgtctacaaatggccgggcgcagtggctcatgcctgtaatcctagcactttgggaggccgaggcgtgtggatcacgaggtcaggagatcaagaccatcctggctaacacagtgataacccatctctactaaaaatacaaaaaaaaaaaaaaaaaaaattagccaggcgtggtggcgggcgcctgtagtcccagctattcaggaggctgaggcaggagaatggcgtgaacccagaaggcggagcttgcagtgagccgagatcgcgccactgcactccagcctgggcaacagagtgagattccgtctcaaaaaaaaaagaagaagaaaaaaagaaaaagaaagaaatttgtgtataaatacaagttttaagagccccccctcctccttcttaataaatattaatgcatttgctcctccactaaaaacactttaagaaaatcaacagccatggcgatctcatggctgtgatgtgctcagggcaagcatctatgtaacatatccctattctgcaacacctcacccagcagacagaatgtttacctaaaactccctgagcttatgaaaacttcaacaatcatgtcaacatttaagctcgttcccaattaaccagtcttaccaagcatcacttctatgaacattttaaagaaaaaccagtgaagtggtgaaatcaactctgtccaagcttgcatgcaactctaggaaggcggttagcttatctctcaactagttcttatattacaccactatatttaacatctgacttttgttgctgtttataatattaccctttattttccttcaattttagaacctcagtttgtggccacctacagaataaactttcagctttaccaaattttctcttcttatgagagatgcacaacacttaatagagagaacactatttttcaagctgcaatatactgtggtgttttcatgttagacataaatagtgtcagtgaaaatgttgatcaaagaaatgaaattctaataggatgtcagaagaagcagattaaacaaatgatctagctgttccaaagacatcaaaatgcaaaataattcttttctggaggtattacttagccaaatgtaatttctttagcaatttcaagaaagaataggaagtgttaatgttagtttaattatagaaataatgtcaagtgacaatggcagggaagaaactgaatgctgatttgatctacacacagtgacatggacatttagaaaatatattatatgataattatataatcctggctaaattctttgataggtttcagttgcccctgtaaatgttctaaaattaaattcaggagggtatattgtgatatttaagaatttaacaaagttatctcaagaacatctcacactctcatgctatctgcaatccttgaatatatggtgactaatatatcttaatgtatttttgtatatcaatattttatcatgttatttcttaagacgacaactccaaataacaaagtgttgaaagaaaatatcagaaccaccaatatttttctttccttgacatacttgcagatatatatttttatgtttataacagaagttaataaagaaacatgcccagcttattatttctggattgattgcagaaacagctactaccttttttgatgatgtggaagtttatgcatgtattgaggaggcaatagctgtgataaattacttcaagaaaataacactttccattgcctttctttttttccttacaacctgtgttatggagtgaaatgtacttggccttgtcttcaggaggcagaagcaatcatttgcagaataggctttgtgtgctaacatttaatattaatctattcccaggcattatattattaactttgaatagatgctgacaagtcttgtttttggagggaggtggggcagggtatcgctctgtcacccaggctgaagtgcagtgttgccatcatggctcactgcagccttgacctcccaggctcaagtaatcctcccacctcaccctcaagagtaagcaggacaataggcatgtgccactacacagggcaattttttttattcttgttttttttttagagacaggagtctcactatgttgcccaggctggtctcatatgcctgtgctcaaaggatcctcctgcatcggtctcccaaagtgctggaattacaggcatgagccaccacatccatttcacttttgctttttttttaatgtgccattgttgcatctgtttctactgaagaataaaacagataccactatgctctttgttttccttttttttttcttttaatcactacccatttattaaaggctaggtggatttgggtaattcatcactgctaagtaaggtaactaagagcacgtttatggatatattatatacactggttacctcgtttcaataaataagcagctggtaagtcatctcccagttttatccccaacttctaaaagaaaaataggtcgaaaaaattaacaaatctggttaggaaaaatacactgagcccaactattatgattccctggattctattattacgtttatttattagtattatgagtctttgctaaaatgttgacttcttatggaaggcctctcaacagtgctgtttaaaaatcacacgtaatcaatcctttcactcggcacaccctaacctttttcccttcttcctttttctccacagctttcatcaatatcaaacacaattcatcatgaaaatcaagatttattcgttttgttcactactctatccccaatgtctggcacatactagctgctcaataaataagaatgaatgtgtagtataccacatggatgaagtatgggaggtattcattcaagcacttatcatgcgctctcctaaattacttaacatcagtgactgcccccactccacccgctcctcatccagcctccactgaatgaggaaacagcaccatgaatgaatagctcatgataaaaatttagcgatcgtcatcagtgtatccctttatccctatcattgagcctttggttctatctccaaaatatttattagatttctctacctctctccatctgcattgtcgtgaccattatctgtcttttgaatcagagcaatactctcagaacaggactcccaaaggcagtcagaggaatcccttgacacaagaaaaaactcacgtcacttcctactttaaaggcctcaatggccttctattgttcacaggataaaatctacactccttactgcagcctacagggctgcacggcctggctcccacttgtcctccagcctcaaccccctgtcacgctcccgctacgccgcccaccgagctcccgctatgctgtgtctggaagaagccaaccccttgctggattttacaccttggtacttgttgttccctttgcctggagcactcttgcctcctatctttccatgactcattcacagcctctagagagtatctcaaatgccagctgcacaggtcttcctgtgaccaccctaattaagcagcctccctaactactctctcatcaccttgtttactgctaccgtggttcttatcaccactttgttaacttactctttgttaaatgtaagccccgacaggacagggactttgcctctgtatattcacagggactaataaaatacgtggaacatggaaattgctccatatataacaaccgaatcaataaatagaacattctccctcacttgggtggcatccctcgtctcactaattagaatgcctgacacagaagagacatgctacaaatgttgaagtgaatgagaaaactgaaatcttttattgtatcctgagtggcacccagaaagatctttgttcattaatatttgcatataataactggactgagagaaaaatgaattcatttgattgacatttactcagtgtctgtccagtgctggaaagagcatatggcaatttggcttgcaagcacagaacagaggatatcatttctaaactgttcggtaatcccataaatataggacacacacatttcaccaaggcatttggcaaagtttctcattatatcttgtctttaacatgcaggaatgcagattggatggtagcccagctgatgggtttggtactagagagtggttagatgaagacagcttaagcatgttcaacagctctttcaatgcagcaaatatttcttgagcagctccggccagccaagtactgagcttgaggctagagtaataaaataattaagtgtggtctcttacctagaagggtgcataagtcttcccgtaaaacatttcagatctctgccctgtaccattgacattatttttaaattaatatattggatggatatatacagaatgtacttctatcaaaatcatatgagaattttaggggaaaaaacagaagaaataataaatcaggatccaagagatgataggtatctcaaaggctggaatgaattctttaaattaaatttagtgcagatatgaggtcctaccaatgaatccaaaataccaactacatatttacaaaatgggggaaatatggaatgtatccactcataaacattccttagggattttaatttacagtactctataaaaatctattgtgatatagtgatcacagaaactagtttcaccttctggtgtatttacaaggaagtaatcagcctgtgctcagaccacacttaagactactgtgtttgaaggcacgcaccacactataagaaaagttcagaggaggcggtcgagatggacacgaggatccttgctgcaacagccaatggtgttgctaaaacactgacactaatgaagaatttgtggaatgttaagaaagtgggggggttgcaggggggggtgggtgacagaggaagtcattctacaaaaaggtacttgcagatgcatgtttatagcagcacagttccaggttgcaaaaatgcggaaccagcccaaatgcccatcaatcaatgagtggatcaagaaactgtggtatgtgtgtgtgtgtgtatacacacacacacacacacacatacacatactactcagccattaaaaggaatgaattaatggcatttgcagcaacctggatgggaatggagatgattcttctaagtgaagtaactcaggaatggcaaaccaaatatcgtatgttctcactcataagtgggagctaagccatgaagatgcaaaggcctaagaatgacacagtggactctggggactcaacaggaaaggatgggaagggggtgagggataaaagactacaaattgggttcagtgtatactgcttggatgatgggttcaccaaaatctcacaaatcgctactaaagaacttacacatgtagccaaatatcacctgttccccaaaaacctatggaaataaaaaatttaaaaaaagaaagtgtgggtgaatggtagagaaggagggagctaactgtccataagtattcaaagagcaggtatgcagaagaaatagtaaacctgttttacacgatcctagggcacaggactaggaaactacatgaggacagattttgattcaccataaaaaggcctgactatcagtgctgtcctgcgaaagtgaagcatctcgtgaggaagtcagctctctatcaatgacaggtctcccacggccactgggacatcctctggacaaagacatcagactcaggacttaaacgctgcatagacagcagatttctagaccctatgtccttgacattttatgatataatgaaaagggaactaaaaaataaggaagtatacattttcattcactcaaccaatgcttgctatggctaggcgctgttttaggcaccgtggacacagcagctaacttaggcaaagtaatcccagcattttgggaggctgaggcaggcagatcacgaggtcaggagttcaagaccagcctggccaacacagtgaaaccccgcctccactactagtacaacaattagccaggcgtggtggcaggcgctacttgggaagctgaggcaggagaatcgcttgaacccgggaggcggaggttgcagtgagccaagattgcattactgcactccagcctaggcaacactgcgaaactctgtctcaaaaaaaagtatgcttgtgaagcatacattctagatggtttgggacaaaatgaaacacaagcataaaacaccaatctttgggtttgagaggatacttggtgctagtttgaggcaaagctacacctgaggcattcacactttaattttgtttatttatttttaaattttatttatttgtttttttgagatggagtctcattctgtggcccaggctggaatgcagtggtgcaatctcggctcactgcaaactccagctcccagtttcaagtcattctcctgcctcagtctcctgagtaactggtattacaggtgtgcgccaccatgcctaatttctgtatttttagtagagatggggtggggcggtttcaccatgttggccagaatggtctcaaactcctgaccttaggtgatcggccagcctcggctacccaaagtgctgggattacaggcatgacccaccacgcccagcccacactctattttttatttatttatttattttcatttttatttatttatttatttattgacagagttttgcttgtcacccaggctggagtgcagtggcacaatcttggctcaccgcaacatccacctcccgggttcaagcgattctcctgcctcagcctcctgagtagctgggattacagtcacctgccaccgctcccggctaatttttgtatttttagtagagatgggttttcaccatgttggccaggctggtctcgaactcctgacctcaggtgattcacctgcctcagccttccaaagtgctgggattacaggcgtgagccactgtacctcgcctccacactttatttttaagctggaagttatcatagatagagccatttgttacaataactgcagtagaccttttgcctttattcccgctatatgttctcctttcctttctaacctgtggcttccactcctcaccactgcaaaacaatttacaattaattgcttatactgcaattattaataaaatatattttgccatttactaaactattagatatgttttctgagtttttacacattaaaactttccacagtaaacattataagtgttcattattagaattcataaattatacagaagtgcaaaaactaaaggatgtatctacttctgttactttcacagaataatctatgcatatgtactaatacagatttagacatatgttatcccaaatctggtagtacttttgtagcttttcattttattctagtactaaaattattagaacactagtctttttggaattgatttttaaagtcccctaattggaattgcagccatctttttggtctgtcctccgattgaagaagatctaacagtgcaatcatcatatgacacttaataagcatccttgctgggcacctggtccataagaacattgagaataaatactttcctgacattcagtcagattgattgatgcacatcaagtcaatgacactggggaacgctttgtggatggaatgactacataataacaggaaaactctaggaagatacacttaatgaatccttattgatctaaatacacctaaaacttgtttgtaactttaacctctgccacattatagaggaagacattccaaactcaaactttttttttatatactttaagttctagggtacatgggcacaacatgcaggtttgttacatatgtatacatgtgccatgtgggtgtgctgcccccattaactcatcatttacattaggtatatctcctaatgctacccctccccccaccccccaccccaagacaggtgtgatgttccccactctgtgtccaagtgttctcattgttcaattcccacctatgagtgagaacatgcagtccaaactctaacttttattttattttattttattttattttattttattttttgagacggagtctcgctctgtcgcccaggccagactgcggactgcagtggcgcaatctcggctcactgcaagctccgcttcccgggttcacgccattctcctgcctcagcctcccgagtagctgggactacaggcgcccgccaccacgcccggctaattttttttttgtatttttagtagagacggggtttcaccttgttagccaggatggtctcgatctcctgacctcatgatccacccgccttggcctcccaaagtgctgggattacaggtgtgagccaccgcgcccggccccaaacttttattttatatatatatatcttagtagaagttgaacaaatatttccgaagctgttcagaacaaggtagaattcaacatactggaaatgtgtgtgtggcctgaaaattatagccagctactccagaaacctatagttgtggtgttttggaatttggtgacttggccatggttattcaattaaggaaaatattctcatacttatttttatatcagtctttcctactcaggtccttcaaagaaaacatggttaaacctattctctccccttcatagttgcttaattttattttttccaacccaggaagtcctaacttgtacaagtgtatcctcataaaatactaatgccttggtcatgttatctactctgaagtcattttaagcctttccctttgctaggatgcttaccacaactggatatttcaagtatggaagcaccatgatgtgaagcaaagatgggaaagtagttttatttctgtttgcaaacaaatgatgtctccttcttcactggtattttaggtaaaggcattaggaaaaactactggcttcagagaagaggacttaatgacactaagttgtgtgatctggtgaacacactttgaatcagttttgtccaaatgcatttccctatgtttgccaacatcaagctccctattataacatagtttctagaacagtgctgcccaatagaaggactagtaaagccaccgatgtgggccacatataaaattttaaattttctggtggccatgataaaaaagtaaaaatatgcagatataattttaatattttatgtagatgcaaaatattatgatttcaacaaataatcaatataggaggtattaataagatagtggtcattctttttttgtaccaagtttttgaaattgggtgtatgttttgtaattacagcacaactcagttgggactgtccatatgtggctaacggctactatattggcagacaattctagaaccaagctgaaaaccataaactgatggcaagtgtggaaagagcacagtttgcactctcagactactagattacctagactctttactcttgaaacatcaaatatgaattcatctattaaaaatgtcaccataattatagatgtaggttagcctttcttttacaatgatggggtaaaaataactgatttcccaccagctttccggtgcaacatccattaccataataaagcaaatttaaatttaattagaatgtaattaaaggtaatgtgggtgattccaggatagctgatttgttttactagtaacagaaacgccctttgccacttatatgaagctggaacaatattaatcaaatgacttattatctgagagaacaaagtacagaaatatttacataacatagtaccataggcagaatatccacgttaaactaatgttaagaacgacaaagggaagatacgccagcataatacatcttacttcttttccaataatacaactgggacattgcaaatacccaacttctagaatctgtcaggaagagtaatctacatgtatttaattctctcctgcacatgttgaatgactaaattgtgaaaatatatttgaatgcttttttttagaaatcactatacttctttgttaggttacttaatttttagcataaacccaccaaatcccatgtcaattgttaaaaatggatctattcaagcctacagtataaatttatggtttcccaggaaatcacaggaaagttgttgtaaaaggtattaaaattattgccaataaatcccatgtttaaaaatattctattaaatgtaaatgttgaaagtagtattaataacagctatgttcaaagaaaactttaagggcaaacataaaacaatttacttggaaggccatattacaagattcaaagatttgctagattctttgaacaggtttcgatgggagatgatgatcttgtgatctgtagataagagactctgaatatcaagtgatcagaaaccaaagcagagataaggctactgaaaatagcctatttcctgtgctggtctggacctaggctttggggtataggcaggcctgataccagaagtccgatgtagcaaaaggaatgaaggaaaaagatgaagagacaaaaacatgctgacactgtcattatttctacaaatgtcaaaataaaattcaaaatgaaatcgattttttaattataaaaattcttctgagaattgtttattttcccctccagacataagtaaacttaaggcaaggaatcatatttaccttctgatatgcttcacatagaatttgccactttttatcagcaatattaaaaatgattatgtgatgaatagctttcagtctatacgccctgagagcaggcaagaaaaattattcaaaaaaacaaaatgcttctcactattaaccaaaaaacagcctatgaaaaggcacagtcaaatgatcttggtcaacaaggctaaggcacccattcattatttattgagggcttattgggtataaggacatctaagaattattcaacgtcaagtgttgtgggccaaaagccacaagagaaaaggattttcacttccaagtccagcctaatagttccaatcttggaaagaacgagagaaataacagaggaagagaaaagaaagagaaacttggaggaggaacaaataaacagcagacatgttgttactggagaagacaaaaaatgcagtgagaagatagagacgtaagaaccgcgcaggtacatgcatgtatgcatgtgtgtgcatgtgtatgcatgtgagtgtgtgtgtgcatgagtgtgtgtgtgtttgcatgagtgtgcatgtgagtgtacgtgtgcaaatcaagagacacaagcacagggctgcgtgtgcaatgcggctagctgcgtcatgcctccggaagtacaaaacaccactatttatttatttacgcctctggaagtacaaaacagcactatttatctatttatgtattttgagacggagtctcgctttgtcgcaatctcagctcactgcagtggcgcaatctcagctcactgcaacctccgcctcccgggctcaagtgattctcctgcctcagcctcccaagtagctgggattacaggcgcacaccaccatgcccagctaatttttgtatttttagtagagacagggtttcaccatgttggacaggatggtcttgttctcacctcgtgagccgcctgccttggcctcccaaagtgctgggattacaggcgtgagccaccgcacctggcctaacaccactctttttttttttttttttgagacggagtttcactcttgtttcccaggttggagtgcaatggcacgatctcagctcactgcaacctccgcctctcggtttcaaacgattctcctgcctcagcctcccgagtagctgggattacaggcatgtgccaccacgccctacttatttttatttatttatttatgtatttttagtagatacggggtttctccatgttggtcaggctgatctcaaactcccgacctcaggtgatccacccgcctcggcctcccaaagtgctgggattacaggtgtgagccaccgcgcccagcccactctttttgagggtagggttcacaactgtgtatatgtaaaatttttagtctcaagatttctttaaagtggtaaacagtcatgctgcagactcataaactgtgtaaattcatacaaaagtttagtaaatcttctcaatcccgtttgtataggctttcttaagtgaaacaaaggggcagaaataaacaataggtaatgataactgtggaaaagaaaacaggcagcacagcatgaggaaaggacgagcacagggaagcccaatgggtcagaatgatgtgcaagctcggtcttgcctggttcaacctcatgaacaagagaagatcagcaaacgtgataccccagccacaagagtaacactgataataataattacgattctatcgtcatcattcatgtggaggtgcatgccaggtgctttcgaattgttaaccacccacaagaagcctgaacacctagagttctcctcatcgtgtacataagcaaagggaagggagagagagtctttaattggccccagaatatacagcaataaatggaggagctgaggagtaaggccaactggttctgaaatcctgcctgtggtgtctggctgtaaaactctgactcttgcctaagctgaagtctagcctgggacctgaagtgcagcaactctgactgaagctggatggttactctacttccagtattgtgctcaatgaagaggtcagtttttgagcaaatacacttgactctttgagggagttaagaaaaatgaaattgaaataaagccagaatatacaccagagaaaattttggtgtctattttcctgaaatcacacaatctatcttaaaatttttacaatgctcaaaggtgtttcatcattgcccaccaacttctatcctggtaggtaccaggaaattatcatctctcaggtttcaaataaagcaggtataggccagctgttcttgctcacagtgatactacaggcagtcaaaaaataaattcgctgatgaatgttacctcctagaacttccacgcgtgggacttacacactgatgcacgagtttccattggcatttttgacagcatctatactcctcttatatcaacagaatatgtccagaactactggctttataagagtcgagttatgcagttgctacacagggtcattttgccagtcctttcattcaaaaccatctttggtgactcccttcattgagaacaagatgcaaagtcttcaggtgttcacagtcctttacgattccctttttccacctatttcttgctatactttcccctttcagtatccactcttttctcatcctcctcctctctgctgcggcctctcctacttcacaaacaccagccacagggagcttgtttctaggtcatgcttcatattctcctgcataactgcatgttctctgggataacctttcccctacagcatctctaactattcaggaagctaaccttgtggaaggtccattcaaattatacccgtcttacaaatcctgctctatctcttgctgttgtttggcaacactaggatcctttactgtttgtcagcctcatcctgtttcccggcttctgcaactgtttttctcagtacagtgcagagtcccagagtgcagggtcctaaagcgcagggtcctagagcacagggtcctagagcgcagagtcctagagcacagggcgaacatggttatccacggtgagatcttcttcccctagtacctaccacagtctcccatataggagacattcacatgtatttgtttaattttatgaacaactgtagagcttactctgagaaaagaggtttcatactgacctgtaattggatattctctttctggcctagtatataacctccctgattcaggctgcggctcagagttcttcaaagagtaagtacagttatcactgttgaaagtgactctggctgtaaacatcaaagacgtgatttctaatgttgttgtggctgaaactccgcttaaacactagggagaacaacaagtccacagaagtcacatgtctgttcattaaacgcacaggaagaccttgaactaaacccttcacaaaacatctaacacagagcttgcaatggtgaggagcctctctctcctgcacagccagtgaacaatctaggcttggagagacagagagaagagcaagagcattctaataagcaggtgtctgtgacctcctgagtaaccaaccgtgaaaccaagagataagtacagtcatgggtcactgaacaacgaggacacattttaagaattgcgttgttaggggattttgttttgggaacaccacggaagggacttacataaacccagatggtacaggcgactccacacctaggctctatggggcagcctgctgctcttggctacaaaccggcacaacatgtttactgaatgccttaggcaactgtaacacaacaagaaacatttgtatatataaacacaaaaaagtaaagtaaaaacacagtataaaaggtaaaaaatgggacactcgtctaggaaacatggagtttgcagaactggaagttgctctgggtgatcagggagcgagtggcgagtgaatgggaagacctaggacatgactgtccattaccacagacttcaccaacactgcacactcaggctacgctaaagttagaaaaaaacatttcctttcctctgtgataaattaactttagcttactgtaactttttttactttataaactttttaactttttgactcttttaataataccggtttaacacacaaatgtattgcacagctacacaaaagtattccttcttcatatccttactctatatgctgttttccaccttaaaaaaaaaaacaacctttaaaacttttttctttttttttgagacggtgtcatgctctgttgcccgggttggagtgcggtggtgtgatcttggctcactgaaacctctgtatcccaggttcaggagattctcctgcctcagtctcctgagtagctgggattacaggcgcatgccaacatccccagctaattttttttgtatttttagtagagatggggtttcaccatgttggccaggctggtcttgaactccgtatctcaggtgatttgcccacctaagcctcccaaactgctgggataacaggcttgagccaccatgcctggcctatctttaaaacatttttgttaaaaagcaagacataaacacacagtagcctgggcttagagagggtcaagatcatcaatatcactgtctcccacctccactcacatctggtcccactggagggtcttcagggacaataacaaacatagagctgtcatctcctgtgatcacaatgccttcttttggacacctgctgaaggacctgcctgaggctgttttacagttatctgtttttttttctcaaaaataattagtaggagccaggcgcagtggctcacgcctgtaatccagcactttgggaggtcgaggcaggcagatcacgaggtcaagagattgagaccatcctggccaacatagtgaaacctcgtctctactgaaaatacaaaaattcgctgggcgtggtggcgcatgcctgtaatctcagctacttgggaggctgaggcaggacaatcgcttaaacccgggaggtggaggttgcagtgggccaagattgtgccactgcactccagcctgggtgagagagcaagattttgtctcaaaaaaaaaaaaaatagtataagttctataaaataactataaatacacaaaccagtaatatggtcatttttctaatcacgtactatacataattgtatgtgctggacttttacacaattggtatcgtagtaggctcattgaccccagggtcaccacgcacacgaggaacgcattgtactaggatgttaccatggcgaagacatcactaggctataggagcttttcagctccatgacaatcttatgggaccacccttgcagatgtggtctgtcactaactgaaatgtcatggggcacatggctgtatacatttttttactgtatttgaatgatacggacaattactgacgaccaaaaatagggaggagaggaagaagatgacatggaagtaagtagaaactatttctgaaggagaaaaacttacatgggaaaaagactccttctttgtgccatggatttgccagttgacatgactgaaaagcagtcacccaaacaatgaccaggaggaccgagtgctgctggtgaagcccaccagagaccagcggacggggactgctgctgtgttagcgaggggaaaaacagcctaggacactgcccaccccatcttcaagggcttccctgactctagcaaatcataaaaaccaaaacccataaatgatgaggccaccaagtcataaagaagaagtcaaacccaatcattacccttttgttagatagtatggaaggagacagtgtattttaactgattctctttttttttaagacagagtcttgctctgtcacccagcctggagcgcagtggcacgatctcacctcactgcaccctccgcctcctgggttcaagtgattctcccgcctcagcctcctgagtacctggcactacaggtgtgcaccaccaagcccagctaatttttgtgtgtgtgtgtgtgtgtgtatttttagtaaagacagagttttgccatgttggccagcttgtcccaaactcctgacctcaagtgatctgcctacctcagcctctcaaagtgctgggattacaggcatgagccactgcgcctggcctaaactgattttcattctactagaattaatgttctcatataaagaattaagtagtcagctatatggaaaagtgaagctttcaaaaataacccattccctattgatctagccagcttcagatttataatagcaaacaggataccaaattataacgagaccacaaattcttatctgcagaatcctcatgtccatggagaggtaaacttaagtctcttcaaaatctgtaaatactattagctaattattctgaaactggttgctgatacattttaaggtttctcttaaagttaactcactttctaagattctaccactactggtgggggaaaaaaaagcagtttttttgttaacgtataatgtttccattaagtggaaattcaagggcaggcagatgctatctcttaagagttgagcattttgtattaaaattaaccagcatgatatttggcatctcactgggatgcaaaagggaacattatttgctgctgcgtgccattagtgccagaaacattttttcataaaatgaagagtgcagctccactaatctattagtcctaagccattttagatcataccattgattaactaaaatatttttttttcaaatgacggctgatgacagagcactaccttaaaagtcaaagaactataaattaaacatgaatccagttaccatgttctgtcaaaacaagaaatacatgcgtgtgtttgtgtcctttatatgggccaacataagcttttcctattatttctggaaatattcagatttattagcacacataaaatcctcagactgaaattattataacatttatttcaaactgaaaaaaataccaaaggagtaatctggggggcttggtgtctcatggtggactcctatttgcttttgccccttttcttctttgggtcttaccttccagcatgcttaaacttctagttatagaaacccatggcaacactcactgcccagaataactatgtttactcagataatgaaaagtggtgtgataaccttatctcctgggataattaggttatgtccaaaaagccaggctccttaaagatccttttcaatgatctccatgcttgatacagggcactgactttactacaaaaatatttaaaacactgtggcttttcatactttcacaactttttattttatgttcagctgctactcaaaaaactaactttgtgcagtattccaaccaatacatcatcacataaatacatcttttacacaagcaagtgcacttgaagaaattccagttgaaggcatacaagaacctccaaggttacccaggaaacctattctgacgagttatgtatatgtcaaaacacatgagtctacatcttcataaaactgtgtgactgagagtgcatcaggggttaagctacgtaaacaaacaaaaccagcaataatggcaacagaaatattcacaatattggaatcaaaagtaactatttgtgacatctaatgttgattggttatccataattttttaaagccttcatattaaaaacaacgaaagaaaaatacatgaaccaagtatactatgtaaaatggataaatgaaagcagagaaaagaaagcaagcaagaataaatatctactccaaaacccaactctaaaatgagatgcataggctctttaaatcacaaaatctgtgtggcttactaatggaaggatccttagagatcatcttgtccaatctaccttccaacgtggaaatttattatccatcatacctaataccaaactgacgcagtccagcagaaacactccggcctgagggtatgcactgattccattgttggacagctagctctatttgttacagcccaacttttgacggatgtgtaagacttgaagacattaagacccagaaatgactctatgattatactatgattataatgactatatgattatacctcattataattactacagcctccataaatatatgctactcaaagtgtaaaaagtcacatcaccagaagacaaacataatgtgaacccctatcccaaggataatttatctgccatatgcacaaaacccagtctcacgatattcgagtctgggtcctctctgagaaacagacatcaagatctgatgacatgtgcaagaaatttattgggtgagacacctgtgaaggaagcggggatggattctttggggagttgcgattgttttgtgtcttatgtgtggtggaggtaaaagaagttatgcctatgtaaaaacacatagaactgtgcaccaaaaaagttaatttaactatatgcaaatttttaaaattagaaaatatatatttaaaaatttggagggaggtgtaggaagctgagaagcatcagactgggatacagattcaactctgtgaaggaggcagtggcggcagtgggggcggggaaggaaggaaagaagggacgtagggaaggagggagagagggagagagggagacggggaaaggaaagaagattttaaatatgtgataacacatgatgttccaaaaggtgaagaaaaacaagccatctcacagattgctggaggcagtctacaatggtaaggctaccaagaaggacaagttggacagctctatcaaaattagaaaggcacaagccctctgatccagcaattctacttttaggtatttacatgacagaaatatgtagacatatgtaagatgatgtgtctataaaactactaattgcaagattgcttataacagctaaagctgaaaaaattcagctcagtgtcaataataggggacaagttaagttaaataccttgtgttccattcatttaagggaataccatacattcttgaaaaatactgatgctcatatgtactgatgtagagatatttccactgaatgaaacattgcaaaaatatgctatcatttgatcatctgtattaaaaagatatatatggttgtctatgcataaagtatgtctaaaaaagaagaaagcaacgatagcatcagatgcctcttaatataaaggaactggctgtttgggcaagagaagttggtgggaaatgtcccactgtaaatcctagtggaaaattttgaaatttgaatcatgtaaatatattacctgttttgaaaggtaagcagactctattttaatgaagatgaaaaagatcattctaaatgttaggtgaagaatacggttcattagggaataagtgtcaaggcaggaagacctcttcaggaatggtggtagcaaaacagggggtctccgtggggctgacagaccctgcatacatgctaaagatgcagccaacaggagttgatactgtaactagatataatggatcgggggaaggggactcaggctggactgacttttggcttgagtatccagataaacaatgttggcatctgttgagatgggtatgactgagttacaaacagcttagcaggtgtaagaagacaaaaacaagaattctgtttgggacacattaacgtagagatgtttgttagccttccgaatcaagagagtaacagtacatcggagtccataaacgtgcctactgagatcaacagtgcttttaatttgcggttcttcagctgcagtgagacggggcatgcttcttaggagtcctggtcattgtgatgtataacactgtgactatctgttcatcatgtttgctcatttgcctattgggcattttgttccttattatttgtaagtgctgttagcatattcaagaaaattggcccttttatcacttacattaaatggttttcttcagttcatcaattttacttttacattgtttatatcattttccctagaggaactctaaatttttatgtggtcatatttactagtttttctatggcctgtggcatatattcttttcataatcaggaaaaacaaagacaaatctcatcagtaattattaatgtgaatgtaaattctataacataaaaaatacattttatataatttcagaagttttgtagtacttacacaagtgttgagggcattcattcgtcacttttgtagttaacccactggaatatctttaataaagtaataggatttttctttattccttagaaaaattggatatttagggatattcttcaattcaaagctcatgatcaactaaggattctttagaggaatggtacgtattattttttacttacagcattaaaactcagctagagataacaattgtgtttgcatagcttatttttaaaacatgtgggcacagtgactttgtgcaattattttagaaaacaccaaagtagtatgagagacactgctattttttaaatgctactcagcacaactaatgacttataaaataggtaattatttcctttgaggtcagaagtagacttaaatgttacagcagaaagccaaaataaatgtgattggtttttctcaaaatagtaaattagcacttgactcccacctgcacactggtatttatcttcctctccacaactagtaactcaatttgatgcagtagcagggtactgggatgccacacgtggtttaactcaccaaggagacagctgctttgtactgacacccactacacttgtctttaccccaacaactgttcacattaatctgagttaactaccctttggagcaacctgttcaatctcagttagtcgcctactggagtgcacagacacaggtgattgagatttgagggaaccacagtcacactgacagaaatggaatctcacccactgcatcttcagtctggctggagaacctgaaggagctaaaggcttgttagaaaatcctaaagaaccataatcttctatcgcatatgcaaagcctgttttacgtcaaatgattgtcagtggctattaagttgcattcacacaaatcgctaacaaattaatatctgacattaagaggggtttatttcagtcttttgtttttcttaaattataaaatgaattgctcttttatttttgaaacgtgcatacactttaaaaatgaaagtgactcccctctccacccaaccccctcctaattccactctccaggggaaagtgctgttaatattttggtgtacaactttgcaggctcttaaagctgcattactactcatacatatgtatatgtacgtatgtatgaatatgtatgattgatatatatgatgcacatatcaatctagcctgctgtttaagcaaaaatggtatcatacaaaaagttctacaattccatttgtactcaataatgcacaaaactccttccgttaaaggaactacagttctaccacatttttttcttttggtgtcatggtgtaccacaccacgtgcatatcagaatttatgtaaacattctcccttggggggccattccagttgtctctgtttttcataattaacaataatgcatctgtgaatatgtaccaccatacacttgctcatctatttgtgagagaccgaatatgagaagtgaagtttctgggtcagagaacatgtccacttgcatttctgataggtattatcaaatgccttttcaaatggtggttgttttacttgacattctaccaacaagaaagactattttataaggctgcatattcaaaagttattttaaaagcctcattacatgtaagacaccatatggagcatgtcacaagataaacacatcagtactctcatataaaagtagattttggccaggcgtggtggctcatgcctgtaataccagcatattgggaggccgaggtgggtggatcacctgaggtcaggagttcaagaccagcctgaccaacatggtgaaatcccatctctactaaaaacacaaaaattagccgggcgtggtagtgcatacctgtaatcacagctactcgggaggctgaggcaggagaatcatttgaacctaggaggcagaggttgcagtgagccaagatcgcaccattgcactccagcctgggcaatagagtgagactctagtctcaaaaaaaaagaaaagaaaagtagattttaaggaaaaaaacgcataatcacctactaagaaggtctagaaagtgtgattaactctttaaaatctaataagatatgaactctacctccttgaccacccagtgtctaaagggttattcctggggtcagctttgcagaaagtgcttccttatggagtggttgttagttgactttgccagacagcctctgcgttttcattctctaacggaggctggcaagactttgtatagagatagaaacaccaattctagtttgttccttgagaaggaaggccaagtgactggttttctgaggctgtgtgtatctcccaggcacaagcctctgtccccaggagagcctgcacgcgtggcaggacacatttgtggtggggctttttacgctccctgtcatcactttttatgattttctcagtaattccttttctttactgaggaaatgaacacacataaaactggaaaaacgagcaaagaattacataaaatctacacaaggacttcctggcaaaaagcttcactaacataatagatttaagttcttacaatcagtggttcccaggcctttgaatttcatggaccagaattttttttttaagtgaagaattcaacatagaaacaactattatttgttctttaaaaacatttttgaaaacctcactcaaacaaataacctagcaaaactgttttataaaataacgcctggctgggtatgaggactcatgcctctaatcccaacactttgggaggccaaggtgggaggatcacttgaggccaagagttccagaccagcctgtgcaacaaagtgcgacccccatctctactttcaaaaaataataaaattaaattaaaataatgggtattttaacaccaaaaagaagagttttgcctagacagcctcccagacataagaacagacactacatccaccatttccctttttttttttttttttttttttttggcggagggttaaacactcactaatatttaggaattagtcctctgcaatttttcacttgtcctgataaaatccagattttacaaagtttaaacaccacaaaaatcacagggctgtctatagaaggaagaattcctgttactcttagctgaatattcccaataattctttgactttctttctttgtcttatcaaaccaatgagaatctccaggcatgcatgttttaggtcaaattaaggaaacgcccctatgcctgatcctatttggaatttccatttttactcatgtatgtcccacgacaataaaattattgaaaagcaagtgccaccagtgtggatgcatggtctccacaaatccactcttcactgaggagatttccccacatccactaaggtgtgggtcgcctccagctgcagcgccatacctcatgagatcagcagagctcaggctgaatagcattcctcctttcctcctctctactcacacttcctcagaggctatccagcatgataatgaagaacacaggtggtggggtcagacagccactgactacctctgtcactctggatgggtgaccgtcctctctgagtatcacttcctcctctgtaaatgagaacaatactgctcactgcatagggctgcttgtgtgagaacagcacgagcaggcccacatggtgttggaaaaggccccgacgcatagcaagggacaaatagtgctggtgattgacactagcccctgccaggctcttgggcattaggaatccatagtcaagcaatgaaagggtcctgccctcatggagtttacactctagcaggaaagacaaatatttaataatcatgcaaactgaaattagaactctgataggtgatactaagaagggggtaaaggtgttcctgaagcctggggtctgggtctgtctgtggagatccaggataagccaccactcctgaaactttaaagatgagtaggagttaacaatttggcacagggagaaaggagcaggggtccagggagaaggagctcacccttccttccttccttccttcctcttcctttttcctaaattgtaaatgtcacctactctaaataaggcagtgtcttaaagaacaacctaataatctatgtactggtataaaccttaaacaaagttcaaatttactccaatgcacaaaaattcagttaatctctatgaaacaatcaaggatggcattatattctagaattcttctgctggccctcctccaaagcgacatatgaaaagctgaagcagcatacatttagcttgtttcacagaagaatacttatcttctaagtgcacaaagtaaaacattagaaagggattcagtacagaatattaaaactctgtatttttcaactgcctgcactgaggaaagatagaaaatctatcccacaaaaaagtatgagtttggaccagtttgtttaaatttaacaaaacaaagttcatcatggctgatgaatcaatctttgttttgagtccctatttttacgcaaaaccgcactttgcccgacagcatgagctacttgtgaaataaacacttcaagcctcaaatttcaaaggagttataagtatgttgggggcagcaatgcaggaataactttcccaccccctggtcactatcaacttggagaaaaattatttccaatttgccttctactttgtacccttgtggtgtctcagatttcacagtccctgaaggatgtgctgtccgtgcactcacaaacaccccactctggccatctccactttgctacagatcacagtctctttgcttccagtaacttttctctatgttccagggtcacaacccctcctcattatccccaatttccttggggtaaatttctaagaagtgtctttataccttaaatccttgtttctttttaaagcaagaaaatgctggcatgaggtcagatgcaaatcactttgcatcctcaaagcaactaaatattgtcccattgtagagatgggatgtccttaccatagtgacagtgacagcatactctctcatggctccctgcagagtccttggaagcgatgtgacaggttttcataaagagggaagagaaaaggacttaaaacactgcctgcaggagcctctacacccttattactttctgggttattgcctcatgaggaaaaagaaattcaatcatttgtcggggggaaaaagtgtgctttttcttttcaaagtctacccttttatgaaatatttaagcaaacatttatttacttctaaaccaccaggaaaagaaagaaaagcaaccaacatttaacttcacagaagaaataaacatttcactaactgttatacctttaaatttgttttgatatacagaagatcatgaatacagtcatctatattttcctagtcagtgcaacaaaaaataacactcactaatagatcagaaaatggagatgacaacacttaattccagaatccaggaattttttcccatagtttcctgtaatccctttaagactctaaacaaagtattctaccttttttctttaagaaaacaaaacgaatttcatgcttatttgatatttctaataaatgattttaataatagactaagccaaaaaggaagctggtctatattcattaagaaaaatgcaaccataatcacatttcgtgaatggacaactttcacatatccacactctcaatgcctacaaagtttaaatggaaagatggatcgttcaggaaaagcgttgagagcagcatccagacctcagcactgccctcacactgagcccttcaaaaggacggcacgaggggccaggtgcagtggctcatgcctgtaatcccagcactttgggaagccaaggagggtggatcacttgaggccagaagctcgaggccaccctggccaacatggcaaaacctggtgtctactaaaaatacaaaaattagctgggcgtggaggctgaagcaggagaatcgcttgaacccaggaggcgggggttgtggtgatctcagatcgcagcactgcactccagcctgggtgacaagagtgaaactctgtctcagaaaaaaaaaaaaaaattagccaggtctggtgacacatgcctgtagtcccagctgctagggaggctgaggcacacgattcatttgaacccaggagatggaggctgcagtgagctgagattgcaccactgcactccagcctgggcaacagaatgagactctggctcaaaaaaaaaaaaaaaaaccaaccaaccaaggatggcaccagggaccactttgtagggtgtaaacaacaaattgctcagcataagaaccattttgaaaacacaatgaaggaaaacctgagatcaccatgcttcactgggtctccagggcccagacagaggtgacgcaccaggtgtgcgtgacgacgtcaccctacaacctttagtccaccttcatgctccagccactgcctgcagctgcgcccagacagcacctgactgcagttgccgtgcctcactcactttccgccttcatatgcctcatacactgccagctcgtgggacgcccatggagactgacttagccatccggctcatacacaagcctgggggagcaaggcagctggctcagggggtcaggcttgactagggagaaccagtcttttgggcagatgcctttgaggcccattcgtcacagctccttggaaggtctgcagcagggtccacaccgggtagcttgttgaggtgaccagccgcacaatcagggacttccgggcatggctccatgtcttgataacatgccagtggctagaacactcctgagcaaaagtatcctgtcagcagatcacgtgttccctgagaaataaactgctgctgagaagctactattaataacagatggcggacagtttgctgtgatacctggactgagtacctcggtgcctctgctgtctctgggccatctggatttctaggtgtgactgtggcagacgtgtctcgggtgcagaggaaatggaaacaagatggtcctgcttctgaactcggcctcatgccctcatgccccaagtctgaagttcttttggtctcctcttctgtacttctggaagcttccactagtctcttaccatgctcacatgaactaaaagccagatgcctaaatgactaacatgataaaagattggcctgtaaggccacagtgacaaatgtcacctgaaagacgaaggggaaataatttgcattgaagggtgcgcttgcttatcctcaccccttggctcatccaagtagcagaagagtttgggttgcatgaagcttccaaccattcaatgcaggctgagctccacagcagtgcctaggggagcacagctcagattgtgctgagagccacctctcttgtctcacaggtcccatccctgggctgaggctctttatcgaggaaagaaagaaatgtcctgtctggcctcacacacctgaaagtcgagaagcagaagaatggccgggtgcagtggctcacacttgtaattccagcactttgggaggccgaggcaggtggattgcctgaggtcaggaggtccagaccagcctggcatggccaacatggtgaaaccccctctctactaaaaaatacaaaaattagccaggtgtggggccgggcgcggtggctcacgcctgtaatcccagcactttgggaggccaaggtgggtggatcaggaggtcaggagatccagaccatactgactaacacagtgaaactctgtctctactaaaaaatacaaaaaaattagccaggtgtggtgacacatgcctgtagtcccagctacccaggaggctaaggcaggagaattgcttgaacccgggaggcggaggttgtagtgagctgagatcccgccactgcactccagcctgggcaacagagcgagactttgtctcaaacaaaaaaaaaaaaaaaaaaaaagaagcagaagaacatgtctcatgcacacttgtgcttcctgccccctcccacacccaagggaggaggatggtgctcatgcagaagacatgtaatctcttcttccagagttttttgttttataccagcctatctcttacttcccttgttcggccagcaggataaaaatcaatggacatttctatcgccaacctgctgcagctgcttctcagaaccaccatccctttatgtagaggaagagagaggcaatttaaaatggaaaagggagaactgcgaagaggaaggaccaaaggtgacttctccctttatccttcctgaaggccaaaggttggagacagtaaaaggaaactttgctgggtttgtagaggcaaagagggatattatggacttgaaagaacttttcagatgcggttggttacaagaatgaaaatcaggcagcaatgagccaaggacactcagcaatgccatcagcagtacttaattccacaaatagagttatcaggtgactataaggtactcagagaaaaggttcatattttagatataaaaagatttatctcttgggtctaagaaactacatatttcaaagagaagaataatcagcttataactaa

SEQ ID NO: 850 - DNA, 167041 bp, Homo sapiens
gcttgctcagaaatccaatcacatacatatggtgaatctttggacaatggaacagttttaataatttgggtttaagaaaggaaaaacttttctctcatttttcagtgttaaatatgtgataaggtttctattttacattttaacaggttggggtttggtttcccaggaaaagcgtacttaatccgaacttctcgtacttctcaaactatttttcaatcacaaaatcttgcattacagtgacataattttaaagttttttgaaaaatatacatttttagctgactaaatagaataataattctggcaagtttttctgtagtaggttcttatatctttatatataacttgcaaacatggattgatcttcagacagctaggtaatttgtattaaggctgaaaacaaaagcaatgataaacagacataatatttagtttacatatttttggccctttagttatacatactatagaatggctatatttttgagtcacattaattgttttagttttgctactttaggagcctgtagctctaaaaattgtactatatatatttatagctttgttagtctgctaaaatgtttgtgtttgacacacagctctcctattatgactttccagtttctttgtgaaatcaaagatcttattttgaatacaagttataatcggatttggtggctgagacttaaatagaagaaacagtaacagaaaaatacaacgatttatccaaagtaatgggatgagctttctttttcaagaatgaaaagaatagggtattttttccctaaagcaaagtgttgttttgtaccagtatatgaaatgacaccgtgaaagataaaacttgagagaacacagcaagttgtggaaaatttgagggaagtgaattttaactgcttttgtttataacacctatgtctgaaaagaagctataaaatatattaaaattcacctaattttgattggcttatttgtgagataaattaagggggaaaatgatctcataaaacctatatttccaatgcattaatgcaaaattaaaagtagtctttttcttagttgaattaataaattcatcttagaattcttaccaaggcatagtaaaaatactatttttcccttttgtgtgatatgaccagaaagcagagattttataacccaccagaataatctctgctttgtgttgattctagcatagtgttagaaaataaaaatctacaattatgaaaggcaaagtttcctcacttgtgaatgaaccaagattccctgcaatcatattacatttaccaacaattatttttgaacacttgttaatttgattaaatcgataattaaaggcacctaggattttattatagccaaacgaccaagtctactctgacaactactttaatttccccccagccccatgatcagatctaaaatttaaaaatatagaccataaaaattcaacaatatactttatacttaaaactggctttaaaatctcccacaggctccctggagagaggagctggaaagccttaggtttgtttcaagggttttgtatttcttaatcacctccccactacagaagagctatggaatgagctgtcaaatcagaaggacgctcagccttccctgggttcagtttgtgtacatgaaatgttatgcacagaaatctgttactaatcgaacattttatgggaagaccaaggagagtcatcagagcccatgctgtccattatatatatgttcttactctccggagaaacattgatcaaactcttataaaatagtcatacactgtgtcacaaagggttattttacactcgtcattctgatattgctggtcactgtagtaattaatccagccttttattagtatcaaactggtttctgtctccatctgatgcttgcctgagaactgtgctataaaccacaggcctggggttgtatcttcagcgtatactcctgtttccagacttctcagaaaggagtgtgccagatactctgaactactgatacttcaaagaatagactcttgggtactggcgttagagctgacatcagctcaacaactttcagactgtaccagggaatgaatcagaatttccaggacttattttagtctggaaatagatgttcttcatgaaactagcacctaacccaagatccaaaaaataacaattaattacacaagaacaaatgaactgatgagttaaattatggctacttattttgaatgtttttagtattgcatttaatgttaatttttatggatatatgaagttctctttcttcttcatcagtatcactttggatataatagactattgcttttgtatataattttttttttttttaagacagagtcttgctctgtcaccaggctggagtgcagtggcatgatctcggctcactgccacctccaccttccaggttcagtggattctcctgcctcagcctcccgagtacctgggactacaggtgcaccaccaccacacccagctaatttttgtatttttagtagagacgaggtttcaccatgttggccaggatggtctcgatctcttgacctcgtgatcagcccgccttggcctcccaaagggctgggattacaggcgtgagccaccagctgcttttgcatataaaatttaaaaaactgtaagtagtatctgatttttagcatccttcgaaaggcagaaagaaatacttttactgattctccttactttttcatgagaacatagttattaacataggttcaattaggatttgttctcatcttaccaggatacaattgaacaaattgattatgcaacaaaggatacacatggagaattatatatgagaataaatctcacttcatcaaacacagcggcacgctagtccggaaaactgacgagacacgtagctagtgcctacgaagcccagtggacaaatcaggtttactacctggctattagagtcctgttcctgagaacttcaagaagaaaggaattcatcccaatttatatatacagtgcaggcaaaatatggtggagagaatgtcttggaattgtttcccgagctttgagaaagaaaagcaaataataaaggcttttaaaagtcaaatctaagattccttaaaaaaaaatctcaggcagaattaattatctgggtcaaattatatggctatagatttgtaaagcaaactcaagcaggcctatctggttaattaacagtctcattggaactatgtaaaaaataaggccatgtttcatctggatgaaaatagcatttttctgtgattaaaacaaaacaaaacaaaacaaaacgaaacctttgtgggctaggtgcagtgtttaacgcctgtaatccagcactttgggaggccgaggcagagggatcaccttgaagtcaggagtttcagaccatcctggccaacaggtcgaaatcctgtctctactaaaaatacaaaagttagccgggcatggttgcaggcgcctgtactcccagctactccggaggctgaggcaggagaatcgcttgagcccaggacgcagaggttgcagtgagccgagatcacaccacaggactccagcctgggttacaacagagcaagactccgtctcaaaaacaaacaaatgaaaaccgttttgattatttataagggggggggcagggaatggagtgtaaaaaaatagccacaacttagaaatgggccaaatagacaactagatgtccttttggtgcagcgttgagcttgttttcctattggcagggagctgtaccactttgtagaggctgagataccttgtacatttttgtttggtaaagatttccatccagtgtaacagataaccccaaagtcaatggtttaatatcctcccatttatttatctctctcacacacacacacatgctagaaagaacttttcctttgatcctttgatgagtacacagaagtacagagagttgtataatgagtaaccatcccccagattcaattataaataatgtgtaactagctggttgtcccacttccactgatcctaagattgatcacatggcatcagccagattcccttcacttatatcaacccattcactttcatctaattgtttcatctatttatatctgttggcagaataaagtaggacttgcaaaatggtgaatatctaatttcgcaatgcatctccaattattgtctgaaacttctctgtaaagaaaaattttcctcaactactagggctatttggttaccttgaaatagaattcttacaggaaaagctagataaacccttattttatttttttaattatcaatttcctgagtttgattttagggctctagttatttccaggagtttctaatgtatttgggttttttagcaaaattatgacttgttaagtcttcaataacttttttgtcttagattacacttgttttcatcttggattatcccatcttgggacactgaatcttcattagcccctgtgtccttcaagtatgtcccttctgatttcataatctccactagctttcaaataagatagccacacaagatacacaaggttcatcttgcatatgatttgtcccaggcctaaaatcttctattcttcaatgattccttgtcttttttagttaaaaacagtattaagagaccacaatctgagtggccacaaacgtactcctagttaataggtttagatgaatgatccagacactctacctgaaaagaggggagagtgggaggatcaggagacaggaaaacactagtacatgaagtgttaaaactggctgctcatcagaatcacctgtgaaaccttcaacatagagattctcaggcctcaaccattatggaatatgatgatcaaaggggagcccaggttatgtaaaaggccctaaggaaatgaagtcactccggggcccactaggcgggagtgctgagttacagtctccaagcagccacatttccagaccttgggatccagtatattagatatgcttagcagttgaagaatttctttcttatcttaaatagtaatacatattcattctagaaagttcatataaaccaaatattcgaaataaaaataagtcacaatcccatcacaagaagaaactgctattaaatcttgcatctgcattttaatattcttctttatgtatgcacatgcataaacggggatatatatggttagttattttttatagagtaagatcacaaactactcagtaatttggaattgaattttgtcatgtggtgtctttccatgccattaaataatattctcaacatcatcttcaatggatccatagtgtttcattttatagaactgccaaacattcagaacctatggttgtacctcttgatagttttccattttttactaatataaacagtgttgaacatccttctagataatctactgtgtatatctgtaatataattttatcataaactctgagagtataaatgactaagtcaaaaggtcgaaattgcattttctcttgtgagaattctaaaataattccctatcagtttaaagtaagaaaagtctagggcacatgaaaagaactagaaatgaagaagcaagtgtgcataaagagggaaggaaacatgctgactcttatcttttagagctgtcacacattgaattttaatgtttggggaaataaccaatgtagctgttaggaagctgtgattcaaacatggtagcactaaacgatacatcactgtattgggggcaggtgcaacataaacctcccatggatatttgtcaggtgaagaattcaggaataaggtttgcctatctgtatatagaattttgaagtcagggtaccttctagtgttgactgcaatggttaagtcatctgtctgtctctgacaaaagagctagaccctgcttcaggaatgcaaacttctcccactgctatggtctgactgtttctgtccccaaataattcagatgttgaaacctaatcaccaatgtgatggcattcagacataagaaatttggaggtgattaggtcatgagtatggagccaccgtgaatgggatacgtgctcttacagaagatgccctggagagctgctgtgctccctccaccatgagagggcacggctggaaggcaccatctatgaaccagcaagcagccttcggctgacatcagctttaaaggtgccttgttctttcacttcccagcatctagaactggaagaaataaatatctgttgcttataagccactgactcattttgtattttgtcatagcagcccaaaggggctaagacacccacaattgggaatcttggatgagaatgaactatatttcccattttcaaaaagcttatcaatgagtgaataaacaaatgttgttttcattcatttaacacatattattaagttagtaagcatcaacaatgtgcccagcactgtgttaggtactgcaacagcccagagtgagaggaaatgcccctgcttcctggagcctgccttccagcgggcagcctaccacctgcgtgtgctattctggtggccaggacgctgttgtctacagtaacctggtaaattaactatgttaagagagtactttttctttcttcacagaaacaagaaaaattatttgccgtggagtccaagagaggagcatatctatcgaaatggtaattgaaagagaaactggaaacatcacctgtatgaaaaatagtggatggctctgttaacgaaacaggcatgctggtgacaacaggcaacaaatctaatctaatctaatctaatctaatctaatctaatctgtttctccataataagcagcaatcatacaacccactaaatgactgctgttgcttgtcactgaagatgtccatattttactgggacataacatttcttcttggcatgaagagaatggattaagcaaatgaataaaagctatggttctactttaccagcacaaatggacaaatccaaaataaataactgttacagcaactatgctaaccgtattaattaaaatatgcaaggtatactcattctcattttcataaaaggaaatcctaaacgctcaatttgaagtatgtttcctcactatttgtaggaacttctagtcctagaattcttggtccacctttccccaagattgtattcatttgttaaatatgagacaccaccaaaattgtaatgatgccacaatgggagagttaatgaagtaaaaaaatattaaatgagtcaactattattaaaaaagaggcaacttcatatccatcaattagaaatcaaagagtctggctggctatttatcatcaaaaatcttttattggtataaaaaagtccacacaataagcagctttttaaaataaccactcaggccagagtatcactcaccaagctgtgactttatgttctttgtaacaataaagaaattacatggcaaacaacaatctgtgaaaactttcaaatcatactttcctaagctatcgctctagattaaaatgtttgccttagttttcagggggttagagaagagtgtcttatctccaaacagaacaacttcatgaagatgcatacacactttcttcttgcagctaaggaaggaccgtctttgactaggtaaagatccatgtatttgaatcatgaaaatatccaaaaagacgggctgggcatggcggctcacatctgtaatcccaaatactgggaggctgaggtgggcagatcatgaggtcaggagtttgccaccagtctggctaacatggtaaaaccctgtctctattaaaaatacaaaaattagctgggcatggtggtgggtgcctgtaatcccagcttctctggaggctgagggaggagaattgctttaatctgagaagtgggggttgcattgagctgagatggcacctttgactccagcctgggtgatagggtgggactccatctcaaaaaaaaaaaaaaaggaaatatccaaaaagacacattagcaggactcagttcccagtgtgttgtttgaggcactgaccctgatctgaaaacagtgctcagttgattcaatctgaatctgtgtccaccgtcttcctgctcacttagaataagagctgtgtttgcattgcacaatgaacacccacttgctgaaagctaacttgttcctaactgcccccatccttcatccactgccagagccagctttgttaagccccctgtgacctatatctgtgacctatccctagctaatcttctctttcaaaatatgaagtggggtacacactcatcgccaaagggtcctttgagcaagtcccagtagaaaatttatccactttttggatgaagtactcaaaaaagagtactacatttcccaacataaaatggaaaacaaatacatatgccatacatcattcagggctggaaaacaacgaaaatgtaacactccagaaaaacagccatgggaagtattattcctcatgccatccatcattatcatagagcacccactattctaatttagctccaaatgtgtggtggaggtgatcaaactttaaaattaagtaaacaaagagattcatacaaaaataaaataaaataaaataaaataaaataaaataaaataaaataaaataaaaaccctgaccccaaaactagagtaacctgacgtctcccaagtatgggttggggacctagcacctgttctgggggcaattcaggcaggtagccctggatctgtaaacctaggtagtattttagagcctgagcacaatattgggcctttgtacatgtgaactagaaagcaaagggataactgaaatggataacagatagtcagcacttggtatattccaggcctttctctaggcccttgtcacgaagtatctgacatcaacttcatgagttaggtactttttccttatctctgtatgagaaatggggaaactgtggcctggtatgtttaaaaacaaaacaaaacagtgcactattcacttgaggatcttattaaaatgaaggttactgattcagtaggtctgatagggggccaatgattctgcatttctgataaactcccaattgctgctgctggcccacagatcacactttggactgcaagaaagtaaattctccgagtcctagaggtagcaagaagtagagccaagacgggctaagttgcttggctccggggcccacacttactgccagtcggcttagcatttgcatggcagacacatcacagcccaggtaccatgaatgcgctcaaggattcaaaatcaatgtctgtcaccctttttgactgcattttctagcaacaaaaattctgtattcagtgcgtagtatataccaggaactgtggtaaacactggttcaaacgattttcatttaatccactgaagtaaattatcggccatttgattcccttcttacaggaagcaaatcacaaccccactgatgcactgggactctagtgagtttaattatcatgcacagaaaagattgagcattaatttgcaaagaattagaatctaataacacacctctaacaccaaaggtagtcaacctttggggattgaggaagaattgtaagatcttacagagcatcagaggtatcatttggaaaattaattatagtcaaatagatgaagaaggtgtaggagtttgggcctgattctgtgaaattatcaaaaagtactctaaaaaagaatgtagtgatattttccttgtcataagggtttcattttctattatataatagatattttattaattctgtttttcttacataagtagaccataaattcttgatttatgtatgaaatgtttggaagctacaggtcatacaaaataacaccttctataaaatttcacaaaatttccattagtccttatttactcagaacaaatttagaaagattgaaaagagtgtattacagacagttaaattctaccacttaatttgaaattttttctttatcttccctttaagaaagtggaatccagcagcctgcctgcatttttggcagactctgcaataattacgatgctcagatgattcccaagatggacctccccagctgtaaataccctgcctccacgctcattcctgtcaagtgcagatctccccatcttggcatatgggcagtgtcctctgaaacacttcagggtttgaagagtaaaagatgtaaatgatttgcttcactggccatgtaggcctccaggagagggacacccagacactaccatttgtagaggcctgtcgttagaagagcacactgtccagccaggcctcatggagtcttgaatgcaatgtctcccttccccttgaaatcacaatatgaccttgcagaggtgacttcagaaaaatcaaaacattttgaggctccctacaagtactttacttaacttcaacaaccaatgctgtcatttctcacctactctcccccacagttactttttatttctttatgtttcaaaacagataaccaaccacaaaaagcaaaacaattcccacagaggcatgaacccaaacaggcacgaacaaaagcacaaggtagacggggccagcctcagcctgtgctgccccggcatggtattcctctccgcagctttttgtcaattgcatgctgacactccttcccgctctatttcatgacatgtctcctctccttttggaagcatataagcaaaaacatggggctgggtgtggtggctcacacctgtaatcccagcacttcaagaggccggggtcagtggattacctgaggtcagtagttccagaccagactggccagcgtggccacagtttttcttttttttttctcaaaagcaaaaaattctgaaaaagtagtataccttgtgatatagttttaaaatctgactacttggctgaaatcaattaacatgactcttcaaaaaggtccattttaagactatatctactttctaaccaaaacatctagaggaaatgcaaaatttcctttcacctgatagctatattcaggaaaacacaggctactggatattttacataagctctgaagtgagacggtccctgggtacggcttgaattgtctgggtcggttcctcaagtggtctctgcagtttcctcatctataaagaggatatgaacatggtctaccttacaaggctgcaaggaattaaaagaggtatttcagggaaacagggtttctatagtgccaggtttgcggcaagcactcaccgacaccgcctgcaggtatggcccgttcgcgatgttctgggcagtgcagcagttctaggatttgaaaaccttccgggttgtgttgcctccaccctttcctcctgcagttccttcacaagcagccagcatgaggcttcctgaagtcagatcatgtcactccattgttcaaaagtcaaattttctcaacagggtcaaatcctgggcccagcagaccctacctgacctctccaccctgccctttttctgacatcctcttctccgagctccacctgctccaagctccaccccatactggctgctgcgttttctgggcgggggcctgcctggggctcacgagttgctgtcgcctctgccatttggcacacaaatggatgctccctgagggtgccctcctcacagtttagctcatcacacaggcctcgcggctgctgtatattacggaactccccaccaatactctttgtccccttgactctgctgtttctcgatagaacacacacttactagctgctccaaatagaatagctccgttgaggtaggcatcttgtctgtttctattttctgctacatcccagtacctggcactgtgcttggcacagagtaaggactcaatcgttatttgtttatgtagttcgttaactgtatgacggatattggaggagcctcctatttttttgctaggtccaatagcttcatctcatctgtcaggagatgatgaatggcgcctcatttaggaaacaccaataacacatgaaggtaatttacacacaggcaccctggagcccaggtgcagctcaacgttcttattgaaaatgtagtaaaaatagattttattcactgaccatattttaaggaatactattttttactatttcgggcagtactactcaaagcacagcccctgggcccgcggtgttagcatcacctgggagcttgctggaaacgcaacttctcagcttccatccaaggccaactggtctgggcccagtcatctgtgcttttataggtcctcaggtgattctgatgagcactaaagcttgagtggcactgctgtaaaaactacttcaatgactcgttccagttctttgacgtcctcttacaagtctttagtgtgacatgcttgcgttcttagtaccaacagtgtaactggttcttcatgtacatcatgttatcacctctcatgttgaccacttatcttttgccaactaaaaatacttgaaaggcaccttctcgggtttcagaagtttccatttgtttcgacaacatatgaggctacagcccagctattcacccattagagccctcccacgtccagccagcacttatattcttcgaagttaaaattgaagactctggaagcacagaaaattgggatttcttttaatctctttttctgaggcacaggttttcaaacattgtataaccaaggatttttttcatcttttcaaatgatagatgttttatgtgtttaatatgtgaagtacgtaaagaggaatggtctcaggctgctgtgattggcttggtgtgttcacctctcaccgacctgcctctgttctcccacccagcgtccgattgttccgtgagaacaacaggtaggatccataattgtaaggctggaaaaccttagccatagggcagagtttctcagagtatggtcagtaccaacattttggggcctctacccccagacaaatacatcaaaatttctggtcacagaaaaagaatgaaagaagattttttttctcgccattctggccatcaaagaaacatggaaaaacatgcaagataattctgcacatgagagtctgtgaatctctgctctagtaactttacgctatcatttttagtgaagaaaaataatcatataggcatactgtttgcatatagtcatttcaaatcattccattcagtcttaactcaaaccaagaatgaaccaagacatttgaagagatgaaatctcaatttctctgtataattttaaataaagcattcgctctaaaagctaaatgcacaggagttctgttgaatgactgactatgtttacaatttgaagcaatttagtaaacatgtatcaccactcttctaagagattttggggaaaactacagttaattggacaaaaactccatcctcaaagagattaaaaggtgaagtcagaactggagtacaaaatagcaagtaataagggagagtcctaagagttctgaaaaggattccctccagttctaatgagcaggagaggattacttgtagtttagctgttagtttaacacagagttaaatctgaaagttgacctgggatgcaccatctctcttttcccaatctttacagatgcaacatatctttacagaggccttttagtagcagcatgtagggtgccaggaagttgcccccagtgtgtagtggtgcagggagaagtgttaggatggcaaccctgcagcccccaactgcaccatgtagagttgcctgagccagtccctagcctgccaaaagcacaaggctggcaggccacaagacagaggggtaaatgagaaacagggtgatcagaggttagatgtgactcagacatgagtggaaagtcaaggtgaaacagcgcatcatcatagatcatacagtactctgaaggctgctgtcatttaccacattccataaatttactagaatttattctctattgtttgggttgaaataatcacacatttcaatttaaaaatataaagagaatattagacatttagcagaattttctcagtgcctactggtacttcagaccctatatagagagaatactatattttcttaaaatattatggtctagagagagagagagagtcagttgaaagtgtcaataattctaagttcattctcataaaagaaaattctggagaagaccaagggcaattttatgataaaacaaaataagaagactaaaattttcagatgaatatggttgataagagagtagagccagatgcactaggaaatgtattaaagaacatgaatatgtacacaacaggattcttgtgctcaaattgtttttaatattcagataataagtaaaggtttaattttgctctaaacaatgtgatttttttatttttagtaagaattttattttgggaaatcaaattaaagaactagtagataggtctcctaacataataaatccaatctgttatacagttgtacaggaacaaacatagtaaatatagggtttggtaccatttttggtttcaggcgtacactgggggatttgaaacgtattgcctgttgatggggagggacaactgtacatgtgagacacccagaaaaaatgcataaatctcaaagaggtgcctaaaattcaggcttgaataccatcttcaatggcaaaggaagaaagggagaggagaagacaagagtaaggtttgttaggcagattattcagttggtgccttctcaaggatcagagtctccagagactctgtcctcctcatcctagtaaggagagggagacacccttacaaatggagacttccttggtagatataaatttcccttacaaaagggtcacttctactctgtttttagagcttttcctgtgtctactgtttctcaaaataatcagcttaaaataatacttatgctaaagtggcatattttggggtggcatattctggtctcatacacactcaaggtggaattttccattgtttggtttataatgttggagcatgagtattctctagaggtgtcagtgtcagaatgatcttatacatactctggttgaaacgtcagaattgttatgggcttgggttcgatatttatattaatatattattctggtcacaagagtattgcaggggtttagatttatctcatttttccccatttttgacatttatttccatttctcaatttttctttccagacctgaggtgcccagctcacatgaagcagagcctctttccctcccacaatcatctcaagatcaccagagcatcagttaatgccttactttctgggcttatctactcctgtatttaaagatgttgtttctacattttcacttgtccttggaaattatctttttttattttttgcaagatcatcgaaaatttttaagttccttaaattttatttagtaagtttagtaggaggcatttcttattatgttaggcttccatcttgcaggccccagaactttctgacactgtgaaggccataccagcccacaactgccaggatctattgtatgtgggaggaaaatcaacttctaccctgtaaagtcattgtgattattttgtgtcttctgtcaaacacagtaaaaattaattctattacacctttgactatttagattagagaataaaagactaagaggcacatattaatttttttaaaataactaaacaataacaatctttgccaaagaaaagcattttgaaatgggtggtagcatagagagaaggaagagtcctttcacactaaggatgtcattgccattggcatatctggctttagaaactacaaatggctcgattagctttagagttctttctgctttttagaatttttctacatcactagaaacatatctcttatatttaatctcaatatgaaaacctgtttcatagtacttacaataaatgcattctcaaatgttacatcaaagtactccacctacagtgatgtctccttgtagtgaattagagactccaatccaaaacgtatcataaactaaatatgcacccggtgaggccatgctccatgcagactgcactaaacaaacaaacaaaatgctttaataatcttagagcattccaattacctggacttccagctggtggtgagtccttcctgctgtcagtgtgcagaatgacagccagccccacagagtctcctgggaggactgagctgctgaggtccacccgagtcaagctctggggctcccgctcacagcctcccgccgcgtttctggggtcgtcgcctccagttgcattcatttcttgaccttttctccacggtctctgcacaatgtgaacaatgctctgctgatccaggtcacaattctgtttgggagcaaggtaaaaaaaaaaaaaaaaaaaaaggaaatgtcaaacatgaaatgcgagatagagtttaacttgccctccgtggtagaagggaagcaaaagtgacatgtaactgaccaacttaggtgctcctttgcccacagcagttacacactacacacggtagacaaacaacactgaactggggccagaaacagaaatttgggaatacgtgaaacacaatagaatgctgacgtcatattcaaaaggacataaaatctagcaggaaaaaataattaccaaactggatctataagcacagtgaaaacaataattccttttttccccccaagacagagtctcactctgtcatccaggctggagtgcagtggtgtgatttccgctcattgcaacctctgcctgccgggttcaagcaattctcctgcctcagcctcccgagtagctgggattataggcgggcaccaccacacctggctacgaaaaatattcttaaatagtaaaactgattgacatcagaattgatatgtcattcatctctgttttacaaaagtacagaaagtgagttattatcaatgagagggcatttctttaaagcatcggaaatgaatgcgtttgagtaggctccacacacaccgctccacgggcaccaacacacacatcattacactggtggggaagcaagacaggagcacactcttgccacccagggttcattctctttctgacgatttaaccatgaaaaccagctaacatttacgaaaaggttttgcatctacatattgacacgtaggaacagaagactttaacattttgtagcataaaaattaaaagtcagattatttgctagcacaagaactaggctaccctaaatggaattctagtttcagaatatctactacatagggccggccgcggtggctcaggcctctaatcccagcactttgagaggcctaggtgggtggatagcctgaggtcaggagttcgagaagagcctgaccaacatggcaaaaccccatctcaactgaaaatacaaaaattagctgggcgtgttagcgtgcgcctgtaatcccagctactcgggaggctgaggcaggaggatcacttgaacgccacccccacccccccaaccaaaaaataatatctactacatagaagcagttactcatatgcttgctaccctcttaagacacagcaaggaccttactctctcagtaaatcgatgtggccggccgcagtggctcacacctgtaatcccagcactttgggaggccaaggcgggcggatcacttgaggccagtagtttgtgaccagccagggcaaaatggtgaaaccccatctctactaaaaatacaaaaaaaattagccggctttggtggcatgtacctgtaatcccagctacttgggaggctgaaacaagataattgcttgaacctgggaggcgaaggttggagtgagccaagatcatgccactgcactccagcctgggcaacagagagagagactctgtctcaaaaaataaaattaaattaaattaaatacaaataaaccaatgcctttcaaatacctcttgccattgtcattttaggaatgctccaagaacactcaagtgaaatgcatccataactcatagcgatgaatgatgcccttccctgctgctttctcaagctcttctgttgccctcaccatcaatgtccctcgaacagtggtgcccagcactcaccaacacccctgaccccaaatacaatggctagaatctgcctcctccacccaggagggcaccaggacacccttcgtccttaaatcccattccaacctcttctctactcttacaccctggggctccgtctcatccccaggccctgtgcccctccccattctcagagctcccagtctctccctaggactgctcctactcagcagaggccactgtgcatcattctctgacctgaagtgctcccctgcatgacttcccagtttctgtcaaaggaaaaaccatcccccacatcacccgcttcgagccttcccctcccacctaaaaatctcattatcctcccatgttttgtaacgggctgcaagagaatcactatcttgaattcctcctacctaatctttgacatcggcaaggcaccaacagttagcaattctgtctcagaattacccttcacatcttcaactcttttacatctcaatagtcacctccccgttttaggccttcctcatgataatagctttgtaattactccccacatctgatatcgccatactccagtccaatacatacaagaattctgggtgtgtgctacataatctttctaaagtgtctcagtattacttgtaaaatggactgtaacatctcccatgttcttcaagtgtgtttgtacttttttcctttctaaatcatgatctagatttgatttttcatcttccttacccctcctatatgatacatgtggcagattaaactattcttcaaaatcatgcacgcctgtacattagtgcgcatacatcatgctccccacttcctccctgcaatctgtgtccagccacatgaatggctttggccaaagggatgttagcagatgtggttgaaccagggccttatatttgtcccgctgctaaggtccatcaaaagaacatccctgccaggcacagtagctcacccctataatccaagcactttgggagactggggtgggcggatcacttgaggtcaggagttcaaggccagcctggccaacacggtgaaaccccgtctgtactaaaaagataaaaattagccgggcatggtggtgcgtgcctgtaatcccagctactcaagaggctgaggcaggagaatcacttaaacccaggaggcgaaggttgcagtgacctgagatctcaccactgcactgcactgcacagagcaagactccgttgcaaaaaacagaacttcccagaaagcttctacctgttcacacatggcccagacctgagtccaacccactgaggtgaccaagtgcagccacactcacagcatgaagcagggacccgcagctgaagccagcctgaggccgcgggcaccctcgctgacctgtaggcacatgagaagatggcatacttttatggcactgagatttctgcttgtcctctaatcaataatggcagacagtcctctattttccattctatttggacaagctatcactgtccatgatcagctccgtgtcaggcagcactcctccagctgtgcacagcctctagcctaagtcgtttcagagaaatgggcatcaggatccgagtatactcaaggacttgcacaggagcatgtgagctttgccacagaaggaaaagtggagaattagcaccctagcctatcttgaggtttctatccacattttttccctacctttccatgttcaggactcagttacttcctgtgatcctcctagagaaaagtaacacctttctccctcatctgaatctaaaaatctttgcttactgtgctcttcttattgcagtggttagagcttggacagtatatacatatatattgtgtgtgtgtgtgtgtgtgtgtgtgtgtgtgtgtgtctgtgtctgagtcttatcttccaacttattttagaaatacttgagagcagcaacttggccatagtagcattcatcagaacacctcacacagtgctttggagccaggagatgtagaaacatatctatgaattctaaaagtttgaaaaagtgaatgactgaagggaagtaagaaagaatgaaggagtgaatgaatcaatgaatataaacagtcataagctcagtgcccaaagtgccacagagggaaccagcagaacaagaaagaaaggacacagaatttaaagtcaaacggactcaagctctacataatttattagctgtatgaattttggcaaatgattcttcctttcccagctttctgccattgacaataatatatcaactttgaaggctgttttgaagatttaaggaaatgtaaagagctcagatcccgatccgcaatgatacatcgttggtagtattgttaccatttatgagtttcagaaaactaaagaggatgggtccctaatcttgtacatgaataaggtgtcagaattctgtttagctgcacacttctgtttggaaaatatacagagaaggcagaataagcagaagctatcaatgtgacaatctctctggtagcattccaactttctgtgaactaaaaatcgatacaaaaaaataattcctatatcaccatatagccagatgccatgaaacacgtgaagaacctgagtgaattttcagggacaggtaaaatgtgacaaatgttgatgaaatctaaaagatttcaaatccagattttcctaatgctcagggtacagctgcaaaggggaaaagaaagttctcaaacagatttcagtagttacagtgatacttataggacgcatttccctcagttggcatccctgtttctgaaatcattaattgcttaatctttgactcttacagaaaatcttcttggttccagaagcggtgcctttgacagacagtggactcacacaccacactggttcagttcaaagccacattccatggacagtacattggatacagtccagttgtacagccacgcaaaagccccaaatactacttagttctcctagtatacaaaaaaattcctcagatgtgggaagaaagagattttcggtgggaagacatcagagtgctccaatatggtttcaggctaccttagagcagaaacaatgtcttatttatctttgtttctccaataaataaaatattacctgtcaaagagaaaacccttaatacaattctttctttttttataacaatatattaatccaacaagtaaggcagtaacaaattcttcagtgtagacaaaccaagtaggtatttctgtaaccgggtttggtcttacactgtcaagcacagctgatgacccatgggagactgagggatcagtatcttgggctttctgtctataggatccttgacatggaaacataccagtattaacaaaacatccatgggagttttttttgccaaacaatgatcaactctcatctggttggacattatccaataatatacaaaaaactgatgtatttttctttttccaaaaagaagttccttcaacggcacatagttaagatccaaatatttcagattcttccaagcacttaataaagagttacaaatatcatctctaaaatgattaataatgagattctaaaattgttaacaataccacattattaatacattgttttcaggagttatgaaaatagttatgttaataataaaaaacatatagaatatacttagccgtatattgcagaccattacaggttttgagacataataaattatttattattctcacactctgatgagggaataactatcaccatctgctatgtctcaatgtgtcctcaaaatttatttgtttcaacttaaccatcaatgtgattgcatgaagaggtggagcctctagaaggtgattaaatcatgatggggcagagccttcatgaatgggattagtgcccttataaggcagtgcaagtgactttctgtcctttttgcccttttagctcttcccctcttccagcaagtgaagacacaacaagaaggccctcaccagacactgaataccaacaccttgaccttggatttcccagctttcagaattttataaattgcccagtctcaggtattttgttatagcaagacaaagaatacaagacaacatacataaagttagtgtgtaaacagagctagaaatagtgtgtaaatccaagagaactgtgcctggcacagataatgctgttttacagattacttattgtggttgctgttgattccactttatagaagacaaaggggagccacagagaagttcacgatgggttcaacaacacccagctcccgagtgtgaagccagggtaggaacccaggccatcgactcctctgctggtgttcattgactctgctgagaggaagtggagacttggatgaggcagacaaactaggacaagtctacaggggcccatggtgaagaccagggtttggatgctgcaacggaaccaccccaggtacgaaggaatgattcagagaagagccagatagctgaaatgttaaaaacatgagaagacaggatctgggacggggctgtataggaggtagcaaagtaaagattagtccagtgtgattttaaagaggaaacaaaacaaaacaaacaaaaaggatgaaagtaagaacaagtgggttgcagaggaatcagtgagagtatggaaagtgaaaagaagatggtataggtgagctggtaacacacctcgcagactccggatgctggtgctggctcaaggtaaagtctgtacctctggagatcccgtcaccccagggaagactgcacttatcacgtcgtattgtagtttctttgtatgcgttgctctctgttaccagacaataccgtctttaagaaaaaatactgcaactgtgtctgtagtacctactgtagggacctgttcataaaacacactcccctgtgtctactgaatgactctatgatcctttaagcacatacctagaagtgaggaaacattccagatggcgttagtaacttacccaagtcaagtctgatgcataattgggaaatgaaagagccaggcctgcagcctcagttttctggctctgagcccaatgctctatttcaaacatcccaccttggattgtccacctctctgtgctcacgacataagtagacatgttggcagaagtgcccagccagtgtgcttttatcagcatactgatcagtctatactcattggcatacttactgtaccactgtctatggtctgtaaagtaggtagggctgtcttcaatatcttcagtatcattcattcattttcagttccttctaaatctgttaaactctatttcctcatacaaaatgcttaaaatcatttcagtgtatggccaacaaacatatgaaataatgtttaatatcactagtgatcagggaaaggcaagtcgaaaccacaatgcgataccatcttactcctgcaagagtggccataataaaaaaatcgaaaacagtagatgttggtgtggatgcggtgatcagggaacacttctacactgctggtgggaatgtaaaccagtacagccactacagaaaatagtgtggagattccttagagaatctaaaagcagaactaccatttgatccagaaatcccactactgggtatctacccagaggaaaagaagtcattatacagaaaagatacttgcacacgcaagtttatagcagcacaattcacaattgcaaaatcgtggaaccaacccacatgtccaccaatcaatgagtggataaagaaatcgtggtatatgatggaatactgctcagccataaaaaggaatgaattaatggcattcacagcaatctggatgggattggagactattattctaagtgaagtaactcagggatggaaaaccaaacattgtatgttcttactgatagatgagagctaagctatgaggacacaaagacataagcatgatacaatggacttcagggacgtaggggaaagggtgggaggggagtgagggataaaatacaacatatatggtgcagtaggtactgcttgagtgttgggtgcaccaggatctcacaaatcaccactaactaacttacgtaaacaaataccatctgtaccccaataacttatgggaaaaaaatcatttcagtggaaggctgtcaaactttctaatgtgtaataactttacattttaaagactgaacatttctgatttttatttggatttttaatagactacattttctatctagaaaaggaatacaatcagccaagaatgatcagactaatttaaaaatcaatagtgttaacagattctaatgttaaaacatttttacattgagttctttcttaaataactttgaagacacacttttaataacaccttaaattgtccttttttgtgctgaacaatcttggcattctttctattttttgcttcttctgaaaataacttctaacaaacagatttttttttttttaaggcagggtctcactctgttacagcccaggctggagtgcagtggcatgatcaaggctcgctgctgcctcgaactcccagactcaagtgatcctcttatggcagcctcctgagttgctgagactacaggcacacgccactacacctagctaattttctagtttttttttttttttttttttgtagagatgggatctcacttatgctgcccaggctggtctcaaattctcaaattcctgggcataaatgattctcctgccttggactcccaaacactgggattccaggcctgagccactgcacctggctttaagcagatgtggttggaagcccatcacagtttttaataacgtattttctatgccaagaaaagacaaaacggcaatgatttaataagttaggccgaatgcagtggctcacgtctgtaatcccagcactttgggaggtcaaggagggcagatcacttgaggtcaggagtttgagaccagcctggccaatgtagtgaaacccgtgtctactaaaaatacattaaaaaaaattagccagacgtggtggcacaagcctgtaatcctggctacttgagaggctgaggcaggagaatctctcgaacctgggatgtggacgttgcagtgaaccaagatcgcaccagtccactccagcctgggtgacagagcgagactccgtctcaaaaaaaaaaaaaaaggtgttatttaaaggtgttttttaatgtaatggctaagaactattttgtttggtcactgctaacaatgaaatgtgtttcaagacaagatgagccagagatgttcacagtaagtcagaataatcaaaaagggaattgttcccagtgatattttttcacttgaactccagttcccctccatagttttcaatgaacactaaatgccaatttatattaattggatgagaacagaaactatcctttcaaactgatccttcatttaaaaaaagggggacttctaaaagatgaatatttgtgatttagcctttcaatttatttcacatttcttatgactgattttcattatgatcaaaaatattatgctgtgtaaagatactgaaaggccccttctctggttcccaaaggcaggcaatacaattactgtgaaaggtcaattagccccacactaattagccagtgcaggcctgggccttgtcacctccatgtccctcccaccacaggcctgagacctttctgctgctcatgaggatcctacaccagaggggctccatagggggcgggaggggggaccgctcaggaatcactcggtttggctacatgccagcaactgcagtaagtgatttagttttgaagagcagaggacagtgctgtttgagcatgtagggtcgggatttcacttctctgggttccctctttcatgaatacaaaggatatcggatcaccaaagctatgcccattaaacccactttaaaattgtgttttatattgtcaacattgcaagaaatgcctcaagtatcacttcttttttctttaagtattattttattactagttgtgataaatattatgaacactttaaaatatatatattttatttgacagaattaaattaatgtttttaaagccatggaatacgctgtatagaattactggggtcagggtttgagagcttaacaacacacgctcttgatgaagctgacccggaaactcaggcacgtcggggaggtcagcactacccaacagaaccacatgcgagtttatgccacgcttcccaaattccaatggttgcgattaacactcaaaatcatatacctccgcgattgcaaaacaacatctgcgcaaggtgtttactgtgggattatttataatagaaaattatgggctgggtgcggtggctcatgcttgtaatcccagcactttgggaggctgaggtgggcagatcacccgaggtcaggggttcaagaccagcctggcacacgtggcaaaacctggtctctactaaaaatacaaaaattagccgggtgtggttgtgcgtgcctgtaatcccagctacaggctgggaggctgaggcaggatactcgtttgagccgggaggcggaggttgcagtgagcctagatcgggccactgcactccagcctgggtgacagagtaagcctgtgtctgaaaaaaaaaaaaaaaaaaaaggaaaaaaaattttcagaaacaagtgaaatgcttgaccatagaagacaagtacaatctgtgaagaaaaaagaaaacaaagcagaaaatagaatatagtaagggactttctatgtcaaaagcaaagaaaattaagtacatacaaaagtagctgtttttgtaaaaggaaacgtagaaaggaaaatcgaagttagtgaaaatggttacctatgagggagtagggaaatgggttaaagggatcgaatgggagccatgtttccctaacgtgactatctacagtttcaggtgtgaggcacagaaaatgtttcacaaaatcacaacaatacttactaaataaaaaggagaaaaaaagcaaactctaaaactgaaaattaccagaaacatattgagctgacaatgtcagtacataaataaaagtagttcaagtaacttttggacacagtgctctgtatatcctttagtacaaaaaaaggaacccaaaagaaattttgtactttatttactaagttgattactggtatgatataggtgtaggaattcagaaactatttgtatttatgttaagatgaaaaattactaaacttactgatgtttttggaaaccgagtttttcacagtggctgaagaaggtgagaaggagcttcatgatgttggagttgaaataaaggaaacaaaatgtacttatgaatttttaaaaaatccaattcattgaggggaaattactcacctatccagaagttgcagaataatgagacccatgtatatctattcatcaccttattcaacaattatcaacttgagtccaaccttgttttatcagtatgaattatcatggataaatgatattatcaatatcactacccactttcccttcctatattattttgaggcaaatctcagatatcatattatttactcaacaaaaatgatccatatgtatctctacgaaggaggaattttcctataaaacctaactagaataccattagaggaactgaaaaattacaaataagcatttaatggcatcaaatatttatgtgtccataattttaattttttccaaatctgtttgaatcgagatccaaacaagtccatattttgggactggaaggaatgtatattatatcttcttgtaatttaattaattaatttattaatttattaatgtatttatttatttatttattttgtgagaccaggtctccctctgtcactcaggctggagtgcaggcatgatcagggctcattgcagtctcggcttccagggctcaggggattcctaacctcagcctccccagtagctgggacaactggaatgtgccactacatccagctaattttttgtatatgccatacagacagggttttgccatgttgaccaggctggtctcaaacttctaggctcaagtgatctgcctgcctcagccttccaaagtgttgggattacaggcctgagctactgtgcctggcgttcaatgtttttttattaagacataactaatatattgtagttctcccttttaaagtgtataattcagcagtgtttagaatatttgcaaggttgtgcagccatcaacactctctaatttcacaacattttctcttcagttgcttttacaagttccctcacccatctctcttcctgtttttacaattaaatttgaagaaaaatgggttaatccattgtagaatttctcataatctaaattttgccagttgcatatgggtggtattactgaacaagtttcttcattgtccttattatagaaaattttatatttgtggccaggcacagtggctcacgcctgtaatcccagcgctttgggaggccgaggcaggcggatcacaaggtcaggagatcgagaccatcctggctaacatggtgaaaccccgtctctactaaaaatacaaaaaattagccgggtgtggtggcaggtgcctgtagtcccagctactcgggaggctgaggcaagagaatggtgtgaacctgggaggtggagcttgcagtgagtggagattgcaccactgcactccagtctgggcgacagagcaagactctgtctcaaaaaaaaaaaaaaaaaaaaaagttatatttgattctacaggcttgactaggtttaggcttaatatgttttgctgggattcctgtaagggtgctgctttgttcttcaagaaggaagcactatgtgactatgcctgagtctgactacatttggctgtagtgtatcttctttatggaagatacgctaaaattgtaaaatggtgatcttttaatattatcacttcttctcaaactattagataacatatttctatcaagataaattttccctcaatagctattttgttactcagagataaattttgtataggaaggcagaataaatgctctattattttcttggtttatacattttcaaaataagttgactctagcaatgaataaaaatgcaatttttaaaagcattattaaaaaattatagaaaaggccgggtgcgaggctcatgcctgtaatcccagcactttgagaggccaaagcaggtggatcacttgagataaggagtttgagacccacctggccaacatggtgaaaccctgtctctactaaaaatacaaaaattagccaggcgtggtggcggatgcctgcaatcccagctacttgggaggctgaggcaggagaattgcttgaacctgggaagcagaggttgcagtgaaccaagaccacacaatcgcactcctgcctgggtaacaagagtgaaaatccgtctcaaaaaaaaaaaacgaaattacagacacacacatattaatgatgtccatcgattgtacttattattttgattggtggttatctatagctaattggcacatcttagaatgggatcctgaactgtggcagaggcgcaagagtctttggtagcttccctgccatcctgtatgacaagagactccagtctgctttgaacactttttgttctagacctgtaataaatcattttgacaaataaaaatggcatttaaagatgacgatgtggatggttagagatactcattgctagtggattcataaacgtctgtcagctttttcagtgacaagaggtatgttttgttcgttttttaaagataaaatacatcacgagttcaatctgatatttcccattcaaaccgaggagtagagggttttaaataatctccttcgtcttccatcttaatcttcttttctcttgttcaaaatcgtgaaaatgaaatgattagatgtcacataattactcattattttagactacattatatacacaatgtgaatgataccattaaattgattactaatcatagtttaagtttttctgcttgtagttctttttgtcttgggatgtacctcattaaagatgtatagtcaaactgctgtattctaaagtcacttggaataatgtggctatgattacaactaaagatacttgcattcatttttttgactttattttttattcttagaactttctatttaaaatatttaattctgttttataattatggaaaatattttcaagtttctaaagtcaaactttaaaaacataaaattgtcaaagatgtctcacttctacttttgtctgtttaatatattcactatctttttgtttgtttttagatttctgctttacctctaacagaagctggtgtgtgtgtgtgtgtctgtgtgtgtgtgtgtgtgtgtatttaagcacctctcttagataattgatagcatgttatatacttttttcgcttaatttcccctacaattaattctacagtagtatatacacatttccttattatttttcacaaccatacagtaacctcacgtgtggataaatcatagtttattcaaccaataccctatgttctatgacaaatgaggtcccactggccaagtttgggaaaatataaatacaaaaaagaatagattgataacaggttataatacattaaagaaaaaatccatgaatatatgataatattaaaaagtatacgtgtgaggagtaagaaagagttcttccatacagaacaacagaataaatatggcaagaactgtcggcacagacaatcatatttttgaaggcactgatataataattaattcactcaaggatcaccagtagaagctacagcaaatggatccaagattggtgggaatcgggattttggcagtttccaagtatctgcccacagattccctaataatttcaaaagaggagggttatttctgcaatgggagattcggcaggcatcactgtaactaagattcacacgggcattgtcagttacaaaggattcagcattaacgacaacaaagtttaacccaaatttagcaatgaggagacaataaaacaaatcgaggttgcaggataattctgcaaacaactgacccttacaattcaaatttttgaaggtgcaaattaggtgtgtgtgagaagactgttctatactaaagcaaaataaagatacatgataactgaatgtgatctgtatatttgactaaacttttggtcagaataatttaaaaaaattatccaaagcatacaaacaacctttaaaactcatcagtaaataaataaacaaacattaaaaaagggccaaaggctttaacagatacctcaccaaagaagatacagagatggcaaagaagtaggctccacatcttatgtcctcagggagcagcaaattaacgcaagataccactacacaccaattagaataaatcccagaacaaaggcaacaccaaatactggtgaggacgtggaataacagaactctcgttcattgctactgggaatgcaaaacggtatagtcactttggaaatctggtggtttcttacaaaactaaacatactataaccacacaatgcagcaatacctggagtatttacccaaaggagttgaaaactaaaatcatgtccacacaaaagcctgcacacagatgtttacagcagctttattcaggattgccaaaattcaatgcaaccaacatgttcttcatcaggtgaatggataaagtatcagacatacagatcatggaaaattattgagcactaaagagaaatgaagtatcaagccaggaaatgacatggaggaaccttaagtgcatattaccaagtgaaagaaccaatttgaaaaggctacatcttgtatgattccaatttgaaaaggccacatgttgtattatacgacattcggaaaaaggcaacactatagagacattgaaaatatcagtagttgccagggactgagggatgacggagggatgaatagagacagcacagagaatatttaaggcagtgaaaatactcagggtgatactatgttgatggataaatatcattatacatttgtccagacccacagagtgtacaccaagagtgtaccctcatgtaagctataaatgtgaagtgattacaatgtgtcaatttaggtttatcagctgcaaaaaatgtaccgctctggtgggggatgttgataatggagagggtatgggcacatttgggcagggagtagatgggaaataccttcctctctatgatgtgaacctaaaactgctaaaaaataaataaataaaggcttaaaaaagctataaaggacaatttgggaacaattgggaggatctttgaatatggactacaaaagaaatatcattgtatcgatgttaaattccttgaaatttacatcacacattacagcggctacacagaagattgccctttgcctttgtagatataggctgaagtgtttaggaacaaaatgtcagtctatctgcaattatgtttagcttcttgagagacagaggaaaggaaggaggggaaggtgtgagtgagggagacaaagaaagataaagcaaatgtggcaaagtgttaacagttggggactctggagaaaggttgtacagatatttgctataaatagatttttttaaaaaattttttaaaggtttgaatctcctaaaatatcttcatactcagtcactaaatggaaagtaaccactgaaaatcagaaatgttggcgaggtgaggtggctcacggctgtaatctcaggactttgggaggctgaggtgggtggatcacttgagctcaggagttcaagatcagcctggccaacatggtgaaaccctgactctgactctactaaaaatacaaaaaattagccaggggtggtggcaggagcctgtaatcccagctacttgggaggctgaggcaagagaatcgcttgaacctgggaggctgaggttgcagtgagctgacattgcaccattgcactccatccagcctggacgacagagactccattaaaacaaaaaaaagaaagaaagaaagagagagagagagaaggagagagagggaaagaaagaaagacagaaaaagaaagaaagaaggaaagaaagaaaaagaaagaaagaaagagacagaaacaaagagagaagagaagagaaaagaaaagaaaagaaaagaatcctctgtcttaatcctgagttctaatttgattgccttgtggtctgagagactgtttgttatgatttctgttcttttgcatttgctgaggagtgttttacttccaattatgtggtcaattttagaacaagtgctatgtggtgctgagaagaatgatttggggtgcagagttctatagatgtctattaggaccgcttggtctagagctgagttcaagtcctgaataaccttgttaattttctgcctcattggtctgtttaatactgacagtggggtggtaaagtctcccactattattgtgtgggagtctaagtctctttgtaggcctctaagaagttgttttatgaatatgggtgctgctgtattgggtgcatatatatttaggatagttagctcttcttgttgtattgatccctttaccattatgtaatgcctttctttgtctgttttgatctttgttggtttaatgtctgttttatcagactaagatcgcaaactctcctttttttttgcattccatttgcttggtaaatattcctccatccgtttattctgagcctgtgtgtctctgcacatgggaagggtctcctgaatacagcacactgatgggtactgactttttatccaatttgccagtctgtgtcttttgattggggcatttaagccatttacaattaaggttaatactactacgtgtgaatttgttcctgcattcatgatcctagctggttattttgcacattagttgcagtttctggaaactgaacaacctgctcctgaatgactactgggtaagttatgaaattaaggcagaaataacaaagttctttgaaaccaatgagaacagagacaatgtaccagaatcactgggacacagctaaggtagtgtcaagggggaaatttatagtactaaatgcccacatcagaaggagggaaagatctagaattgacaccctaacatcaccattaaaagaactaaagaagcaagagaaaagaaattcaaaagctaaaaggccaggcatggtggctcactcctctaatcccagcactttggaaggttgaggtgggtggatcacttgaagccaggagttcaagaccagcctggccaacatggtgaaaccccgtctctactaaaaatacaaaaattagctgggcatggtagcgtgtgcctgtaattccagctactcgggaggctgagggaggagaactgcttgaactgagacctggaaggtagaggttacagtgagtggagatgacgccactgtattccagcctgggctacagagtgagactccatctcaaaaaaaaaaaaaaaaaaaaaaggctagaagacgacaagaactaactaagatcagagcagaactgaaggagacagagacatgaaaaacccttccaaaaaatcaatgaatgcaggagctgttcacatatacaccatggaatactatgcaaccataaaaaagaatgagatcatgtcctttgcagggatatggatgaaactagaaaccatcatcctcagcaaaccaacacaggaacagaaaaaaacactgcatccatgccataaaatacaactcagcatagtattccatggtgtacaaaaaggatgagttcatgtcttttgcagggacatggatgcagctggaaaccatcattctgacaaactgtcacaaggacagaaaaccaaaccccgcatgttctcactcataggtgggaattgaacaatgagaacacatggacacagggaggggaacatcacagactggggcctgtcagggggtggggggctagggaagggatagcattaggagaaatacctaatgtaaatgatgagctgacgggtgcagcaaaccaccatggcacatgtttacctatgtaacaaacctacacgttcagcacatgtagcccagaacataaagtaaaattaaaaaaaaaataagaaaataagaaatgcggtattactacaaaatttttaggatgaaaaattgtatgtatttcatgctatctgtcatgaattcagctatctaacctgctatatcctacacatagcttacaaactgacctaagaaaggagggaaaaatgaaagcaaaatccaaagttgcttataaaaaagaaatctttgttttggaatatgagaaagctattgtataaatacagattaccaatatggtttaaatagaagaattatagtcaaataccatagcaaatgagttaaaattttgcagctcattacagttttgaggtctctaaagtgaataagcataatacccaaaatactgactttgtagaatcctaaaatccagttatgcagtctacagcagcagtcctgaatctttttggcaccagggagtggttttgtggaagacaatatttccacagatgagggcaatggggatggggtgtggtttgtggatgaaactggtccacctcagatcatcaggcattagttagattctcgtaagaagcacacagcctagatacctcacacgtgcagttcacaatagggtttgcactcctatgagaatctactgccactgctgatcagacaggagctccagcgtcatgctcatctgcccatactcaccccctgctgtgcagcccaggtcctcacaggccacagacaggttctggcgccacgggggttggagacccctggtatagagcaacgcatgggcaaaagcactgcatgagtaatcaaggtcaaaggcagaattaatggatgttctaatttactatggaggcaacatagcaaaacctcttaaacattttacaacaaagatcctgtccatattacagtcttcaaacagatatggacttccatacaagaagagtatattaaaaaaaaaatccacaccctctcagatgttcactcaaagtgataaaaatggaaacaatggaatcacatctgctaaaatccatattagaaagtatacaaataaaagtgcttatgataaacagctaatgagaataaatggatacactattaagctatcttggcagaatttatcaatgtcttagatgtacatgcagaaattctcacatatgtcctcaaaaacacatgtacatggatgtcctttgcaaccacagtaaaaaccatggcaacaatctaaacagtcatcaatattgggctggctgccattcatacatacaattggtaaacatttgttataactctagaagtacacggaaaagaaggcggtctattttttaaataaaatcagcaagttgcagaatagcatgcactattattattagcccatttgtctgtatgttgtatatcactctgtatatgcattaacttattgggtacacatagcaaattttgattaactctgaagaatgggattaagtgatggaagagaggaatttgaatgtttctgaaattttaaaaagtctaagcacacattactttgataattttaaaaagacacctgggaaattatttgcaagtaaaatactcatttaattcctgataagctttcctttctttctttctctctctcttttttttttttgacagaaaagataatgacagtaaatgctttacttagaatagaatggaattttttttctacttttctgtcaatgtctttatggatgatgttgccatcttcattttgtcactgttagttgtaacttctttctgacctatgttttaccctttctggctacaagctcattttacacacagttatttatatgaacagttgggagccactcactcacctctcttttgagaaaagaaaaatatatttgtgctttctaacttttattatctttatgccaataagtctttttattttcacctaagatttgtgtccatttttggaatggcagagatgctggaaatcatatttcaatccaactgaaatgtacgtgtgagtgtgtgtgtttgtatgtatgcatggttttatgtctttagaattctttgtgagtgctccagtaaatctggtgccttctgagacgacaagagaggattaaggaaatggtatgagttttttgtaactatctcaatgaaaaagtagagaagcatagagtgaaaaaatccttagaacagtcttgctctgtcgcccaggctggagtgcagtagcacgatctcggctcactgcaacctccgcctcccagattaaagcagttctcatgcctcaacgtctgagtagctgggattgcaggtatgcgctatcacacccagctaatttttgtatttttagtagagacagggtttcgccatattggccaggctggtctcgaactcctgacctcaagtgattcacccacctcagcttcccaaagtgctgggattacaagcaggaataaatgttactgtattaaaagtattagatcctgacccctgcttgatgtgttaagctcagtgtcctctatctgaaataaagatacacactagcgtgttctccagattcaccttaattttacctgaacaatattctaaaattttcaaattatagcacaaacatactaagtacacatataattcacaaaaattaaaaacatatatttagccaaaagtaaataaaataaaatcagtaaaataaacaaatctgagaacttcatgaatggcaaccacagcctaaatgcaaagaaggaataaaacagctacttcttggctcttgggctttcatgggcccaggatccactaatgtaagagtaatttcagagattttgaagggtaactgggtatatttatgtattgtgttatttctttcttttttttttttttttttttttttttgagatagagttttgctcttgttgcccaggctggagtgcaatggcgcaatctcggctcactgcaacgtccacctctcgggttcaagtgattctcttgcctcagcctcccaagtagctgggattacagacatgtgcaaccatgcccagctaattttgtatttttagtagagaccaggtttctccatgttggtcaggctggtctcaaactcctaacctcaggtgatccacctgcctcggtctcccaaagtgctgggattacaggcgtgagccaccgcacccggccatattgtgttatttcatctcacatcttgaccttgaactttgccagttctcctataaatagcaattccactgtagtgacttacatttgaagtttgggcagtttttgataaatatccttattactggattttcttttcaaaatgaacaagaatattggacaactcaggtcctccgtttgaagacattcacagctgagaatgatattcgtatacatctgggccacagactagcagttcatctagttaatcagttactatgtagccaacctcacaagttgctatttactgccaatatgctgcacagctacaagtgttatgggctaaattgtgtcccctcacaagtcatacattgaattccaaacccccagtatcccaaatgtgactgtttggagatagggcctttacagaggtaaccaagttaaaatgtcagcattagggtgggtcttatctaacatgaatggaatccttttaagatgagattcaggtatagacagacacagaaaacagaccatgtgaaggtacacggagaagacatctgtaagcccaggagagaggccacagaaggaatcaaccctactgacaccttgactttggaattgtgagaaaataaacatattatttatttaagccacccagtctgtagtgaaggttcattttatacaagaattatacaacattttactggtccctctcgaattctatagcagcaggcatgtatcagggatcttcacagatattttggagatttttttttttttttttttttttttccgagagggcctctggcatatactcttgacataacatctgggcaccatgggtagtacctcctttatgacagatacttcattttaattaggggatgactgcattatttcaagacaaagcaggtgtaggttattattgggtgttgtatcaaagaaataaagaaatgtaggatgacatggggttattcatttctgcattgaaaataaggggaaataaggagttatatagtaggatcttcgcaattacactgaaaccagtatagtgcgtgcttgttgaatgaatgaatatcagtaataactctcaagaactgtattaagcaccatatttactaaatatcttacatattatttgtaatcatcaaaccacactgataaataagtattgtagcagagacagctggcacctcatcgaaatctgtttcctcctcttccccgacaccagatgacctgatttcccaaattccttaacatttagggttggctacactgattccttttatctgatgggtatgactagaagagatgtgtgccactttgaagccaaagcatgttcacagaagttgtagtgaacacagacagacaacaaacagataaatacacgacaaaatggttgataaatgtgtggcggcgggggcatagatggagagatgggcaaaatacaagttagagacaaactctcaactgtaagctgggagctcacatcctatggtttcaaccacacaaccaaagactacaaaatgcagcgtggcagcataatcaaatttacatcatcaggttttggattgtcaataaactttctagagattactctgcacagccaaaattttaaaatgatatcagatacaacagctaaaattactgggttgaaactggaagcttcctttttaaacagagctgtaaatgtataaaatgccacattagggcacaggttttatcacgtttatttgctagctaattattgaatccaaagcctttccaaacttgtttttggatgttcttgtgtttgtttgtttgtttgtttttcctaaatctttatagccgtgagccttgatcttcatgttttctttctcagaaatcaatcattcctttgtgctacataccacctcctccttcctgatagtatgtaggccatcttcaaactccctacaacttcaccaacatttccaactcattttcatacttttaagcccactggcattatacatgcaatactgactccaataaaatttatcatgtgggattagcataagcagaggtggcaaacttctcatttgttgctcccaaaaacaaaatgctagatcgctctcaagtaagaagaaacttgtatcacagtgtggtttggatggttgctatgacaatatcgagttcttctttgagaaagaccatgataaggcattcattaggaacataagtacctagcagtgagggttgttttctttttcatttttaaaatatctggccaagtagctggcgtttaaacagatcaagcattttacctacattctccaaactttaatttcataacgactccttgaaataagatgatggacaacaaaactggagctcaaagagatgcataacttacctaaagggatatcactggatttgcatccaggttcatcttgtaaaaccacgttgaactgcttaccttgactgaataaatcagcaatgagtacagatatctactttaattaacacatctaaattttgcttcattctataaccaaagcagttaaagggtagaatttggaagcacttaagatgaaccctccaattcttctctattgtctccaaaggctgtcccatctaatggtacagatgtgtgaaactcagaaaaatgataacagattacagatgagacgcaacgaaagcttccagccaggaaggtgagtgaggcagatagacaagctcatgaatttccagaggaacatatcacaattctgatttgtctgtgaggaaaagacatgatgtctccctataaaaattcactgcacattgccaggcatgggggttctcgcctgtaatcccagcagtttgggagtctgaggcaggaggattgcttgagcccaggagttcagaatcagcctggacaacatggcaaaactctgtctctacaaaaaaatataaaaatcagctgggcatggtggcacatgcctgtggccccagatactcaggaggctgaggtgggaggatcgcttgagtctgggaggtccaggctgcagtgagccatgatcatgccactgcactccagcccgggcaacagagagagaccttgctccttgcaaaaaaatcactggacataatgaaattatgaacataagaaaaggttggatttaagggctattttaatgtaattcccatcattttcatcattcttttgtgattcatattatttaccatggaagacttctatttaaatcaaaaggattaactgggagggttacattgataacaaataactagctatcacaaatagaaatttgtgaagggatggaatgtgagaaaattagctttgattatgaaaaatgaaagagaaaagcctaatgtagaattcgcagctaagtgggggcaacccatgccaatcatttcaaaggctggtcacacccgaggcgtgactaacccagcagcagatggaacctggattctacatttcaccatgcttggggtgggcttggggctccatgacccacaattttcccactgcatttcccaggccaaatgcctcaggttctgtcttattccggaatcctgttcatgattagaatcatgctcaagagctaaaatcttcttctgaacttaagccccactgacggaagcactgaatatgcctaactcttacagtttccctccctgcctggaagtgggctctataccaagccaggtggtccagagccactcttctgcccacatcctatcctcatcctcatcttaaatgtagccaacaagaggaaaaacatccattctggttttggctgctggtagtaggcagcggtctaaggtagctcttgagtgtctcactccctgatctgtgtatctgccttctatgagcagcatctgtgactatgaagaatgccacccgtgtgattaggttacactatagggccaaggagaggggggttttcagatatacgtcaagtctgtaatcggctggcttgttcagcaaaagggagattatccccggcgggcctgaactactaaaaagaagtgtgcaagtgagctccatgaaacggggtctcaagttcagagacatgaagtgacagagacttcacgttcctgctaggcttgaagaagcaagtcatcgtaagttctacagctgcaagaaagtgaacttctccgaaaaggacacggagccctcaccgaggcccccaccaaccccttattgtagcctcatgagcccctaagcagaggacccattaaaccaagcccacaaacatggaaatggtgaaacactcacatttttctaccatgataccatttataaacatcggatacatttatcattccaaggattcttgccatttgcagatacctatgcttggctgctgaggaaggctgaagccccttgaggacaaagaaacatgagcttgttgtcatttgatcaaacgggctcttgaagcttaggtcagcagtaccattgtgaagtctgtttttcactttaaggccatgtgagacaaagagatttgttgtggtctgtagggttttactacaacataggatgtggaatatggcaaaagtgtagtttcctacacatgggtttcctaggatggcagtaatcaagtaccacaaactaggggtttaaacaacagaaatgcactgtctcacagctctggaggccagaccctgaaatcaaggcatcggcagggctggttccttctgagggctgggagagaaggacctgctccagggtgctctccttccttgtagatatccaccttccccttgtgcctgcacatcgtcctgcctctgtgcttgtctgtctcactttttttcccctttttctaaggacacttatcatattggattaaggcccagcctaatgaccacactttcacttgattaccactgtaaagacctgatctctccaaataaggtcacattcccaggtgcttcaaaataggtgtttttttttagccaggcatagtggctcatgcctgtaatcccagcactttgggagactgaggcaggtggatcacttgagctcagcagttcgagaccatggccaacatgatgaaaacccgtctctactgaaaatacaaaaattagccgggcatgatggcaggtacctgtaatcccagctacttaggaggctgaggcaggagaattacttgaacctgggagatggaggttgcagtgagccgagataactctagcctcagccaacagagcgagacactgtctcaaaaaaaaaaaaagattttttgaagaacacaattcactccataacgcccataaaagaggaaggagagagcatccaaggactaggtaccttactggagggcagatagccagctgcctctgctgtggcagcaagacaccaaggtgaccctcccaatttcaatagccgtgggatcatcaagggcaggagaaagggaaaggaagaaccttgaatgtgactgcatatctaagtccctaaattgaaacagaatgacctacctggaagtaagagtatgatttttttctttccttctgagagtggaaatgagggcttgtgagaaagttgaaaaatagagaaagtttcatttcagcttatctgagttgtgctgcatgaatatttttattcgcctcctatgtcctgagcatgagaattgagcaccagaggaagaatccaagactccttcactttatccccagtccacagaccgaccattgtcctcagcaataggctgactgtcattccctctcattttgcatgcagggattgtacacgctgaaaaactcccttctgtctaacctcccctgcagcaggtcaagtatagttgtttgctttaatataagatatctgttgtactaagacttcattgaataagtttcttaaacagacgagcaagtcatttttccactcttgagtggcctcttagtgagttaatcattttgtggaaatacaaataaatctaacacaaaatatcagaattttttccttcttaatagaatttaaattctttgatttaaaacatcataatttattccttgttagatttttcaaataatatattcaaatgtccatgttaaatgtcagattaagagacaatgatttttatgagtaattttttatcaccaaaagttaattgcctcatgtatatttctccactgagttagtaatattatgacaatattaatgccgtagattttcaagctaaaacagatctatttttcaaatggaaaattaattctaaaaaaatgaaagtactaatttaaatcattaatggcaatttcctctttgcagactgccttgaacttttccagttctgccctaacagtccaggagaaggaaaatacaaattttctggcatggaaataacataagaaggagctgcaagtttcttggcaaagacattgacaacttttcaggataatcacaaaagggataggataactctaaaaatgaacataatgctagtctgagccagttaagtgctcactttcatagcttctggtagaaagagcattcatggaattaaatattaaatatgttctccgaagttctgagatagtaggataactgtgtgtacttataagaaaggagcgatgtcatgggtgattttcctaaacatagcagagaatcaggaaaacagccaagcatttgctgagacggaggcacataaaacatgaatctgagaatcccaagggtagaagagagaaatgtggagggttatcatcataaatcatgttagaaactagggcaagaaactcatggtgacctctggacactaaaatgcagctggtcataattaagcttcaggctttgctcttcctgggccagttcattggcatcgtctactgccaggcctcgtaccagtctacagaagagattgcctggaacaagcctcttgatgttattcacacttatgaaccaactctggtactagatgcaaaaagcatgtcacaagagggatgggtgggatgggggggaagggacatcgcaggaatcatgccactttccagccccaccaccctctggtgccacgtccacccttgatcactattaccaacccagtatccctccagcacttcacgggagggtgtcagggatcacaaggaaacacatgggacccacacatttcgagatgcctcacctcctgctcgaaagtcaggtgaagaaggattcttgagccaaacatgaaagattttttgagagctaagctgacaggagaatttcccgtaaaaagatgaaagccctggctttaacagagccccttttcatttttacctttaaaaagcttttcctttcatgttaccctgaggttattcaccgctacgacaacaatctccaaagacgttttctccattatagaagaggaaaaggttggcgttgggatttggtcaggaaatgaagcgttgaagacaaacaagatgttctaatatagagcaaacctgatgagtcattttctaagtgagcagccacttccagatacaattcatagtatcttcctagttattactattattattattgtttttttttttttttttctgagacggactttcactcttgtcatccaggctggagtgcaatggcgggatctcgcctcactgccacctctgcctcccacattcaagcgattctcctgcctcagcctcctgagtaactgggactacagttgcctgccaccacacctggctaatttttgcaattttagtagagacaaggtttcactacattgaccaggctagtctccaactcctgacctcaggtgatctgcccacctcggcctcccaaagtgctgggattacaggtgtgagccactgcgcccggcctcttccaagttattctgtcatttggcactgatccgtctttcaaagacattcaattaatcaccagagatgcaacaccataaaggagcagaatatttcaatatattacctgatatattttcttttgtcattacccttttgtaccctgtagctttctaccttaaaggctccacctacaggcagaggctcattgccttagagaaggagagacttaaaaaaaatcccaggcaaacagagggtcaagtaaccagacttggaattgcacagatgttggtgaatctacagcagccacaatggtccaggattgaatctactccatggaagcttcgaagtgggaagagccgaggatgacctagagcccataagaagataagtctgaatcagctggaggaaggtggatacccacaggatgtgtgatggggtctggatgagagcagctgggtgagaagcagcaccactgccttccttagacccaccaggatcagttctttcggtagtgatggagatggggagggggatataaaaacccccagatctctttgattaggtgaaagtaaagcaaccaatggaatgccctaattctttctgggatctcctacagcacacaaaaaaacctgatttccaacactgggtagcagcaatactgtaggtatggccccacagagtgtctatgcacagagtcctgtggtcgctggggacccaaggggtgcagtaaatacctcatgaagggcaaggaggaggtcaaagagactttctgagaataacagtatttccaaagggtgctggctcaaaaaatgaaaatatgtaagccagatgtttagcatcctgggtaagatattaacaagcttcaacatcagatgtaaagggaaggaaaagaaaattgattccacaacatccccagtttcacttcagtagaggccaataagacagaagccaacaggaaattagacttcccttcttcaggcagaacagtggtgaggccctatgggctgatcatccccaggaaaaggatgaaaggataagaagagggaaagaacccgaatgggaaagagtatttctcaaaggggcccaagttttaatttataagattaaaagaatgagggttaaaatgtaaacaaagccaccaaaatatagaaaacacagatttggaattctaaatccatgtactccattcatggaggaggtggaaacttgctgagttctcggaccactcagccagttcacagacataaaaggagacccagcggagagggagtgggtgagtgggagatcaccgccctggagagggcagctgtcccattggggggccccacctccactttttcgagtgctcttcctccacctcaagcccggtggaagccaggggatgactcagagatggggacacagagggctctcctcccagcctgaagagctagagcaggctgtcaggaggaatgtgaatacagtgggtggacctgtactccagggctgtgggaaagactggggttccccaaggaccagatgtgggcaggtggagagacagaaagagagagagacagaggaagaagggagacagagagtgcccgccaccgcacccggctaattttttgtatttttagtagagatggggtttcaccgtgttagccaggatggtctcgatctcctgacattgtgatccgtccgcctcggcctccgaaagtgctgggattacaggcatgagccactattcccggctgggagaagtcttagggcttagacatgagggccacctggagggtggcaggaccctggaaacaagaagccaaagtcaagtctttagggcagcaggagagatcagaaggggccatgcaacccggctgaatagagaggcatcattgggaggcaggagagatgcagaaaagaggtttccagcggtgcaaatgtactaagagttcatgaaagcccccggtgctgaggaatcagctggaacccttggccaggctccaagtacccgagccaaaagctctgtttcctggccccattctcctccttcctacaccctttcaagcttcctcaaacttcttcagagcttggcctgagagagagaaggaggtgaacagagagagaggagagagacagagagagagagagaagcagagactctaattaaacctcttcctcaatgtcaatgtcaggcagagaagaacctgtggcttgaaatgagcaagaaatacaaattgtggaattgattaataacttgcctgaataccaggattagtaaatttagactttgttcactacttcaactgcccacaggactgagtaaaacaaaaatcacagaccctgctgaaactgcaggaatgatttaactcctgcacacgatttaattgggcaactggaaaaggaaatacaaccttttgttctgacgttattaaagatgtgcttgctcagcatcattattgtattaagttttctgctgaagaagattaagaagagaataagaatagaataagagtaaaaaaaaagagaaatacaatacaataaaaacataaaagaaaagaatagaaaaaagagtaagaaaaggaaaagagggatgtaagtaatgcagattcaggtgtaagcacaaactaagttccatctagagactactgaaatactgcactcactttgataacccagaaaacacaggacaagatctgaacgagacctggatctgggttgtgcttcctcgatcactaaccctagtaaccatacttattagctaaaacctctgcctctagcttttcatttggaacatacatttaatatacagccctacataagttcagccaatatgcagctcaacaatatattaactaggcaagttgtatttcagaatctgtgtgagaagcggcatgcacgcagcctcccagcattcgctggtgctggggcttgtgcgtgacaacatcagggagctcttccaaatgctggtcgctcggtacccatatggaggctttcttcctctagattgccaagctttcttaccagaggaagatttaggctgtgtccacttagggccaaaataatgaatcagttcagttgttatgtgtgcaccatttatactggggtttgacagaattttaaactttttactcgattgccttgatatcatggaattattgctatttatcagtctatatttacacaaaaggcctgacatggctacacacaggccctgtggtctgataccacgtaaggcacccacagcatccctcgccagctgagatcgaatttattcacacacatgcgtctcccctccaaatggaacttattctgactttagatctcctattaggactaatgccattaactaattgtccaataatttcagcaaaattcaaagtataaaacggaagtattacctggccccactacaggagttgtgggaacctcactggcaatcagatttttcctgtctgtcttctcttgctcttcacttcccaggaaagcaggcagatccactaacttcataattctagagcaaagtggggccttacacacaagcctacgcttgcccttggagtttattttgacttctgcataggtggctgccactgcagttgtcagaatctgaaattcaggagatgccccttgacaggcagggacaccatctgatggcagtgtgacaaggagcattgttaatacaggaagggctttctaattgagagtggatacccatgcagaaattttcggatgttcccaaggccactacaaagaaacatgaaataaaaagatatatcccatgaaactacaattttggaaaagtaaaaataattacagcaagtttgtatctgggatttgttcattttaaataaaatttaaaaacaaaaacaaagcaaaagagaacaaggaggggagagggacagtaaatgggtaaaaagaaggaaaagatggaggagaaagaccaagagctgtcaaggcccacagtcgccttaaaacagaatgtgcccatccccccacccccttctatgccccccacccccttctatgccagcgcccagtacctcactccctatctgcgctgcctcccagccaggggccttgacaagcccacactctccaggaagggtatgagcacagcctctactgcaggagaggatggagacaagctctgttcttcttgcttttatgtgagtctgatactcatatcactcatctcctttctgagcattgcaggctttaaggaccctctggctggctccttaacccagcttctgaaatcccccggagctgcctgacttcccactctggaccctaagtaaacatttacagaagcagtggatgccgcttatttcttactccacaactatctatccattcttttgccaaccaaattattatgtgccaatcacattgaggtaaagcaaaaatgaacgcactttaaaaacattaaaatgtgctcagattgcaaatgtatacagctattatacccagcaggaaaaaagccaattaatttacgtatttaagaaaattttcttacttgaggacaaaaattaaaaaggggaaggaaactcatgttgaatttcacttagaaaagtcaaagtgaaaataatcagaatgtcttcagctacccaaggatttactgttaactagaaaaaagcatcgtttccatgccacctcagctttccaaatctatcattctaatccatttttaaaaaagaataaaatctgaaaaataaagtacatctccaggcctctcatattgcaaatgacgtgtccaatcatacttctacaaggaaaaaattaatggcaaagggggccaagagttaactgctggaatggttaactagaaaaggcccagtcgaaattaatccccatgatttcatgtgaatttcaagccatagcttaatcctacatgtcagtacaacaggaactgcttagctctgctaatcagattctagaatttttcttttctttttttttttttttgtaagcatcttagtttcgcaaaggcagctggctgtgatggtattggtcactctgctgaagaatatacatgggacctaaaatagctctgggtccttttcaactgtggcagtttcatcaatggcatccgttacaagatcctggtagtaatattgatatatcaaagtaccaattaaaccatctgcacaagggtatccatccacctgtgtctgataccatgtaaggcattctttcacatctggcacaaagaaggaaaaaaggcacaattctacaagattggattttgaaagaacttctgtttgaagagtgaaaagaatagatgtgacatgaatggacagatgaattaggaggcatacagtgtaataacacaaagaaattattgtgggttcatatctaaactccatcagaaaatatattcatatattctgtaacatgaacacatttaatctatagtggttgttctcagagtaacagaaaaaaaatattcttattattaagttcactttcagaaaaatataattaaaaaccacataggacaaggagagacaaagaataaatttccttgaatcatctaaaaataaatgtatcaatatagcaacataccactgtgggctcttcatccttcctgcttcattaattacagtccagtgacacctccatgcccagtcctagctaaaaatcatactctcaacactaaatattaagtctcagattctgacaagtatgttcatgtcagtagttacaacaagcaaaatatgtgaaatcaggattatagctgtgggtgctagaagtggattctctgtcctattattctccattttcacacaactacacatccatccatcttccatctttccgattctgttctgtgccctcagaggttgacacccacaggccaaatcacttgggctcccttgtcctgcaacctccagttgggttttgacaaggggaggtaccaggaggtcaatgggtacagacggaggggagagagagagagagagagagagaaattgactggggcttccctccatccttcctggccctgcttgcttgaaatctctggttccggtggggactgcaaccctctaggatttaccatccaccagatgtcccttctgctagggctccaattctcattagctctgggaacagcatttattcctcttgtccctaaagacctaacaatagtaacagcttcgcaccatgaatagttcaggtgtcttgacatccttctttgttttttttaaaactgttttcttcagcctcctatctgagggtactgttttcttctggaatctgaactgacacaccctggaattacagggttatgtttccctgaagggaagggtgacaataggaagtactaatgaagatatttccccctcaggatgacatatgctctctaatttagtgactctcccacccccccaccaccccccaccccccaaccccatgaggtcagcatggaggcaccagaggacatatttacaattcttggccttcaccttgatgaaagcagcaatcttggggagagggagaatggtaaggaaaaactgccgaggtgcaagctgtttcttgaccctgtgcccatcctgagctgtataagattctcagagcacaggaaaagaaagccagagccagggctgagccaggtggaggaggggagggctggaagcctggacctctgggaggtgctgccccgccatgtgccctgagggccttgatgtgggagcagaagagatggcctggtgtgtccaagacagtgagggcctggttccagcccccgctcttccaggagctaaaaagagcctccacatcctactgcactgaaaagaggagttggccttgctgaagggaggatggcccacaggggctcacagggtcagggcaaagggttgctcttggggaaagctgcaaggaggtgtgaactggaggcagagctgctggaacacatctcagatgccaaccttaacagcgaagacgcatcaggcatctcagccccttcgggcagacagagacactgtgctggatggtgggacgctgcccatgacacggctcactgtgagctcccgacttagattcaatgccagaaacaggggcagagaggccaatggctgaatagaggagacttccaatctgaaacgcttgagtgtctctcccggtgggtaagattctggtttttacccttaggtggaaggtggaatgggcacactagaacactattcttttctccctctttgtgagcagcttcttcgataaaaacagtctatttttttcccaggtgcacccaagtgttcagtggcttcagtgaataaagtcactggaagatatggggctcatttctatttaattagatataacttttcattatcattattgtgaacttggctttaaattatgcaaatatatataaactatacattatcacttccctttatttaatcctttatatatatatgtatttattcctttaaataaatatatacatatatttattcctttatatatatgtgtgtctataggtctgtgttttcatggccatacagtgggctgcaggccactttgcaggaattcttcctacctaccacacttactgcttagcacacaggtgttcaaaagacatctgtaacaaataactaattacacataattgtaaagtaaagtaaagctagaccaaaatgacataaaatctgaatcaatgtttccatgcagaaaatcctagctttcactacagctttattcatttcatacttatataaaatactcatggtatttttccacatacttagtgctgagttacactcatgtttgctttccattctctgctgtctttttttaataatacagaaattttcatacaaaaatgtactgaacacgtgtagtagcattatagaatcagagcagtagctgcaaatgatttatgaaactatctactctggataatacaacagtgctatacatacacaattacttcataaaatatggaatacaaacatgaataggaatgcctatgacattcaatgtgttttgtcggcctttaaaaacttatttctgaacacagtggcttttcttcttctttaaaaaaaaaaacacattctatcagaatccatctaaactatttcagagatgtgaaaagctgtcatatttgcaaagaccaacagagaaaaaggtattacagttatccattccacctcttgatgccagttaaatatctttgggagctcatttaggtttctaaaagagaagatcatgcaaaatgcttattttaggtctccttaatggagactgaagaatgttatgcagctctctgcgttttttttttctttttatgtctaaattatttgacttctttaaacctttcacctggatacttttcaagttttccacatgcatctttaatagaggaggcctggaaccaaccaaacatagattagaacacctcacttctctaaagttaacctttatcgggcaagctcagtcactcaagaaagagtcaagagccaggatgtagacaaaagaccactgagctgccacatcttcacaggaccaactaacaggcaacagaattgcaccaaagcttgaggtctgtaacctgtactcagatccatcgtaacccacttattctttttgtagacaacctaccaacaaccattaacaaccttgtcttcaacctatacattaacaaaataaaatgcatgtcaggacacagatgacagtacctaaacaccaatagcaaactggagctgatggtggagctacatccacagacatgcactaaagaagaatagatttttttttaatggatgcaatcagaactccacagttttataacttctgaaaaaaagagataatatatttatctagtacttcttatacatgatttttatagaagaaatcgtttaattgtatacacatatatcaacataaaaaaaaggccacagaaatgcaaaaacttttttaaaccttccaatgaccaggaagatatgcactatgatttctcctttgtgcatcaagcgctttgggagctaaagaggcttgccaaagtaaagtagcgcgtccatggaagagagaagaccagattccaggccatttaacccccaaggctactgatctttgtagtatagtcaaagacgcagactcagcattcttaaacttctgattgcctttcactcacttgcctgctcttgcctcctaaatatatgtctgttcttaggaactgtatttggtctttgtagtagtcagtgagggatgccataaccaaacactactgacagggcggcctagacaacagacactgattttctcgtggctctgcagattgcaagtccaaaatcaaagtatctggacgtttggtttctcctgaggcctcctgcgttggtcttcagatatccattgtcttgctgtgtcctcacatagccttttctctgtgtttgtgctctcatggtatttctgccttttcttaaaagcatgccagacctattacattagggcccaatacttacagcctagtttaacatgaattgccttggtaaagaccctatctctaaatacagcctcactggggaggttaaacttcagcaaataaattggccggggcggggggggggtgcagaattcactttccctgaaaggcatatttattctcaatgcttcgattatatctccaatatgatgtacaccaaacctgtctcttcaggtctcaggtcttatttgtgctacagtcacaaatgtatttccaactacctacgcaatattctcattctgatatcctgttagactaaacttgtatcaaaccaaactcattggcatcctggtcaaagacattttcttttctcgtgtccttgcattaatcaatggtttgatttggtttgaactacttttcactattcctgtcttcctcatttctccagccgataagcaagtcttactgataactctgttcaaaatgtgtttgcatttagtcattttatcctccccctctaccacttgagtaaaggccttcataacctcacacctgaaagagcacgataatcatctaccaccttggacccaaggtagatgctcaaccttatttaatgccctcctattgtgtatgagaggaatccattaataggatggtatgtcactcttattgttaggttatgttataagacataggtagctttaagaaaggattaacctaagttagacttaacctaatcaagttaccccttaaaagagacgtagctcatcctggtgaaggagacttcaatcatgagagaaattcaacaagaaacagattgttcattgttagctttgaaaatgaagggagcactcactgtggcacggaatgcaggcaggtgacagtccccggggaagagccagtgaggaatggagtcctcaatcctacaaccataggaattgaattctgccacagctacctgagcttggagaatgaccccaagctcctaatgagatttcagtccttattgacaccttgatttcaatcttgtggcactccaaacacagaacacatctatctatgttatgccaaaacttctgagctacagaaatggtgagatcaccaacaggggtctctttaagactctagatatgtggtaagttgttacacagccatagaaagctaacattacttggttaccctctaattcacctcccactgccacatttatatttcttgttcaattagttcattattttggtgcccttttaccaacctcattgaacattatcataatgctaagggcctatgggtgagtattatatgccttaaacatacacacacacacacacacacacacacacacacacacagacacacacacttcccagagaaagcagttacgtgacttttggaaacataaccaaactgtcaaaagaacataaaactagttactcatatttggaaaggtaattcagtactatttgttctgctatggtgtaaaaaaaatccacaatattttaatggcaatagttattaaatagtgaaaatctagcagcatttacatcaactaatgttaagttccataagtactatgcccaaatattattttatcccttatcatgttaattcctgccattgaaacttacacccagttttcaaagaactttgatttttgcctcacctaagacagcaagtctattcccccaatttggcaatacaaaaacttttgtttcaggcaagccaatgttctcagtgctccactgtgcatctctgttcaatgcgattcctttcagaaccacttatgaagaagaattcctctccatcaatccaaacctttgagatgcatctatgcatctatgaacttcttgttcataaattcattaattaacaaacatgtactgaagtacctactgggtatactagaaatgatgagatgctttttcattggaaattggttaaaactaataaagattaggaagctgtaaaaaaaaattagacaaagatctctatgcaagaatatcaaattatactggtcaaaattcatctctactttacaaaagatgtctgtaaaccacaggaaggagacattgtttttaaaagtatacatgtatagttggctatcttttgcttaacagagaaggaaaataagaaaacatttgcttatctttaagaaaacaagctcaggaagagtaagctggaaacatggcgttgatggaacacaagtggtggatggaggtagtggagggccaggaggaggcaatgggaggataggaatgaggagggaggcagccttctctgcagggaattttttgtatagattttgctcctggaaatatgttaaaggtccaaatacattcagtcaacaaaggcaggacaatcctataactgaaaacatactgaaacaaataaacctaattatatctcaaatggatatcattacctctgtgaagggagaaaaaaaaagaaatagaagtaatccaagtgattataattcatttggaataggccttttcctcacctctgaattgcaggggttgttggtatttaagtgattgaaggtcgtctcttatgttgccgcaatcccctattattttggcaggactcatgactcgtctaaatagtcagttttcatcttttatttatgctgtttttttctcctatgtacacactatagaaatggaaacttcactgtagtaaacttttccctctttgttaatgaccactgctggcctaaaaatgttacctttattttaacactgctgcctatggctattagaaaaagttgtttcacacataaacatacttcttggaaccaaaaactttccatataactaaaatgtaatgcttgactcatccagttctatctatctatctatctatctatctatctatctatctatctatctatctatctatttatccatctgtccatttatctatctatccatctacctgtctatctatctatacttcccccacacttatatatgatcctcttttaacgacttggggaacttttcaacattttgttactccactggcttttcacacaaatggggaaaagacagacttaagggtaccagataaacaaaaattactaaatagctaagagcaactgtctcaagggtcctggggacctggaggccctgctgccaatgctgggacccagcacctccactccagctgctgctgccagatgtgagtgccagggtagtcagatgtgttgtttaactcaagtgaaaatggaaatccaggtttttagatgtaatcaaacagtttccaaatattggcattcaattcaagatatttatttctaaactatctgagggccactcccaacccatctataggtcacattcagctgctgaggacattgtgagacctcagatatggaacaacaaagccaactagagatacctaagcaccaagttatgtattacaaacaagatttgcacacaagggagaaataaaactgggagcagaagtggaaagtgctgcagaaggaagacttgaactgaatttagaaggaaaacactacatcttagagtatagaaaataaaagggaaaaaaaagtttgccaatatgtcatggctaattatgccctcagtgtctttgtaaacggaagtgccaggccactattcactgaaacttagcttggttttaccaaacctcgaaaagttaatattatgatacatccagaaagatgaagataaacatgacatgtttataatgtgatttccccattctacctctaattttttaaaaaaattatcattgctttttttttaaagttgtgagtatgtttcatataatgtttctgatcttttctcaatgtccagttgtttttacttcttgctgggtcagagtataattcttgaacgagcttcgctcttatttccaaatgcttttagaccatgggtccaaaaagccatattagctagaattttgcataaactgaagataagaaaactatgagtgcatgacattcttataagaaaaatgttttggtttttagtttcctaattaagttttgttaaatcaatgttgtcagctctgacttctagtgtctctgtgtcactagcatttgattgctgaataagtattattttggtgtattttaaagtattattatctgtcacaatatatatgattttggaactatttgtaagtatactgaaaattctatatctaaaaccatatatacatttatcatatagatacacctatctatagtatctatatctgttttagatacatattttacatatatacatgttaatgtcatgttaatgacatgttgatatcatctcttttcttttacatgttttaatctttttcttgctcaattcccttgactatttcacaatggaaataaaaaagaagttcttaggaccaaatcttctataaccttattacacaattgggttatttctattattttttaaatatatggaaaataatcttcataagttccctttctcccaaatagtatattgtaaatattcttatacaattaaagatgggtcagaaaaagaattctacaagaagtaaccctaaatgaaccctagtctacataacaaaagatgtacaatggtcagagatggcctgactgagggtgtcgggtaatttggtaatgctggttcacaagaaatgatggttctaaggggctgcagggctggagagagtaccagacacccctctctgtggaggccactttctagtaaatgatcagctggtgttaacccctatggggcaatttccaatatgagtaattacttcttgtgcatctaaatcttccctgaatgtgcagctgggaatactttcattacatgttattctttccacaccataaattaatccctacacgtgctgtagatcccctgtgaatctcaaaaaggagttgcgaagattaatcatttaatttgtgtgaattgtgtgaaaattgttttcccctggctctttgagaagctcagtatatgctcagctgcacacaacggaagtatttgaacaaattaatttactgagcaactactatgtgtccggtactacgccaggcagtgggagaatgaagaaaattattagacaatctctgacttcaagggatttattagctagtaacaaaactgaaatgacatggttaggccacaacctcaaatgcctatggccaacgaggcagagctaagagcaactgtttcaaaggcccaggcacgctgccaatgctgaggcccagcacatccactccagctgatgctaccgatggacacgatcaccagtgtgtccaggtgtgttgtttaactcaagtgaaaatggaaatcctgctttttatgtgtaattaaccagttctccaatgttggcattaaattcaagatttgtatttttaaaactatctatctgtgggccaatccccacccacctataggtcacattcagctcctgaggacattgtgagaccatggatctgaaacagcaacaacaaaaccagctagcgggatggtgtggtggcttgtgcctgtaatcccctcaatttgggaagccaaggcaagtggatcacttgaggtcaagagttcgagaccagcctggccaacatggtgaaatcccatctccactaaaaatacaaaaattagccagtcatgctggtgggcgcctataatcccagctactcaggaagctgaggcaggagaatcgctttaacccaggaggtggaggttgcagtgaactgagaccatgccactgcgctccagcctgggcggcaaagagacaccgtctcaataaaaaaaaaaaaaaaaaacaccaactagatataactaagcagcaaattaagcaccaaattatgtattatgtacataataaattatgtattacaaacaagatgtgcatatatgggaaaaatgaaactggaagtggaaaatgccacagaaggaagacctgaactgaatttggaaggaaaatactatacctttgactatagaaaatgtaaggggaaaaaaacagtttgatgacatgtcatgattaatgatgctctattgcatgctaatacaatggagattatcctaaatgatggagacatgaccttcacagaaaaatctggaaggcactgcaaacattgaataattttcatataaactcagatgtgaacaacatccatgctcccaaacatttctccgctagtaataagaagatgattatgaaaatgaaaaccttgttcctttcagctattacgatataaaaagtggttattgttaatacattgtgagatcaagagtgttatacagacaagaatgatgaccctaacatttgctttcaagatgttttgaaatatttgtcaagctggtcattgtgtggagatgacatttaaggattaaaggctctttgcaaactcccctctcctggccatgcctggcctatgcaggatcctttctaataagaaaggatgcaaatgcatgggtggtgacaggcacgtggccttcttcaccgtcactgctaccaggaaccgagggatcactacacatgtctcagttgtttgtagcccctcagggtcaggaaacacctttcaaatccacgttttatttcctgatcgatgaaatgcagccactgtggcatattcatgcatctctgctaagaaagaaataatattcatgcatctctgctaagaaagaaaagtcaaaaatagaaggggaaaaaaaactttttgtgggaagagagaaactggaacaaaatgggttggaataaaagattgatgaagaggtattcaatgcttgcagggaaaaaactgggaaaacaattgatgtcaggaagctttagataagacactcaagaatttcattttaatatttattgcttgtagtgaaattgatcggtatctccggcatgatgaggtcatgaaagaagagattgatgcaggcaaattcattatttctgcttctgttctttctgttttgatattagtctattttctcccaataaactatcctattgcatacctcccaacttttgccatttgtggtaatgtaattttcctgtcatcttttatgaaatactagagtacccatctgttgtacgggtagggataaaatagcttccttcagaagaaaacactgactgtaaacagccaagccccatgaaagacaagtgaatcttctagtggtcctttatcagattatattttctggtgccagggcagcccatcttgcttgaccttttttacttatgtacatgagaaaaaccgtgggtcctaatcagtcatatgataatattctgggtttttttttcctagcatagttattcaactaagatattttaatgcaaatactctgatttcaatttattgaaatcaaggaaataaacataaaaaaatggaaacaaacaatgtaatttagtcaggtatcttgaaagatcaagcactacattatgtgtctcagagactggcttcagaagtcagccgctgtcctcagagacatgactgaccttaaaacgcaggtgacaatgataccccttttcctcagagattgtagcaaatcccaactcaaaatctcacaaaaacaaatcacaacaacagagtctcactctgtcacccagcctggagtgcagtggcatgatctcagctggctcactgcaacctacgactcccaggttcaagcgattctcctgcctcagcctcccgagtagctgggatcacaggtgcctgccaccatggccaactaatttttgtatttttagtagagatggggttttaccatgttggtcaggctgttctcgaactcctgacctcaagtgatctgcatgcctcagcctcccaaactgctgggattacaggcgtgagccagaaaatcacaactctatccagaagatgctcctgaatctgacatccagggggataggatcagctgccttcttggatgtggtgaagggatctttatctcagctgtcttgccgaataagcacatggagctgatttcgattgtgcactgcagatcagcaaaaatctttctacttacactgtgcgtaagctgtatggaaaaagttgtactgttgaaattatttttaatattatcacattgtaattgttagattagattttttttaacttttaagctcaaaggtacatgtgcaggatgtgcatgttagttacataagtaaacttgtgtcatggagttttgctgtacagattacttcatcacccaggtattaagccaagtatctattagttatttttcttgataatctccttcctctcatcctctgccttccagaaggccccagtgtgtgttgttccctatatgtattcatgtgttctcatgacttagctcccacttatatgtaagaacatgctgtgtttggttttcccttcctgaattagtttgctaaggataatggcttccagctccatccatgtccctgcaaaggacatgatctcattcttttttatggctgcatagtattcaatggtgtatatgtaccacattttctttatctagtctgtatgagaatatagacgggaagacaaagagagagtaatgaaagataagagctaaagtcccaccaaaccatcttaatttttgccaccaacttaggatacttccctcatgtcacatgtcaaccaaaactgcagctgtctgatccaccgtctcatgtccaggccaggtggcctctcaacatctgtaataccataatagcttcttccttggatgccctgcctctaccaggccagttccccaccatagccagagggccgaagtcctagcaggtgccatggtgacggaagcagaggatgccagaagcagaggatgccagatgcagggtcaggagctgaggaaagcaggcggcctgcagcaagaaaatgggtccctggagcctgcaggagcaacagccctgccgacaccttgttttctgcctggggcattctgacctccagaagtctaaaggaagaaatttctgttgtttaagttcccacgttcatggtaattgtggggtggggggagcggggagggatagcattaggagatatacctaatgtaaatgatgagttaatgggtgcagcacaccaacatggcacatgtatacatatgtaacaaacctgcacattgtgcatatgtaccctagaacttaaattataataaaaatatatatatataaaaaaaagcagcaatgggagactttacagtactggatacatgaaggttttatgtacaatttttaaaaactagtgaattcaaaacaactgacatacctttagggtcaatgaaatttgaaacaaccacagcaaatactttgttagtgtccatattattacataattattaataacattaagtataccatcttttcagtatttaagtgaaaatttacaatcattcagtaaggaaagttttctgatgaccatagcgttctttttacttggtaactgaaatagtgaaaacagaaaatcataaaggctatctttttccaacaaagccctgactggaaagaaataacaaggtcatagtctctgctaacaagggcaactaactttcctgtaacagttgaagttttgttatagtggtttgaaagattgctgatttataactttgagatttaaaacacttgctataagaatagatttgttaaaatatttgttgtagcaaagaaaaatagctgtgaaagatgcttcctgggagatggtttgtacctggcaactcataatcattagctcacaatgacttcactgatctgggtctaatcaaagcatgaggaatctgaaaatcagaaacatagctaagttattctcccctgtaaaatctattatacaggtgaaaataaaagttactctaacgacacataatctcaacttgtttaagtaataataatttttttcctttttttttttttttttttgagacagagtctcgctctgtcgcccaggcaggagtgcagtggcacaatcttggctcactgcaacctccacctcctgggttcaagcgattctcctgcctcagcctcccaaatagctgggactacaggtgcgtaccaccatgcccagctaattttttgtatttttagtagagacagggtttcaccgtgttggccaggctataaataattattatgtcatattcttaagactgctcagtgcttagggtgagaaagccttcccaagggagggtctgttctctcctgcctggtcatagggcatagtacatctctctccatttattttctattctttgagacaattattcctcatgttccaatattctttttcttttcactgtctttctgtcttgaataaatctccaacatcccccacaactatcccttttaagtttcagatacccagacaacaaagcacataaccaagacgcttgatcacacacacgtgcatgcatacacgtacacacttatacaccatgcatatatgtgtgtgtttgcacacaaaaatcttgcttcgcaaacagaaggcggcatgtaaataactgcttggaactcattggcagataaagaaacagaggagatgtcaattatttaagataacaaatgggtcttttctcttagtattgctcccctgccagagcaggttcaatcttaagaattttacctttatcccacccctctgccactgtttcattttatggccttaggactgtcatttggcttttccttgaccagttctttccataagacttgctggcctttgtttcctttctgatttttactgttctcttgtccttgctgccctcactgtaactggcttctgttcatttctccaacctgtcaagagcatttagaatcccattcctacccagctaggttctgttgccccatctgactttacgacatcctcatgcaaggtgaccatgtactctactccatcaccccagtcactgacgaagagccctgggcacagggctgacccaggcgatacaacacctgtgtctgccaagttaatggcattccattattaattactcgttaggagaaatgtgtgggatgacaggggataacacacacctctaacattcccagacatcgaagcaagcatctcatgggcttctgtggaagttcatttacataagtggttcttgatcctgatcttgtagaggtcataaagcctttgtggatcggataaaagctatggattatcttttcgaaaagctgtgcacacacacatgccacagcattttgcataaaatttcagaagattcaaggatttcccttgaagtacatctctagaactcctggagtttagaacattcaggttaagagtatctagtgaaggtaattttaaatattgtagcatctacattatctttaaaagaaatgtacactagatgccagaagaaaatataatttgaaggattttctttaatctagatgatatcacatatataccttaaaaataatcttgattgacctatgctctcaggccaaagaaagaattattcatgcaatcaaatgaaaatgatttttttctgctgtaaaaagtaaaattattttttaaattgtggtaaagtacacatttcatacaatttgccatcttacccatctctaagtgtacagttcagtagtgctaaggaccacagttgtgcagccaatctccagagccatttcatcttaaaaaactgaaactctatactcattaaagcattacacaataactctcaatctcccccttaacccagtccctagcaaccaacattttaccttctagtctctatgaatttggctactctaggtagttcacagagtatttttctttttgtaactggcttatttcacttagcatcatgtctcaaggtctttgttgctgcatgtgtcaggatttcatgcgttttcaagggccgaataatattctattgcatgttgcatgtatatactgtatcaatttttttttatttttttgaaatgtagttttgctcttgttccccaggctggaatccaatggtgcgatcttggctcactgcaacctccacctcccgggttcaagcaattctcctgtctcagcctcccaagtagctgggattacaggcgcgtaccatcatgcccggctaatttttgtatttttagtagagatgggtttcatcatgttggctagactggtctcaaatccctgacctcaggtaatccacccacaccagcctcccaaaatgctgggattacaggcgtgagccaccatgcccagccgctgcatcagatttttgtttatccattcacacatcaatgattacctggattgtttccaccttttggccattataaataatgctgctgtgaacgtgggtatgtaaaatcaaatttttagcaaagaaatcttactgctgtgtaaatactattgtttgttttaaatttttgaaacttttaaaaatcatttcattgttaggcacaactgacaaaaagagaagtacacaaaacaactcaatgagtcatcaggtagcaaacagtcatatcgccaccacccaagtcaagacacaaagaaggtttccatgtagcgcttgctctctgaggtgtgtctactacacaacacagagttcccatgcagaattaatctggtctccccaagaatgctgccagacagagattagtaatcccatgttctgggttgagtaaagggaagcttagagaatgtcttacaaggtcacatagctagtaagtgatagaaataggattctaaacatcagcctttttcaccccacctccacatgggttggactacatagaggccagctggtgcagtaaaacacatcaattatattaaaattatccagaggtataaatgtgactcatacttggttaatgaccacattgtttatccttttgatattcttcattgtgacttctgaccactgttctaattttgccctttagagtaatttaaacagatgccttaacatttccacatgcaagatcctaagtagctaaagaccgtgggcacatccccaggaagactcattcccaggaattctccctaggttctctcagggaacggcatctccaggcaacttactcccctgactgtcctcttgtggtcacattagtgtgttaacacccctagtaagtaaaggtatgtccagaactgacactgaattttagatgttcactatcaacccaacgaacagttcattcactcattcaacaaatatttctttagagctttgcactattccagactatacctcctctgacaatgctttgattaatgcagggaaagtcacaggcacatttttctactcttgccacactgttgtcttatactgaacatgggatcaagtaaaatctgtatgcgtttcacaggaactactgccaaggaaggtccccagcatcctatatttatataattggtttttcgaaatgatctttgtgctgtcttcacagtagatcaccagggtttcatgtggtaatatttcaaaattagtattttggtggttgatcaacagaatccaataatattttttaaatgttttttcagactttaaaagttaaatttttatatctgtttagaaagaatcctttccttccttatatgcctctccttccttaaaaacaaacaaatgaagtgtgtataattgttctctgttgttatggtttgcatcttatagccatgaactctaacgaccgacttcctatgtgctaaaagtggtaattgatctaactgcattacaatttttcaatataagcaactagttattgaagtggcttaatttggcaaggaaacacctaatgagtcaatggctttattcggttaattcagtgaaaagtgctaatgattcagaaagtttaaggagttattgtaaggccgcctgtaggaaagtactaataaccaagctatgaccaactgcctcaaaagcagggttgccagggtaggcaacttaggatacaaagcactcagtgaaatttgcatttcaaatttgttgttcatctgcaattcaaatttaactggttgtcttgtgttttatctagcaactctattttgcagccttcaacatagcaatgattaattaacaggagatgttaataccagatttacttctccatgggcattcactacccacaaaaaaggtagccaacgtattttgatgtttgacttctgcaaaattagaagacataagtcttttttggaaatggcttaaaaatagaaggggcaggataaaactgcagatgccaactgtcattttccactccatccattcatttcataaaattatacagccagaaaaagatcatttagtccaaatctatttacttagaaatgtcacaagaccaagaaagtatcttacttttcaataattcctcagaatctgacttcgcatctactcaacctatttcattttggatgctgtaaggtcttcagagctagaaaggatgctgcagtaaatctggccatcaggcagctaacaaagagggcacaccagacagcagacaatgggctaatgctggagatggccctggaagggcatgggtcaggttctatgatgtcctggtgatagaagtattccaaggctggacagttctgcaaaagggataggagctggggaaatcaagaggagcagtggccaggaaaaatgtgcgtgacttaggcatacaagatgtataggaccatgaaaaatgggaaagcaaaactccataagaatttttggtaggctgctagttttttaagttacattccacagccggatgtgatagagtcccagtcatgatacctcatgtcactggccaacagggttgattgagccacaaccaggcttatgaagttggctttgcccctactcactgcttcagctgaatatctccctaaactgaacattctggtaaaaatgacatcttcctagaaataagaccaatttaagcataggtgagattcacagtctataatagagaaaaccataatttatgactttttataagctaagtttatcattgctaacactgttctttctttcatgcacacattccaccgacaaacagccaaaaattttaaataaaccaaaaggattcaatacatattcacagttctagacttattggctctagaaattggggccttttccttttgttttatgctaattaggcttgaagtcataatttcccttaaacacatgagcactattaagcgccaattctggggtatttaaagagttacaaagagagtgcaaaaggggaaaaaaaacatgaatacgacctcattcctttctttaaaaggatctcagtatagttaatgaaataagacatatttatatgaaaagttggcatatattgcctgtgcttttatgtaaaagctgcattagtataaaaaacagtaaagattatagaaattcaaagaatccatatcacttttgataggggtgctcaaaatttcattgcagtaaaaaaaagagggaattgaacctggacttaaacagttaagattcaagtaaaactgattatttgagcatctactcaacggggagagtaggcttattcacatatattctctaaatttatgtcatttcattcaaacattaaagcatatcatttaccaataaagcctcaaccatttacttcttccatatttcatatataggtaatgatatggtttggctgtgtccccatccaaatctcaccttgaattgtaataatcctctcacatcaagggcagggccagctggacataattgaatcatgggggcactttccccgatactgttcccatggtagtgaataagtctcaagagatacgactgttttataaatgtgagttcccctgcacaagctctcctgcctgtctccatgtaagacctggccttgctcctccttgccttctgccataattgtgaggcctctccaggcatgtggaggtgtgagtcaattaaacctctttgctttataaattacccagtcttgggtaagtctttattagcagcatgaaaacacactaatacaggtaatgaggtatgctagtagaaattaagtttgtactgtgtttgttttccctatgtcttgggaacagatgtatcagaaactcacacactcactcgattggggagaaacgtggggattctctctacaaagagcacaatcactgaaagtagtctgcctgaaggatagtgtcctatttcaactttgacatgtgatggctcctgagggtagagcattgaaaagaaggcaaaggatggtcgagatacatcccattcacctatttccctgtctcaagtaaatgtatatcctgggaaggacagacagacatgtaatagggagaagtgaggtggctggctacattcagttcagtaattgaatatagatacaggtattggttctgaagtttttttaacatggtaaaatatatatataatctacctttttagtcatttgtagttgcacagttcagctacattaagcatattcacattgttgtccaaccaacaccaccatccaactccagaaatttttaattttcccaaactaaaactccatacccattaaacactcacttcctgattcctacccctctccaggccctggtaactgctattctattttctgtctctaggaatttgactacttgagtatctcataaaagtggaatcatacgatatttctgtgtgactgcttatttcacttcgaatattttccgagttcttccatgtcatagcatgtatcaaaattttattcctttttaacggtgaataataatatcagaatatgaaaaatgcctacagcagcaaaaagtaagccaaatagatgtgaagccaacaaagggcctccatgttatatacatacataccacattttatttatccacttattcattgatggacatttagctactatgaattatactgctatgaacagtgatgtacagatatctgttcaagtccctgccttcaggttttgggggtatatacctagaaatgaaattgctgggtgatcatctatatttcagttgtgtggaaccaccatactgatttccacagcggttgcaccagcaaagtacaagaatttctatttctctacatccctgttgaactttttacttccttttttgttgttttgataatagttatcctaatggatgtggtacttcactgtggttttgaccagcatttccctaataattagtgatgttgagtgtcttttactgagcttattggcgtgattatgaagatttgaaagttacattttataaacatagcatcaatccaggcaggccaaagatataacatttgtgaaagcaaaaacgaattgaaaaaacacaaacaggtgacttttcaatgccattgatcagcatgctacatttagtacttaaatactgaaaaagaaacttaaaaatccaaatatagaataaacggttaagtgtattacgaagcacttgtcacaaaagaacactaagttataaaagtaggaagactggtaggtaatacaccaaaatgtttaaggtggttatttttaagtgtgtttcataagtaagctttgttttattctttacacagtcttcatccttggcactcaagaaatatttcctgattaagtcacaaattgatttttttataatagtgtgtaattacgaaataagaaacaaacatatttgttttaaaaggaaaaataaagtaaactagtaaattggttctgctgtacattagaattgtctagggagcttttaaaataatataaatgtgtggtacttctcttcatcaaagatcagaatctttgggggtggaggagcccaagcatctgtaatattaatacacaaagaaagttgagaactactgttgtggaaaataagaatgaattaggccctttggaagtgttctcttcatcgtccgttgctgcagttgattaaagatgaaccactcaaccagcctaaattgttgacccacaaaaccatgtgcaaactataatagctgttttaatgctctaagttctgatgtggttacttacacaacaacaaattattaactcacttaaaattttccccaataagggcttattgtgtgttaggcacaatacaagtgcgtaacattcattatctcattaaattgtcctaacaaaccaataaggaaaatacattatttcaaatgaaaataggcttgggatgcttacacagtttgctctttagcatccaattccaatcactaatatactaacatttgcctaatataaattagaggaaattaagagagacaaattgcaagatattgcattgtaaatacataatacatacacaaatacacaaaaattcattgtaaataattcatcagcatgcttatttttcaactaatgtaaacactcaacattaggtagtcagttaggtatgcctttggcataactgaataatatatataatatacattgtactcattaggtaacttctcatcattcatcctacttccacccacttaccctgccaagtccattgtctatgactgcacactccatgtccatgtgtacacattctttagctcttacttataagtgaaaaaatgagctatttgtctttctctatctgacttgtttcacttaagataatggcctcccgttccattcatgttgctgcaaagtacatgattccatgttttctatggttaaatataattttattgtgtatatctgccagtttctttatccaatcattcattgatggacacttaggttgattccatatctttgctattatgaacagtgctgcaataaacacaaagtgcaggtatcttcttgatgtaatgatttttcctttgggtagatacccagtagtggaattttaaaactgtaatagaaatacaaaaagccaaaaaaaaaaaaaaaaaaaaaaccaagcattttaagatcaaacaagcaaaaaaaaccaaaaaaaaaaaaaaccccacaaaatttcaagatacttcaccaaaaaaaaaaatatatgaaaagcaaataggtaaatgaaaacatgtgcaacatcattaaccattaagaatgtgcaaattaaaaccattaagacaccactacacacctattagaattgttaaaaataaaaagactatttcaagaattggccaggatattgtgctgctaattgggaatttaaaattatataaccactacaaaaacagttttgcattttcatgaaaggctaatcatatacctcatatggtctagccattccactcttaggtattacccaaaagaaatgaaagtttattatgaaatattgaaaaaatgaaaatgcatttctaaacaagccttgggtaaaagaagaaatgaaaatggaaattaataaaattcaaaagtgaatgaaaatgaagacataacataacaaaatttaggggatgcagctaaagcaatatgcaaagaaaattttttgggactaaacagaaaaaagtttccaattgtcttcacattccaccttcacaaacaaaaaatgaagagcaaatgaaaagcaaagcaagaagaaaaaagaaaacaataacgatcaaggtgaaaaatcactggttgagaaaacagaacaataggaaaaagaccatgaaaccacaactttgttctttttgttgatcaataaaaattatactgtcttgtcaggctgatcaggaaataaagagaaaggatacaaattaccaatgtcagaaacaagagaagtgacaacactacacattgtagagataccacaaggataagagaatattctgagcaattttctacctataaatttggcaacttagatgaaattttacaattcctgtaaaggctaaacacaaggacctactaaatttcaagccagagagaaaagaaaacttgaatagacttatgtctattgaagaaactgatactgcattaaaaaacctcaaacgaagaaaacttttaggcccagatgtcttcactaatgaagtctatcaaacatttaagaaagaaaaagaagcaattctacacaaatgcttgagaaaagtgaagacaaggcaatacttccaatttattttttttcagccattattactttgatacaaaaacaagacaaagatattgtgagaaaagaaaaccgaaaatgaatattccttaagaacacagaaatgttaacaaatagaattcaacaatatgtcaaataacgatacattgtgactgaatggggtttcacccaagaatgcaagtttgatttaacctttgaaaatcaaacataatttaccatggtaagagagtgaaaaagagaaatataatactctcataaggtttaaaataaaagcatctgacaaaaatctgaagtctgtcttatacagtcccacagcaaattaggaaaaatagagaactttctcaacctgataaagatcatctatgaaaatctacagttaacattacatttaatgatgaaagattgtctactttccctctgagattgaggccttaatgttaagtcttacaacttccactcaacattatactggagctgatagccagtgcaataagtcaagaaaaataaaatgcataagattagaaaaaaattagaaaattcctattctcaaatgacttgattgcctccatagaaatttctatagaatctaaaaaatgtcattaaaactaataagtaaacttaacaattatctcggttataaagtcaatatacaaaatatctaaaattggaattaagaaacaccatttacaatagatcaacatataaaatacgcaaaaataaatttacaaacagtttgtgtgaattgtacactgaaaagtataaaacattgctgagtgatattaaagaagaaagacctaaataaatggagcagtatttgctctggaattggaagacgtaacattattaaaatgtcattattccccaaagtaatctacagattgtcaatcaaaatcttagaagatggtgatagaaactgacaagctaattctaagattcatgtgacaatgcagagaacctgaaacaggcaaaaacattttgaaaatgtagtacaaaattaaaagactaacaccatctgacttcgggtctcattgtaaagctacagaaatcaagacaatgtggaattgacatcaagataaataaatatatcaatggaacaaaatgagggtaaattcaaaaatatgttgaccattgagcttttgaccaagtatcaaaggcaatttaattgataaaggacggtcttttaaacaaatggttctagaacaattgactatccattataaaaatatgaactatggtctatatcttgcatctcttgcaccatatataaaaatgaacttgattcacaatagcaaagacttggaaccaacccaaatgtccaacaatgatagactggattaagaaaatgtgacacatatataccatggaatactatgcagccataaaaaatgatgagttcatgtcctttgtagggacatggatgaaattggaaatcatcattctcagtaaactatcacaagaatgaaaaaccaaacaccgcatattctcactcataggtgggaattgaacaatgagatcacatggacacaggcaggggaatatcacactctggggactgttgtggggtggggggaggggggagggatagcactgggagatatacctaatgctagatgacgagttagtgggtgcagcacaccagcatggcacatgtatacatatacatatgtaactaacctgcacaatgtgcacatgtaccctaaaacttaaagtataataaaaaaaaaatgaacttgaaatggatctcaccaataaatgtaaaatctaaaactgaaaatttgaaaaaccacttatagaaaaaaacataagagaaaatctttataatctttgcttagacaagaatttcttagataataatacaaaaatctataaaaatctataaaagacttcatttattttgactgtcaaaataaaaaaaattaaagacttcaaatttaaagatttttttaaaaagccaaatattgagagaatatcttgcaaatcacatatttgatatatgatatattcttgtatctaggatatatataaaaattttcaaactcagtaagaaagcaaacaatcatattgaaaatactaagaaaaagatttaaacaaacacttcatcaaagaaaatacttgagtggcaaataagcatgaaaagatgtgcaacatttttagtcattagggaaacgcaaaataaaaccacaatgagatactactacaaacctatcagaatgtctaaaattaaaaaggctaatcataccaaatactggtgaaggttgggaataactgaaactcccatgcaccgcttctgggaacataaaatggtaatcagtttggaaaagattttggtgatttttacaattgagacataagctgatcatatgactaagctattctactcctagaaatgaaagcatatgtctattcaataattagtacacaatattcagagtaactttatttataacagtgcaatagccaaaaatgtgataaaaacaaatgtcaatcaacaggtaaatgggcaaatactgtggtaagtctacacacctgtatacaggtgtgcaactttctagtgtgtagatttaccacagtgtttacccacttacctgatcatttgtttttatcacattaaatataccagcaacatgaaaaaattttaaaataattatgtttaataaaacaggccagagtaaggagtgcattctatattattccatgtaagtacattatagacaatgcaaactaatctagagtggcaggaagcagattagcagcttcttgaggctgggaaagagtggggaaggtgccgcaaagcagcacagagaacttcttggggaatttctgtgtttactgtcgttactgtggtgatggtactgaggtatacaaagacactaaaattcacaaacatttatatgccagatacatgcagtttattgtatgttgattatgcctcaataaatccacatgaaaagaaacccaaattaacccaaaattatttgtaggggtaaagtaaatgcattagaatacaggtagacaaggagatactggaaatcttgaacagtatcagtaatgctttgctaagcactggcacagggggtccacaggtgcgcagggggtccacaggtgctcagttcataattctgcttcacaacttgcacacacactataaactctagtatatataaaatagtaaaaatattgatccttatatacaattaaaatggcctctatttcacaatgacaaatatgtgtgtatatgtgtacgtatctatgtgtaagtgtatatgtgtacatgtatatgtactggaatgtgtatcggcatgaaggggaagaataaaaataaaaataaaatgacaaaaatgtctcacatgaaccaatggcaatattgtgtcctaaactagtgagtatgactaattcaacttttgcatctgatgtaaaacaaaacaaaacaaaacaaaattactactgttgctttaatccactgggtgatttcccagtaatttaatttaaaaaaactggcattaagaactaagcagaacgaggatattttaatttggaaaaaaaaatccataaatacacaagtaataacattattttaaaattaaatgactgatttcagaaggaaatgttttcaacaactttattagtgctagagccctcatgccacagctcctggaagacttcaggctctcaatttaagctctttgaatgtaaagagagccagacaaacagcttttcttctgtaacactccatttggctggttaacacaagttatcgattctgggatttagggttgccaaatgctttcttaagagctctgtgctattgactatcctcgtttcctctgcacttcttttcttagtcttgggtaaaatttaaaactctttgtaccatttttcaactcatctcgacggaaacagcctcaatttactataaaaatgtcaatggctcactagtgacctaacctcaaaggattgggaacgctgcctcagacatctcttttctatgttcccagggtctacagaggctctaccacaacaagatggggaagcccagtctgtaatccagcaggacagtggaatgctactggtgagacctacaaactaagtctgcagcacagtcctgcagcttccccgaaagctcagcccaacaagcttcctgaatttcacattcattttacacaacatacatgttagtagatatttttaacgtacatatgtctatttaggggaaattattagcatcattattgccaacttacaagttattattttgcaagttttatgccctttagaagtgactttgtaacagtttaaaatattattttctttaggtaaagagtcatatttgaaaaagagtaagtcaaacaaattgtatacattttataaatttgttgaaaaccttattcttagagactgtaaagcaatggagatctttgcaaacatccgtggtcatgtctaatggtgacggcacacataatagccaatcagagctcagtaaaacataagccagcaaatcagaggccgctcatagaaggagtccaaattcctttactgcaggatgaataacttgtaaaatcctaacattcacattctaatcctctgaatgaatgctgagtagggaggagacgaagcttagaagcaaaaggaagcttgcatcctttgatgtcctctattgttgaagttacaacaaattaagacaaaaataatagttatgttagaagacaaattaaatacacgaatcataaagtagaaagaatttttgaagaaatgatattcagcgttcccagggattataagtcaggcaaaattaagtcatgcagcattttaatgtaaatattttgcatgatacatttacccacaggcttatcctaaagcagtatgtttgcacttttatcatttgccttaggatgaaaaaaaatcaatgaatttaagagttttaaacctctttaatatttgcacaatattagatgtgctataatctcatataaaactacctcctagagagcttttgagaattgcttttgcctggggtctctggtactaatacttcaagagattagaaacatcttacttaagaagagttttctttttgcccattaaaatcaaacaagctttgttaaacactgaggcagaagagattcataaatcaatgatactcccctgaactgcccaaggtttgcatcatagattaaaaaccaatctcagaattgaaaaagctacagtgccacatatctgtcacaacactaatttactgaacttaggaagaaaataacactagcatagatttaaatagttttctatgcaatatgcaatgaatcaatgtactgacttgcttggggtttatgaaaacaacaactgacaatgaatatcatcctaagtaaagagaggagttatggtttaaaatcatgtgactacacaattcctacatttttttaaagaataatttacatcaaaatttttctctaactctaccctattatcacagattcttttccttgcattcttttcaatactatttatctgctatgaataatatttccatgtttaaagcattctattattttatgacctaacaaactccaggatttaaacaatgctcatctaacaggaaataccgcccttccaatctaaccttcatatgctttcgttttcttccttttcttctctctgaacatggaaaatgagtgccatttctatgctgaatattgatcaggagagaaaaatatatgaggtgtgagttatattgtgactacggtgattttccatccactcagtattacttatcgtgtcaatcacttaatcctgcagcataagttcttttttgcttatgatggaaagttttgttgtgttttattttttatttttgttttttgaaaaaagacatgagcaatctgattttctttggacttcacaaaatccaagaaagaagatttactgaaaattcatttcttaaaaaatgtgaggtccttgacaatggtcttctctacagtttcaatgttaggttttgaaaatgtgaggtccttgacgacggttttctctacagtttcaatgttaggttttgaaaatgttaggtccttgacaatggttttctctacagtttcaatgttaggttttgaaaatgttaggtccttgacaatggtcttctctacagttttcaatgttaggttttgaaaatgttaggtccttgacaatggttttctctacagtttcaatgttaggttttggtcatctctgagcgtgcataacatgaatggaaagtttttttcggagatcagaccgttatgatttttggaagtgtttcctgtcaaggagaagctcatggtctccaaggtcttatctttctactgggtggatgggccaagggaacacgaagaagcataatggagctctgtctgagagaatcaccagagtcttccccagcgtttctcaatggtctacaaacaggtctgcgggcttggatcacagacggagatccaagatgggcatgggcatttacgtgggcagggcaagcgacgctggccacactgcaaggccctcaacgttcccacgtgaaaaaagaaattgttcctcaaacagcaccactaggtcgggtgcggtggctgacgcgtggaatcccagcattttgagaggccaaggcaggcgggtcacaaagtcaagagatcaagaccatcctggccaacatggtgataccccgtctctactaaaaatacaaaaagttaatgggcatggtggtgcacacctgtagtcctagctactcaggaggctgaggcaggagaatcacttgaacccaggagacaggagacagaggctgcagcgagccgagatcgcaccactgcactgcagcctggcaacagagtgagattccgtctcaaaaaaacgaacaaacaaaaaacagcaaaacaagcacacgtgagaagccctgcttgttctgtgaacacagtcatttctgcctttccttcacagtaattcaaaagcatttactgaacaacgaatgtgtattagaacttacaaagatgggtgaataagaaacagctccttccttcaaaggtctccctatctacgggagaaaagagaccggtaaataaagggccgtgcagacgtatcttataagtgctgagctagcagcaggacaaacgaataaaggaagaaatggcagctctgatattaaagccctcagctcctcctggaaagaggaaccaagccttggtgaagcttcagagaagaaggaacaattaaaacaggctccagggatgaggagaatggactggatggaggaggagcgagcggctgccaaggtaggtgtgcctccaagcacagaaggcagccaatggtcatgcccggttcctgggccagagagcaggggggtggtaccaggtggtgctagggcccctgctacatggctggagtttctcttcttctctagttcattccatgttctaaacacaacaaatcacattgcctccaggtgttaggaccaagaatattaaggtcctgaaccaaaatgccaatatttggtaaaatggcattccctcatttatatatataagtgcgtatctgtatgtgttcgggtacttctataaaatctgccagtttttaacttcctaaatataatggctaactcttttattgtagacaaaataactaaataattgcacagacataatccaacatcatgggtttgattttcttaagggtagaacagctccagccatataaatgcagtgtgtgagtgaaaatgaggacggaagagcgggtgcagcacgggggacccagcagtccttgagccaaggtctggaccctcaaaagcagtggacgtggaaggtggtagctccgatagccagtgggcatatacgcacagagagcctcactctccagctccaaagccttccatatcgatggctccttttagcactacagggtcctaaggagagatgtcaaaaatgtttaacaaccgttgcagcagtaccgggttggaagggactccgtaagcaagttcctacctcctgagcatcaggtctggccttggtgatggtttttctctgtcaaggagattttcagcatttgcagtacattaattttatgcatgaaatttatcttcatgtactgttcctttgtttatttttgagaggaatataaaggggaactaagaacaaacttttgctcgaagccctactctagaaagaattctagagtaacaggatctctaaatttcaaaggaagccaaaaaataaaaaaataaaaaaactcaataattttgtacattttatatatgttttggtagaataaaataaatcctgtaaaaccacagaaaggtaatttaagtacttggaaatctatgtcaatatagccaagataatggaggtaaactaacctggatcagagaaaacaaaagttggaaaacactgagggatcatcttgtcggcctatcagaaacggtatccaatctacaacatcacagcaagtcaacatccgatttcttcttaaggctttccaacagcaagaactttgccatcttacaaggcagtccatcctatcaatgaatagctctacgtcttagaaagttcccctcaggaaagaaatctggtcctctatacctttcatctatcaatccaagttctgtcctctggtgtcctaaagagcaagtcaggtcttttgaaaaagatgtctcttctcatatttccagtgcttatcatgtgcctctataattatgctcttttccatggtttataagcacattgctgatgtgatgtggggtctctgcattttttcttggtgctgtcttgggaagcggcatagtatggtggtatcttctgaaactgcagactccaggcccaaatgggctgtggaaaggggaccttctttatacatgtacataagttctgagcaataaaaaattttattctatctggtatttgtgcagtagctttttataaaagaaagcaaacagcttcacctttgtttctgttatatatcctcctgttggttcagcgcataattccaactataaaggctgaaactgaattctagatattgagtctgtcactcagggcatccgttgttcctgcaagctcagaaccaagtctgctatgcattccttctgtgttttgtacaagcagatggaaaatgtctgaaacaaaaagaaactaaacaggtagtgctttcacatgccactagagatttccttctacttcaactgtgccattgtatttaagtgaagttctggaagttacaaatccccctgttactctgctgtcctatgaaaggctatgaagaaggtgcatgtgtgaaagtgccagctgcttcactgacacactcaccttcacagcctaagcaagggtgttgatcccacttgacacatcaggaactcgtgttgtggaggcattcaacagcccacctaaagccactgagtgggtgggaggcaggtgagtgactgcaatacagaccccaggggtccttcacttacaaacacatcaagagaagacacagtgttgatgcccagatatatcgtttcaggttttccatcactctattacgattttagaaataattttaggcagggcacactggctcacacctgtaatcccagcactttgggaggccaaggcaggccgatcacttgaggtctggaattcaaggccagcctggccaacgtggtgaaaccccatctctattaaaaaaaaaaaaaaaatgccaggagaattctatcacaagaagcacaaggatgatctgtgccccgccataattcaatcgctcccaaccaggcccctcctccagcaatgggaattacaatttaacaggagatttgggtggagacacagagccaaaccatatcaaccatcaatcctaaacagtgggtttaactttcctttcaggtctcagaaaagtacacaggacaataaaatatgcccgcttcatcatttcatttatgtatccatcccttcattctttcatgctgtaaacaacataaactgtagctcattcctttcttctgctctatgaaaacatttttacagcttcccatctttcttcctacttatccttggttacttgtcatttcttcagcatttgtacttcccctttcaaaatgtgagcttggtggacaccacctaaattggttttgttagatatcaccccatttttctttctgagtatcatcacatgtcagtaaatagttggaatttattcttccagaaccttaaatcaaattccttcagaggatctagaccctgccttttctagaaatgtggaggccagttttcctaaaagccatagtacgtgtctgattgacctggcattttctttcttgctgactgagacctccgtagcggtggggttattgtctctgacactgcaactcagtatggaatatgtgttccccttgtagcttcctccaccatttttgagaatgcatgttaaccaataaagtcaaaactttaatgacttttagtgggatgtattcagatatttgttcattcaataagtattgatcaatttcttgcaaaatgccagtcttgtgacctatgtagttaaaatgtcacccctactcttccttcccaagaactctgccatctgctctttaaaggttacaaatgctggctcagctcaaccagaattaatccaggcatgtggtttctttggctaacatgttgcattacaaaacgaagtcatttctccaaaatttcacatacaagatttcacatacaattccaaattattaattcctcttgaaaaactggaagacaactctgagactatatatccatagggccaaaaccagtgagagacaagcagcagcttcccctgcagaaaggttttatttctccatgtgaatgaagataagttctccaggagcagtgtcaacacagcacacaacctggcctgcgcccctctctctcctgagccctgtaggcatccaggtttatacctcctgccctaagtaaagcctcaatcctcctctcctttaggacgcacataaattatttctgccattcctgctcccttggattggtaaattatcgtatcagtataaacccatgccatcactagcccatatggcccttcatgaaaaattggaaaaaggcaccctaattctactttatatccatctgttggaaaattgctgtgaattactgattttgtcatatgaagttacatggcttctttatcccagaaatttatcataataaataaccaatagcaaatcttggaatcgcactgtgtgaatggtgtccctccacatgagacactggcaggcagggcccagacagcaccaacatccacgacagcccccaacccacacctgcttgtcacctactacagttccatccaatagcaccaccaccaacacttccactgccccacacacagcttcatgaaggccattatgccaaggggaggttttttccttccaactattatttctatgaaattttttccttctaaaatttgctctccaaatattttaccctgcacagggctctacatgctgctatttgaaagaccagtagcagaatcttcactaaccttccaaacagatattttgagataatattaaggggactttatttccatagtttaaagaaatattttgccctgttactatactttttcctattttgaattttaactagagaaagagacccatatattcttgatgtgaaaagggacaagttactctttctctgctactctctttttataaaaaataaagcaaataaaatgccacattaaaatctttttttttttttttttgaaacagggtctcactgtccctcaggctagagtgcacatgcaggcacacctcttgtcattgtgcttcaagttgttgtgctttgaagatactgcattttttaacaaattgaaggtttatggcgaccgtgcatcaagcaagtccacaggagacattttgccaacagccatgtgctcacttcatgtctctgcatcacattttggtaattcatataatatttcaaacttttccactatcattatatctgttattgtgatgtatgatccacgatcactgacataaatatcgtctagttttggggcaccaccaaccatgcctatataaaacagcaaacttataaatgttacatgtgttccgactgatacgccaactgcctgttagacactgtctctgtctttctcctcaggtgtgcctcccgatagcctgagacgcaactatactgtattagaccaattaataatgctacgacggcatctaaatgttcaagcgaaaggcagagttgcatgtctctcactttaaatcaaagctagaaatgataaagctcagtgaggaaggcacgttgaaagccaagacaggctttgcaccaggttggctgtaccaacaagttagtcaagttgtgaatgctaagaaaacttcatgaaggcaatgaaaagtgctactccagtgaacacacaaacgaaacgaaagcaaacagccatattgctgatatggagaaagtctgagttatctggatacaagatcgaaacagccacaacattccctaaagccaaagcctaatctaaagcaaggccccaactcccttcaattctacgaaggctgagagaggtcaggaagctgtaaaagacaaggttgaagctagcagaggttggttcatgaggattaaggaaagaaactgtctccatcatgtaaaaatgcgaggtgaagcaacaaatgctgctgtagaagctgcagcaagttatccagagcatctagctaagattggatacaccaaacaacagatattcagtgtagagaaaacagccttttattgcaagatgccatctgggactttcatagctagagaggaaaagtcaatgcatggcttcaaaacttccaaggacaggctgattatcttgttaggggcaaatgcagctggtttaaagccaatgctcatttccattaaaatcctagggcccatcatgctgaaatttctgtggccatgctctataaatggaaaaacagcctatatgccagcacatctgtttacagtgtgttttaccgaatattttaagtgcactgttgagaactccagctcagaatattactgcttattgacaatacaactggtcacccgaaagatacacaaggagattaattttgtttttatgcctactgactcaacatccattctgcatcccatggattaaggagcaattttaacttgcaagtcttattatttaagaagtatatttcataaggctatagctgtcccagatattgagtcttcttatggagcttggcaaagatctttgaaaaccttctggaaaggattcctcatcctaggtgctctaacaacattcatgattcatgggaagaggtcaaaatatcaatatgaacaggaattagaagatttggattccatctttcaatgacttactcctcagtggaggaagtcactgcagatgtggtaaaaataacaagagaacaagaactagaagtggagcctgaagatgtgaccaaattgctgcaatctcattacttgaatggatgaagagttgtttcttatggatgattttgtttttgtttttgagacaagagtcttgctctgtcctccaggctggagtgcagtggcctgatcttagctcactgtaacctccgcctcctgggttcaagcgattttcctgcctcagcctcccgagtacctgtgattataggtacacggcaccacgtttggctactttttttctttttcttttttttttttaattgttgtatttttagtagagatggggtttcgctaggttaggcagggtggtcttgaactcctgacctcaggtgatctgcctgcctcggcctcccaaagtgctgggactacaggcatgggccactgcacctgacctgtaggttggttttgagacataatgctatcgcataattaatagactacattacagtgtaaacataacttttaaatgcagcgggaaaccaaaacactcatgggttgcactttcttgctatatttgttttaccgtggtcttctggaatctaacctgtagtatctctgagggtgtgcctgtaacaataccagagttcattttttctaaatataccttttgttaaatcaccaccattttcttaaaaagcaatatgtttatgccaacaacatactcagagtgagattaaattctttaaaagaagttgactttttgaatgtaataaacttaatatataataattacatcaaactgctcttatttctcctattttatcgctcaccagtgattttgataatgccttcttctcctcacccttctacacagttcaaggccaggcctgccattccttcagaggtagagggctacacaactggtaagtccatgccgagtgaagcgagggtggccaactcttccagcaaagagaggggccctgggacttgagactttaagtgctgaaacaggaaacgtcctgggtaaactggggaggattggtctcacttaagggcaactagattcaagtaattacagtgattctgccacacaccttggctttctctgagcagtgcggcccatctcacactggaatgcgtgatgctaaagaacctctacagggtaagcaagggcagcaaggacaatggaatagttgggctccatctgtgaaataccagagcagcaaacaggagtatgagaggtttccataacactttctgaagactgtttgtcatttttccacttatctaatcaggtgttttcataaaactcaacagaatatgtatacaagtataaaatgtatacaatgtatacaagtataaaatgttcatattactctatcttcacctcttcttctttttcactagaaagatgtcacactctcaatgccaatttcagtctatgttacagctacaacgatacctcctctctctggaagcctcaggggaatgtctgggtaatggagagcaccgtatccacactttacaattttaaaacttaaagccacacatctgcggcacatgacagtgccaactgccaagtactgaactgacagagattcacaccataatgctaattctctgcacaaggaaggaataaaagtatgtgtcaaaaatctgaaaatgattgatgcctgccatctcatcaagactgtctgtcacacgatttcgattgatgatttgagattgcatgtgagcgggacgcaggtgctgcaggttgcctaactagctcaacacttattctcaacaacacaaagacaaattaatctccacatcagaatactttccataaagttcattagactttactacatctacaaaaggcttgaggtggttggcctaatctcagggatactaaattcctaaccatagaggacagctcaacaaatcagccactttcaaaggtactggtgagtccaagagacccaaaaatgtgagaagcagtgctctggccattgtgaaggcactgaattgttttcatcactgggggagaacatatctactctcagataaggatatccctggattttctggctgtccagttgagactgctaaggactcggtcagaggtgtaattagaagaacaacttgtgatttcagtgattatttctaaagcacacagtactgtttaaacatgactcttatgtatcttgtgactacaaatattgaattagtaaactctcatctctaaaaaggaaccccaaatattgacttgaaaataaccacttttagccacaagattatagatgcaacctgttgaaccatttagtatgaatctgcctaattaagcaagaggatttcaaataaccaaatatttctattataaaacacaacccaaaataacagttaagaaaagttatctcacctcccccatcctcacataaccaaggtatttgaaattgttttaatatttgcataaatatttaaaaagtttcacctttaacagaataggtaactagacgatgcctcatcttttctcagagttcaacacatttggacccattctttagatgaatgcacttgtttataaaaatgtgtgatgaatgtcactacattagcacgtaatagataatccaagttattttcagacttaatcagttgtaagtaaagtgtgagggatttgagaacacagagagagggctggtggctctgcagctcctggtcaacatggaaaatatgcagcatttcccgtggagcctctcagtctcgctggcagctgcaggatcagcaggtctcgatccatcatcattcctccttggccccatacgggctgtgaggacacctgggtctaataacagaagctaatcactcggcagtcatttatgaaagagacataggaatggaaagaaaaccaggaaaaatgaaacagatgaatacaaaagtacgctgaagagactgatgttaaatggaatgggattataggatattttaagaaaatgtgagagtattacaagtaacaaactacttctaatagcaaaatattgccataaaaatacattattaatgttacataatacacaatatttcattataacatattataaatgcatctttaaatatctttaaagttttaagaggataaatctaaaaattaactttccgataagtttggaacatgcatagaatgtagagatttaactttgataaataactctgtactaggacagtggcccgggagacagaaggagaagaagcatttgctcctgacttcaaggttcttaccatctccaggagagacaaatgtacaattataaccacagcaggagatgataaggctaataggtaaatctaaaagaagtagtctctgaaaaagagtgttctctccctctccctctccctctccctacggtctccctctctttccacggtctccctctcatgcggagccgaagctggactgtactgctgccatctcggctcactgcaacctccctgcctgattctcctgcctcagcctgccgagtgcctgctactgcaggcacgcgccgccatgcctgactggttttggtggagacggggttttgctgtgttggccgggccggtctccagcccctaaccgcgagtgatccgccagcctcggcctcccgaggtgccgggattgcagacggagtctccttcactcagtgctcaatggtgcccaggctggagtgcagtggcgtgatctcggctcactacaacctacacctcccagccgcctgccttggcctcccaaagtgccgagattgcagcctctgcccggccgccaccctgtctgggaagtgaggagtgtctctgcctggccgcccattgtctgggatgtgaggagcccctctgcccggctgcccagtctggaaagtgaggagcgtctccgcccggccgccatcccatctaggaagtgaggagcgcctcttcccggccaccatcacatctaggaagtgaggagcgtctctgcccggccgcccatcgtctgagatgtggggagcgcctctgccccgccgccccatctgggatgtgaggagcgcctctgcccggccgcgaccccgtctgggaggtgaggagcgtctctgcccggccaccctgtctgagaagtgaggagaccctctgcccggcaaccaccccgtctgagaagtgaggagcccctccgcccggcagccgccccgtctgagaagtgaggagcccctccgaccggcagccgccccgtctgagaagtgaggagcccctccgcccggcagccgccccgtctgagaagtgaggagcctctccgcccggcagccaccccatctgggaagtgaggagcgtctccgcccggcagccaccccgtccgggagggaggtggtgggggtcagccccccgcccggccagccgccccgtccgggagggaggtgggggggtcagccccccgcccggccagccgcgccgtctgggagggaggtgggggggtcagcccccgcccggccagccgccccgtccgggagggaggtgggggggtcagccccccgcccggccagccgccccgtccgggaggtgaggggcgcctctgcccggcggcccctactgggaagtgaggagcccctctgcccggccagccgccccgtccgggagggaggtgggggggtcagccccccgcccggccagccgccccgtccgggaggtgaggggcgcctctgcccggccgcccctactgggaagtgaggagcccctctgcctggccaccaccccgtctgggaggtgtacccaacagctcattgagaatgggccatgatgacaatggtggctttgtggaatagaaaggggggaagggtgggaaaagattgagaaatcggatggttgccgtgtctgtgtagaaagaagtagacatgggagacttttcattttgttctgcactaagaaaaattcttctgccttgggatcctgttgatctgtgaccttacccccaaccctgtgctctctgaaacatgtgctgtgtccactcagggttgaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaaaaaaaaaagtagtctctgatttttgcaattttatttcgtgagaaccaagaaaatcagaaaagctctctaattctatgcattttgtcccaattactcagtttctctatttcaagtaaattggatataacacttgaataggattctgccttgataagtatttatccaaccttattctaaagtttaattcattgttctgaaaattggatgaaaaaagtgaacttcttaaaggtttgtgaataaaaaatatatagtcaaaccataatgaaattcttcctgaataccaatgtctagacatttccctgtagaaaactggcagatatctaatagagtattgcttctgaaaattaactgtgtagttctgtggtacaaaatcacttgtaaaaaatctcctggtgtcaaaacagcatggaactggtaccaaaacagatatatagaccaatggaacagaacagaggactcagaaataacaccacgcatctacaaacatctgatccttgacaaacctgacaaaaacaagaaatggggaaaggattccctatttaataaacggtgttgggaaaactggctagccatatgcagaaaactgaaactggaccctttccttacatcttatacaaaaattaactcaagacctaaacgttaagacctaaaatcataaaaaccccagaagaaaacctaggcaatacctttcaggacataagcatcggcaaagacgtcatgactaaaacaccaaaagaaatggcaacaaaagccaaacttgacaaatgggatctaattaaactaaagagctttgctcagcaaaagaaactatcctcagagtcaacaggcaacctaaagaatgggagaaaatttttgcaatctatctatctgacaagggctaatattcagaatctacagggaacttaaacaaatttacaagggaaaaaaaaacatcaaaaagtgggcaaaggatatgaacagacacttctcaagacatttatgcggccaagaaacatatgaaaaaaagctcatcatcactggtcattagagaaatgcaaatcaaaaccacagtgagataccatctcatgccagttagaatggggatcattaaaaagtcaggaaacaacagatgctgcagaggatgtggagaaatagaaacacttttacactattggtgggagtgtaaattagttcaaccattgtggaagacagtttggtgattcctcaaggatccagaatcagaaataccatttgacccagcaatcccattactgggtatatacccaaaggattataaatcattctactataaagacacatgcacatgtatgtttattgtggcactgttcacaatagcaaagacttggaacaaacccaaatggccatcaatgatagactggattaagaaaatgtggcacatatacactgtggaatactatgcagctataaaaaaggatgagttcatgtcctttgcagggacatggatgaaggtggaaaccatcattctcagcaaactaacacaggcacagaaaaccaaacactgcatgttcccactcataagtgggagttgaaaaatgagaacacatggatacagggaggggaccaacacacactggggcctgtcagggggtggggggatgggagtggatagcattaggagaaatacctaatgtagatgatggattgatgggtgcaggaaaccaccatggcatgtgtatacctatgtaacaaacctgcctgttctgtacatgtataccacaacctaatgtattaaaaaaaaaaaaactcctggtgtcacttcggccattcaaagtcaaatgttcttctaaatctaggtattcattaaattaacattgtagagggtttgctttttaatgaaatagttttttttgaaacctcactaattggtatagtgactcttgcatggctcttccatcggtatacatatttaagtttgaattattgctaaatcctctttgtgaataactaacttggccttgttctttagttctgtgtcaacctatttggtagaaagtggcaaaagtagaggcaagaatatttcaaatcatgcaagtgatgctgaactcagtttctgtcatatatttaagcacatctgattatggccaacgtttcccttcaactttcactctacatgattgcaatatagtttttccacgagtaagtgagaagtgcagataatactttcaaaacaaaacaaaacaacgttggtgtttaataagaccctgaataagctattgatctgtgaattagcaccaggcacgatgtgaagtagtttacatatattatctcatatcaccttcttaataacttaatgaggtgctattatgataaatattatagggtgaaaaggactaatcattaagaagtcaggtcacttgccaaagtttacatagtaagtaagtggtggacctgggattttgactcattgattaattgacacgacaaataattaagtgtctactatgcaccatgcagtgtgctagggagggaagaatcatttacttactcctcagtgactctaaggcagatttaaggcacggcttctctaagctcttgtgttgtcatttgccgcatgacacagacatagaaactagagtgattttcctccttgtcaagcccaatcatggtgatgattttaaaaaatattattaatgattacctttggcttctaatccctaacgtgatatacttatctactgattacagaaatctttgcttagttttattttccaagcaaacacaaaatatgatggtaggaaaaaagagtccaggttgctcctttcataaaatcttattcctaggtttctctcttgtggcactttaaaaaaaagtatccatgaaagccaaggattgatgtaaataaccattaggaagagcttaatgttgacaagtagaagtcgagtttgttttagaaaaacaataggaaaacctgttatatactgtctgcaatgctaaataaatatttctcatcagaagaaatatctgcttattacatttttgtcttcctgattagtatgctttattcctgacatcaacttgaaaaaagatgcaataaatgagaagtttaaataacacaggtataagactgttaaccttgggatcaagggattatttgttaatatttttaaaatgataatacctttatattaaggctaggttctagacgcacctcacattctccacccctttctggctttgcagaagccatgactgggtctgtggaataaagccttagccatcccgtgtggttgttgtttgctactacagcagtagccatagctcttaccctcccctaggaacagcaagttgcattgctatcctggtttcccagaaacagtaataagaaaagagtaggaagtataatggtagactacatggtggcactagtggtggatcaggtgaagtatattggatatctgagactagatggggtttttttaagtgtacttacataggatcaaacaacatttaactttctgaatatgcatttagtaagtataaggcacaagttgtttctgtacattcattttcatggaaggggtgtgtgtgtgtatgtgtatgtgtgcaagcatgctcacaagtgtagaagacagggattatagaagtaaaataataatgcaagatatgcaaaatttaaacagttaaaattttaggaaacctacatgatttctaatgttgcaagataagaaagcttctgctaaaaccaacatatacaaaaacgttacttatgaaatacttttgtagagatttcacccatgagcaatagaaaaaaaggaaagttatttaatatattagaaaaccctaagaaacgtggtctgtggtcactccctctctggcacctttaccacagtgatgacagagctatgcggaaaagaatttctgtgccagttcagccatctgctgttggctcacaaatggagttaacagtctaaaaggaaagtttgttttgaggtgccattcccatgtgcatacaatccacaaactgcagtgtataaacgtggctcagtctaataccaagttaagacttggtttttttgaagagcatattgcacagcattttctggaaatgctcccaatattagatacatgtcacattcgcatagaaacatatggtcttcaatgtgcaatctcaaatcgtctacagagactctgcaatcagagattccctgttttaccttccttttataagtcaattttcacttagcaaactatcacactgtggtgatttggaggcattattttaattcctaatgtaaatttacttttaacagatgtgattctatgaatcatatagcagcatatgatattagttattagctgaaatgatgccaaggggtgttacgtgctggaaactagagcaactgagccaaaccaaggtcacccccatcactgccctcacagctgggtcagggaggtctggcctggcccttgtccattctgaaggttgagagaaaaatggcgtctttatgatgccccctgcccaccgagatactcagatatatttcgccctgtccttgaagcagccccactactactaacagtggctctgaaaatgtggacttgacagatagtacctgtcactggctttctatccaggctccattcctttctgggctgcaggtttgaaaatggatgtgccccagggaacctgaatacagtgagttcacacacaagcaggaaagaagtgagtttcttttggtttgggttgaagcagttgctcaaacgtgataggcagaagaggtaaggatttcactgtgctttaacaaaatgcttccatggtaatcagtcctgtatactgtataatcactatacagaaacaaagtgtgcaccaaaaggtaaagaattttcctaggacaagaccgcagctccacaaacaaccaaggaagctgttcagaaacctctttctgtgctctcttactcccctgagttcatccccaggccccagggcctcccattccagatgtgaagaggtgaagaccacgcctggaataactccgaatacaacacaattgctcctcacatatcagctgttcttttccctgttcactactgagaaaacatagataaatcacggcactttctgtctagcattgaaaatggtcattttaagaatcagggcagatgttggctacacacagaaagctgcccaagggtaggcttgaagcaaaataaattaagaaacccatcatgtactcttgagtgcagggaaacaaactgataatagcaacaagtatgcatccttttcaagtaaagataatgagtcaacctgctgattgcatattgtggtgactgaatacattgtgcaatgattaacaaaagaactgattgttcgtaattcaaggaatatctttccatttactgaggctttacttaacctctagcaatagttttgtcaagttattcacaaaggccgtataaatcttttgttagattattccaaggttcagcatatttttgatgcacgcaattttaaatggtagcttagaaaaatcacatcttctgcctgttgttagcatacagaaatgcaattgatttcagtatgctgaatttttattcagcaaagttatacattctcttatgaatttatatgacttatcgttatattcttttgagctttgtagtcacattagctatgaataatgataggttcttactttccaaccttgaaacttgctatgttttgaatgtgtccctcaaatttcatatgttggaaacttaatccccaaattcgtatgttgatggtatttggaggtggggcctttgggaggtaattaagattagataaggccatcagagtggggccctcataatgagactggtggctttataagaagagaaaggagatcttagctggcatgctcttgccctctgccatgttatgacacaggagaaaggtcctgaccagataccattgccacgttctaggacattccagccttcagaactatgagccaaatgaactcttttctttgtaaattacccaggctgtggtattctgttgtaacaacataaaacaaagacaataacttttgttcttttactagccatattcctttcagtggactggtcataatgaatataatcgtgttttttcccaatcttaaaaataacctttgagcatttttgccgtattttccacagtttttaaatagatctttttctattagattaatgaaaatttggctgggttcagtggctcacacctgtaatctcagcactttgggaggcaaaggtggatgaattgcttgtgcccaggagttcgagaccagcctgggcaacatagtgaaaaatctgtctctacaaaaaaaaaaaaaaaaagctagccaggtgtgatggtgcatgcctgtagtcccagctccctgggaggctatggtgggaagatcacaggagcccaggaggccgaggctgcagtgtgctgcaattgtgccactgtactctagcctgggtgacagagtgagaccttgcccccatacccccacccccaaaaacaagaaaaaaaaagtcctctatttctagtttgatacgtttttaaccatgactgcatgagaaattttttaaaatactttttcagcatctactgagatcatgtaattgttttaatctgtcaatatggtaaattacattattgattatttatgtttacataacatgactatttcatgttactccagacaggtatatctggaataaatcctagagggttgtgagatatatatctatggatatatacatatatctatatatgtgtctatatctatttctaaatttgctttcctagtatttgtagtcatatcatcctttaacaacattttaatttcagatttatatttgttaagtgtacttttttattcctaatattatttgtgtctttagtatttttttcttgatcagtcttgtgagatgtgtatctattttctttgctttttaaagagcaaactattatatttattatatttattttatttttttctttgttgatgtctggaattatttttattattttatttatccattttctttaggttctttctgttgtcttttttctgacatcttatgttggatgcttagttcactaattttcagcctctgttcctttctgatgaaaaaaaaataaagctcaccaattttccttgaagagccattatagccacacatgtaaaaggatcaatttttagtatatagaattttttttttattttgtatttttctacattaataataccatctaatttcctttatgatttcttctttgatccattagttacttaagaggttttcttaattttcaatatgggttgacctagttaagttttctaacttcatttcattgtattcaaagaatactgggtataagaaattaatctttggctttgatgattcttgctttatgacttaaatatgtgtgtttgaataaagagaatgtattatttgtgatgaatatcacatttataaatttgtgtcagatatagtacttatgtatatatatatttttatatagcatttgttaattttattgcttaaattttatctatggctccctcttatttcactgagacaaatagatttagaaatctcccattacattgctgaaatgatctatttcttcttttaaaaagagcttcaagctcattcatatttttttggtaattattttacttgaaacaatggttttgaagatactggctatcaagcattgaaaactaacaatccctaagagacagaaacaaataaggtgagtcttaacattactccaacttactgccttgagagcgtttccaggctggggcctaaggctaaagtgaggagataaagctgagagttgagggagacgatggcctccaaatttcacaggacaaaatattggtgagaggtgctcagagacagagtgtcagagatctgcaaagacttgttcaagtttatgcatgtgagaaaactaaaaagaacctacccaaaaggattagagataacagtgtcagggacccacgagggtaaggaacagtgcctcttatacccaccagtgaaactgaaaaccttgctggttcacagagcattgagtagaatacacagagtggccggcctctggtgggcaacagtaagtcctagactgacccttattccagttctgcctaacaaccaacaacgtgacctggaaggataaaactatttccaagtaacttaactcggtcccagaacaacgaccaaaaatatctgtagaagagaaaaaaacatatctaataatccacaaagcataagtcacaatatctgatatccagatattgtggtcaacagaaactgacgaggaatgcaataaatacctatattagaaaagaagatctcaaatcaatgacattttctataatataaaactaaataaagaagaacaaattaaatccaaagaaagtaaatcagagtcaaaatcaattatataaaacagggatggacaaattttttctgtaaagtgtcagacaataaatattgtcatctttgtaagtctcctatggttttgttgcatattcttattatttctttttacaaccctttaaaaaagtaaaaatcattcttagatgcaaggccttacaaaaacagagctaaatttggtctacagactgtaatttacccaatactgaagtaaaaagcaaaaaagaaaaagagagagagaaagagagacagaaattctaaaaatcaacagcaaattagttgagatagtacaatagataaacatgtaggcagagagagaagacataaattataacatcagcaaaggcaaaggttacatcactacagattgtgcagatattaaaaatataaagacagattatggacaattttataccagtaaatttgactacttggatgaaatggacaaattctttgaaagacatagtcagtcaataaaaaagagataataacctgaatagaatttgttgaagagactgattttgtaaaaacctttcagtgaattctagcaaatatttagggtaaaaattacatgaatctacacaaactttagcagaaaattaaaaaggaatgactggcctggcacggtggctcacgcctgtaatcctagcactttgtgaggctgaggtgggtggatcacttgaggtcaggagttcaagaccagcctggccaatatggtgaaaccatctctactaaaaatacaaaaattagccaggcgtgttggcatgcgcctgaaatcccagctacatgagggggcagaggcaggagaatcgctggaacccaggaagcagaggttgcagtgagctgagatcgcgccactgcactccaacctgggcaagagagtgaaattctgtctcaaacaaacaaataaacaaacaaaaaatgaatgactactttccaactcaatgaagccaccactgccataataccaaaaccagataaaatattacattcctcagaaacagataaaaaattaacatttttcacaaatgaaattcaacactgtattttaaaaagtacattatgatcaagtagagtacattccaataatgagaggtgatgcaaaacgggaagagaagtaaacttccttgccctgataaagagaatctatggaggacctacagctaactttatagttgacggtaaaagactgaaggctttccccttaaaaggaggaacacagtgaggatgtctgctcttatcagttctattcaacattgtactggaggttttagtcaatgcaataattccaaattaagaactccagataaacaaaagacatcgaggctgggaaagaagaagaaaaactgtattccttcaaagatggcatagtttctatgtgaaaatcctatgggaactcctaccagaagtactaagtgagtttagccaagttggaagagaataagctcaatatacaaaattaattgtatttctacatactagcaacaaactgttggaaattaaaacgttaacactaccatttaccacatcatttaaaaaaatataaaacaggaaaacatctgaccaaacaacagaaagaaacagaagagacattgaaaacccaaaacaaaacaccactgagaggaaataaagtagcctcaagtaaatgaagtatgttatgttacaggttagaagactcagtgttgtcaaaatatcaatactctccaaattcatctatagattcattgcaatcctaatcaaaatcacaacaggctttatttatttattttagaaactgacaaagtgattctaaattttatagagtaacacaaatgacctggaatatctaaaacaaagttagagaacactactaaatttttagaactaatcaagctaccgtaaaaaagagtacgttattggtacagatacagacaaatagatcaatagaacagaagactccagaaacagacacaaacatgttgacaactgatcttgataaaggagcagaggctattcagtgcagaatgaatagtcttttcaaaataccatactgtagcaattagagattgatatgcaaaaaatgaactttgatttctgctttacatcatatacaaaattaacacacaattgatcatagtcttaaatttaaaacctaaaactatataacttctagaagaaaacaaaataattcctttatgaccttgggttaagaaaacactttttagctaagatccccaaagcatgaccaaaaaaaagagcaaagttacaaattaaatgtgttaaatttaagactttctgcttgtgaaatatactattaaaatatagaaaagacaagtcacgaacttggataaagcatttgcaagttatatatctgataaagaggacttatgtctgtaatgtagcacatgcagaactcaatggtaagaaaacaactcaccatcctgggcaacagagcgagaccctgactctataaaaaataaaaaaataataaaaatccaagcaaggtggcatgtgcctgtagtcccatctcttcaggaggctgagatgggaggatcacttgagcctaaggaggttgagtctgcagtgatccatgatcctgccactgtactccggcctgggccacagagcgagtctacgtttccaaaaataaaaataaaaaataaaacaacccaataaaaagtggaaaatgaagaaaacaacccaataaaaaaatgggcaaaagatttgaatggacactgcagcaaagaagacatatagatggcaaataagtacctgagaagatgcccagcattactttctattaggaaaatgcaaattaagaccacaatgagatactactacacacctgtcaaattgaataccttttaattaaaaggtagaccaaaccaagtgttgtcaagaatataaaacaactagaattcatctatgtttctggtctaaatggaaaatggtacaactactttggagaagagattgccattttctttgggaccaggacatttcgcagggaagtatttgcacaagaggcaaaaaaaagcacatgactacacaaagaactgtatacaaatgtccagctttacatgtactcgtcaaaacctatttaaacccaaatgtcagaacagataaacaaactgtagtatatatttatgcaatgaaataatattcagcaataaaaaggaaggcacttgcaaaatacactgtaacatagatgaatctcaaaatgattgtaatggatgaaagaatccagtcaaaatgtatataccctgaggtttttgtgtgtgtttgtgtgtgtgtgtgtatgggtgtgtgtttattaaaatatatgtaacttttctgctagagtttttttcctgtggtataaaaacaaggtagttttcctaccacctttgagtagataagtgtacttaacattaaatgccaaaggtagacaccagcaagcttttgagccaccccctccggacaccagagtgctacttattctaacataccctaccgggtcagatacaaatgaaagacagactgagcaggggacacagagctcagtaatattgacagcggggttcaaaaggatttgagacatggacttcacaaacagcagcaccgtaggtctccctgaagcactcccagtgaattcctatggttggcaatatctggaagatctctgcacccaggtcatcccaccagggggccctgagaaccagaactactttttatcactgtgcttcacgtagtctatgaagcagaaaaggcagattacggcaggttgtcacaaagaacaaggtgagtcaaaccgcaggactgcctttacttaagcatacaacagaaaaggctgtgtgtcaaactttctgaaccatttatcttttatagactgctgaagactgttgagttcagcgtctcttaatccaaagcgctgttttagaaaagataatctacgtggcaaaaaatctggtcaggtcagtgtgactgcgcatcctggggccatcttgattatgaaaaactctaatatgggaggagagagactttcagtaacaatcactcaggggaaagcaatggcatcaccctgaagggcatggattaacagataaatagtgaagcaggttaaaatctaacagtcacattcctgtaaaagatatcttcatctcacgtctaattattttcttttccattgctcttctctaattagtacttgcttagtaatggaagcatcgagaaaggacagagagagtattataattctagcaatagaaagctagacacctcattttctagatttgattacacatcttaaaagtatccatttttccccaaatttacatggcacctataatggcataatttaaactttaagtagataagatgaatagatggggactgaatgcagcgtgcttactttaaaacaaaaatgtgggttccttatttcctaatgagtaaacagaaatagaactttcctataattttcaatgctgtattttattttgattatctttactagtatgttgaatgagaagtttttcacacaccaatgtccactgcaaatgtttttagaagttctcactaagtggtggtagcaggccaatgccaccatgctctcaacctcatcgtgtggcaggttgatttagtcagcttcccatattttccaagttctgcttttatttccatccccttaagcaatgaaagtcacaccattagagttggctctaagctacctagggtaagagtggacggttagcagaaaatacataagcaataaccaaatctaatttttatctttctctcgaataggcagcacaaaaattactggaactgctaaaaaaaaaaaatgaaattgagtgctaagcatttcagcagctattctttcacatatattaaatgctatttagctattatatattatgtacataaaataaatgttaaatgctaaaatgttaaattttaaaaactaagtatacgtatatgaataaatttttaaaaaaattcatattcacatatgtatacttaattttttgaagaatattaaaggtaagacaatatagagacatgaataatacacaatctgcaaaaattaactattggattaatcaactatgtagtttaccttgtacatagttcctggaatttttggaaagtggcatgatataatagaaagagtccagacattagaattaggtagactgatattgaaaccccacagcctacttgattttgagcatgtattacttaagttgtagtgtcctcatctgtgaaattccatataaatctaatgtggggattgaccaattttatgtgtctgtagtgtcagtatttgctagcacatattggctagcaaagaatgtacagtttttaatatgcaaatctgctagaagtagggacaaactgcacacttacaacttaagcatgcaattctccatagcttttatgatgattgcagttatattattattttatcgttataagttccacaagtttctttgactatccgaatataaccaaactagtttcctttatctcttcatatgaaatgggtgtatttgtctagaatttaattctgcagcatatggaaatttgcctctgcaatgttatgtattcctgtgacattctctggaccattctcaaccgaagaggaaggtatacacaccattccttgatttttaaaaacttaacaataaaagaaaactaagagagtggttgttatcatacctcggtatttaaaatagcaaggcaaaagcataaatcctctgaccatttactcacaattgctcatgaggcagatagtggcaacttttaagaagacaagatgagaataaaattgcgtcacaaagcagtctcttgattaccaatattaaaatcatttgtacttatcaggaacaatggggagatcagaccttctaactctaaatgagtaatataacagattatagtctctattttggccagaatcacaaaatgtactttttaaagtatactttaaaaatatggatcatatgaagtatgcataaaaataagatggcatttccacctctaattagcagctggaaaagctagagtaagtgtatggcaaatctctactatggccaattatatttccaatgaagcaataaagcatacatttattacataatttaacagatatatatattttcagttccttcctcccttcgttatactgaggaatcttcctctggacagtgctatcctcagatgttttactctttgtattatttgtctttactgtgtctatcaaccatcagcaaaccattaattgaataagttgacgtattagcttttatatttttgaactaagcaaataaattactagtttatttatgcagttatccttatttggagactcttaaaatatcatatgaaaggtttttttttaaatgcaaacacaatttacttttcctcagtcaattaaaaaaataatattgttactctcacttaaaagaatatacatcaacaacagaaatactcattaaatggaactatgtcaggctctgtgggagattagaaatacaaagcctataagacagtctacaggtttgaatttctctttaaaaatatttattatatttttctgttttcatagaattagagaataatatatagtttcatgttatattgataatagagaaattggactttatttacaatttaattataggtgtttgaaattatgttctaggctagagatctaaaacataattatgttttagatctagaacataattatgttctaggctagagatctaaaacatagatctcacattatctatttaattaagagactttttaaaaggcaagatatgagaactggaacttaaattttaacaccatctgtaatctatctatctatctatctatatatatataacaatttagtttttcattttgtgtagatatatatacacacacacatatatgatttctgggaggagtcaggaaatacctctaaacaatacatactgtctctctaaagtccttcaccaattacttcccatattaagtactgaaacaaaaaccatttacctaactgcagctgtagtagcaagaagaaaagcccatttcttcagcatgaataaaaggcaaaagtaagcaggaaagtgggttggagatgaaaaaagaaattactcaggacaaactgggtatttccttttgaaccaaattaaaaaaaaaaaacatggtcaattttgatggattctaacattcatctcagggaccctgagtgacataaaggaaaccaagtcaggaacaatgtctctgtcttcggaagtctcctgtgaagcagaatttgtttacaaggtaaaggattaattaggtttaccttaactgatctatttgacaaaaactcaaatgtaaattattaagagcaaagatcaactcatcaaaagaaatgaagattctgcatacaagtgcccagcagatccatctataggttgatacagggagtacttatacaggagtcttgttggtcctccagtatacagggctatctcagacattctgtgtgagggcactgtgggcactttacacctgccacattcagagacaaggccaaaaccaccaacgtgacctttattatctcccttaaatgtagatttctgtaattaaatatcttctacccttggtcactactacttagcaggattacgctattcaataaattgactacgtaatgtagaaagcagaaaatgttcttgcagctttaatcttctctaactgaaagatgctaatctttctactctgtggtcctaaattgtgccccttgctgctttcatagccgtccccccacccccatcccatttcttccagggccatcatttcctctttcaggacaagaaatgactacagtgttccatgaatataataccatggtttacaccacgataagagactgtgtttcactatgattgctgtaaggtggccacatgggccccagactaccatagtagactacaatatttaagaaataatctaatatataatacatttttttttgcttggtcaaaacaaagtttaaattaaatattaaaatcacataaagttattttgaggatatcaacaaactgattctaaagcttatatagagaagaagaagacccagaaaagcctacacaacactgaaggagaacaaatatcattggtaccacccgactttaatgcttactataatgtcacagtaataaagtgtgattattagtaaaaaaaaaaaaaaaaaaaaaaagataagatagacaataaacaaatcaatggagatcccagaaatagatccacacaaatacagtcaactgatctttgacaaagaggcaaaggcaatagaatggagaaataatcatcttttcaaaaaatgatgctggaacaaatagccatccacatgcaaaaaatagaataaatcattacagtttacatccttaacaaaaatcaactaaaaatgcgccataaacttcaatataaaatgcaaaactataaaacatggagaagataacaaataagatcatctagatgaccttgggtttgctggtgattttttacatgtaacaccaaaggcacaatccatgaaagaaataattgataggcagggcttcattaaaattaaagacttctgctctgcaaaagacactctccagagaatgaaaagccgagtcacaatcagagagaaaatattcacaaaatatatatctgataaaggagtagtatccaagatatacaaagaagtcttgcaactcagaaacacataagtaagggacccatttttaaatggtcaaaagagttaagcagacatcctaccaaaggaaaaataaagaaataaataaatacagctggcaagtaagcatattaaaagatgctcaccatcatatgtcattatggaattcagaaataaaacaaaattagatagtactgcccacctagttgatggctaaaattcagaacactgaaaacagccaatgtcagtgagaatgtggagcaaaaagaactctcattccttcctggtgggaatgcaaaacgttatgaccagtttggaagatagtttggcagtttcttacaaaactaagcagatttaccatgcaatccagcaatcacactttattcatatctggacaatacctggaaacaagatgtccattaatgcatcagcaggtgaatgaacaaactctggtttatccttacaatagaatattatgcagcaataaaaagaattattgagtcaccaatagatatgaaggaaatttaaatacatattgctaagtgaaagtctgtctgtaaaggctatatactttctggctctaactaaaagatatttggaaaaagcaaaactatatatagaagcagtgaaagatcagtgattgccacaggttcaggggaaggagggagagatgagtacgtggagtacagggtatgtttagggtagtggtgctcttctgcatgacgttataacggtggatacatgccattagatatttgtcaaaacctacagaatgtacaacacaaagaatgaagcttaatggaagctatggactgtagttaataataacgtatcaatattgcttcaccaatttaacaaatgtaacacacaaatgcaagatgtgttaataacagaggaaagtgtatgtgtgtgttgggggagaaatagggaaaatctttgtgcaacttttctgtatgtacaatttgtctgtaatcctaaaattacagacaaaagttagtttatgaattttaataaacagtttggaatatttttcgaaatctttatttttcacttgccatactgaaagttacctggcatggttcttttcagccttgtaagcaatcaaaatatttccacaatctaattcaatcaagcttggtattttactgtttgaaaatcttagcattatttacagatttaaggtatttctattccttctttttaaaataataattaaattgtttaatgaaagcatttctgactgtaaacgtttaaatgctacaaatttacatttctctgttcataaaagaacttatttttggtttcttatctttaagacaatgccacattcatgataaaaatatacttcaccaattttgaaatagttctagtagataactattaaagatcattaaaaactcttgagtggatgcattcagttctctaaatctagagtgcagcatatcataaagtgtctcctatccctatcttatcattttagatttttttctccaaagtagtgctcactatcagaaatcaccttgtttaggccaggcagagcagctcacgcctgtaatcccagcactttgggaggccaaggcgggtggatcacttgaagtcaggagttggagataagcctggccaacatggtgaaacctcctatctactaaaaataaaaaaattagctgggtgtggtggcggctgcctgcaatcccagatactgaggagactgagtcaggagaatcatttgaacctgggaggtggaggttgcagtgagccgagattgtgctactgcacaccatcctgggtgacacagtgacacactgtggcaaaaaaaaaaaaaaaaaaaaatatatatatatatatatgaaatcactttcttcacatatctgtttacttgtttcctaaatcatctctcccaattccccagcccatcagccccataggaacagatgtacttggaagtgccacagcagaggaaaaccaccaggtaaataaatatttgggaggtgactgattgaataaattaacttatctagatttggtttgtcaaggacattcggaaaattaggtagaatttagctccatgaatgttgagaaagttgagttttgagagccctaacatggccaattcattttacagaggtggaaaatggggctgacagatgttaactcaccttgtccaaagtcttagtaatggaatcaggaaaaaattcaatcacttgacttttaaccaataatcttttttactacaagagttaatttgctaatgaaatctcctcagtattttctcaaaacagaacaaaaccatgagttaagtattcctttttctttgctataactaaatataccttttaaaattaaaaaaaaaaaaacataaacatggttataagtgatcttatttcctgcatttgaggcagctaaaccagtatttcccaaaatgtcttaatacccacttcttgatctgctgcaaggaaaaatattgttcagtggtcaaatacgttcaagaatcatgattattatatagagaatagacgtttgcctcttaatggaattggaaaattcctacagtaaagatacatgtttagttaagggttggctaaactacttcactgtggcatcctctcttcaaagaacccatcaatattctacagaacaaatatgccatacaacacatttttatccgaaaatcttttataattggcttatattattgttttattcttcaaaatgttttctaaactgtctcagttctcgtcccatgtcatacaatattttataatttttcaaattctcacttttatgttctcacttactaaaatacggcaaaatataatttatatatacatatgtgtgtgtgtgtgggtgggtgtgggtgtgggtgcgggtgtgggtgtgtggtacctggaacacaataagtggaaaaatttgtttcctctgtcttatcgcacccctttaaaaataacacaaacagaaagtgttctttctaatagtgcaacttacggtccatttattttttaatatttgttatttaatccatggcactcacttttttgaactgcagtaaggtgttcttcaacaattcctaatttttctgtgaatcgtttacttggacaatgccacattcacatatacatcccctaacatttgcatttattcagtttccttttaaaataagtgctaaacaaattaatggattttgaaggagaaaggctttcctttcaaaagaatggtaacctttatgtagttgtttttagatatttcctataaaacctgtctactctcgatacagtcagacatcttttcttcttttttaaatattaaaaataagcacataaaataagtcatttgttctttaaaaaacaaacaaaaaaaccaaaaaacaaaaaacctacaaacacaaaatcatgtaaaccagaaatctttcacagaggtcaagaagtcaaaagtaaacaccgacaatgaaacaccgacaatggtaagatccttgtgaggctctcgctccacctttctcattacttctatgtttccgtggcacaccacgggccagtgcttactaagacctctgcttagcgatggagttagtgggtctgcacctctgattgtgctgggcatgagacatactgattaaaaatggtaaaaggataaaggaactggcctttgagagacaacatggatgaatgatgagtttttgaattaaatttttgacagctttgatctttactgaaaatttaaatgaaaaacaaaacaaagcaaaacagagttccaggattttagaagtgccttttatcttaagtgaaatgttctcatcagaaactttggcatcccatccagtgcctttgatgctggctgtgaaacaagacaatccatcttcttagctgggaagacaggcccttcaccacccaggaaaccataacttgtaaacatcagtcaagttcagatggctacatttttacttcagaagttcgctttgcatttggagtggctcattaggggaaaagagagagagagagaaagggttatggaccaaagtgtgtttctcaaaaaattcatatgttgaacccctaacccccaatgtgatcgtatttggaggtagggcctttcgaaggtgattagggttagatgaggtcacgaggatgaggtcacaagccaggattggaaagcttgataagatgaaaaaaaaagagtgagctttctactctgtgtgagaacacagcaagaaggcatctctctgcaggccaggaagagaggcctcaccagcaatcaccttgatcttgaacgttccagcctccagaactcagagaactaaacatgtgcgtttaagtgcccagtctatgagactttcttttatagtagctggagcagactaataccgacagaccaagagagagaaaatggagagaaattttctggcttgtcttttaattattctttatttataaaaaaagccacattgatttttgcagcagtgatgcaagtgtgctgtgcataggtttgatgttctgctcaaattaagtctaagtttttccactaaaggaattatagtgttaatatgccaagagtcctatctgctcacgtacttccagtctctgtaaatacgtgcagcctgatatcaaagcaaaccttgaggccattaactataacattcttggagaaacagctgaagacctactaagaaaaaagtaccaaataaccaaagctggcaattacaattccaccccgaaaagaaggaaggcatgcatatgaattatgaaaaatagggactgtgcagctctcagattttcaacaatgaattgctcacattctacaccgtgtgtgttaaatgtttaaaagtaaaagatcccaaacattttgccaaatatgcagtgttccaaagggaagtatcaaaaggatactcatttataaaattatggttcagtagataaattataaggcctcaaagaacatgctgttacttctacttgccaatttataaattgactcaagtcttcatttaatttatgaaaaatcaaatcatctcaagaatgttttcgttatttttctctaccatgtaaaatatatgttttgtatgtttgataagttgtatcctgtcaattttagaatttagctatttggaacatataaaccacatttctacaactcaaaatagtataatgcttagttacctatctttaaaaaagtaatagtaatgcactgagatatttgggggtgggaggtggcggacacaagtttaactttcaaaaataagggccgtgtaaaataactgaaaaataatcctatttgaattaaaattgaataatattaaaaataaatttctactgaaaattacacctgtttctctattttatttttcttccttttaggatagcagaaaattctgttagataaatcagactaacatgggagacattgtaaatattaagaaacaatagtaggaagaggcggactcacattcatcttgctctttctgctattcccttccaaaaccaactgtgaacaagcactcagggtggccagggtacgtgaggaagcctcctctagcccagaaaaaaactttatttcacaaaaagttatccttcacaataaaaaacactattctataaaaattgtttcccctggccaggcgcagtggctcacgcctgtaatctcaacgctttgggaggctgaggcgggtggatcacgaggtcaggagatcgagaccatcctgactaacacggtgaaatcctgtctctaataaaaatacaaaaaattagccaggcgtcgtggtgggcgcctgtagtcacagctactcgggaggctgaggcaggagaatggcatgaacccaggaggcaaagcttgcagtgagccaagatcacaccactgcactccagcctgggtgacagagcgagactccttctcaaacaaaaaaaaaaaaaaaaaaaaaaaaaattgtctcccctgacttgagttatgggaaagagggttagcttcacttggccctccatgcccctgcccaggcacgtgtctgtattagtgttctgcagaggcaattcaaagtacattgtccaaagcccctctttgaaaatcttttgatgctgctgtaattcaatttggtttctatgttgaatctgaagttctgtgttactactaaccccctttctgtaggaaaaaaatgtatttttctatacaaacccatatgccatcgaggtacctgtatttaatatacctccatttagtagctaataaatatgtctatttgaaaactatttattcttccatacttaatcatagtgaactataaatccaaacttgacagcacaagaaaagtgacatttttcttctttcatttctatgctactttttccaaattatttcttgttctttttaaaaatgaagcaaagacatcatcattgttactattatgccttcagttaacaaaaaccttttaaaaagattatttgaaatgcatatgtaatatgcatgactacgttaacaggattatatgctattagatattgtgatataaaattacaactcactgggagatacagtcctctttgggcctctctcccttctatacatcttgctggacttgccaagatcaaaaggtcctgcccgcttttaacagactattactcagggttgcttatgcaactggtaacctaaagagataaggcaaggtcttcccctagacaaaaggcttgcatgcggcttgctataacagtagtcccagctcagtattcaccggctgtgatgcaaatccacccatgagtaagttccctctgagccaattgcttcattccctgcacacaagctgctgcactgctgagcactgtgtaataaagccctttgcctttggccccaagactcacgtcttccaccagcagcctgatacagtagcaggctcactgatttgtaagaggggtaaaatcaaaccccagacttgataataccatctacacagacattcactggtatgattcaagaatataaataactggtattcaatgtatccaaaaacaatcatgatgaatatttcaccaatgcattgctctttaaaataatacccaaataattatctgtactgtttccataccttgacctttcaactggacttttccttaatttgagcttttttgagttgtcatcagtgtcgtggagacttgcgccttccaattacacagtggtgttcaaacagaagaaattccaaacttttcttccttttgactataactaccctgggagtaaaatgtcccccaaataaaaacataaaataaataaaataaaagaaagaaagaaagtatctacttggcaagtgggaggtcagaagaaaaggggcttcaaacatcaaagaaggttctcaaaatactctttcaaatgaagaaagccccacgctcggtgccttatcttgcaagctcacatggccagacagcaacctttaaaggattatcttaacatgcggcgagctgggccctctcatgtgttctgaaatttaaaccagaaaatggctgcacaactgacatggttgtggggtgtgaaggggaatcaggaagagggaggagaggcttacatttccagaatgagccagagttcagataaagatatttgtgtaaaaaacaaagcaaccaggaatatgatcctgggctgtcaatttgtagaatacaatctaatacttatacgccataggtagtcacagaagttataagaaactacaagccctaaggcattttttagaatagaaatctctcttctccctctctctctctctctcttttttttttttttttgccaatatgtagtgtgggattttctttggctaaaaactgttccaatttccctgttttctaaatatactttactaagcatttttttttacaatcaggagtattgtaacctttgtatattttatcaataataaaataaatccataatttaaaaaaatcacacaaaagtgtataaagtaaaaagtcaaagtcccacatccccacctctgaatttcacctttatctgtgtgtatatgtatattttgatattgtattttgtaagtgtattgttctgtaatgtgctttttcatttaatagcatgattcacattcttccatgtcagtaaatacagagctttctatttttttcatgtctagacagtactttacaagatgattatattcagtaatgtatttaaccattcccctactgatgaatgttgaaatattttcccctaattttttactgtttcaaaatcaaaaatatgtacatcaacttcaagctttttactatagcccgtggactcttacgtgatttactacctgtctttgtcttcctctggaacttcttataccaaatctttgtgcccctggcctttcttccatgcctgggctaagccaaccttgtctctgcatctctgtggaatgtcctgtcccaaggtattggcgtggtggttcctgctgtctcatcactcgctccaaggttacttccttggtgaggtctttctagagctcctgttctacacaatctaatttatccttagtcaatatcttttataccttctcggtttattttctgtacagcacccatcaccctctggaataatcttgttcatgtatttcttactgtttactgttttcatgtaagatttttctctggtatgctctaatgtgtcctttattagaacaatgtctgccacatcataggctctcaataaacgtccactgagaagatgcataatggaagtatacttcaacttggattgtagcacatttacacaaatatttccattagagagatgcctcgaagtaaaattactgcccaaagatttgtacacacaaaatattgatgggtacttgccatgggtactgcaaaaaagctttaatggcaatttatattgtcaccaatattatggcaacggcccttttcccacaaatgcagttttataatgccaatttgacaggttataataatttttttgtaaattaaaaatcaccttgttctaaagaatctttttacatttatcacatttgtgttttatctccaaattaatcattgttgaaaatcttttttattcttttatcttttgggattacagaatgtcattctagttttcttccattattatacaagattgaaaggattttggttggctttcttagatcttatatccaaatgggatttattattatatgtggcataataagaactattattcttttaaaatgtattaattgtcttttgcttattaaaaaatagtcatggtggacatttctttaaattttcaaaaataaacacagaaaagaaaataaaaatcaccccaatagaaacttgcctgatttctttccactgcattccctgtaaaggtgtgttaatagaaatgtttctttgatcatacctataaagtggtgtttataaaaatgtttattcccggccaggcacgatgggtcatgcctgtaatcccagcactttgggaggccgaggtgggtggatcacctgaggtcgggagttcgagaccagcctgaccaacatggagaaaccccgcctctataaaaaatacaaaattagctgggtgtggtggtacataatcccagctacttgggaggctgagacaggagaatagcttgaacccgggaggtggaggttgcggtgactagagattgcaccattccatgccagcctgggcaacaagagtgaaactccatctcaaaataaaataaattttaaaaaattaaaatgtttattcccttatacaacattccctcatactcttttgtatacagtttgatatggtttggctgtgtccctacccaaatctcatctcgaattgtagttcccataatccccatgtgttacgggagggacccggtgggaggtagttgaatcctgaggccagttacccccatgcctgctgttctcatgatgtgaatgagttctcaggggagctgatggttttatcagggactttttccccttttgctcggcagttctccttgctgccatcatgtgatgaaggacatgtttgcttccccttccaccatgattgtaagttcactgaggcctctccagccatgcagaactgtgagtcaattaaacctctttcctttattaattacacagttttgggcagtcctttagagcagtgtgaggacaggctaatacactgttttttcgcttatgctatgaacattttcttttgaaaatgtgatttttaataatggtacagtatcttaatgtgtatgtgtattgtaatttgtatgagtgtattttaatggttcctattgttctacaagtaattcctttttctgttattaaaaattaacccaccaatgaaaacccatgctcataaaatctccaggaccatctctgatttcattcacaggatagattcctaaatgtggactcaataagaaaaggagtataaattatttcacagctcttttcaggccttttacaggcaggttgtgtgtactatttaaagtactattaatcccaccacatacaagatgtattaggtacttcttaagagtgcactgaatataagaaatctgttacaaaatgttagcagagcagaaagagaaaaaaagaaagaaaaaagggatagaatgagattagatcacctggtaaactgtaggaaacagctactgcccccaggactcaggaaactcaagaaagtactttatcagaacttctgagtgctgagtgcatgccaggacccctgaggatgggccgactgagtgggtagaaaccaccaaggcactgcctcccagtcacggaggagtggcatggagaagggatcacagacacttccagaagcaggagagagggaagggtagaaaagagaaaatgacagcgcctttcccctgacctgcctttggatccactgagcagatgtcacaggaactcgctggcaagggcatctgggaaatacagtttcctcccgagccaagcattgcggagcagcacaaagggcgtggctggggaagggttgggagaacagggaatcactctcacacccaagagtgcatggagcatatctgggtgtctacacaggtaagagagtgaggggtcaaaaccgggcttcttatgactctaaaatgtatttttagagcagttaccaggagagctgacattgttgaatctacctgagaagccagaagccagactctttgtattactacagaatgtgattccatgctgttgccaaatgccaggaatttctacatcgactgccatcaggacatggaagtctcattgtttcttaaaacgcaactattcttgaagacatggaaggtcatccttcttacatccttacatccttctttctgtggccctcctaggcttgtcacgagtcagcacgaatcccaaaggtaccagcagcacagaagctcacactctgtcatcagagctgggttggcagtgacagaaatgcttatgcaaacacaggctgacttctcactgaatgtatagaacatctaggaaagaaaggcaaaggatttaggccaaagcaatacctcaatgcagacaactaactagtggcagctagctagtcacctgctctcaactcttcaacgtccttcaaatattttctctaattgatatagcataatttgtgatgccaacaaccaagtgttttttcacaattacagagagccaaacctgtgtctctgctgctcccttaggctacttataatattggcctagttctcttagctgtcagcacaattaccttgtgattaaaaagataacatcaataggaatttcttttttatcagctaagccatggttacatgttgcatggacactagcactcattaccccatccatattttggtgagatttttgcccatttccttcgttttcacagaaaatgaaataaagcataagcttgttggttgcaaaggtgacatatagtaagtcaaataaacccataatgaagttcccttatacttcaggttagcttcaaaatcccactcaaatatgtatccaaaaagaaataaaacaggaaactttctggaataagttcttttgttgctatttttatattgaattggcaaatgtcatttcactgtctgaggtcaagggaacacaagggaacaggcagttctcgaaacagaaaagttggaggtgctgtgccgtctctagctaagaaaactctagttctatgaaatatcattccacctgagaaaattttcacatgattaaaagataacagtgccataaatctacccttgaacatcaggtgtgactcttactatactacccaatgtcttttaaaaaatatttagatcattagccaatttgtgtgggtgatacaattgtacacattccacaaaaatatcagccatttgtctagttcagcatctggtaatgtcaattaagggttttatttactcacaaagagaaaaaagtaaagatattagtttcaaattaagtccaacagtctattgagtacgtagtttaaatgtatttcagctcttcatcctccccagggcagagatcactggcagaaattagcatccacggataggaaccaacaacagggtagctgatgatgtttaggtgaactcccctctttataataacagaaataaccccttttcccctacaaagcccgtctacattttgcatagcactaaggatggcagacctaggagctgagttagccaaccctgaaggtatcctgcctcaagacttgtggctatttggaaaaataagcatcctcgtcatggggtcagtggaatcggggcagtttgctggagtgaaagcccccaattaggtcaccctgtacttgtcatcaagaatgagtacacatggcctctctatcatcaagtggccacctacgctttttgagtggtaattcttgaaatatggttttctctatgaagaaagcttttctctccatagaaaaagcttaacagcaaatttcactgtagtcgaaatgtttcacctttctttcctttttgatgtgatcgtcagctcttgactgcatctcgttttctcatgcctgctttctttctgctgtcagtcacaatcctttgtgacaaggtgggatcacctggcagatgatttggatgttgcctctcatggagatatatctcattgaccctttcgaattcagagatttttttttaatatagaaaaaaaggcatagcattttaacatcactaactaaggcaaaagataaggacactggactgaaaaaccaaggatgttgtataaatattcgtccttgtgtcactattttattggcttgaggtatccaggaaacaacttcatttccccaaattacattttattaccaaacaaaagatgaaaaaagtactacttatcccattaaactagcataatggttactttaattggaggggtgggagagaaagaaaggtgaatctacttagatttcttggagaaatgaacttacaaaaatggaagctggtggcaaagccaaagtgaaattcacgtttacttattccatgcaatatttctctgtccaacctatgtaaagcactacaaatgaatacagtcatagcaactaattgagttatcagcatctccagagtagatgttactagtatgtcctggcatatgaatggtagtattatgtgggatattagtagttcactaagagtcctataggacttcttgtgtctggaaaaagagtttagtgagtgatactgaaaaaccaacagcttggctcacgggcatcattgaacaaatggtactgagcatggaacgcagctactcagaacttatgagccaaatgggtgttttccgtacatggcttcttgtccagaatgctactgctattagcccaatggccatcactggttatcaaacatcctgacccaagtcaaagccagacgaagacagaaggccatcgtgggaaggtgaagcgattcatgcttagggcaagataattatttggtatcctttcaatccatttgttcaacatttgctcccaggagaggcgggatgcttcctggggacagattagagaagaagggacactgctaagtgctcatgtattatttcaagcagttcactctgggccccgacccaaatcctcaggcaacaaagcagcaccctgcaggtaataggaactgtcttctttagaaagcagtgtggtgaccaggtgttgctaatcatcagagtctcttggtgactcacagccgccctcatgcagctttgcgagttctgactgccaacacacacaggactcttcctaagtattatttcagctgaattctgggatgtgaacatcagactttcaaacccggctttctcactttctactggggtgaccctaaatacaagttatttcatttctctggactcagtttcctcatttataaacatgagaataacattatctactccactggttgctgtgaggaccaaataaaataacacaattaaggtgttatctggtatataataaccattcgataaaacttagcgattattatttatggcatccattccacaatggtactcaatggtactgtgtacactgcctaagaatcctaacctttatttttgctccactcatcacttctatttccagttctgtgatgccaacaaattgggtaattgtacagcagcatgttattatgtttcttcacctccccttcttactatgggtcccttctccgccttcctcaaacatggcagccctgtgggatgttgaggctcttgaggctcctcagtttgaaatgaatgagcttgctgaagtggaaacattagaagggcatgattggcagattattttgctccagcaccttcttgacagaagtgcacaaagctcttcaagaagatggagctgctgccagatgccctctgtccagcctcctggaagcccaggagaaagctggagtggacgccatccttctggcctcctcctgaaggacatactggtttccttaatttcttttctactttttgtccttcagtctgttgtccctgcacagctatagagaaaacaaggattacagattccatgtcgttttgcagccagggaacatctttggctagagatttgacggaagtcagtgccaagtggctgtgtccctgtaagcagtccattatttctaatggtctatttgcatgcaaacctccaggccagaggcagaagtaaacatcccagaaacttgtccctggagactctgggacactctcatttacacgctgtgctccattcacggcgctgagtttactcacacgtgctacacatgcgatcctcacgacagccctgtaagatggtattagcatctccattttatcagaagaaaaataacttccgagagggttaagcaatgggtaaacacggacataaatatggcaacaagagacactggggactactagagaggggagtgagggaggagggagggttgaaaaactaactattcggtgctatgctcactacttgcgttgcagaatgatttgaaccccaaagctcagcatcacgcaatatacccatccagcaaacctacacaggtaccacctgaatgtaaaataaaagttgaaattataaaaaattgtaaattacaaataaatgaataaataaaattttttaaaatacagttaagaaggggactttgcagtctggtgtacctgacactaaagcccgtgtatctttaccatatcatgtttaaaaaatcattttcaagagaggcaagaaatttcagtggagaaaaagactgagtatgtagaatggaagattctctagatgtgttgattttgtttatcacggtgtcaactaccggaggagtaggcaattttatgtggatgtagaccatgcacctttatcaggagtactttttcaggtcaattcccttccctagcactaaaaataattaatagatctctttgagagactaagacagtgaggagaaagtacatttacctaccacaactaatgagacctgaataactggaacagaatatttggaaaaaaataatggtttaaatggttaacgatgtgtaactagtaatataatagctacttcaacggagctttcatgtaaaacagaatttcattgcaagtttaagttttcttttgagaaaaatttggctatgtaaaggtgagtttggcaattttaagtttacaacttattggtcaataagtagtagtaagcctcttttgtgtttgttgagttaataaactatggttcttggacaatttctttgttggatgttaatctataactcttatttgacctgttatttgacatttctaacctcttccttaaacattaaccagaaccctgagtactttcttttccaacacgggtaagggattgattttttttcttaatttcataacttatgaagctaaaatgtgcaatattttgactgagtgaattaggaattcttgttgggatttgggaaaaagaaagttatgagaaactgatgactgcctatgtaatacttcctttataggaaattcttaatacccttatataggaaattttaatacccttcttacatatcttttgttcctggtgacatagaagaacaagtttaacaacatcttaagaaagaaaattattaaatatttacagtcacaaacctttgttcaaaaaagcacttaaaaattatatttaatagagtttaattgagtaaagtgaatcacatagccctcaaactagaataggtttagagagactagtgtttttgtgtggtcaaagaagacttatggaaaaaaaaggaaaatgatgtacagaaaatggaagtcaggtacacaaacagttgtattggttacaccttggtgtctatttgaactgctttgaagaatttgtcacctttcagaggccaaaacttggtgatcttcgtgattggaacaagaggaggttatagcctgattacacagtttactctgtacagggaaaactttaggccagacttaaaatacgcaaggaggcagcttaggctaaatttgctttaacaattctctctttatggtcaacctccaaaaatcatgaggggttaaccaaaactctaggcactgatgacattttgtcactattataaacatattcacacagttttaaattttattgggaagtagttggatagtgggttttgtaaagtgaaaagaaggactttaggttacttttctgtaaggattagagtagaaggaacctctgtgtgttgaaattttttgattttaggagataaaacctggtctgctatagtttttttttttttttaagttttagtttgtttatgtgatatttagtatgagtgactttagtttggtttggtctggtcggttggagcctagtacatgagtttagtcaaaagcaatagcctcttataattttatgttttatttatttatttgtttgtttgtttatttatttatttattcatttattggataggtgagagggtgacccaaactttactgttggcttcgtggtacttttagctattattattttcagttttcggtctcagtgtgtcttatatgttacagtgacttgttgatcactttttggagtttttgttgtttgggttgaagagggaccagttgacagtttatagatgtctgtatgtaaacatttgagaaaatatagtattttggggaggctactattatgactattaggaagataatattaagagtttgaaatatggtttctggtcagagtctctatgaatcaattaaaattgaagagttttaaacgtgagttagataaatagtatttgttttagccaagtagtctgttaatctctcacaattgaatctttataatttttatgtataacaaaaagtgttcataacaaaacagattctttttgtgtagtcaatggataatctagtgtgattttattattaggaacaattttagtaacagaatttagtcttttgtgtaacaatagtctttgtagtagaatttcttatggagtctattatgagggatgcatttataatgactgtcccatttattttaaactatggaaaaagagacctaataagtcatgtatcctgagaagagtgaaggacaaaatctttaggccaaacgttataaatagaatgaaacagctttagactaaacttcatgtaacaccttcaagtgtgagccacagtgatgagtaaccagggtctcaagctggtattttttcaagcaaaaaatacttcaaaaaagccactggagtaggggtggggagcgggtaagaagatccatatctgcttatcaactcctgtttttttttttttccatttctttttgtatttggtgtctacaaaagagccttaacatggtttaataaacatgtgtcatagactgcatggagttgcttatgttgtttcaggatacttaaaggaaatgctcactggaacgttctagattttggatttggaatgttcacccagttaagtatactgtaaatattcaaaactccagaaaaatagtctgaaatacagaacacttatggtcctatgaattttggatagggatactagacatgtacttacaaaatggttttgaaaattccttagtacaagaaagactctgccaatctgatacaaatatggctttgtacacacacacacacacacacacaaacacacaccccactctctctctctagatatatatacatatatatacatattaacatataacacatatacacaagtaaatatacttttcactgaattttgggtggacatggacccacggttcttgtctgggacatcagctactaggtctgagtcccctgtctgtgccctgtgcatctgggaatgtgtacacactcttcaaaactccagttaatcaccatcctccctgggaagcttccatgctagaggattgaggaatccaactcttgagaaacaagaacatcctcttcagctcttcattctaatacttagcagatatcatagtgttttcttagttgggagactagattctgtctccctcatttgccccaacttcatgcccactggagctccagacacccactggaggaggcagtgacaacaggatttgcctccaaagaacacagaccgcacccttgtgtgaataagggaattttgttactcctgattactttacccatcctagaatacgctgaatttagccataaaagaagttgaaaaagatactcagaagaagaaaaaagaacactagagtggcaaattgtattatattaccagttttacacatatccacatggatccttatgtttgtggggtccacagcctgaccactgtaatccctcacattcatgtttccccgccgtgtagaaaagctatacagggtattcctgctgtacacgcagccactgtgcaaagatgaccctactctccttggcactgaggagccgaagtcatcccctgagagagaggcagcctacaaatgaatacctggggccaggggcctccagagaggggagttactacaccaggcaatgcttctctcccagacagcttgaatattaaatgtgtaaacatactagacagcaaagtagtgccgaaaccaagaaatggacacacggagagagagggggaaagggaaggggagagggagggagtgggagagggagacggagagtgagagggaaagggagggggagggggaggggaggaggagagagagaggcagaaggagaagaacagggagagggagagggagggaggggggagggggaggggaaagggggaggaagagggggagagggagagggaaagagagaggtaggaagagaccacgaggagagaggaggaggaagacaaagtaaaggcaggaggagaagcccagtctgggaggtagagacagcaacaacttgagtcatgcgctggacacagtgcccacttagcaggaaccgctgcagctacagatgggtcccaaatcatgaacgaggacgttctggttgcacttccatcctaagaggatggtggagggtgatgctttttgtttcttactcatttccctgtgcatccatacagttagccaataccctctaaagtaataaaagtgtatttctgctccgagtaacttggttgaactaatattcaaatccaaatctgcagactggtaggctgactaggctatgtgaatgtgtaaggaacacagaatgtgcatacaaattccatacagacagagaggactgggctggcattaaggaagaccagtcacttcagaggactggccaagaggccagtgacaccacgctcggtgacaccacagctcttctcatggtttcaaccccagaggcagatattcttggctgccttcttgagtgccctgacgggggccactccttttgtctctttctttgatttctctgggtgcagactaaaattctccttgaatctagttcaaactgtccaaaagaggggatctattcagttcgattcatcacactggatggagttcttagaccaacacacgccacaggcccatggccagcctacagatcggctccctgatgtcatgccatggccatggaaagactgaaccatcacagaaggggctgccagcactgggacaggcatgtaagtcatatgagaccatctaccttggtcaaccaggcagtgctaatcgggagagtaagaggacagcacggagattagcaacccaaagcaataccccagcaggtattagagttgaccattggagcttggcatgttttggttattaatactccaaactattcatgcttaaggcaatgtggaatttcaagtgaaagccagatggttcttgggcaagaggaggaaagaaaaacaaagcatcatgtgcttgggagaacgcctagtaaaacaagaggatcccagtctctcccagcagagtgtgggcatcgttcactccctttggtacaatccattccctttctcgtcgggattcacacagcatggtcaaaggcaatactttaacatcacgaaatcaagctaggtttacaaatgtaaggtaagagataaagaaagaccatctatctggagttcttttctcccctttctttctatgtgtagaataaaaggacagagaagagacagaaatttaaagggaaacaaggcaagtgctgaaataaacctgccatctattttaagtgaaacaatttatttgggtttcaagaatacttttttctgtctctcgttcttcctaaatcccagattatcagtctaatcgaagatcataaaggagatgacaaaacaattatcagagagaaaactggattccacttagcagcggctaccaaaagtacagtttaatgtgttttcaatgaggtgggcccctgggggcctgaacacccacaggccaacggatgtttctatgtaagaagagcaacgtcatcagcaaaagcaatttcccacttttattaatccagtttattttaaggcatgattattcaagctttcgtctgctatagttagtcttgtattttcaggataataagactggtgaggctagttatcaagtgcctatgcacagaattcaaatggcctttgttctacctggcagtctcaagaactgttaaatgagcttaaactttattacaagaagaaacagaacatgctgagtgaaaggtctgcttagttgcttaccataaaaccacaactacttaggaaacttatgctctgcatattctaaacctgaaggagcctctaatggggcatttggggtcagttttaagatgattcctcaaaaatgcccccaaataagacctggaaggggattccacacttggctgtctctgcagagccacaggcaacaacacagaggtgccatgatttatttaatggaagcttggtagtgactcaatatcaagaactcaccttgagaagccacatttcaagtatctgaaaacaactggcaggcctttattcaaatactttaaatagatcaaagctgtttattctctaaactcctctccccttcttacacattttaaccaagtcaatgttttccttctatttctctcagaggtctaaacatctctaaactatatttggcctaaagttttgcttgaccacatgattttaagaactgttgaatttgagtgccattgccagggaagctgggaagatggctggataccagcatttacaaaggtctcatcactccatgagtgataaattcccatttctcacatggttcctatgggctgggagtaggagtcctcaattcattgtccttctgaaaggcccagatctatgaattgggagattacttgtattcagcagttacattttctactttttgtgggctttgaggagattagaaggggtaagagaaagatatttgacatacttctttctctacccctcaagactaaataaatactaactcaactatcttactacttcaagtttctaaataaatctcccattcagggtcaggctaatccccttaactctcctctccagtatcattctgatcccatccgacacctcccaaactgagcctcaatgcctttcccgcatggacccgcctctggctggtgaagccaaaggtcctgagagcatgcatgtggacagagctaggcaggtttccttggcgtctcctggggacgtcacatattatcctccattatgattgtcacagtacatggtatgagcagacaatagattttaaggcactttaaaaaaatgcttgtgtaaatgaaatggagcatttggattcaatttagtagccttatacaatatctgctttttatttcagagaagacttctgaggtagctgatgaacatgccggcagagaggttgaattccgaggtgaaccagtcattccaatccaagggagacagcgtttggaagctttaatgtaaacagaaaccctgcgggactcacttgtgcatacagctgtcaaaacaattcaatatccagagataaacagggtataagacacccactagtatattatactggaatgcaacatctttttaaaattatgttgccatattctgtactttatcgagtaccttccattttaatatttcatctaatagactgtaatttggcactttgggtagtaaatagtgaattaaatgctgatgtggcttattagggcaagtaaatttgaaatcaagtatagtgatagcattataatgtgacatgtcatcagtttacagaagagatttctcaaaggaacacagagttctgaatacatgggtgttggtatcatcatagagaacagcaagtattcattattcatttaggaaaggaaatgtgtacctggataatagtttaaagctatatatatatatatacacacatatatatatgtgtgtatatatatatatgtatatatacacacatatatatgtgtgtatatatatgtatatatacacacatatatatgtgtgtatatatatatatatgtatatatacatatatatatgtatcattaacatcaaggctgcatgaaccaatttgctttgcacaaagacacaggagaggtggtatcaagtagtggaaggagttgtggctttggagttaaagatactcattcagattctatcatttgctagatataagccttgagaaatatacttctgtgggcttcaatgctctctactgtttaaaaaaaaaccttgaaaaattccaccttgcagcattgttttcaaattgtcaatttcaactggcgctcagtgaatgggaggtgttggaaatgaagacattcagcacataaataaggaagtaaggtgtttaagagtctgtatcactggacctatgggcagtctttctgggccactgtcaagcctccctttttgagaagctacaacagccacatgggagagtccagcgaccagagtggccgccgtggtccagataaggaaaaccgccatggattcagccagacttagagcaggatccgcaggcgaaccgttcttcctcttccagctatttctggataagcccactgtgtcccttcctctgcagagcacacctgcatctttgattccccaccttgaagtccttgtcctttcctagcctgagtcattccactcagctcaaaagacagtgtctgggcatcgtctccattggaagacagttcctgatgtttcctaaagttctctttactcccccgtcacatcctcatagcatgcagcaataaatagaaattaccctgtttttcaattatatttctataactattgttgccctcctccctttcagtaatgtaaaaaattttcacagtatcttctgtatcctaattttccccactcaattcgatttttgagatgaactggcagctgcctattaccttttactttttcctctctaagtgatacttttagtaagcaatttacagctacctccaaggtgaatttgtgtgtaacttaattacattcacttataccctcattataattacagtagcttaaaatccccatctgtggaacaaaagatgtttccatttatcatgtttctattgtgtataagctgtccttaatattaaacaccacaatactctcaaaagatgagactatctctggtaaatgctatacctgtcccccccactatctctttataaatgcctcagttaaaaatgatatgtttttaccattacgcacttttttctgatttttttttattagtccaaagaaataaagtgctaacaaatagctgggtggatgaagtgagtgaggccattaatattctatactgatagttaatatacattctcttttccacattacgtccttagacttcaggcataactccaagtaaaaattcaacagaataaggaaaactgcattcattagtagaattgtttttctttttcccttataacacagcacaattgcagatcaggagacacacaagcagacctcccagactcgtgggtcacacttagggggttattggtcaaaaatttctggatatctgctttctgagaaagtagcaagattttgctggcatttactttttgataattaaaactagatttttattttatcctataatcggtagtattctcccccactcagagtcataaataaggttaaatagtacaagacgtatttagtcacctaatgatgctgatgatccatctcagccaaaacaaatccttaaaaccaggcaaataatattaatctcacaaaagaagcaactgttaactagaaatggaaatccaattaaatacatttcctgaataattaaataataatgaaaacttgaggaacatgtacaggcatacctcagagatactaagggttcagtttctgaccactgtgtaaagtgaatatagcaatacagggaggcatacaagttttgtggtttcctagtgaatagaaatgttacatttatacaatgctgtagtctattaagcgtataatagcattatgtatataaaaacagcatacaaactttaatttaaaaatacgttattgctaaaaaatgctaacaattacccgagccttcaacaactgtaatctttttgctcatggaaggtcttgctttgatattgatgactgctgactgactaggatggtggttgctagaagttgggatgactgtggcaatttcttataaaaagacaacagtgaagtttgctgcactgattggctctttctttcatgaaagatttctccatagcatatgatgctgatagcattttacccagagtagaatgtattttcaaatttggagttaatcctctcaaaccctctcaaagccactgctttatcagctaagttatgcagtatctaaatccttggatgtcatttcaacaacgttcacagcatcttcaccaggagcacattccatctcaataaactgctttctttgttcatccgtaagaagcaactcctcacctgttcatgttttattatgagattgcagcaatttggtcacatcttcaggctccaatttaattctagatctcttgctattttcaccacatctgcgatgacttcctgtgctgaagtcttgaagacctcaaagtcatccatgaggactggaatccacttcttccaaactcatgttaatgttaatattttgacctcttcccatgaatcacaaattttcttaatgacatctagaatggtgaattatttccaattaacttttcccagttccattagaggcatccctacctatggcagttatagcctaatgaaatgtatttcttgaataataagacttgaaaattagaattactccttgattcatgggctacagaatgaccgttatgttagcaagcatgaaaacaacattcacctccttgaacatctccatcagagctcttgggtaaccagctgcatcatgaatgagtggtaatgttctgaagagtcatttttttctgagcattagggcacagtaaggctcaacagtggacttaaaatattcactcgagtatgccctaaacacaggtaccatcatccaggctgtgttgttgcatttacaaagcaaggtcagagtagattcagcataatccttaagggccctaggactatcagaatggtaaatgagcattagcttcaacttaaagtcaccaggtacatttgcccttcacaaaagggcaggctgttcttggaagctttgaagccatgcattgattttttctctttagctatgaaagtcctggatagcatcttccaatagaaggctgtttcatctacactgaagatctgttgtttactgttgtcaccttcatcgatgatcataaccagaacttctgggtgacttgctgcagcttctacatcagcacttgctgcttcaccttacatgtctatgcagtggagatggcttctctccttcaacttcatcaaccaacctctactaccttcaaatgtttcttgtgcatcttcctcacctctctcagccttcatgatattaaaaagagttagacccttgtctgaatcaggtcttggctcaatggaatgttgtaactggcttgaacttctattcagaccactaaaatgttctccacatcagcaatgagactgtctcacattcatattatttatgtgttcactggagtagcacttccctcaagaatttttcctttgcattcacaaattggctatttggcacaagaggcctagttttcaacctgtctcagttttggacatggcttcctcattgagctaaattattcctagcttttgatttaaagtgagagatttgcaactcctcctttcacttgaatgctcagaggccactgtaggattattagctggcctgatttcaatattattttgtctccgagaatagggaagcccaaggagaggaagagaggtgggggaactgctggtcagtggagcagtcagaagacacacattaagtttgccaccttgtaagggagcagttcatcgcactccaaaacaataagatcaaagatcaccgctcacagatcaccaaagcagataaagtgataaactttaaaatattgcaagaattaccaaatgatagagatagagtgagcacatgttgttggaaagatggtgctgctaatagacttgcttgatacagggttgccacaaagcttcaatttgtaaaaaaaaaaaaaaacaaaaaaaaaaaacactcattatctgcaaagcatgctaaagggaagcatggtaaaatgagctgtgcctgtgataccagcaaatatttattacacgctgcatttctttaaattgtcttatatggcgggtattactttttcctatttcacaggtcagaaagctgcaatgcagagaggagaaatgatttgtttaaggaagtagagtaagtaggcatcagaggcagcattacattagcttcgaagtctttattttcactaaaataccctgccttcccctcccttttgttgctctgtgtcccactttagtatgaaggggcctatgtttatatcacagtaaagtcatgacttaagtagttttagacatagtatttcccccctcatgaaatttaactcctgcagcctattctatttctttaacaaagacatacagaatcatattaattatctttttaaaaaacctgaaaataccatcaagatacttatggaactcacatgaaagtgaaatagggagtatgtccccattccctcaaggaattgagtaataaactaagttttaaccaccaatggtagcaggtttgcatgccacttcacccagataacataaacacaccagttatctgcaacccctgtacgcccaacatggtataaagcaaaaagagaaccatttaacagcttttatattagctagtcattccagtaataaaacaggaagacaatcatacataaatgtcaccacacaaaaactttctctattacttattaataaccaacctgataatatcattaacggcttgtagagctaattgcggtggctttttactgctccctttgatatgtgcactatcctgaggaggataacatctgttagatctaactcatcccaaacatcaaatgtgacaccgtggtgtttaaataacttgactgcgcgctatttcagcaggtcctttcccgctctcctttctcatcttcacaaggctgaccacaggcagaggccttcctgtgctcattactgagtttcatgcagacacgatggagtgggagggaaagtttattaccttcattctgcttgaatccatccctgactttttggtccttcacagatttctttgggaaaataaaaatgatatattgttttctgaacaaaaggaaattaatttcaatcttttaaaaaccaacttgaatgttattcagttcggttttttccctaaaaaaaaaagtttcagattccaaagtttttcaaaaagtaacttcaaatttcatctatgtcaaaataagtaaaataggtcctcttgtcctattgagaatgacaagctcagtataatcttggaaaaatcaatttctataaatgactaacccgccaattgtattttgattttttttaaaaaaagaggtgcctatgcagatgcaggatacatataaatatagagtcaaccatctcctagtgactcaatcattaaatatttagctgacttaaattacactgcatgcatggggactacagttaatgacgatgtattgtggaaaatgctgagagactggatggtgtgttctcccagcaaaatgctaactaagtgaggtaatacatttgataatttgctaaatttaaccgtgccacagtgtctgtctacttcaaaacagcacgtggtatataataaaaacatataattttatgtcaagtttaaaagtatatttatactaaaaattaaactcatttttaaccctatagtttatgtgaaactatatgttatgtaactgaaatattttcacctaatgtgaaatcttgtctctgctcctgccacaaaacagaaacatgagaaagtccactcgtacttgtcagaggtgggttctcttcatcttgctgattcctctggtgggtctggtaaggctgagcttggtgttccctggactcccagaatggtttgggtccagcactgggctggccctcaggaggctgccctgcacatccccgtgcctgtgctgggttccgccccagcctgtctgtgaaatatgcgtgtacgtacgtgtgcacatatgtgcgtgtatgcatgtgtgtgcgcaggtataagggacagagacagacagatgaacacagatggagaaagaaaaattggtaggttgtattgagattccaatcaaaatctaaaatatgattttatagtttcaaactcaatctaaaccttttttgcagggtaatgttttatgactaagcagacgcagaagtcactctcaaataaatatagactacgtcaataaggtaacattgcattcaattatctccccaaggcagaatccctgtcttttctaaatgatgtaaataccttgttctctgtgtccacaatttaaaatggaagttaattaaaaagtcgacttgagcagggaccccaaatatagattcatttatttatttatttttaagttacacaaaagtattactatactagggtgcacactacaaaatatgctaatagaatttttgaagcaatgatgtgaataaaatgaatgaaacattttagaaggttcataaaggcaacaagaattgaaaatccagtaattacacactaagaaaaaataagcaaaaaaaaaaaaaaaaaaaaatttctccaaccaaatgtttactggaaggctgtgataatttttatactaaaggttattattctcaacaaaagcttatttttttccttagtaatagttcttaagctcaatttacaagcacaaattctctaatcttattgtgagaaggctgttacgaataatttttgttgttcatacagagaaattgagaaacaacgataataattgctcaaattattgaagttaagaagaaaataaaaattaatggtctagtgtttattcttataaaccctcctcacaacacacacacacacacacacacacagagagagagagagagagagagagagagagagagagagagagagagagagagaaattttccacttgtctgcaaatagtccctaaggttcttagccaaggtgtgtacctcaaagtctaaagtatgaagacttaaaagtggaatcaacagagcattttatcatgaaagccacacaagtgtggtatctgaaatggtgttctaaacatccttcgaatgctgccttttcttcaccttattgccaggaaaagcacagaagaatgcgtcaggtggaaatctgcatgggaggacaagcaatgaaacaaggtggcctctggctgagtagatgcactcactcattcctccaaccagcgctgtctgtgctaactccatggcggaattcctctgagtgctggggaacacaacagtgaacgtgacagacaaggtccttgtaaaacacacggtctcgtggggaaggcagagccaacaacacaaaaatattctctgcaaagcagagaactgaggtaaactcgtgtggttgtcagtgactggggtgttattttaggagaaggctgaattcatgcaattcttgagttaattatgttcttcgggctggccctggggactgcagtggcaatggaccaggtttcattgcaggaggagggtgttggcagcgactctgggcagtgtggggctaggccgaggaaggcgcctgaggagacagacacccttcctctctgacctctagggcccaggtccagcttcccaagacacccagcacaaggaaagctccaatcgtcatctttcatttctatcaagagtgacacttacggatctctaacaacgtttctatccaattttgggtctctaactatgtttctatcctgatgaaaaaagccagagggtttaataagaaaatgaaaattaaatgcactacttcctcacttagcacacagcaaggttgaggggcagcttttctgagcctgaccctaggaatttcctaactcaggtcaaaaggtgactgactcccaagccaaaggtctctaaggacaggtgtgttaataacaccactgccatgggtggagctttcagaggtctccaaggacagatgtcttaacaacactgctgccatgggtggagcctctctgtgccacgtactgtgctcggggagggacatgaaccacctcaccctggacccctctctcttctccagtatctgcattacatgtgcccagggggcccttctctactctgctgggatgccagcatctggcccagcatctggcacagaacagactcagcccaaatgtagaatataaagtcgggtatgggggtctgatgccctggcaaaggaactgaaagacttacccactgtccagtccaaagtccctaaaagaaagtcacagaggccaagaccccagacactttttgtccccaacacccaaagcttcattttaaaatcctttcagttcctccagaaaaaaaaaaaaaaaaacaaaaaaacctgaccctcaattcttagacattttatgtaaatgaggagaaagtaaggtgctagcccttcccgatcacttcttgttttgaatggatgtgtgagtcctgccaaagtgcaggctagtttgtgttctccaaatgcctcctagctcagtgagggtggtgtgcgcagggctgggatgggccacacaacatataggagcccaaatagcaagaaggcagttggagcacagcttaatcctgttgaaagaagccaccaagaagagctggggcaccggtgggtgcaggtgatgagcaaagctaccttcttccctaggtaatgattgcccatggggaaataatcagtaattcttcatctaggaaaatactagttgctgttcagagcctctgactggaagtgaggcatttccaagtatcaaacaatgattaaaagaaataaaaaacctttgcatcttggcatgctcatttaagaaagaaaacaaaatagacgtacacacagcccatttgcattccctctacccagtctaaaaggtgtccgatgattcattttaatcatttaccaatttcttggtaaccagtgtgtattgcagcagatacttggcaaaagcatgttaatttgctactaatatctgtataaaccagacattaatattctcaatttacaaataagcaaccagaacttcagcgaagataagtaacttagccaagattatccttctaataagtggtaaagctggaattcaaacacaggcctagtggagtccaaagctttccccactcctcagtaaaaagctaaacaaacttcctaattttctgagcttcctacatactctttgcactagggtaacaaccccatggctggctttattgcagagtttctctgcactggcatttggcctttgcctgtctaattttggctagttgcataagattctcacttagtgcaggctcaaggtgagacagtatttttgttttttcttaggtttatctctggagattgccaatgcttgcaagaatagcaatgctatcattaacctaataatgttggattaacttcaagagctgggtaatagcgccaatgttcatttcccgtaaatgttggaaactcctttaacctcatgagatcctacataacgtgggaaagagtccagttctgactccaaaatcttaataattcactctttcgttaactgctttttaaaaattaaatgtataacaccaaatagtgaaaaataataataatcagtttgtacctaaatttctttaaagaaatttttagttttttaaagaaatctttccaatgattctgactttttggaggggaatgccacatggtgattatactgctaaggtatatatatatatatatatatacacacacacacacacacacacacacacacaccttatatatatatatatatttggatttttttgagacagagtctcgttctgtcacccagtctggagtgcactggcacaatctcagctcactgcaaccttcgcctcccgggttcaagtgattctcctgcctcagcctcctgagtagctaggactatagatgcccccaccacgcctggctaatatttgtatttttttagtacagtcggggttttgccatgttggccaggctgatctcgaactcctgacctcaactgatccacccacctcggccttccaaagtgctgggattacaggcatgaaccacaatgcccagccctgctaaggtatattaacggtcagtttagtattatttgactatttgttaacataataggagtaaaacttaacactttttagggtagagatggtacaaaaaattaaagtgtaataaatataaatctataaaaacagaagttaaataagaagaaatcttctggggaagaagaaataatagagtatagattattcttaacgtaagtcaaatatttgataaggaccacaggcaccttcttttaattcagatgctgaattttctttagtcctagaaagaagtgttgttagaattccaaggatatttggatgaaacttcgctgtaaactcacgtggaaactattttagctggccacagatgtgaaactaaaaatgttgaaatacttatttcaagtgcatctcgaaaatctgcaatgacttcctcctggaagataattttcttactacgcatgcttgacatggatttcgaacatctgcaatgacttcatccaggaagataattttcttactgcgcatgcttgacgtggatttcgaaaatctgcaatgacttcctcctggaagataatcttcttactgcgcatgcttgacgtggatttcgaaaatctgcaatgacttcctcctggaagataattttcttactgcgcatgcttgacgtggatttcgaacatctgcaatgacttcctcctggaagataattttcttactgcgcatgcttgacgtggatttcgaaaatctgcaatgacttcctcctggaagataattttcttactgcgcatgcttgacgtggatttcgaaaatctgcaatgacttccttctggaagataattttcttactgcgcatgcttgacgtggatttcgaacatctgcaatgacttcatcctggaagataattttcttactgcacatgcttgacgtggatttcgaacatctgcaatgacttcatcttggaagataattttcttactgctcatgcttgacagctgggtctccacactgcatcacttccaggctcctttcacacagccctcctggcattctgcctggaaatatgtcatatagcaagtttcacacttttttaacatacttgcaaaaaatcttaggttagtgctaacctaagattagtgcattgtttctaaaaggccaacgcattacatttttcctgagaataaatattgacaactccaggatttaaatagtgcacttggctaagattatggattttaggtagtctgtatatctttatgatattgtcctatgtattttaacattcttcacttttcttagtactgccatttcatgatttttttttccttttggatgctattgattagtacataaattccttggttgtacaccctgttttcattgctaatccagtagaagaaaagcaatatgcccaaaatcttttacaaaaaaaaaagctttcttgcatctgctgcttgcattctttgtgtgatacagtattttctctcattattgttggtcttcaaaggcaacaacagcataaggtctgctcaggccagagggcctcctgatatagtcctcatggagaccacacagagcctttccaagaggtcaaaggaggccagaagtttttggttctttttctcctaacttttatgttcatcccaggtaagcctccatctccaatctctgtctactagaatctatacacaagctggtgcaccagcttgcctgctctcacttgccttcctttgatgataccataatgtctctgattctacaacttaatttttctttcactcaagtctagtccagtagatacacattcctgttatggcaaaagatcatgtactgctatttatggaactgtaatttattctgtacttataggtgaattaggcaaaccaataatgccagcaaagcatatagattgaggccaacatttgcagtcattagacaaagtggactcagccactatttctaagtctttagtttggcctaatacctaatgttacattgatgccatactgtaagctccttgaagtaattttctacatttttaaaactcagcctatcattgctaaaataataaaaattctaatgcaagttgctctttatttctattacctgtaaggacacttgtatttgagaatacacacttgaaatgagttaaatataccaacatggatgtttggcttcaaagaccaggagcatgtcggatccgggctcactgctaagctttctctgactaggcatataaatcaacatcttcagtgcttttagggccaccatgcagcaattccatgatgcttggctcaagctctgcgcatctcacattagtcctcctttcacccaagctggctccagtaattgggtgactgttctggcagaatcatgtgctaccatttaaagtgaactagacaaccagttgatactgggtgaggataggagattcttttttttttttttttttttttgagacagagtctcgctctgttgcccaggctggagtgcaatggtgcactctcagctcactgcaacctccacctccagggttcaaacgattctcctttctcagtcccctgagtggctgggattacaagtgcctgccaccacgcccagctaatttttgtatttttagtagagacggggtttcaccatgctggctaggagttggtctcaaactcctgacctcgtgatccacctgtcttggcctcccaaagtgctgggattacaggcctgagccaccatacccggccgaggctaggagattcatagaggacagagaagacattctaggcttcatattgaaattgtaaatgtgaacccataaacaagtcaatagagatcaacttttgcatgcacgatcttatttactcttacataataccaccaactaccacttaactggaatgtcataatgtagaatctagacaatctttattaaattattaaattagctagaatcactcaacatggtattgtggtaagagtaaataataaattttatctagcaaatttatttttggatatacattacttcaaatagttgtgtgaccacaggagcatcataactctcaccggttttttcttctgggagacagctaataaacaactttactacaatttagaaaataatcctttagatttagttaaaattaaaaacatttcatatactggtagctcaaataaaattttggttgctcactaaaccatattatttctcagacatgattatatggtcattttgattacaaaagaaatacaaagcaaagtttatttggaaaccttttcaaatgtttctacattgttagcaaagcattatatattttcaaaagtatccaaaattttttttgttacactgtagtaacttataatctagcttgtatttcctattttcccataatattaacaaacatttacgtatttgagaaagaattccttgaagcataatgagaatatacttgttcaaaaatctcgctttcatgttttcattttaggactataaacattaggtagttcagaagaggaggtgcaatgcaaaaggtcctctgcaatgctagggagctctgggcaaagtgagagcgttctgctttcccttagagaggtcctggcctaaaatgaacacgtacttccacgagcttcgggtgtgatacagaaatatgtatgactctatgtaatccttatcatggcgttcctaccaactcaaacatttttaaggttaactgagtactcgatgtaattgtaatacatccacctagtcactactacaagatagtctgtgtggctgcaggctatgaaggatagctttttattttttccttatcaaggtaatatttggaacacttcaaaaaagccatcacagtgccattatagatgaaaggcttcccggtagaaatttcatttcctatacctgtaacaggctttcctgcagaaatgatagcatatgtgatacatccaaaaggcttatctcatgaagtcccagtgaaatgtattaattttgcttttggaaaataaaaacatcactaatttactgagaactctgcaatgcagtgtaaattctgtacccaagaagtagagctcatcacttaagtgaatagaaaagtagcctatagatgttactgtggttatgataaaacacttttaaatcctgtatatgtttaaagtttaaagaaaagcatttgcatctcgttttcctagtgtaattaattggaccttgaatgttgtatgtttccctgtgatatttgaatgaaagccaggggttgtcttattatttgccttaatatctatttgcagtaaaaagctaacaaagaagtgtccaaatttgcaggtagtgaacccccatttaaaagatatactatctcaatcaactcacctatgtaactttattaatataaaaagagatatcctggctgagggcagccagaagttactctgggataactagccttcaagacgtacctcttggtagtcatactctagcataataccttcccacaatgaattatggctgccctgtgtgatcaatacaatataacagcagtaacaatatgtgctagattatataaaggaatgcagctgccacttgaacatttggattgctcatccaggggaagccagctgtcctgccatgggaacacagacactgtcctgcagaaaggtccaaacagagaagaactgaaggcccttggccaacagccagcatcaatttgccacatgcacttcagtttgccacagtgccaaccacattggaagtgaatcttctatcatcagttaagtcttcagatgaatgtagctcactgacatctaactgccattgcatgagatacccaaatcaagaatcgcccagcagtctctccacaattccagacctacgcaaaccatgaaagataatgcatgactattgtcctaggccatacgttttgaagtaactcattatgcagccatagacactgatacaaacgccaaagttacaagaaattctcctttgtttgcaaaaaaaaaaagaaagttcttactccagatgcccactgtcacctggggttgttgtgtggtttagcagtttgaatttcaaggtgcatatgctttaaaataaagggctggctctcaggcctagtctgtctagctgagcatacatataggactattattatctgagttattaacatttcttcaaacacagcattatccagtttaaattctgtcttcctcagtagacactaagttgtagaactcaggcactgtgctgtacccaatgcaccaggcaccttttctggtatacagtaaaagctcagtaaatgttggagacaggaatatgtcattcatatgtgaataattaaatgtagacaaagcgaatcgaatcatttcttgaagcctaatgagttctgggcaaggccttaagctgagttaagagttactattgcagagcttttgttttcacttccaggcagtccttggaatgctgctgggccattttgtttgtatatgtactaaaccagctgggattgtaggagttttagaatgttttgaaagaataaatttctctgaaatgagaagtggattgtcattttaggattcggagtagttgaggatgtgttcctcgtgtttgaacaggagtgcagtcagcattagtgttgtccagccctccttgctgccccaccacatagaatatcgagccagctagtccctttgtttttaggtgggacgtgtcactagttctggctaacaaggtggaacgatgggtatcacttcccagccagagcataagacgccaactcttccctgcctttgtgactgtggcaacttgtcatggtggagcctcgtgacaaggaccttgtctgtcgcgttcactgttgtcactcagtcagcctggagcccgaggtcccacatcgagcagacccactctggacccgtcgcttgtgttagaaaacattttttgttgttgtgtaaagccactggaactattggcacatttgttacagaaacataattttctgtgctgataaaggccagtgtaagatcgatataaattaatcaccctcccatatgcacatgcacacacacacacatttatacaaaagaagcaatcatatttactgtgtttttacctgcccagaattcttctccttttttggtaagaacaacttcactgacttctgagaaaccacaagtctgatgcatttaggttcaaggtgggctaacttatcccctaaacacacaggcatgaacacacacacacaatatacacacaggcatagggtttgactagggtgggcctatccacctgtttagttcccatggccatagtggtgttggagatagtatgcaaccgaggacagcgcaataagggtcactcctatgacttttgctggaactattaagaaagaggccttctcttcccactaggcttgctaactgatagaatgtaagcctgaagcttatggtgcctttctgtcaccaagaggacacagctgacttaatgaagtaaattccagaaaatttgcttaattattgttaaatgattctgtgaactctcttcatttagcaactgttcaggaaggtaagaaaaagaagcaaactcgggaatatcaacagatttgagatgtctgaattaacttcgagcacctggattaagtcatgtctaggccaacattaatgccaggaactcaaatatttaatccaacaatctctctttttttcttacgccagtctggctggatttctgcttcttgtaattgaaagagtcctagctaatacatcttctatatgcacacggctgtactagatatttggaggtagatggaaatgcagaagccgaagacaagcaaatataacatggtccttgcttcagaaatttaaaatttgtttacagggacaactataataaatgaaaagctaaacgctccaatccatgagctcttccagcagcgttaaggaggtctagaaaagctacttatttcctgcactgtcaccgctgacattgagtgttagggaactccttacccatttttattgaggcagaagagcacactcggcagtagaaatgtaagattttggccggtcacagtggctcatgcctgtaatcctagcactttgggaggccaaggtgggtggatcacttgaggtcaggagttcaagaacagcctggccaatgtagtgaaaccccatctctagtaaaaatacaaaaattatctgggcatggtgactcccacctgtaagccaagctacttgggaggctgaggcctgagaaccacttgagcctagtacctggacgttgcagtgagctgggatctcaccactgcactccaccctgggtgacagagcaggattctgactcaaaaaaaaaaaaaaaaaagaaagattttctcaaatttgtggaaaagaaactaaacaaaaattcactatgaatcaatttactataaaagttctatttaacacttgcaacataaagcaaatactttaaaattaaaaatcccagagtgctatgtaatacaaacatgaaaaacatataaaaggcttctagtatcatttcctaactaacatctggcttactgaataaagctttataacatcaacttcatttttccacagttattatcataggtagttataatgtttttcttaaaaaaatgaatatcaacacaaatttgctgttataaagagtaagacaacttcagccagatctttctctttttgttttttttttttgagacagagttttgctcttatcacccaggctggagtgcaatggcacaatctcggctcactgaaacctctgcctcctgggtgcaagcgattctcctgcctcagcctcccaagtagctgggattacaggcacccagcaccacacccagctaatttttgtatttttagtaaagactgggtttcaccagttggccaggctggttttgaattcctgacctcaggtgatccacccgcctcagcctcccaaagtgctgggattacaggcgtgaggcactccacctgggccagccagatcttttaacttcatcaggatcttcactttattttcagggaaacaaatatgcaaatctccttttctctacagtaatctgtgtgtatattacatgatgtggcaaatgatacattcctgcttgccacaactaattttcactaatttctccagatattctatttaagagggctattttctaatgggcaatctttaatattgatccagtaatttaccatacagactcaagaaaaagaaactgaagatgtaaatttttacttcagcaaaataccttcttcacatgacttaaaacataaacatgattatcaggaagtattatgaaaaatgggactatgaaaaatgggacaataaaaattctcctagggaaacttccatcaacaagaggggacggaaaaacagcattttctctcaccaaggaacaatcccctccccattttttttcatcttgttggtgaaactctaaaatgaatgtgaaagccacataagcaacagcaattgggtaggaactgtggaaggaagccagagatattgtcatggagagacatcttcctgaaagtgaggggaacactgaggggtcaaaatcagaatggggtaaaccaatgggtggatagctccactagaccaaatttggtttagagtaacagaggaggcaggtgaaaattaataatcacacagcaaggccacggttggaagaagcagtctgtatccatgaggcagagagtaagaaagtgagcaatactagaatagcaggtggactactgctctacgccccaccacatacaggacacccctccacaatacatgtccatgaaacccaagtattcaatgttgaataacacatacacacacacacatgcatgtatgcatgcatgcacacaatctatacaaacatactacaagaaaaagtctatttatagactaagaaatctcatcagaaaaatgttgttactcaacagaactctctggcaacctattctagtaagaaatgaaaaccaaacaatgaatcaaccaagcagttgtgtccatgaaacaagacaacagagcagaaatacaagagctggagacataacagagaaacttaaggaacaactgaaaaaaaaataaaaataagatgtgaagtgacacaaaggtacaaactcactgcaaaaagcactacaaggaaaaagatagaaaaaagaacaatgagctaaacggcctgtatgatttggaaaaaaaagaaatcaaagaagaggctgggcacagtggctcacgcttgtaattgcggcactttgggaggccaaagtgggcggatcaccttaggtgaggagtttgagaccagcctggtccaccatggtgaaaccccatctgtactgaaaatacaaaaattagctgggcatggtggcaggtgcctgtaatcccagctacttgggaggctgaggcaggagaattgcttgaacctgggaggtggaagttgcagtgacctgagattgtgccactgcactccagcctgggtgacagagcaagactctgtctcaagaaaaaaacaaacaaacaacaacaaaaaaaaaaaacaaagaagatttgaatctacatatggaaataacactttgtaataaaaggaaaatgacctgtagacaacaccagattataacttattaaaatgatcagtttgtggtttgtggagcaaaagaatcttctggacagccaagcagaaagatcaattcacttatgtggagaaataaatcagacttgcctctgactttcccacagcaacatgtaaatatcaaaaaaaaaaaaaaaaaaaaaagctaaaatgacaccagtaaaaaacacaaggaaagagtgttccaagaaaagtaatacagcatgttgaatattgttctcaaaattttttggaaaaaaccgaactatcattagcttaataatagaactaagactgaaatcattgtggattttagggtaatggaaaacagtttagtgcactttgtcctgactgtaaaacaacagcatttctttaaaatgggaggtgaaccagaaaaggtagatgggtgggaagcagaggaagtacatttcttaaaacagaggatacatcttttctcaaatgcttatggaacagtcatttccttgaagagactgcatatcaggccccaataaaatatgaattaatttgaatgagggaactactatatacatcatactctgagtacaatgtaatatacacttagaaattaataaagcaaaaataacgtgttattaatttaaaataattattttaagcaattcttgaataaaataggaaatccaaatgagaatcacagaatatagtaaaaacattgatgataatggaaacgcaacacaaggcaacccacgctgtgcatctgaactgatgctcagagaaaaattcatagttgcaaaagcaagtgtttttaaaaacaaggaataaaaagtatgttttcatgccaaaatgtggcaaatggagacagaactacgattaaatatatataaacaacataaccataaaagtcagaaaaaaagaatattaagaaaaaaatagaaattgctgaatcagaaaatgggcaaaaagagcagaaacatcaaataaactaaaaagctagttcttcactgggaaaaaaaaaaacctatgcagatactccttgacttacaataggtttatatcaccataaattcattgtaagttgaaaataccataatctgaaaatgcatttaatacatttaactatggcatatcatagcttactgtagcctactttaaatgtgttcagaacacttacattagcctacagctgggcaaaatcatctaagaaaaagcctatttttataataaagtgttaaatatctcatgtaatttattgaatactgaaagtgaaaagcagaatggctgtgtgggtagttcaattacggttcctactgaatgcctatcacttttccactattgaaaactcaaaaaatcatgtcaaaccatcataagttgagcatcatctttaagcaataaacttcaaactaatataaggaaagagaaagaaaatatacaaaattaaaataaggagaatggtaaatatgagggaaagaactttgcacaattctttgtaaatttattaacttgaagtaaatgaacaactttataagaaaatagaatttatcaaaattgagtcaagacaggaaatctcatcagaccaatttccacagaagcaaacagttattttggactcgataactttttaaccagctttaagcaacttctagagattattctgagtatttcaaaccacagtgttgccgggtgaagtggctcatcccagtaatcccagcactttgagaggccaaggcaggaggatcacctaaggccaggaattcaagaccagcctggccgacatggcaaaacccagtctctaccaaaaaacaaaaattacccaggtgtggtggcacacacctgtaattccagctactcgagaggctaaggcactagaatcgcttgaacccagaaagcagaggttgcagtgagctgagattgcaccactgcactccagcctgggtgacagagtgagactctgtctcaaaaaaaaaaaaaaaaagtttcaaaccatagtgtcattccgataagcagtattattccagcgtttgccaaccatgctcaggcatggagagttaaggaaattaatagccatatgtacttttctccaaaaggaatctatcggaacacaaggccgttcccacactttccacttcccactcacagttgcccccctactccctcacggtaaaacaaatgcagaagtctcactcttgagggctcttagcttaattcattgtctcggggtataagactttaggctgacccccaaaaaaggaaaagttaaaatatgtgtgtccactcagcctcctttaactaaagcactatacaataaatcataaatagtaggggtttgtgtctttccttgtcatatatatatatatttcttttatttcctttttttttttttaagacaaggtctttctctgttgcacaagctggagtacagtggtgtgatcacagctcaccgaagcctgaagcctcaaactcttggcctcaagtgatcttcctgcctcagcctccttagtagctagaatgccatcatatctgagtgattgttttttagctttcttagagacaaggtcctgctgtattgcccgggctggtttcacactcctaggctcaagtctcgggctcccaaagtgctggggttacaggcatgagccactctgcctggccctgtcatgcatatatttctgttaagggtatagggatatctggccagtgttgggatggtctggactcagatacccatgaagatctcatctagtctcaaggctttaaacaccgtctggattctcactcccagatttatatcttttccgccttgctttgttctcaacataactggccaacttcttctcaacattggtttacagcatgtccatgaacgtgaaattctttcaactcacaaggcccaacaccatctggcgcctttcgtcacttgtagctcgcctccagctctcctcactcactctggcctccagcctctcctgccagcgaatgcttgcccccttggagctttgggcttgctgctcctttaatctcattcttccccatgcagccctgtgcctcactccctcacccgggctgcgtctttactcaaatgccttcttgtcaaagaggtcgaccactccgccttatttagaactgcactctctgcttcctatccccagcgagttttatttttatctacagcatatatcaccatctgaaataccactgtgcatatctgatggatttatcttgtctgtcgtcagccttttctctttaaaaggaggctccaagagggcaccggtgattcctttccattgtgtgaagctgtaacccccacacctaaaacacagcctgacacaggtgtcagaaatagttactgaatccctggaatcatcaccgtattcctggattcaggaatggggaaaaaagtgttccatctgaggacagaactggatcaagttccaaagcagcctcaaagtttggatgggattggagtggggagtgacacaagtcgttgtaattacatgggcggggaaatcatggagttttgtgggaggaaggccaatgtcagaagaacgtttcagggaaatgggtccaggtggctcacttatcatcattaaaaagctatgcaagtttttacttctctttctcctctatccataaagtcctggtggtgaaggcttacctgtttttttcatggcattaaaccgaaccattcacttcatgattttgcctggtatcccagtaggtcttccctatcctaatacataaaatagaggttggttggcaatttgctgcttcatctgtcagtttagaaataatcctttttggccgggtgcagtggctcatgcctgtaatcccagcactttgggaggctgaggcaggcggatcacgaggtcaggagttcgagaccagcctgaccaacctggtgaaacccccatctctactaaaaatacaaaaattagccgatgtggtggcatgtgcctgtaatcccagctactcaggaggctgaggcaggagaatcatttaaacacaggaggtggaggttgcagtgagccgagatcgcacgattgcactccagcctgggcgacagagtgagactctgtcagaaaaaaaaaaaaagaaagaaagaaagaaagaaaatccttttttcttttcctcattagcaaagagctcagtgcttcctccaaaaggatattgggtctagaaatttgccaaatacctgtgagcatgtcctttaggattccaaatagtacactcatattttgaaatttggcaaaggcttgaaaccaacacttatgggtttttggtttgtttgtttcactcttgttgcccaggctagagtgcagtggtacaatcttggctcactgcaacctccacctcccaggttcaagcgattctcctacctcagcctcccgagtagctcggactacaggcgtgcaccaccacacccagctaattttgtattttgagtagagacggggttttgccatgttgggcaggctggtctcgaactcctgacctcaggtgatctgcccgcctcggcctcccaaagtgctgggattacaggcgtgagctactgcgaccggccacttctgattttttaaaaagtgaacatagagccacacaccaagtaaggaaatacttttagcagcatagaatccaacgcttgccttccttcatagatctctatatacacaaaatagaaatgaaaccaagcactaggcctatattattaatgcaagaagtgtttgcttgggattggatgagcaaaaatgtcataaaaacaaaacaccatgaatgtttcacaatatgccccgctcagaggtcagcccctccatgtgtcctgcagagctcctgaagcctttaagagacaactcaaaaaaggagtgaggcagcctgttctgacacttggacgtcttccaacgcagactttcagtattatttttctaaacatcctaaatctctagtgagaacatggaatagactatttctgtaatggcagatcttacaaaagagaaacaacttcccgaaaacatgcctatgtccagtcacagagaccaagcatcaaaatcacctgcaggggtttctctaagtcgccctcacacatgcttggacatctgtatgaattcaatgcacagtaaatactcctttgagggtctcttatggacaagacttcgagagaagaataagatacattctgcctccaaggaactcatcatctagtccacggtgtgtggtgatgggaatgcagatgccaggtgctatgaagtgaaccgtgtcacccccaacatttacatgctaaagctctaaactcagatacctcagaatgttttgggggacacggcctttaaagaggtgatcaagttaaaatgaacccattagggtggacccgaatctaatctgaatggtgtccttataggaaggcaagattaggacaggagagatactggcgttgcaggagcccagaagaaacgctacgcgggggtgtagtgagaatgtgccatccgcaagccaaggagacaggcctcaggaaaaaccacctgctggcactgtgcactcagagtaaaccccgagtgatctcagagttctagactccagacctgggagaacatataaaccacgcagtctgtggtatggcggccctagcaaactaactcacctgaatgtaaatatacaactacaaagcaacaaataaaaagatggcaacaacaagcaagcaatggaatggaccctcctgctgggctgaacatcaagacagggatttagaaccagctttacacaaggagcatcatttttccctaggtatgatttttatccaattcactttgattaatgacagctaccatttagcaagggctttttatgtgccaggcaccaaactcaacacttttcatgcattcacttactcaaccttcactgcaaccatgtaagatcgttgccattgttattccaaatggacagatgtggacactaaaacagagaggtaaattttgacctttgctgaagtcagatggctgcaagagttggaactagagttcaagtccaaagagtccaactctagaatccttagaaccactgtgcatactgcatgaacagtactcttaccttctctagtcaagagttcaatgtgaactttattccagaaaaacacaccattcaacatcttcatcaaatattataaagaatgcagtacttagatatagactctctatgcagcatttcctagctacatttgacctctctgtttcaatgtatctgtgtagcaaatattctatgaaacacaatttcttaattattgacctcgttgtgtctttaccagcactgtgactataccatgtggtgtgagagtcactccagtgaataaacacagactgaggtcaagagtctaatcattaccaaggccctgggaaccctccttgaagagaagagataggagcgcactatccaccatgaaaagttgaggtaggtagcaaagtcagtgtctacaccacccgccagcttctcctcccctcttccacacgggtgcatggctgccaccacttcctgatgggaagcttttcagaatacagataacatcctcactctcctgcctccctccccaccccagtatttttatttagtagatctggtatggctctaggaagctattcttgaaagtttaataatgattccaactttctgccaggtttaagagccataataatgttgaccaaaattgtagattttccaggatactctaagctttgataattttgtgcggacagttactagatcatgtgatctaaacgagggttggaaatacccccatttatattcccaggcagactttcccttgcccacttccaaagcaacctagactttgggactactctattccctcactgctcttgccctcactcacttaaaatacttttatctaatacaaaggtgctagatgttgacctgattgaagtagagctgttaagaggtaactgaagcttcagctaaataatgccagggggtaacattgtccagggaaactgttcaccagcagacctctgttgctcctgatgtactccaagttattttcagtttagcctttcataacgttgtacaaagaggctttattcataaaacagtagctttggttggcctcccacatcgtgaaaacaaatgtaatatagtaattaagtgtgctgatatgttatcattgcaaatgtcaagttcattgtagcagatgtgtcaactgaagatcactacccattaaaatcaaacaaccagtaggccccaaactcaccatctgatttcatgcgtcaacttcaatgcttaagacagtcaatcacaactgtcttccatgtaattgtcttaaaattattacataacaaagaatcagatctcaattcttatcacctgctagtcataattaaaatgtgaatgaagggctaatgactgacacagttacagggtataaaatactttcacaattttacttccccaaatagatggcattattattaagaaaaattactcaaaatgtgaaataaggaaaaaaacgactgatgtgttaatgtcttgctagagcaaagctcactaaatctccttgaactctctagagaaatgtaacttggttaaacttactacattttctattcatttgggcccaggtattttacacattttaaagtttgggttcctaatttaaaaaaaaaaagtgataaaatcagatgactaatatttttatcaagttaaaaagttttattatccagtaggataataaattagccactatgatatctacatcttttcaattttatttcagcatttctttttcatctgactatataaaattcctactctcatatcttcttttgaaccagttttgtcatcctgctgattccctcattagtagtcacatggatcttatgaaaataaatataatatcccattagaaacatatctgctactagtcggggtacttacataaagttgcagcaattatcagaaaaaggtaatatgcaagtctcctctaaaatttcccaactatattcagaaaaaaaaaacaaaacaaaagcttaagtgactgcttaggtgaaaataagacttccagaagaatgtctgtcaaagttgtaccaagaacattttgaaaatacaggttaattcaaagaagcactcacaaaatgccctcaatatgattttgagaggaattattacaagtggtatgtattcttgaaagccaggtttagggtacatctctaaagcagaataggttgttttcaaattgctaggtcattcaaggcctttaaaccactatattctatccataatttgcaaacgtaccactaacttacactaaagagatagtgagaaataagttcttgtggaagcaatttacacatacagagttgactataaagtcctaggcactttggcaaacatgcttaggggtggaaagtttcttttttggtaaagatcccatagattactatttacattttagcatcatctaaacaatctggaagctcctgaagctcatgtctcatcttcaccatggacacaatcacatattcttactctaagcatctctcatttttattctagttgattctcattcttcattcttcgtaaatgattataatgaatcctctgcctcttccttcccctcttcttcacctcactttcccctcccctcccagctttccctctgccttctcctcccctccccgctccttgtcttccatccctgcctctcccactccccctgtctctctgacactgttgtctccaaccacacacaggctccctgggtttctttcacaaataaaggaacgatttgcatagatggggtaatgtgcatctgcttttgtggtgtaccttccattcttcctttcttctgggaatagtaactccctcccttttcttttcttttgtattttttttttatagacagtgtctcactctattgcccaggctggagtgcagtggcacaatcataactcatgacagcctcaaactcctgggcttctgcgatcctcctgcctcaacctcctgagtagttggaactacaggtgtgctctaccatgcctgccatatttttttttgagagggggtctcactatgttgcccaggctggtctcaagcttctggcttaaagtgatcatccagccttggcctccccaaatgctggcattacaggtgtgcaccaccacgcccagacccctctcccttttctgtagcacaccccaccctcaccccatgcacttttgcatgattatcaatatgggttgaaccacatgaaattgccaattttgtagatcaaacatgatagaatattagcaaatagaatcatgagattgaacatatccttttaataacactaacgtattcagtattttatcaagcatataatttaaagttgtattactagttataaatttaatatttacctctttcaagcccaagcacaaaatatttggtttgtttaaactacatcatgtaggatgaaattaatacctcaagtgggattctcaacacactaactagaaacagctctcagagaagataattcaaagacgaatttaaaatcaatcccacagcaagtaaaaccaacttttttaccaagtagttcagtcacatgggagcagcggaatcagtgtgacattttcttttcacgggatatgtgcaaccatgctgtttaaaagggaagaaataagataagctgattttatttccaccagtgaaaaaagttttcaatacagcagctttcatcgactcagcatggctaacaaaataacattatcaatgaaaataaaataatagatcagctgcacaatctaggcatttttgtttttagaggccttctctaacatttctctgtagagatctgtgaatgcctggttcctgtgaatgaaaaccaccctgctgttttttctgctcctgctgagagacttgcaaagaataaaatctttttttttttccagctggagatcaattggtttgaggactgctctggcccccaggaagtattctttgcccccatggggggaagagatcctcagttccccaccctgaccagagtttgcccccattggatagttttcaaagctgaatccagaaacagacctaaaagcatatccaaaaaatgtgccactgaaaaacagctaacgattcacatggaaagtccacaccctccatctagccgggtctcctcctgcctcccttggggaagaagggggagaatgccctttccaatttcgctcgactgaaagcaagggctgtgtctgtcccccttgctgaaaagcctccttttgtttttcttttctactgtcaggaagcctgcctcagaggagtggacaatgcataccaatgaggaaaggagagcagaggtgattgaaagtgaagataatttttccctgtcatttacaggctgcttctcaaaccatgccccttttgtgattccacttcaaaacacattcttgccaactctcatccaggaggcttttccttagtgatctgctccactatcttggagtttggcttctgttatcacctgaggagctgaaaagcgttcagattcaaggaagcctctcctctgcccaaatcagcagaatttaaggctcatgaggatgaggactgtgacagggaagaaggaggtgacagggaaaggaaatgatactttagcttatttcattgttgaatggagcaaagttgaaaatgattcttctggtgtctctccttaaatcttggggtattgatacagactcatacaaaaatgaaaaggagagaaatgaacatattcatatagtcctttggggtttcacagtgatctacctacagcgacatgttattttaaattacaataatctatttaaagagaaatatggtggaatttacttttaaaaaggttacgttgcagggatgttttaaaagataaaaattaaatggcaactcaaaaaatatctgtcaggcatttaaaaatggatttcaagacaagcatttgaatcctactttacaagaagtgactaggttaattaggaaaataaggtatcttctgataacagtaaaccttgagatacatgtgtagctcttataccggaatgaccatgaatcactaacaaatttactttctagacaaaagatggaccacttagacagcacagtataagaaacaaggaatgttaaatgaagcttaacatcatgtaacagatgttaggttttctcctctcccccaaggaggactgtaatactgttggagatgacacttgtcaactgtgcaatgtgtgtgataaattacagaagcaaaaacataatattattatttaataatccattttaaatatcactgtcatttaaataccacctgtaagaaaagttgtataaatttggcaatgaaaaatacacaatccagaaaaaattacaattaaggatcaggtttttctttgaatatagttataatttttaaaaatcccttatcacttttattaactataattattaggagactggagacaaatataaccattgaagcaaactgagtacctttcaagggccaccgtctttttcctctaacctcctcaggctcacatccccacctcaccccaccacatttaaattactttaaaaacactaaaaaatgtttcctatattagaaatttgaatctatcaaccctgatacttctttagatcctggaactccctttgctttaaacacaatgtccaactattgagaaagaaatttcccataaagaaaaccatagtatttctttggtcacagctgagaggcatttttttttttctgatctggaaaacaacaatcacagaaagcaggttgtttgcaaaatgagatcttaatttacttaaaaacagaatagtaagatgaacctactaaaagtaacaccatagcactgctacaaatgatttacagttgttcacattactgccataatattggaacgataaatgacatgccaaggggctcaaagtaaatttctggagttgaactgcacaaagcaaattgctgagtttgtgtcatatcctaccgtgaggatggcatatctagagcaaggctcaatctagaaggtgtctggactgaggattctagggtacgatgaataacaaatggaacaaagatgtcacccacaggaagtggggactacgggactcactgtggacacctaagccaccgcctccctatgcgatgaaaatctgttcttcatagcaatccagtatacattcaaacaagcagaagaacaacacggggtaagggctacttaactaacttatattatcctattttccatggaattccagcaatcataagaaaaagttccatcttcttggttttgaatgttttaaattaaaagaatttcccttcccaacactacaaatatgtacaatgacacattaaatacaactgtgctttctaaaacctgatacttgacagagagctcttcttcaaagctcaactgcaagttaaattttactgcttatcttttgtttatcaccaacaagaaaaaaattgagcttgagaactgtaagcttataactgggtaaattatgttttgtataagaaatacaagtatccatatttggattacttttgtatagatgggatatacaaaggtgccgacattacaggactgaaaaaaagagccaacttgttttgcattaaaacatttttttaaactttcaaaacaataagagactagtggtctcttaaacacagtttaatgaatttatctctggcaatgtattgtgatatgtttgtgtgataaacctgataccatgaaaacatgaaaataatttctggaatgtttcatttcttaagcaaaaatttcttaaatatgaaaattgggggcttcttctgtgcagtaataggtaagaccagtctggtctgaagcccatatcaaatatttcaacatttcatgcctatataattggctttaaaagactaaaaactctctgtacagtctgttttttttattgttgtttttctcagtccttaatatcctggagtcagaacaaatgaagaagccccatcagcttcagaccacgacacacagcttgcaagagtaaatgatttatggagctacaagcatgagttatgagggagcggtctacatatttgcgttgtgtagctatgcagggggaaagagacaaatgagattcttgaaacatttgtgaaatatagaaaggaagaaaatagaaaaaagttaataagctgcctcagatagtaactaattagatagcaaggtattactgacaaaatgaaacaagaacaaaaggcaacaaaagttggtttagggccaaacattatctgtattttcacttttggatctctactcatttcctttttttc

SEQ ID NO: 851 - DNA, 468435 bp, Homo sapiens
cttactatgatactggagaccaccatgatcactgacatttccttaatgatgcacaaaatgaagcgcacaagtatccaacaaatgaccagagaaaacgctagcatacttctctgaatgtacacttcagagaaggagggaaatgcttaaatgtaatattttagataaatcactgaatacaattagtatagtaagtacactatggatttgatggtatgtagtaatacgtctctatggcaagctcatctcctggaaaactggaactacatttgtccacaagcctttctcactgagcaggaacacagcttgcaggttggccgactcatctccccagattttattttctattttatctatatttttcctggctctaatttgtttctgttttgttacattttatagattcctacaaacctctttaactattttgtaatgcaagatatttgagcataaatccctaaaagacatattattttatgatgtaaaggtttcattttttccattttatagatgattaaatagaggcccggcatggttaagcggcaagcccagagtcagccatccaacgcagcgcagagctgtgatacaacccacttccactcccacggcatctcggcttcgtgggagttgaggagcgtctcaactgcatgtcaggagaacccatgaaaaggaaagaacccagaacaaatgggtgagaaagttcaagactatgttcagcgtaagagcaaaagcctcctgagaattctgcttgcagcccattcccaggcattacagtgcaaagctaattagggagaatggcatgagtagaagaccaccaagaccaccagctgaaacgggtgttctcatggcctccagtgggctcgactatttttatatttttaatattttggtccaatcactactctatacaacttagctgtcttaaaacaataaagccaaaacaaaaataaaacaataacccaggcctcccagatgttggcttcagtctgtgttcacaagttatcttcctaatataacagcatgagtactacttccccatactgttctcatgagatctatggccaggtccaaggtcacatcatagtaaatctttatgaaggttaagaaatttataacatttgcatttgttcacgaatgtcaataatcccaaccggcaggttttacgctcaggtttgaatgacactttgctaaccaagccattaaggtttgtttcaaggagtcgggggaagctccccagcagctctgagcaaatgaggagccagagaaaaacaattaaaaattttttaaaataagatctttgaaagtatattattaattctatcatccaataagtgttttcgaagactatgcaaatgacatcttgcggtataaaagctgttacagaacagaccttccaacatttctcagtctccttctttccttcccacgcatgccctatgtgtggactggcagcaatgtttttacttttaagaggaatttcatcatttgggaaaaatttagagatattaacgaaaaattgctatgtgtctcatggctacctactgattagaagcaattaacttatttctattttgaaaaattaggctagcaaatgaagcctgtgggagaagcatatttaataaatatagaaatattaattgtaggaagtaacaataacaccatgcaaagttgtcctgtacattgaaaaatcatactgattgtttacctccttattcacagcaagggaatcaagaccatagaagtcaacctgtagctgtataattgcgtccaaatcccagtgaagagtaaatgctaaagcattagggtgaacccattaaaactgagaaaagagagggaaataaatcaatacttaagagtagagttacctaccaaagtaccattcagttcaacacatttggaggcctctttttcatatatgatgagttttcactcatatacactgataaaaaggtgaagcataaaacatctagaatgatgttttgaagaaggtgaaagaatcactgtggtgaagactatagaactgccctgcctccatctctcctaggcactttagccattttactctaaagcagatttggagttgactttttaaatttcctttcaatgttagaaatttaaattagaaaatgtatgttaaagttgattaaaacttaacaagttattctgacccattttcctcttctactgcaattctgtctaatgtcttttatgatgcctttacaattactgttatcatcatcattattattttagtctatcatgtaggaaaatataactggattttgatttccttaagaggttttctacattatttagatttgtgaaagaatgttattgtaagtaaatagcaccaaatcttaaggatacaatatataactgctaacgcaaacagtatttgagaaatgcatctagatattcattactttattaaaaaagacatagaattggcataataaattgctagataaagcaattgagtaaagtgtaatgagttcaagtagagataagatcattttatggagataaatgaattagagaggttgtgattgagaagtgagaagtggttaaagtgttttaagacaaattataatatctaggtcttatccctacttatattgataggcatgatttggtgggaaaaaaagaaacattgtcactttaagtatttccctatcctaaatgaaagctactttattcaagagtataagctaccctaagtttctttattttaaactttgaatgcttcatcacacaaatgtttatattttaatagaaatgtattatgtctgatgatatccaacatatatatacaggctattgaattctatatgtagtaataatcatgaaactcagtgttttctcaattatatcagcaaattctctaacacagatatgccaggttttcttcaactttgatgaagtcactttagttctagtaaagtagaattccttctagaaggaatttaaaagaagctgaatttcctggcttccccccacccccaacaagcacctatataatttatcagtccatatttcaaactactttatttattcaattacaacacattccatggataattctaaaataaactcccacatttaaaattaaggagccacaaaagacacttttaaaataagaaattgcataaagagagaagaaaaaataaaatttttcacaacctacaaattaccaccaagttttacattgagtttgacattcctggtattcagagcaaaatatggacacaaagactcatgcacacactgggtgacctcatttcactgttgtatgtgtgattcctcattctaagtatagaatccaggaggtgcgggtccctttgtccccaccaggaaaatgcagttttccacagtgttaaggttggttacctttttccaatggcagaaaatgcaggccagaaactgagaaagttgctcagttcatacagaaagcagactgcctaacatgaacctcttagtagtcagagcgacatatgctattgaagtaatgtgttcctttattttctaaatggatccttcccaagtaaaatgtacctaagtacataaaccatttagtgggaatacatacacaaagagttgcctcctagatgtaaatgcctcttgaacaacaatcaactattaactcatgcaaaaatattttgataacattttcacaattatctgctaaattaaaggaaactactcacagcaacaaatgccatcaacatctggcagtgaaacaactttgaggtacatctggacaaaaatgactcatgtctaccctcacctgttgcaggctttacacctacagagaggcagctcctctttgccccaacatatttagtttctggactgcattttcgccttctgttgcaaaatggcaatcaaccttattaccgtagaaaactgcatcttcatggtaaggacaaaggggtctgtacattctggaattatattcaacacttacatttacatgaaagagccttgaaaacaatagaataattagacatgtttgtgagataattatgtcatgtaatgatgcctattacccaaagagctgttggttccttaaaaaaaaaaaaacatttatcagccaatcttgcagacttgtaggatctgaagaacagcactgttctcatcagagctaaaagcatatgctatgaatggggtcctccacatggcaatgaccgcaataaattaccagtgtgtgttctgttttcttgagatgggctcaatttatcattttattgaaaaggttccattatgctaatgtcttacaaaatcacattctgctgttgctggaaggtcatgaggggatataaatttttgcatttagaactaagaagttgtatagcagtcacagactccaagggttaataagaagccatcaaattacattcaaggacttatcaatgacagctcttcagcatgctctcctagttaacaaaagagaaaaaggggaatattgttccaagcttaacatcacacacacaaaaatgcttcaagtataaacgtattaaaacttggttttaacacaggttgatcatttgaaaaaaaagtcattgaaattttatctgtcagtgtgaagtatcagtataacaggtacatttaatacgagtttaatagaggtttctagtacatagtactcagtttgtttaaattagctactatcttcaaagactttcaaagataagtttgctgaagatctacaaagaatgcaaaaattaatatgcatattttagtgtaacctcattgtgtctataaggaggataatggagatttttgactagcatcaaatcccacatctcagtgagttcttagggaaaagaaagatgatgagctaattattcaatgcaaattagatattattccttagagaaatgttttgtttccatcttttcaagaattactgtttccttccaatcatgaaggactgtggatgtaattcacgaatatatggtgccatcaatctatcaataatttgcagttatgggcaacaactgtcaaacagctgagtaaaaacacataaaaccagatagctccctttggaccaattattgtaaaccatagaaacactgaggaaaaacagttgctctttagaaacacttggtatatacttggcatccaattttgtaatgcaacctaacaagcagaatgtaaacaacagtaactgcattgctagatttgtcattctgttttgtctggttcagcagctaagtggttacgaatattaacattctacaacatcagtgtaccttaaattcaagaggccattttgaatggatcactgattgcattttgatggaattcccagggaggtgatgagtaagaagccaggttgtggtctagggctgggcacattcaatcttattctgtattaaagtacagagatggagatacacaatatgctctttcctcacctggaactaatttgacagggaaaaaaaaagctttagaaatgggtctaagatagtttggaaacccaagttcacaaaattgtgtttaaaaatatataaaaggattatagaacttcttgacaaattcaaattattatataaagtttctcattgagtagctccaaacactgtcaaaattattttttctgtcagttatgtatgtcctgtcaacaggtatatgcattcacgccaaatgaacaggccatggaaagtagacatctctttatttgggaaaccattactcaaagattttaccaaaaaaataaaaaaagatttttggaagagcttggggtgaagtggttgtttttgcatcagggtatatggaattaatgttgattcttccaaatcatgatgactctaatgaatctaatcaagtacacataaacactttgatctaattcaaagaatatggaattttgaatcaaaagacagtggttccaatcttagcctcaatatcttttagctatgacagtttggccaacaatttcatctttactctcagttctccataaaagaaggaatgataattatggccctaagagataatgtaagtgtaaatgtttcacaaactgttagaagaaagggaaatacttattattctcttgagcgtaaaatattgtatctctctggtgatgtaatggttgcagggagcaaagtatatttaccaaaacattttacatattaaataggactattttagtttcattctcttaataatcaaaaaaaatttgaaacttagaattaaaccaaagagattactggtactctttcaatgcgatgtaggtttattatatgggctattttacaactcggtaggagcagtggttcacttttttccagtggaaatacaaagaatttctgtccagtggagcagacaacctcaaatattatggtttattgccctgtaaacacttgacaagatttgtatctagtctagcaatcttatgctaacatctctttattaaattgcatatttacctatctataatcaagacactaatttttccaaagccttttgaaccaatttatacagcttgctgcttctcacattaagtaataggttgaagaaaatttttgacacttgtacattttatatctaatataatatctaatataatataatataaaatagcaaaacagctattttaccttactggaaattataatttaatggttttagaggtcacgctcaaatggaccaaataaccttcatttccaggaagtttgcctcatggactaatatactaaggaatagttcctgaagtcagacagatcttgaaatctgcaaccggggttctccactttttcccctttttcttttctgaatttgtgtgtttggttttgcttggagcacagactcacaataatctatttccctttggtggtcacagtgattgggaattgccttgatagtctgactggcaatctctggacctggatgacacagctttattctttgttgaataagagacaacagagactatgtgtaagtcacttgtgtttacttatctcttggtgacctcagatcaattaaaaatcatatgcccactggggaggaaaacagctctttgaggtctggactaatacatttttgtgattctctatcttcttttgacgcatgactgaagttgtaggactgaagctataaattctctacatggctttgcgtctacatatctgtaattcacaaaagctgttgcctccgttgtgtgaaatgtttccctgcttgttgcaggctgaattacgtcaaaattcctatgttgaagctctaacccccagcacctcctaatccaactgtatttgattaattataatgaggtctttcgggtgagccctcatgcaatctgactactgtccttataggaagaggaaatttacacaccagacaagagggtatgtagaggaaaccccgtgagaggaaacggagaagacggccatctgtacaccaaagagacatgcctagaaagaaagcaaacctacaacaccttgatcttggacatttggcctccagaaccacaaaaaatagattttggttgttgaagaaaaataaataatgacatatacaaatggaataccggcaaaattcacagaaaataaagcaaactctgagtacttcaagtgttctagatttttagggaaaaatctcctcttatagaaactgcttgctcagaaatccaatcacatacatatggtgaatctttggacaatggaacagttttaataatttgggtttaagaaaggaaaaacttttctctcatttttcagtgttaaatatgtgataaggtttctattttacattttaacaggttggggtttggtttcccaggaaaagcgtacttaatccgaacttctcgtacttctcaaactatttttcaatcacaaaatcttgcattacagtgacataattttaaagttttttgaaaaatatacatttttagctgactaaatagaataataattctggcaagtttttctgtagtaggttcttatatctttatatataacttgcaaacatggattgatcttcagacagctaggtaatttgtattaaggctgaaaacaaaagcaatgataaacagacataatatttagtttacatatttttggccctttagttatacatactatagaatggctatatttttgagtcacattaattgttttagttttgctactttaggagcctgtagctctaaaaattgtactatatatatttatagctttgttagtctgctaaaatgtttgtgtttgacacacagctctcctattatgactttccagtttctttgtgaaatcaaagatcttattttgaatacaagttataatcggatttggtggctgagacttaaatagaagaaacagtaacagaaaaatacaacgatttatccaaagtaatgggatgagctttctttttcaagaatgaaaagaatagggtattttttccctaaagcaaagtgttgttttgtaccagtatatgaaatgacaccgtgaaagataaaacttgagagaacacagcaagttgtggaaaatttgagggaagtgaattttaactgcttttgtttataacacctatgtctgaaaagaagctataaaatatattaaaattcacctaattttgattggcttatttgtgagataaattaagggggaaaatgatctcataaaacctatatttccaatgcattaatgcaaaattaaaagtagtctttttcttagttgaattaataaattcatcttagaattcttaccaaggcatagtaaaaatactatttttcccttttgtgtgatatgaccagaaagcagagattttataacccaccagaataatctctgctttgtgttgattctagcatagtgttagaaaataaaaatctacaattatgaaaggcaaagtttcctcacttgtgaatgaaccaagattccctgcaatcatattacatttaccaacaattatttttgaacacttgttaatttgattaaatcgataattaaaggcacctaggattttattatagccaaacgaccaagtctactctgacaactactttaatttccccccagccccatgatcagatctaaaatttaaaaatatagaccataaaaattcaacaatatactttatacttaaaactggctttaaaatctcccacaggctccctggagagaggagctggaaagccttaggtttgtttcaagggttttgtatttcttaatcacctccccactacagaagagctatggaatgagctgtcaaatcagaaggacgctcagccttccctgggttcagtttgtgtacatgaaatgttatgcacagaaatctgttactaatcgaacattttatgggaagaccaaggagagtcatcagagcccatgctgtccattatatatatgttcttactctccggagaaacattgatcaaactcttataaaatagtcatacactgtgtcacaaagggttattttacactcgtcattctgatattgctggtcactgtagtaattaatccagccttttattagtatcaaactggtttctgtctccatctgatgcttgcctgagaactgtgctataaaccacaggcctggggttgtatcttcagcgtatactcctgtttccagacttctcagaaaggagtgtgccagatactctgaactactgatacttcaaagaatagactcttgggtactggcgttagagctgacatcagctcaacaactttcagactgtaccagggaatgaatcagaatttccaggacttattttagtctggaaatagatgttcttcatgaaactagcacctaacccaagatccaaaaaataacaattaattacacaagaacaaatgaactgatgagttaaattatggctacttattttgaatgtttttagtattgcatttaatgttaatttttatggatatatgaagttctctttcttcttcatcagtatcactttggatataatagactattgcttttgtatataattttttttttttttaagacagagtcttgctctgtcaccaggctggagtgcagtggcatgatctcggctcactgccacctccaccttccaggttcagtggattctcctgcctcagcctcccgagtacctgggactacaggtgcaccaccaccacacccagctaatttttgtatttttagtagagacgaggtttcaccatgttggccaggatggtctcgatctcttgacctcgtgatcagcccgccttggcctcccaaagggctgggattacaggcgtgagccaccagctgcttttgcatataaaatttaaaaaactgtaagtagtatctgatttttagcatccttcgaaaggcagaaagaaatacttttactgattctccttactttttcatgagaacatagttattaacataggttcaattaggatttgttctcatcttaccaggatacaattgaacaaattgattatgcaacaaaggatacacatggagaattatatatgagaataaatctcacttcatcaaacacagcggcacgctagtccggaaaactgacgagacacgtagctagtgcctacgaagcccagtggacaaatcaggtttactacctggctattagagtcctgttcctgagaacttcaagaagaaaggaattcatcccaatttatatatacagtgcaggcaaaatatggtggagagaatgtcttggaattgtttcccgagctttgagaaagaaaagcaaataataaaggcttttaaaagtcaaatctaagattccttaaaaaaaaatctcaggcagaattaattatctgggtcaaattatatggctatagatttgtaaagcaaactcaagcaggcctatctggttaattaacagtctcattggaactatgtaaaaaataaggccatgtttcatctggatgaaaatagcatttttctgtgattaaaacaaaacaaaacaaaacaaaacgaaacctttgtgggctaggtgcagtgtttaacgcctgtaatccagcactttgggaggccgaggcagagggatcaccttgaagtcaggagtttcagaccatcctggccaacaggtcgaaatcctgtctctactaaaaatacaaaagttagccgggcatggttgcaggcgcctgtactcccagctactccggaggctgaggcaggagaatcgcttgagcccaggacgcagaggttgcagtgagccgagatcacaccacaggactccagcctgggttacaacagagcaagactccgtctcaaaaacaaacaaatgaaaaccgttttgattatttataagggggggggcagggaatggagtgtaaaaaaatagccacaacttagaaatgggccaaatagacaactagatgtccttttggtgcagcgttgagcttgttttcctattggcagggagctgtaccactttgtagaggctgagataccttgtacatttttgtttggtaaagatttccatccagtgtaacagataaccccaaagtcaatggtttaatatcctcccatttatttatctctctcacacacacacacatgctagaaagaacttttcctttgatcctttgatgagtacacagaagtacagagagttgtataatgagtaaccatcccccagattcaattataaataatgtgtaactagctggttgtcccacttccactgatcctaagattgatcacatggcatcagccagattcccttcacttatatcaacccattcactttcatctaattgtttcatctatttatatctgttggcagaataaagtaggacttgcaaaatggtgaatatctaatttcgcaatgcatctccaattattgtctgaaacttctctgtaaagaaaaattttcctcaactactagggctatttggttaccttgaaatagaattcttacaggaaaagctagataaacccttattttatttttttaattatcaatttcctgagtttgattttagggctctagttatttccaggagtttctaatgtatttgggttttttagcaaaattatgacttgttaagtcttcaataacttttttgtcttagattacacttgttttcatcttggattatcccatcttgggacactgaatcttcattagcccctgtgtccttcaagtatgtcccttctgatttcataatctccactagctttcaaataagatagccacacaagatacacaaggttcatcttgcatatgatttgtcccaggcctaaaatcttctattcttcaatgattccttgtcttttttagttaaaaacagtattaagagaccacaatctgagtggccacaaacgtactcctagttaataggtttagatgaatgatccagacactctacctgaaaagaggggagagtgggaggatcaggagacaggaaaacactagtacatgaagtgttaaaactggctgctcatcagaatcacctgtgaaaccttcaacatagagattctcaggcctcaaccattatggaatatgatgatcaaaggggagcccaggttatgtaaaaggccctaaggaaatgaagtcactccggggcccactaggcgggagtgctgagttacagtctccaagcagccacatttccagaccttgggatccagtatattagatatgcttagcagttgaagaatttctttcttatcttaaatagtaatacatattcattctagaaagttcatataaaccaaatattcgaaataaaaataagtcacaatcccatcacaagaagaaactgctattaaatcttgcatctgcattttaatattcttctttatgtatgcacatgcataaacggggatatatatggttagttattttttatagagtaagatcacaaactactcagtaatttggaattgaattttgtcatgtggtgtctttccatgccattaaataatattctcaacatcatcttcaatggatccatagtgtttcattttatagaactgccaaacattcagaacctatggttgtacctcttgatagttttccattttttactaatataaacagtgttgaacatccttctagataatctactgtgtatatctgtaatataattttatcataaactctgagagtataaatgactaagtcaaaaggtcgaaattgcattttctcttgtgagaattctaaaataattccctatcagtttaaagtaagaaaagtctagggcacatgaaaagaactagaaatgaagaagcaagtgtgcataaagagggaaggaaacatgctgactcttatcttttagagctgtcacacattgaattttaatgtttggggaaataaccaatgtagctgttaggaagctgtgattcaaacatggtagcactaaacgatacatcactgtattgggggcaggtgcaacataaacctcccatggatatttgtcaggtgaagaattcaggaataaggtttgcctatctgtatatagaattttgaagtcagggtaccttctagtgttgactgcaatggttaagtcatctgtctgtctctgacaaaagagctagaccctgcttcaggaatgcaaacttctcccactgctatggtctgactgtttctgtccccaaataattcagatgttgaaacctaatcaccaatgtgatggcattcagacataagaaatttggaggtgattaggtcatgagtatggagccaccgtgaatgggatacgtgctcttacagaagatgccctggagagctgctgtgctccctccaccatgagagggcacggctggaaggcaccatctatgaaccagcaagcagccttcggctgacatcagctttaaaggtgccttgttctttcacttcccagcatctagaactggaagaaataaatatctgttgcttataagccactgactcattttgtattttgtcatagcagcccaaaggggctaagacacccacaattgggaatcttggatgagaatgaactatatttcccattttcaaaaagcttatcaatgagtgaataaacaaatgttgttttcattcatttaacacatattattaagttagtaagcatcaacaatgtgcccagcactgtgttaggtactgcaacagcccagagtgagaggaaatgcccctgcttcctggagcctgccttccagcgggcagcctaccacctgcgtgtgctattctggtggccaggacgctgttgtctacagtaacctggtaaattaactatgttaagagagtactttttctttcttcacagaaacaagaaaaattatttgccgtggagtccaagagaggagcatatctatcgaaatggtaattgaaagagaaactggaaacatcacctgtatgaaaaatagtggatggctctgttaacgaaacaggcatgctggtgacaacaggcaacaaatctaatctaatctaatctaatctaatctaatctaatctgtttctccataataagcagcaatcatacaacccactaaatgactgctgttgcttgtcactgaagatgtccatattttactgggacataacatttcttcttggcatgaagagaatggattaagcaaatgaataaaagctatggttctactttaccagcacaaatggacaaatccaaaataaataactgttacagcaactatgctaaccgtattaattaaaatatgcaaggtatactcattctcattttcataaaaggaaatcctaaacgctcaatttgaagtatgtttcctcactatttgtaggaacttctagtcctagaattcttggtccacctttccccaagattgtattcatttgttaaatatgagacaccaccaaaattgtaatgatgccacaatgggagagttaatgaagtaaaaaaatattaaatgagtcaactattattaaaaaagaggcaacttcatatccatcaattagaaatcaaagagtctggctggctatttatcatcaaaaatcttttattggtataaaaaagtccacacaataagcagctttttaaaataaccactcaggccagagtatcactcaccaagctgtgactttatgttctttgtaacaataaagaaattacatggcaaacaacaatctgtgaaaactttcaaatcatactttcctaagctatcgctctagattaaaatgtttgccttagttttcagggggttagagaagagtgtcttatctccaaacagaacaacttcatgaagatgcatacacactttcttcttgcagctaaggaaggaccgtctttgactaggtaaagatccatgtatttgaatcatgaaaatatccaaaaagacgggctgggcatggcggctcacatctgtaatcccaaatactgggaggctgaggtgggcagatcatgaggtcaggagtttgccaccagtctggctaacatggtaaaaccctgtctctattaaaaatacaaaaattagctgggcatggtggtgggtgcctgtaatcccagcttctctggaggctgagggaggagaattgctttaatctgagaagtgggggttgcattgagctgagatggcacctttgactccagcctgggtgatagggtgggactccatctcaaaaaaaaaaaaaaaggaaatatccaaaaagacacattagcaggactcagttcccagtgtgttgtttgaggcactgaccctgatctgaaaacagtgctcagttgattcaatctgaatctgtgtccaccgtcttcctgctcacttagaataagagctgtgtttgcattgcacaatgaacacccacttgctgaaagctaacttgttcctaactgcccccatccttcatccactgccagagccagctttgttaagccccctgtgacctatatctgtgacctatccctagctaatcttctctttcaaaatatgaagtggggtacacactcatcgccaaagggtcctttgagcaagtcccagtagaaaatttatccactttttggatgaagtactcaaaaaagagtactacatttcccaacataaaatggaaaacaaatacatatgccatacatcattcagggctggaaaacaacgaaaatgtaacactccagaaaaacagccatgggaagtattattcctcatgccatccatcattatcatagagcacccactattctaatttagctccaaatgtgtggtggaggtgatcaaactttaaaattaagtaaacaaagagattcatacaaaaataaaataaaataaaataaaataaaataaaataaaataaaataaaataaaaaccctgaccccaaaactagagtaacctgacgtctcccaagtatgggttggggacctagcacctgttctgggggcaattcaggcaggtagccctggatctgtaaacctaggtagtattttagagcctgagcacaatattgggcctttgtacatgtgaactagaaagcaaagggataactgaaatggataacagatagtcagcacttggtatattccaggcctttctctaggcccttgtcacgaagtatctgacatcaacttcatgagttaggtactttttccttatctctgtatgagaaatggggaaactgtggcctggtatgtttaaaaacaaaacaaaacagtgcactattcacttgaggatcttattaaaatgaaggttactgattcagtaggtctgatagggggccaatgattctgcatttctgataaactcccaattgctgctgctggcccacagatcacactttggactgcaagaaagtaaattctccgagtcctagaggtagcaagaagtagagccaagacgggctaagttgcttggctccggggcccacacttactgccagtcggcttagcatttgcatggcagacacatcacagcccaggtaccatgaatgcgctcaaggattcaaaatcaatgtctgtcaccctttttgactgcattttctagcaacaaaaattctgtattcagtgcgtagtatataccaggaactgtggtaaacactggttcaaacgattttcatttaatccactgaagtaaattatcggccatttgattcccttcttacaggaagcaaatcacaaccccactgatgcactgggactctagtgagtttaattatcatgcacagaaaagattgagcattaatttgcaaagaattagaatctaataacacacctctaacaccaaaggtagtcaacctttggggattgaggaagaattgtaagatcttacagagcatcagaggtatcatttggaaaattaattatagtcaaatagatgaagaaggtgtaggagtttgggcctgattctgtgaaattatcaaaaagtactctaaaaaagaatgtagtgatattttccttgtcataagggtttcattttctattatataatagatattttattaattctgtttttcttacataagtagaccataaattcttgatttatgtatgaaatgtttggaagctacaggtcatacaaaataacaccttctataaaatttcacaaaatttccattagtccttatttactcagaacaaatttagaaagattgaaaagagtgtattacagacagttaaattctaccacttaatttgaaattttttctttatcttccctttaagaaagtggaatccagcagcctgcctgcatttttggcagactctgcaataattacgatgctcagatgattcccaagatggacctccccagctgtaaataccctgcctccacgctcattcctgtcaagtgcagatctccccatcttggcatatgggcagtgtcctctgaaacacttcagggtttgaagagtaaaagatgtaaatgatttgcttcactggccatgtaggcctccaggagagggacacccagacactaccatttgtagaggcctgtcgttagaagagcacactgtccagccaggcctcatggagtcttgaatgcaatgtctcccttccccttgaaatcacaatatgaccttgcagaggtgacttcagaaaaatcaaaacattttgaggctccctacaagtactttacttaacttcaacaaccaatgctgtcatttctcacctactctcccccacagttactttttatttctttatgtttcaaaacagataaccaaccacaaaaagcaaaacaattcccacagaggcatgaacccaaacaggcacgaacaaaagcacaaggtagacggggccagcctcagcctgtgctgccccggcatggtattcctctccgcagctttttgtcaattgcatgctgacactccttcccgctctatttcatgacatgtctcctctccttttggaagcatataagcaaaaacatggggctgggtgtggtggctcacacctgtaatcccagcacttcaagaggccggggtcagtggattacctgaggtcagtagttccagaccagactggccagcgtggccacagtttttcttttttttttctcaaaagcaaaaaattctgaaaaagtagtataccttgtgatatagttttaaaatctgactacttggctgaaatcaattaacatgactcttcaaaaaggtccattttaagactatatctactttctaaccaaaacatctagaggaaatgcaaaatttcctttcacctgatagctatattcaggaaaacacaggctactggatattttacataagctctgaagtgagacggtccctgggtacggcttgaattgtctgggtcggttcctcaagtggtctctgcagtttcctcatctataaagaggatatgaacatggtctaccttacaaggctgcaaggaattaaaagaggtatttcagggaaacagggtttctatagtgccaggtttgcggcaagcactcaccgacaccgcctgcaggtatggcccgttcgcgatgttctgggcagtgcagcagttctaggatttgaaaaccttccgggttgtgttgcctccaccctttcctcctgcagttccttcacaagcagccagcatgaggcttcctgaagtcagatcatgtcactccattgttcaaaagtcaaattttctcaacagggtcaaatcctgggcccagcagaccctacctgacctctccaccctgccctttttctgacatcctcttctccgagctccacctgctccaagctccaccccatactggctgctgcgttttctgggcgggggcctgcctggggctcacgagttgctgtcgcctctgccatttggcacacaaatggatgctccctgagggtgccctcctcacagtttagctcatcacacaggcctcgcggctgctgtatattacggaactccccaccaatactctttgtccccttgactctgctgtttctcgatagaacacacacttactagctgctccaaatagaatagctccgttgaggtaggcatcttgtctgtttctattttctgctacatcccagtacctggcactgtgcttggcacagagtaaggactcaatcgttatttgtttatgtagttcgttaactgtatgacggatattggaggagcctcctatttttttgctaggtccaatagcttcatctcatctgtcaggagatgatgaatggcgcctcatttaggaaacaccaataacacatgaaggtaatttacacacaggcaccctggagcccaggtgcagctcaacgttcttattgaaaatgtagtaaaaatagattttattcactgaccatattttaaggaatactattttttactatttcgggcagtactactcaaagcacagcccctgggcccgcggtgttagcatcacctgggagcttgctggaaacgcaacttctcagcttccatccaaggccaactggtctgggcccagtcatctgtgcttttataggtcctcaggtgattctgatgagcactaaagcttgagtggcactgctgtaaaaactacttcaatgactcgttccagttctttgacgtcctcttacaagtctttagtgtgacatgcttgcgttcttagtaccaacagtgtaactggttcttcatgtacatcatgttatcacctctcatgttgaccacttatcttttgccaactaaaaatacttgaaaggcaccttctcgggtttcagaagtttccatttgtttcgacaacatatgaggctacagcccagctattcacccattagagccctcccacgtccagccagcacttatattcttcgaagttaaaattgaagactctggaagcacagaaaattgggatttcttttaatctctttttctgaggcacaggttttcaaacattgtataaccaaggatttttttcatcttttcaaatgatagatgttttatgtgtttaatatgtgaagtacgtaaagaggaatggtctcaggctgctgtgattggcttggtgtgttcacctctcaccgacctgcctctgttctcccacccagcgtccgattgttccgtgagaacaacaggtaggatccataattgtaaggctggaaaaccttagccatagggcagagtttctcagagtatggtcagtaccaacattttggggcctctacccccagacaaatacatcaaaatttctggtcacagaaaaagaatgaaagaagattttttttctcgccattctggccatcaaagaaacatggaaaaacatgcaagataattctgcacatgagagtctgtgaatctctgctctagtaactttacgctatcatttttagtgaagaaaaataatcatataggcatactgtttgcatatagtcatttcaaatcattccattcagtcttaactcaaaccaagaatgaaccaagacatttgaagagatgaaatctcaatttctctgtataattttaaataaagcattcgctctaaaagctaaatgcacaggagttctgttgaatgactgactatgtttacaatttgaagcaatttagtaaacatgtatcaccactcttctaagagattttggggaaaactacagttaattggacaaaaactccatcctcaaagagattaaaaggtgaagtcagaactggagtacaaaatagcaagtaataagggagagtcctaagagttctgaaaaggattccctccagttctaatgagcaggagaggattacttgtagtttagctgttagtttaacacagagttaaatctgaaagttgacctgggatgcaccatctctcttttcccaatctttacagatgcaacatatctttacagaggccttttagtagcagcatgtagggtgccaggaagttgcccccagtgtgtagtggtgcagggagaagtgttaggatggcaaccctgcagcccccaactgcaccatgtagagttgcctgagccagtccctagcctgccaaaagcacaaggctggcaggccacaagacagaggggtaaatgagaaacagggtgatcagaggttagatgtgactcagacatgagtggaaagtcaaggtgaaacagcgcatcatcatagatcatacagtactctgaaggctgctgtcatttaccacattccataaatttactagaatttattctctattgtttgggttgaaataatcacacatttcaatttaaaaatataaagagaatattagacatttagcagaattttctcagtgcctactggtacttcagaccctatatagagagaatactatattttcttaaaatattatggtctagagagagagagagagtcagttgaaagtgtcaataattctaagttcattctcataaaagaaaattctggagaagaccaagggcaattttatgataaaacaaaataagaagactaaaattttcagatgaatatggttgataagagagtagagccagatgcactaggaaatgtattaaagaacatgaatatgtacacaacaggattcttgtgctcaaattgtttttaatattcagataataagtaaaggtttaattttgctctaaacaatgtgatttttttatttttagtaagaattttattttgggaaatcaaattaaagaactagtagataggtctcctaacataataaatccaatctgttatacagttgtacaggaacaaacatagtaaatatagggtttggtaccatttttggtttcaggcgtacactgggggatttgaaacgtattgcctgttgatggggagggacaactgtacatgtgagacacccagaaaaaatgcataaatctcaaagaggtgcctaaaattcaggcttgaataccatcttcaatggcaaaggaagaaagggagaggagaagacaagagtaaggtttgttaggcagattattcagttggtgccttctcaaggatcagagtctccagagactctgtcctcctcatcctagtaaggagagggagacacccttacaaatggagacttccttggtagatataaatttcccttacaaaagggtcacttctactctgtttttagagcttttcctgtgtctactgtttctcaaaataatcagcttaaaataatacttatgctaaagtggcatattttggggtggcatattctggtctcatacacactcaaggtggaattttccattgtttggtttataatgttggagcatgagtattctctagaggtgtcagtgtcagaatgatcttatacatactctggttgaaacgtcagaattgttatgggcttgggttcgatatttatattaatatattattctggtcacaagagtattgcaggggtttagatttatctcatttttccccatttttgacatttatttccatttctcaatttttctttccagacctgaggtgcccagctcacatgaagcagagcctctttccctcccacaatcatctcaagatcaccagagcatcagttaatgccttactttctgggcttatctactcctgtatttaaagatgttgtttctacattttcacttgtccttggaaattatctttttttattttttgcaagatcatcgaaaatttttaagttccttaaattttatttagtaagtttagtaggaggcatttcttattatgttaggcttccatcttgcaggccccagaactttctgacactgtgaaggccataccagcccacaactgccaggatctattgtatgtgggaggaaaatcaacttctaccctgtaaagtcattgtgattattttgtgtcttctgtcaaacacagtaaaaattaattctattacacctttgactatttagattagagaataaaagactaagaggcacatattaatttttttaaaataactaaacaataacaatctttgccaaagaaaagcattttgaaatgggtggtagcatagagagaaggaagagtcctttcacactaaggatgtcattgccattggcatatctggctttagaaactacaaatggctcgattagctttagagttctttctgctttttagaatttttctacatcactagaaacatatctcttatatttaatctcaatatgaaaacctgtttcatagtacttacaataaatgcattctcaaatgttacatcaaagtactccacctacagtgatgtctccttgtagtgaattagagactccaatccaaaacgtatcataaactaaatatgcacccggtgaggccatgctccatgcagactgcactaaacaaacaaacaaaatgctttaataatcttagagcattccaattacctggacttccagctggtggtgagtccttcctgctgtcagtgtgcagaatgacagccagccccacagagtctcctgggaggactgagctgctgaggtccacccgagtcaagctctggggctcccgctcacagcctcccgccgcgtttctggggtcgtcgcctccagttgcattcatttcttgaccttttctccacggtctctgcacaatgtgaacaatgctctgctgatccaggtcacaattctgtttgggagcaaggtaaaaaaaaaaaaaaaaaaaaaggaaatgtcaaacatgaaatgcgagatagagtttaacttgccctccgtggtagaagggaagcaaaagtgacatgtaactgaccaacttaggtgctcctttgcccacagcagttacacactacacacggtagacaaacaacactgaactggggccagaaacagaaatttgggaatacgtgaaacacaatagaatgctgacgtcatattcaaaaggacataaaatctagcaggaaaaaataattaccaaactggatctataagcacagtgaaaacaataattccttttttccccccaagacagagtctcactctgtcatccaggctggagtgcagtggtgtgatttccgctcattgcaacctctgcctgccgggttcaagcaattctcctgcctcagcctcccgagtagctgggattataggcgggcaccaccacacctggctacgaaaaatattcttaaatagtaaaactgattgacatcagaattgatatgtcattcatctctgttttacaaaagtacagaaagtgagttattatcaatgagagggcatttctttaaagcatcggaaatgaatgcgtttgagtaggctccacacacaccgctccacgggcaccaacacacacatcattacactggtggggaagcaagacaggagcacactcttgccacccagggttcattctctttctgacgatttaaccatgaaaaccagctaacatttacgaaaaggttttgcatctacatattgacacgtaggaacagaagactttaacattttgtagcataaaaattaaaagtcagattatttgctagcacaagaactaggctaccctaaatggaattctagtttcagaatatctactacatagggccggccgcggtggctcaggcctctaatcccagcactttgagaggcctaggtgggtggatagcctgaggtcaggagttcgagaagagcctgaccaacatggcaaaaccccatctcaactgaaaatacaaaaattagctgggcgtgttagcgtgcgcctgtaatcccagctactcgggaggctgaggcaggaggatcacttgaacgccacccccacccccccaaccaaaaaataatatctactacatagaagcagttactcatatgcttgctaccctcttaagacacagcaaggaccttactctctcagtaaatcgatgtggccggccgcagtggctcacacctgtaatcccagcactttgggaggccaaggcgggcggatcacttgaggccagtagtttgtgaccagccagggcaaaatggtgaaaccccatctctactaaaaatacaaaaaaaattagccggctttggtggcatgtacctgtaatcccagctacttgggaggctgaaacaagataattgcttgaacctgggaggcgaaggttggagtgagccaagatcatgccactgcactccagcctgggcaacagagagagagactctgtctcaaaaaataaaattaaattaaattaaatacaaataaaccaatgcctttcaaatacctcttgccattgtcattttaggaatgctccaagaacactcaagtgaaatgcatccataactcatagcgatgaatgatgcccttccctgctgctttctcaagctcttctgttgccctcaccatcaatgtccctcgaacagtggtgcccagcactcaccaacacccctgaccccaaatacaatggctagaatctgcctcctccacccaggagggcaccaggacacccttcgtccttaaatcccattccaacctcttctctactcttacaccctggggctccgtctcatccccaggccctgtgcccctccccattctcagagctcccagtctctccctaggactgctcctactcagcagaggccactgtgcatcattctctgacctgaagtgctcccctgcatgacttcccagtttctgtcaaaggaaaaaccatcccccacatcacccgcttcgagccttcccctcccacctaaaaatctcattatcctcccatgttttgtaacgggctgcaagagaatcactatcttgaattcctcctacctaatctttgacatcggcaaggcaccaacagttagcaattctgtctcagaattacccttcacatcttcaactcttttacatctcaatagtcacctccccgttttaggccttcctcatgataatagctttgtaattactccccacatctgatatcgccatactccagtccaatacatacaagaattctgggtgtgtgctacataatctttctaaagtgtctcagtattacttgtaaaatggactgtaacatctcccatgttcttcaagtgtgtttgtacttttttcctttctaaatcatgatctagatttgatttttcatcttccttacccctcctatatgatacatgtggcagattaaactattcttcaaaatcatgcacgcctgtacattagtgcgcatacatcatgctccccacttcctccctgcaatctgtgtccagccacatgaatggctttggccaaagggatgttagcagatgtggttgaaccagggccttatatttgtcccgctgctaaggtccatcaaaagaacatccctgccaggcacagtagctcacccctataatccaagcactttgggagactggggtgggcggatcacttgaggtcaggagttcaaggccagcctggccaacacggtgaaaccccgtctgtactaaaaagataaaaattagccgggcatggtggtgcgtgcctgtaatcccagctactcaagaggctgaggcaggagaatcacttaaacccaggaggcgaaggttgcagtgacctgagatctcaccactgcactgcactgcacagagcaagactccgttgcaaaaaacagaacttcccagaaagcttctacctgttcacacatggcccagacctgagtccaacccactgaggtgaccaagtgcagccacactcacagcatgaagcagggacccgcagctgaagccagcctgaggccgcgggcaccctcgctgacctgtaggcacatgagaagatggcatacttttatggcactgagatttctgcttgtcctctaatcaataatggcagacagtcctctattttccattctatttggacaagctatcactgtccatgatcagctccgtgtcaggcagcactcctccagctgtgcacagcctctagcctaagtcgtttcagagaaatgggcatcaggatccgagtatactcaaggacttgcacaggagcatgtgagctttgccacagaaggaaaagtggagaattagcaccctagcctatcttgaggtttctatccacattttttccctacctttccatgttcaggactcagttacttcctgtgatcctcctagagaaaagtaacacctttctccctcatctgaatctaaaaatctttgcttactgtgctcttcttattgcagtggttagagcttggacagtatatacatatatattgtgtgtgtgtgtgtgtgtgtgtgtgtgtgtgtgtgtctgtgtctgagtcttatcttccaacttattttagaaatacttgagagcagcaacttggccatagtagcattcatcagaacacctcacacagtgctttggagccaggagatgtagaaacatatctatgaattctaaaagtttgaaaaagtgaatgactgaagggaagtaagaaagaatgaaggagtgaatgaatcaatgaatataaacagtcataagctcagtgcccaaagtgccacagagggaaccagcagaacaagaaagaaaggacacagaatttaaagtcaaacggactcaagctctacataatttattagctgtatgaattttggcaaatgattcttcctttcccagctttctgccattgacaataatatatcaactttgaaggctgttttgaagatttaaggaaatgtaaagagctcagatcccgatccgcaatgatacatcgttggtagtattgttaccatttatgagtttcagaaaactaaagaggatgggtccctaatcttgtacatgaataaggtgtcagaattctgtttagctgcacacttctgtttggaaaatatacagagaaggcagaataagcagaagctatcaatgtgacaatctctctggtagcattccaactttctgtgaactaaaaatcgatacaaaaaaataattcctatatcaccatatagccagatgccatgaaacacgtgaagaacctgagtgaattttcagggacaggtaaaatgtgacaaatgttgatgaaatctaaaagatttcaaatccagattttcctaatgctcagggtacagctgcaaaggggaaaagaaagttctcaaacagatttcagtagttacagtgatacttataggacgcatttccctcagttggcatccctgtttctgaaatcattaattgcttaatctttgactcttacagaaaatcttcttggttccagaagcggtgcctttgacagacagtggactcacacaccacactggttcagttcaaagccacattccatggacagtacattggatacagtccagttgtacagccacgcaaaagccccaaatactacttagttctcctagtatacaaaaaaattcctcagatgtgggaagaaagagattttcggtgggaagacatcagagtgctccaatatggtttcaggctaccttagagcagaaacaatgtcttatttatctttgtttctccaataaataaaatattacctgtcaaagagaaaacccttaatacaattctttctttttttataacaatatattaatccaacaagtaaggcagtaacaaattcttcagtgtagacaaaccaagtaggtatttctgtaaccgggtttggtcttacactgtcaagcacagctgatgacccatgggagactgagggatcagtatcttgggctttctgtctataggatccttgacatggaaacataccagtattaacaaaacatccatgggagttttttttgccaaacaatgatcaactctcatctggttggacattatccaataatatacaaaaaactgatgtatttttctttttccaaaaagaagttccttcaacggcacatagttaagatccaaatatttcagattcttccaagcacttaataaagagttacaaatatcatctctaaaatgattaataatgagattctaaaattgttaacaataccacattattaatacattgttttcaggagttatgaaaatagttatgttaataataaaaaacatatagaatatacttagccgtatattgcagaccattacaggttttgagacataataaattatttattattctcacactctgatgagggaataactatcaccatctgctatgtctcaatgtgtcctcaaaatttatttgtttcaacttaaccatcaatgtgattgcatgaagaggtggagcctctagaaggtgattaaatcatgatggggcagagccttcatgaatgggattagtgcccttataaggcagtgcaagtgactttctgtcctttttgcccttttagctcttcccctcttccagcaagtgaagacacaacaagaaggccctcaccagacactgaataccaacaccttgaccttggatttcccagctttcagaattttataaattgcccagtctcaggtattttgttatagcaagacaaagaatacaagacaacatacataaagttagtgtgtaaacagagctagaaatagtgtgtaaatccaagagaactgtgcctggcacagataatgctgttttacagattacttattgtggttgctgttgattccactttatagaagacaaaggggagccacagagaagttcacgatgggttcaacaacacccagctcccgagtgtgaagccagggtaggaacccaggccatcgactcctctgctggtgttcattgactctgctgagaggaagtggagacttggatgaggcagacaaactaggacaagtctacaggggcccatggtgaagaccagggtttggatgctgcaacggaaccaccccaggtacgaaggaatgattcagagaagagccagatagctgaaatgttaaaaacatgagaagacaggatctgggacggggctgtataggaggtagcaaagtaaagattagtccagtgtgattttaaagaggaaacaaaacaaaacaaacaaaaaggatgaaagtaagaacaagtgggttgcagaggaatcagtgagagtatggaaagtgaaaagaagatggtataggtgagctggtaacacacctcgcagactccggatgctggtgctggctcaaggtaaagtctgtacctctggagatcccgtcaccccagggaagactgcacttatcacgtcgtattgtagtttctttgtatgcgttgctctctgttaccagacaataccgtctttaagaaaaaatactgcaactgtgtctgtagtacctactgtagggacctgttcataaaacacactcccctgtgtctactgaatgactctatgatcctttaagcacatacctagaagtgaggaaacattccagatggcgttagtaacttacccaagtcaagtctgatgcataattgggaaatgaaagagccaggcctgcagcctcagttttctggctctgagcccaatgctctatttcaaacatcccaccttggattgtccacctctctgtgctcacgacataagtagacatgttggcagaagtgcccagccagtgtgcttttatcagcatactgatcagtctatactcattggcatacttactgtaccactgtctatggtctgtaaagtaggtagggctgtcttcaatatcttcagtatcattcattcattttcagttccttctaaatctgttaaactctatttcctcatacaaaatgcttaaaatcatttcagtgtatggccaacaaacatatgaaataatgtttaatatcactagtgatcagggaaaggcaagtcgaaaccacaatgcgataccatcttactcctgcaagagtggccataataaaaaaatcgaaaacagtagatgttggtgtggatgcggtgatcagggaacacttctacactgctggtgggaatgtaaaccagtacagccactacagaaaatagtgtggagattccttagagaatctaaaagcagaactaccatttgatccagaaatcccactactgggtatctacccagaggaaaagaagtcattatacagaaaagatacttgcacacgcaagtttatagcagcacaattcacaattgcaaaatcgtggaaccaacccacatgtccaccaatcaatgagtggataaagaaatcgtggtatatgatggaatactgctcagccataaaaaggaatgaattaatggcattcacagcaatctggatgggattggagactattattctaagtgaagtaactcagggatggaaaaccaaacattgtatgttcttactgatagatgagagctaagctatgaggacacaaagacataagcatgatacaatggacttcagggacgtaggggaaagggtgggaggggagtgagggataaaatacaacatatatggtgcagtaggtactgcttgagtgttgggtgcaccaggatctcacaaatcaccactaactaacttacgtaaacaaataccatctgtaccccaataacttatgggaaaaaaatcatttcagtggaaggctgtcaaactttctaatgtgtaataactttacattttaaagactgaacatttctgatttttatttggatttttaatagactacattttctatctagaaaaggaatacaatcagccaagaatgatcagactaatttaaaaatcaatagtgttaacagattctaatgttaaaacatttttacattgagttctttcttaaataactttgaagacacacttttaataacaccttaaattgtccttttttgtgctgaacaatcttggcattctttctattttttgcttcttctgaaaataacttctaacaaacagatttttttttttttaaggcagggtctcactctgttacagcccaggctggagtgcagtggcatgatcaaggctcgctgctgcctcgaactcccagactcaagtgatcctcttatggcagcctcctgagttgctgagactacaggcacacgccactacacctagctaattttctagtttttttttttttttttttttgtagagatgggatctcacttatgctgcccaggctggtctcaaattctcaaattcctgggcataaatgattctcctgccttggactcccaaacactgggattccaggcctgagccactgcacctggctttaagcagatgtggttggaagcccatcacagtttttaataacgtattttctatgccaagaaaagacaaaacggcaatgatttaataagttaggccgaatgcagtggctcacgtctgtaatcccagcactttgggaggtcaaggagggcagatcacttgaggtcaggagtttgagaccagcctggccaatgtagtgaaacccgtgtctactaaaaatacattaaaaaaaattagccagacgtggtggcacaagcctgtaatcctggctacttgagaggctgaggcaggagaatctctcgaacctgggatgtggacgttgcagtgaaccaagatcgcaccagtccactccagcctgggtgacagagcgagactccgtctcaaaaaaaaaaaaaaaggtgttatttaaaggtgttttttaatgtaatggctaagaactattttgtttggtcactgctaacaatgaaatgtgtttcaagacaagatgagccagagatgttcacagtaagtcagaataatcaaaaagggaattgttcccagtgatattttttcacttgaactccagttcccctccatagttttcaatgaacactaaatgccaatttatattaattggatgagaacagaaactatcctttcaaactgatccttcatttaaaaaaagggggacttctaaaagatgaatatttgtgatttagcctttcaatttatttcacatttcttatgactgattttcattatgatcaaaaatattatgctgtgtaaagatactgaaaggccccttctctggttcccaaaggcaggcaatacaattactgtgaaaggtcaattagccccacactaattagccagtgcaggcctgggccttgtcacctccatgtccctcccaccacaggcctgagacctttctgctgctcatgaggatcctacaccagaggggctccatagggggcgggaggggggaccgctcaggaatcactcggtttggctacatgccagcaactgcagtaagtgatttagttttgaagagcagaggacagtgctgtttgagcatgtagggtcgggatttcacttctctgggttccctctttcatgaatacaaaggatatcggatcaccaaagctatgcccattaaacccactttaaaattgtgttttatattgtcaacattgcaagaaatgcctcaagtatcacttcttttttctttaagtattattttattactagttgtgataaatattatgaacactttaaaatatatatattttatttgacagaattaaattaatgtttttaaagccatggaatacgctgtatagaattactggggtcagggtttgagagcttaacaacacacgctcttgatgaagctgacccggaaactcaggcacgtcggggaggtcagcactacccaacagaaccacatgcgagtttatgccacgcttcccaaattccaatggttgcgattaacactcaaaatcatatacctccgcgattgcaaaacaacatctgcgcaaggtgtttactgtgggattatttataatagaaaattatgggctgggtgcggtggctcatgcttgtaatcccagcactttgggaggctgaggtgggcagatcacccgaggtcaggggttcaagaccagcctggcacacgtggcaaaacctggtctctactaaaaatacaaaaattagccgggtgtggttgtgcgtgcctgtaatcccagctacaggctgggaggctgaggcaggatactcgtttgagccgggaggcggaggttgcagtgagcctagatcgggccactgcactccagcctgggtgacagagtaagcctgtgtctgaaaaaaaaaaaaaaaaaaaaggaaaaaaaattttcagaaacaagtgaaatgcttgaccatagaagacaagtacaatctgtgaagaaaaaagaaaacaaagcagaaaatagaatatagtaagggactttctatgtcaaaagcaaagaaaattaagtacatacaaaagtagctgtttttgtaaaaggaaacgtagaaaggaaaatcgaagttagtgaaaatggttacctatgagggagtagggaaatgggttaaagggatcgaatgggagccatgtttccctaacgtgactatctacagtttcaggtgtgaggcacagaaaatgtttcacaaaatcacaacaatacttactaaataaaaaggagaaaaaaagcaaactctaaaactgaaaattaccagaaacatattgagctgacaatgtcagtacataaataaaagtagttcaagtaacttttggacacagtgctctgtatatcctttagtacaaaaaaaggaacccaaaagaaattttgtactttatttactaagttgattactggtatgatataggtgtaggaattcagaaactatttgtatttatgttaagatgaaaaattactaaacttactgatgtttttggaaaccgagtttttcacagtggctgaagaaggtgagaaggagcttcatgatgttggagttgaaataaaggaaacaaaatgtacttatgaatttttaaaaaatccaattcattgaggggaaattactcacctatccagaagttgcagaataatgagacccatgtatatctattcatcaccttattcaacaattatcaacttgagtccaaccttgttttatcagtatgaattatcatggataaatgatattatcaatatcactacccactttcccttcctatattattttgaggcaaatctcagatatcatattatttactcaacaaaaatgatccatatgtatctctacgaaggaggaattttcctataaaacctaactagaataccattagaggaactgaaaaattacaaataagcatttaatggcatcaaatatttatgtgtccataattttaattttttccaaatctgtttgaatcgagatccaaacaagtccatattttgggactggaaggaatgtatattatatcttcttgtaatttaattaattaatttattaatttattaatgtatttatttatttatttattttgtgagaccaggtctccctctgtcactcaggctggagtgcaggcatgatcagggctcattgcagtctcggcttccagggctcaggggattcctaacctcagcctccccagtagctgggacaactggaatgtgccactacatccagctaattttttgtatatgccatacagacagggttttgccatgttgaccaggctggtctcaaacttctaggctcaagtgatctgcctgcctcagccttccaaagtgttgggattacaggcctgagctactgtgcctggcgttcaatgtttttttattaagacataactaatatattgtagttctcccttttaaagtgtataattcagcagtgtttagaatatttgcaaggttgtgcagccatcaacactctctaatttcacaacattttctcttcagttgcttttacaagttccctcacccatctctcttcctgtttttacaattaaatttgaagaaaaatgggttaatccattgtagaatttctcataatctaaattttgccagttgcatatgggtggtattactgaacaagtttcttcattgtccttattatagaaaattttatatttgtggccaggcacagtggctcacgcctgtaatcccagcgctttgggaggccgaggcaggcggatcacaaggtcaggagatcgagaccatcctggctaacatggtgaaaccccgtctctactaaaaatacaaaaaattagccgggtgtggtggcaggtgcctgtagtcccagctactcgggaggctgaggcaagagaatggtgtgaacctgggaggtggagcttgcagtgagtggagattgcaccactgcactccagtctgggcgacagagcaagactctgtctcaaaaaaaaaaaaaaaaaaaaaagttatatttgattctacaggcttgactaggtttaggcttaatatgttttgctgggattcctgtaagggtgctgctttgttcttcaagaaggaagcactatgtgactatgcctgagtctgactacatttggctgtagtgtatcttctttatggaagatacgctaaaattgtaaaatggtgatcttttaatattatcacttcttctcaaactattagataacatatttctatcaagataaattttccctcaatagctattttgttactcagagataaattttgtataggaaggcagaataaatgctctattattttcttggtttatacattttcaaaataagttgactctagcaatgaataaaaatgcaatttttaaaagcattattaaaaaattatagaaaaggccgggtgcgaggctcatgcctgtaatcccagcactttgagaggccaaagcaggtggatcacttgagataaggagtttgagacccacctggccaacatggtgaaaccctgtctctactaaaaatacaaaaattagccaggcgtggtggcggatgcctgcaatcccagctacttgggaggctgaggcaggagaattgcttgaacctgggaagcagaggttgcagtgaaccaagaccacacaatcgcactcctgcctgggtaacaagagtgaaaatccgtctcaaaaaaaaaaaacgaaattacagacacacacatattaatgatgtccatcgattgtacttattattttgattggtggttatctatagctaattggcacatcttagaatgggatcctgaactgtggcagaggcgcaagagtctttggtagcttccctgccatcctgtatgacaagagactccagtctgctttgaacactttttgttctagacctgtaataaatcattttgacaaataaaaatggcatttaaagatgacgatgtggatggttagagatactcattgctagtggattcataaacgtctgtcagctttttcagtgacaagaggtatgttttgttcgttttttaaagataaaatacatcacgagttcaatctgatatttcccattcaaaccgaggagtagagggttttaaataatctccttcgtcttccatcttaatcttcttttctcttgttcaaaatcgtgaaaatgaaatgattagatgtcacataattactcattattttagactacattatatacacaatgtgaatgataccattaaattgattactaatcatagtttaagtttttctgcttgtagttctttttgtcttgggatgtacctcattaaagatgtatagtcaaactgctgtattctaaagtcacttggaataatgtggctatgattacaactaaagatacttgcattcatttttttgactttattttttattcttagaactttctatttaaaatatttaattctgttttataattatggaaaatattttcaagtttctaaagtcaaactttaaaaacataaaattgtcaaagatgtctcacttctacttttgtctgtttaatatattcactatctttttgtttgtttttagatttctgctttacctctaacagaagctggtgtgtgtgtgtgtgtctgtgtgtgtgtgtgtgtgtgtatttaagcacctctcttagataattgatagcatgttatatacttttttcgcttaatttcccctacaattaattctacagtagtatatacacatttccttattatttttcacaaccatacagtaacctcacgtgtggataaatcatagtttattcaaccaataccctatgttctatgacaaatgaggtcccactggccaagtttgggaaaatataaatacaaaaaagaatagattgataacaggttataatacattaaagaaaaaatccatgaatatatgataatattaaaaagtatacgtgtgaggagtaagaaagagttcttccatacagaacaacagaataaatatggcaagaactgtcggcacagacaatcatatttttgaaggcactgatataataattaattcactcaaggatcaccagtagaagctacagcaaatggatccaagattggtgggaatcgggattttggcagtttccaagtatctgcccacagattccctaataatttcaaaagaggagggttatttctgcaatgggagattcggcaggcatcactgtaactaagattcacacgggcattgtcagttacaaaggattcagcattaacgacaacaaagtttaacccaaatttagcaatgaggagacaataaaacaaatcgaggttgcaggataattctgcaaacaactgacccttacaattcaaatttttgaaggtgcaaattaggtgtgtgtgagaagactgttctatactaaagcaaaataaagatacatgataactgaatgtgatctgtatatttgactaaacttttggtcagaataatttaaaaaaattatccaaagcatacaaacaacctttaaaactcatcagtaaataaataaacaaacattaaaaaagggccaaaggctttaacagatacctcaccaaagaagatacagagatggcaaagaagtaggctccacatcttatgtcctcagggagcagcaaattaacgcaagataccactacacaccaattagaataaatcccagaacaaaggcaacaccaaatactggtgaggacgtggaataacagaactctcgttcattgctactgggaatgcaaaacggtatagtcactttggaaatctggtggtttcttacaaaactaaacatactataaccacacaatgcagcaatacctggagtatttacccaaaggagttgaaaactaaaatcatgtccacacaaaagcctgcacacagatgtttacagcagctttattcaggattgccaaaattcaatgcaaccaacatgttcttcatcaggtgaatggataaagtatcagacatacagatcatggaaaattattgagcactaaagagaaatgaagtatcaagccaggaaatgacatggaggaaccttaagtgcatattaccaagtgaaagaaccaatttgaaaaggctacatcttgtatgattccaatttgaaaaggccacatgttgtattatacgacattcggaaaaaggcaacactatagagacattgaaaatatcagtagttgccagggactgagggatgacggagggatgaatagagacagcacagagaatatttaaggcagtgaaaatactcagggtgatactatgttgatggataaatatcattatacatttgtccagacccacagagtgtacaccaagagtgtaccctcatgtaagctataaatgtgaagtgattacaatgtgtcaatttaggtttatcagctgcaaaaaatgtaccgctctggtgggggatgttgataatggagagggtatgggcacatttgggcagggagtagatgggaaataccttcctctctatgatgtgaacctaaaactgctaaaaaataaataaataaaggcttaaaaaagctataaaggacaatttgggaacaattgggaggatctttgaatatggactacaaaagaaatatcattgtatcgatgttaaattccttgaaatttacatcacacattacagcggctacacagaagattgccctttgcctttgtagatataggctgaagtgtttaggaacaaaatgtcagtctatctgcaattatgtttagcttcttgagagacagaggaaaggaaggaggggaaggtgtgagtgagggagacaaagaaagataaagcaaatgtggcaaagtgttaacagttggggactctggagaaaggttgtacagatatttgctataaatagatttttttaaaaaattttttaaaggtttgaatctcctaaaatatcttcatactcagtcactaaatggaaagtaaccactgaaaatcagaaatgttggcgaggtgaggtggctcacggctgtaatctcaggactttgggaggctgaggtgggtggatcacttgagctcaggagttcaagatcagcctggccaacatggtgaaaccctgactctgactctactaaaaatacaaaaaattagccaggggtggtggcaggagcctgtaatcccagctacttgggaggctgaggcaagagaatcgcttgaacctgggaggctgaggttgcagtgagctgacattgcaccattgcactccatccagcctggacgacagagactccattaaaacaaaaaaaagaaagaaagaaagagagagagagagaaggagagagagggaaagaaagaaagacagaaaaagaaagaaagaaggaaagaaagaaaaagaaagaaagaaagagacagaaacaaagagagaagagaagagaaaagaaaagaaaagaaaagaatcctctgtcttaatcctgagttctaatttgattgccttgtggtctgagagactgtttgttatgatttctgttcttttgcatttgctgaggagtgttttacttccaattatgtggtcaattttagaacaagtgctatgtggtgctgagaagaatgatttggggtgcagagttctatagatgtctattaggaccgcttggtctagagctgagttcaagtcctgaataaccttgttaattttctgcctcattggtctgtttaatactgacagtggggtggtaaagtctcccactattattgtgtgggagtctaagtctctttgtaggcctctaagaagttgttttatgaatatgggtgctgctgtattgggtgcatatatatttaggatagttagctcttcttgttgtattgatccctttaccattatgtaatgcctttctttgtctgttttgatctttgttggtttaatgtctgttttatcagactaagatcgcaaactctcctttttttttgcattccatttgcttggtaaatattcctccatccgtttattctgagcctgtgtgtctctgcacatgggaagggtctcctgaatacagcacactgatgggtactgactttttatccaatttgccagtctgtgtcttttgattggggcatttaagccatttacaattaaggttaatactactacgtgtgaatttgttcctgcattcatgatcctagctggttattttgcacattagttgcagtttctggaaactgaacaacctgctcctgaatgactactgggtaagttatgaaattaaggcagaaataacaaagttctttgaaaccaatgagaacagagacaatgtaccagaatcactgggacacagctaaggtagtgtcaagggggaaatttatagtactaaatgcccacatcagaaggagggaaagatctagaattgacaccctaacatcaccattaaaagaactaaagaagcaagagaaaagaaattcaaaagctaaaaggccaggcatggtggctcactcctctaatcccagcactttggaaggttgaggtgggtggatcacttgaagccaggagttcaagaccagcctggccaacatggtgaaaccccgtctctactaaaaatacaaaaattagctgggcatggtagcgtgtgcctgtaattccagctactcgggaggctgagggaggagaactgcttgaactgagacctggaaggtagaggttacagtgagtggagatgacgccactgtattccagcctgggctacagagtgagactccatctcaaaaaaaaaaaaaaaaaaaaaaggctagaagacgacaagaactaactaagatcagagcagaactgaaggagacagagacatgaaaaacccttccaaaaaatcaatgaatgcaggagctgttcacatatacaccatggaatactatgcaaccataaaaaagaatgagatcatgtcctttgcagggatatggatgaaactagaaaccatcatcctcagcaaaccaacacaggaacagaaaaaaacactgcatccatgccataaaatacaactcagcatagtattccatggtgtacaaaaaggatgagttcatgtcttttgcagggacatggatgcagctggaaaccatcattctgacaaactgtcacaaggacagaaaaccaaaccccgcatgttctcactcataggtgggaattgaacaatgagaacacatggacacagggaggggaacatcacagactggggcctgtcagggggtggggggctagggaagggatagcattaggagaaatacctaatgtaaatgatgagctgacgggtgcagcaaaccaccatggcacatgtttacctatgtaacaaacctacacgttcagcacatgtagcccagaacataaagtaaaattaaaaaaaaaataagaaaataagaaatgcggtattactacaaaatttttaggatgaaaaattgtatgtatttcatgctatctgtcatgaattcagctatctaacctgctatatcctacacatagcttacaaactgacctaagaaaggagggaaaaatgaaagcaaaatccaaagttgcttataaaaaagaaatctttgttttggaatatgagaaagctattgtataaatacagattaccaatatggtttaaatagaagaattatagtcaaataccatagcaaatgagttaaaattttgcagctcattacagttttgaggtctctaaagtgaataagcataatacccaaaatactgactttgtagaatcctaaaatccagttatgcagtctacagcagcagtcctgaatctttttggcaccagggagtggttttgtggaagacaatatttccacagatgagggcaatggggatggggtgtggtttgtggatgaaactggtccacctcagatcatcaggcattagttagattctcgtaagaagcacacagcctagatacctcacacgtgcagttcacaatagggtttgcactcctatgagaatctactgccactgctgatcagacaggagctccagcgtcatgctcatctgcccatactcaccccctgctgtgcagcccaggtcctcacaggccacagacaggttctggcgccacgggggttggagacccctggtatagagcaacgcatgggcaaaagcactgcatgagtaatcaaggtcaaaggcagaattaatggatgttctaatttactatggaggcaacatagcaaaacctcttaaacattttacaacaaagatcctgtccatattacagtcttcaaacagatatggacttccatacaagaagagtatattaaaaaaaaaatccacaccctctcagatgttcactcaaagtgataaaaatggaaacaatggaatcacatctgctaaaatccatattagaaagtatacaaataaaagtgcttatgataaacagctaatgagaataaatggatacactattaagctatcttggcagaatttatcaatgtcttagatgtacatgcagaaattctcacatatgtcctcaaaaacacatgtacatggatgtcctttgcaaccacagtaaaaaccatggcaacaatctaaacagtcatcaatattgggctggctgccattcatacatacaattggtaaacatttgttataactctagaagtacacggaaaagaaggcggtctattttttaaataaaatcagcaagttgcagaatagcatgcactattattattagcccatttgtctgtatgttgtatatcactctgtatatgcattaacttattgggtacacatagcaaattttgattaactctgaagaatgggattaagtgatggaagagaggaatttgaatgtttctgaaattttaaaaagtctaagcacacattactttgataattttaaaaagacacctgggaaattatttgcaagtaaaatactcatttaattcctgataagctttcctttctttctttctctctctcttttttttttttgacagaaaagataatgacagtaaatgctttacttagaatagaatggaattttttttctacttttctgtcaatgtctttatggatgatgttgccatcttcattttgtcactgttagttgtaacttctttctgacctatgttttaccctttctggctacaagctcattttacacacagttatttatatgaacagttgggagccactcactcacctctcttttgagaaaagaaaaatatatttgtgctttctaacttttattatctttatgccaataagtctttttattttcacctaagatttgtgtccatttttggaatggcagagatgctggaaatcatatttcaatccaactgaaatgtacgtgtgagtgtgtgtgtttgtatgtatgcatggttttatgtctttagaattctttgtgagtgctccagtaaatctggtgccttctgagacgacaagagaggattaaggaaatggtatgagttttttgtaactatctcaatgaaaaagtagagaagcatagagtgaaaaaatccttagaacagtcttgctctgtcgcccaggctggagtgcagtagcacgatctcggctcactgcaacctccgcctcccagattaaagcagttctcatgcctcaacgtctgagtagctgggattgcaggtatgcgctatcacacccagctaatttttgtatttttagtagagacagggtttcgccatattggccaggctggtctcgaactcctgacctcaagtgattcacccacctcagcttcccaaagtgctgggattacaagcaggaataaatgttactgtattaaaagtattagatcctgacccctgcttgatgtgttaagctcagtgtcctctatctgaaataaagatacacactagcgtgttctccagattcaccttaattttacctgaacaatattctaaaattttcaaattatagcacaaacatactaagtacacatataattcacaaaaattaaaaacatatatttagccaaaagtaaataaaataaaatcagtaaaataaacaaatctgagaacttcatgaatggcaaccacagcctaaatgcaaagaaggaataaaacagctacttcttggctcttgggctttcatgggcccaggatccactaatgtaagagtaatttcagagattttgaagggtaactgggtatatttatgtattgtgttatttctttcttttttttttttttttttttttttttgagatagagttttgctcttgttgcccaggctggagtgcaatggcgcaatctcggctcactgcaacgtccacctctcgggttcaagtgattctcttgcctcagcctcccaagtagctgggattacagacatgtgcaaccatgcccagctaattttgtatttttagtagagaccaggtttctccatgttggtcaggctggtctcaaactcctaacctcaggtgatccacctgcctcggtctcccaaagtgctgggattacaggcgtgagccaccgcacccggccatattgtgttatttcatctcacatcttgaccttgaactttgccagttctcctataaatagcaattccactgtagtgacttacatttgaagtttgggcagtttttgataaatatccttattactggattttcttttcaaaatgaacaagaatattggacaactcaggtcctccgtttgaagacattcacagctgagaatgatattcgtatacatctgggccacagactagcagttcatctagttaatcagttactatgtagccaacctcacaagttgctatttactgccaatatgctgcacagctacaagtgttatgggctaaattgtgtcccctcacaagtcatacattgaattccaaacccccagtatcccaaatgtgactgtttggagatagggcctttacagaggtaaccaagttaaaatgtcagcattagggtgggtcttatctaacatgaatggaatccttttaagatgagattcaggtatagacagacacagaaaacagaccatgtgaaggtacacggagaagacatctgtaagcccaggagagaggccacagaaggaatcaaccctactgacaccttgactttggaattgtgagaaaataaacatattatttatttaagccacccagtctgtagtgaaggttcattttatacaagaattatacaacattttactggtccctctcgaattctatagcagcaggcatgtatcagggatcttcacagatattttggagatttttttttttttttttttttttttccgagagggcctctggcatatactcttgacataacatctgggcaccatgggtagtacctcctttatgacagatacttcattttaattaggggatgactgcattatttcaagacaaagcaggtgtaggttattattgggtgttgtatcaaagaaataaagaaatgtaggatgacatggggttattcatttctgcattgaaaataaggggaaataaggagttatatagtaggatcttcgcaattacactgaaaccagtatagtgcgtgcttgttgaatgaatgaatatcagtaataactctcaagaactgtattaagcaccatatttactaaatatcttacatattatttgtaatcatcaaaccacactgataaataagtattgtagcagagacagctggcacctcatcgaaatctgtttcctcctcttccccgacaccagatgacctgatttcccaaattccttaacatttagggttggctacactgattccttttatctgatgggtatgactagaagagatgtgtgccactttgaagccaaagcatgttcacagaagttgtagtgaacacagacagacaacaaacagataaatacacgacaaaatggttgataaatgtgtggcggcgggggcatagatggagagatgggcaaaatacaagttagagacaaactctcaactgtaagctgggagctcacatcctatggtttcaaccacacaaccaaagactacaaaatgcagcgtggcagcataatcaaatttacatcatcaggttttggattgtcaataaactttctagagattactctgcacagccaaaattttaaaatgatatcagatacaacagctaaaattactgggttgaaactggaagcttcctttttaaacagagctgtaaatgtataaaatgccacattagggcacaggttttatcacgtttatttgctagctaattattgaatccaaagcctttccaaacttgtttttggatgttcttgtgtttgtttgtttgtttgtttttcctaaatctttatagccgtgagccttgatcttcatgttttctttctcagaaatcaatcattcctttgtgctacataccacctcctccttcctgatagtatgtaggccatcttcaaactccctacaacttcaccaacatttccaactcattttcatacttttaagcccactggcattatacatgcaatactgactccaataaaatttatcatgtgggattagcataagcagaggtggcaaacttctcatttgttgctcccaaaaacaaaatgctagatcgctctcaagtaagaagaaacttgtatcacagtgtggtttggatggttgctatgacaatatcgagttcttctttgagaaagaccatgataaggcattcattaggaacataagtacctagcagtgagggttgttttctttttcatttttaaaatatctggccaagtagctggcgtttaaacagatcaagcattttacctacattctccaaactttaatttcataacgactccttgaaataagatgatggacaacaaaactggagctcaaagagatgcataacttacctaaagggatatcactggatttgcatccaggttcatcttgtaaaaccacgttgaactgcttaccttgactgaataaatcagcaatgagtacagatatctactttaattaacacatctaaattttgcttcattctataaccaaagcagttaaagggtagaatttggaagcacttaagatgaaccctccaattcttctctattgtctccaaaggctgtcccatctaatggtacagatgtgtgaaactcagaaaaatgataacagattacagatgagacgcaacgaaagcttccagccaggaaggtgagtgaggcagatagacaagctcatgaatttccagaggaacatatcacaattctgatttgtctgtgaggaaaagacatgatgtctccctataaaaattcactgcacattgccaggcatgggggttctcgcctgtaatcccagcagtttgggagtctgaggcaggaggattgcttgagcccaggagttcagaatcagcctggacaacatggcaaaactctgtctctacaaaaaaatataaaaatcagctgggcatggtggcacatgcctgtggccccagatactcaggaggctgaggtgggaggatcgcttgagtctgggaggtccaggctgcagtgagccatgatcatgccactgcactccagcccgggcaacagagagagaccttgctccttgcaaaaaaatcactggacataatgaaattatgaacataagaaaaggttggatttaagggctattttaatgtaattcccatcattttcatcattcttttgtgattcatattatttaccatggaagacttctatttaaatcaaaaggattaactgggagggttacattgataacaaataactagctatcacaaatagaaatttgtgaagggatggaatgtgagaaaattagctttgattatgaaaaatgaaagagaaaagcctaatgtagaattcgcagctaagtgggggcaacccatgccaatcatttcaaaggctggtcacacccgaggcgtgactaacccagcagcagatggaacctggattctacatttcaccatgcttggggtgggcttggggctccatgacccacaattttcccactgcatttcccaggccaaatgcctcaggttctgtcttattccggaatcctgttcatgattagaatcatgctcaagagctaaaatcttcttctgaacttaagccccactgacggaagcactgaatatgcctaactcttacagtttccctccctgcctggaagtgggctctataccaagccaggtggtccagagccactcttctgcccacatcctatcctcatcctcatcttaaatgtagccaacaagaggaaaaacatccattctggttttggctgctggtagtaggcagcggtctaaggtagctcttgagtgtctcactccctgatctgtgtatctgccttctatgagcagcatctgtgactatgaagaatgccacccgtgtgattaggttacactatagggccaaggagaggggggttttcagatatacgtcaagtctgtaatcggctggcttgttcagcaaaagggagattatccccggcgggcctgaactactaaaaagaagtgtgcaagtgagctccatgaaacggggtctcaagttcagagacatgaagtgacagagacttcacgttcctgctaggcttgaagaagcaagtcatcgtaagttctacagctgcaagaaagtgaacttctccgaaaaggacacggagccctcaccgaggcccccaccaaccccttattgtagcctcatgagcccctaagcagaggacccattaaaccaagcccacaaacatggaaatggtgaaacactcacatttttctaccatgataccatttataaacatcggatacatttatcattccaaggattcttgccatttgcagatacctatgcttggctgctgaggaaggctgaagccccttgaggacaaagaaacatgagcttgttgtcatttgatcaaacgggctcttgaagcttaggtcagcagtaccattgtgaagtctgtttttcactttaaggccatgtgagacaaagagatttgttgtggtctgtagggttttactacaacataggatgtggaatatggcaaaagtgtagtttcctacacatgggtttcctaggatggcagtaatcaagtaccacaaactaggggtttaaacaacagaaatgcactgtctcacagctctggaggccagaccctgaaatcaaggcatcggcagggctggttccttctgagggctgggagagaaggacctgctccagggtgctctccttccttgtagatatccaccttccccttgtgcctgcacatcgtcctgcctctgtgcttgtctgtctcactttttttcccctttttctaaggacacttatcatattggattaaggcccagcctaatgaccacactttcacttgattaccactgtaaagacctgatctctccaaataaggtcacattcccaggtgcttcaaaataggtgtttttttttagccaggcatagtggctcatgcctgtaatcccagcactttgggagactgaggcaggtggatcacttgagctcagcagttcgagaccatggccaacatgatgaaaacccgtctctactgaaaatacaaaaattagccgggcatgatggcaggtacctgtaatcccagctacttaggaggctgaggcaggagaattacttgaacctgggagatggaggttgcagtgagccgagataactctagcctcagccaacagagcgagacactgtctcaaaaaaaaaaaaagattttttgaagaacacaattcactccataacgcccataaaagaggaaggagagagcatccaaggactaggtaccttactggagggcagatagccagctgcctctgctgtggcagcaagacaccaaggtgaccctcccaatttcaatagccgtgggatcatcaagggcaggagaaagggaaaggaagaaccttgaatgtgactgcatatctaagtccctaaattgaaacagaatgacctacctggaagtaagagtatgatttttttctttccttctgagagtggaaatgagggcttgtgagaaagttgaaaaatagagaaagtttcatttcagcttatctgagttgtgctgcatgaatatttttattcgcctcctatgtcctgagcatgagaattgagcaccagaggaagaatccaagactccttcactttatccccagtccacagaccgaccattgtcctcagcaataggctgactgtcattccctctcattttgcatgcagggattgtacacgctgaaaaactcccttctgtctaacctcccctgcagcaggtcaagtatagttgtttgctttaatataagatatctgttgtactaagacttcattgaataagtttcttaaacagacgagcaagtcatttttccactcttgagtggcctcttagtgagttaatcattttgtggaaatacaaataaatctaacacaaaatatcagaattttttccttcttaatagaatttaaattctttgatttaaaacatcataatttattccttgttagatttttcaaataatatattcaaatgtccatgttaaatgtcagattaagagacaatgatttttatgagtaattttttatcaccaaaagttaattgcctcatgtatatttctccactgagttagtaatattatgacaatattaatgccgtagattttcaagctaaaacagatctatttttcaaatggaaaattaattctaaaaaaatgaaagtactaatttaaatcattaatggcaatttcctctttgcagactgccttgaacttttccagttctgccctaacagtccaggagaaggaaaatacaaattttctggcatggaaataacataagaaggagctgcaagtttcttggcaaagacattgacaacttttcaggataatcacaaaagggataggataactctaaaaatgaacataatgctagtctgagccagttaagtgctcactttcatagcttctggtagaaagagcattcatggaattaaatattaaatatgttctccgaagttctgagatagtaggataactgtgtgtacttataagaaaggagcgatgtcatgggtgattttcctaaacatagcagagaatcaggaaaacagccaagcatttgctgagacggaggcacataaaacatgaatctgagaatcccaagggtagaagagagaaatgtggagggttatcatcataaatcatgttagaaactagggcaagaaactcatggtgacctctggacactaaaatgcagctggtcataattaagcttcaggctttgctcttcctgggccagttcattggcatcgtctactgccaggcctcgtaccagtctacagaagagattgcctggaacaagcctcttgatgttattcacacttatgaaccaactctggtactagatgcaaaaagcatgtcacaagagggatgggtgggatgggggggaagggacatcgcaggaatcatgccactttccagccccaccaccctctggtgccacgtccacccttgatcactattaccaacccagtatccctccagcacttcacgggagggtgtcagggatcacaaggaaacacatgggacccacacatttcgagatgcctcacctcctgctcgaaagtcaggtgaagaaggattcttgagccaaacatgaaagattttttgagagctaagctgacaggagaatttcccgtaaaaagatgaaagccctggctttaacagagccccttttcatttttacctttaaaaagcttttcctttcatgttaccctgaggttattcaccgctacgacaacaatctccaaagacgttttctccattatagaagaggaaaaggttggcgttgggatttggtcaggaaatgaagcgttgaagacaaacaagatgttctaatatagagcaaacctgatgagtcattttctaagtgagcagccacttccagatacaattcatagtatcttcctagttattactattattattattgtttttttttttttttttctgagacggactttcactcttgtcatccaggctggagtgcaatggcgggatctcgcctcactgccacctctgcctcccacattcaagcgattctcctgcctcagcctcctgagtaactgggactacagttgcctgccaccacacctggctaatttttgcaattttagtagagacaaggtttcactacattgaccaggctagtctccaactcctgacctcaggtgatctgcccacctcggcctcccaaagtgctgggattacaggtgtgagccactgcgcccggcctcttccaagttattctgtcatttggcactgatccgtctttcaaagacattcaattaatcaccagagatgcaacaccataaaggagcagaatatttcaatatattacctgatatattttcttttgtcattacccttttgtaccctgtagctttctaccttaaaggctccacctacaggcagaggctcattgccttagagaaggagagacttaaaaaaaatcccaggcaaacagagggtcaagtaaccagacttggaattgcacagatgttggtgaatctacagcagccacaatggtccaggattgaatctactccatggaagcttcgaagtgggaagagccgaggatgacctagagcccataagaagataagtctgaatcagctggaggaaggtggatacccacaggatgtgtgatggggtctggatgagagcagctgggtgagaagcagcaccactgccttccttagacccaccaggatcagttctttcggtagtgatggagatggggagggggatataaaaacccccagatctctttgattaggtgaaagtaaagcaaccaatggaatgccctaattctttctgggatctcctacagcacacaaaaaaacctgatttccaacactgggtagcagcaatactgtaggtatggccccacagagtgtctatgcacagagtcctgtggtcgctggggacccaaggggtgcagtaaatacctcatgaagggcaaggaggaggtcaaagagactttctgagaataacagtatttccaaagggtgctggctcaaaaaatgaaaatatgtaagccagatgtttagcatcctgggtaagatattaacaagcttcaacatcagatgtaaagggaaggaaaagaaaattgattccacaacatccccagtttcacttcagtagaggccaataagacagaagccaacaggaaattagacttcccttcttcaggcagaacagtggtgaggccctatgggctgatcatccccaggaaaaggatgaaaggataagaagagggaaagaacccgaatgggaaagagtatttctcaaaggggcccaagttttaatttataagattaaaagaatgagggttaaaatgtaaacaaagccaccaaaatatagaaaacacagatttggaattctaaatccatgtactccattcatggaggaggtggaaacttgctgagttctcggaccactcagccagttcacagacataaaaggagacccagcggagagggagtgggtgagtgggagatcaccgccctggagagggcagctgtcccattggggggccccacctccactttttcgagtgctcttcctccacctcaagcccggtggaagccaggggatgactcagagatggggacacagagggctctcctcccagcctgaagagctagagcaggctgtcaggaggaatgtgaatacagtgggtggacctgtactccagggctgtgggaaagactggggttccccaaggaccagatgtgggcaggtggagagacagaaagagagagagacagaggaagaagggagacagagagtgcccgccaccgcacccggctaattttttgtatttttagtagagatggggtttcaccgtgttagccaggatggtctcgatctcctgacattgtgatccgtccgcctcggcctccgaaagtgctgggattacaggcatgagccactattcccggctgggagaagtcttagggcttagacatgagggccacctggagggtggcaggaccctggaaacaagaagccaaagtcaagtctttagggcagcaggagagatcagaaggggccatgcaacccggctgaatagagaggcatcattgggaggcaggagagatgcagaaaagaggtttccagcggtgcaaatgtactaagagttcatgaaagcccccggtgctgaggaatcagctggaacccttggccaggctccaagtacccgagccaaaagctctgtttcctggccccattctcctccttcctacaccctttcaagcttcctcaaacttcttcagagcttggcctgagagagagaaggaggtgaacagagagagaggagagagacagagagagagagagaagcagagactctaattaaacctcttcctcaatgtcaatgtcaggcagagaagaacctgtggcttgaaatgagcaagaaatacaaattgtggaattgattaataacttgcctgaataccaggattagtaaatttagactttgttcactacttcaactgcccacaggactgagtaaaacaaaaatcacagaccctgctgaaactgcaggaatgatttaactcctgcacacgatttaattgggcaactggaaaaggaaatacaaccttttgttctgacgttattaaagatgtgcttgctcagcatcattattgtattaagttttctgctgaagaagattaagaagagaataagaatagaataagagtaaaaaaaaagagaaatacaatacaataaaaacataaaagaaaagaatagaaaaaagagtaagaaaaggaaaagagggatgtaagtaatgcagattcaggtgtaagcacaaactaagttccatctagagactactgaaatactgcactcactttgataacccagaaaacacaggacaagatctgaacgagacctggatctgggttgtgcttcctcgatcactaaccctagtaaccatacttattagctaaaacctctgcctctagcttttcatttggaacatacatttaatatacagccctacataagttcagccaatatgcagctcaacaatatattaactaggcaagttgtatttcagaatctgtgtgagaagcggcatgcacgcagcctcccagcattcgctggtgctggggcttgtgcgtgacaacatcagggagctcttccaaatgctggtcgctcggtacccatatggaggctttcttcctctagattgccaagctttcttaccagaggaagatttaggctgtgtccacttagggccaaaataatgaatcagttcagttgttatgtgtgcaccatttatactggggtttgacagaattttaaactttttactcgattgccttgatatcatggaattattgctatttatcagtctatatttacacaaaaggcctgacatggctacacacaggccctgtggtctgataccacgtaaggcacccacagcatccctcgccagctgagatcgaatttattcacacacatgcgtctcccctccaaatggaacttattctgactttagatctcctattaggactaatgccattaactaattgtccaataatttcagcaaaattcaaagtataaaacggaagtattacctggccccactacaggagttgtgggaacctcactggcaatcagatttttcctgtctgtcttctcttgctcttcacttcccaggaaagcaggcagatccactaacttcataattctagagcaaagtggggccttacacacaagcctacgcttgcccttggagtttattttgacttctgcataggtggctgccactgcagttgtcagaatctgaaattcaggagatgccccttgacaggcagggacaccatctgatggcagtgtgacaaggagcattgttaatacaggaagggctttctaattgagagtggatacccatgcagaaattttcggatgttcccaaggccactacaaagaaacatgaaataaaaagatatatcccatgaaactacaattttggaaaagtaaaaataattacagcaagtttgtatctgggatttgttcattttaaataaaatttaaaaacaaaaacaaagcaaaagagaacaaggaggggagagggacagtaaatgggtaaaaagaaggaaaagatggaggagaaagaccaagagctgtcaaggcccacagtcgccttaaaacagaatgtgcccatccccccacccccttctatgccccccacccccttctatgccagcgcccagtacctcactccctatctgcgctgcctcccagccaggggccttgacaagcccacactctccaggaagggtatgagcacagcctctactgcaggagaggatggagacaagctctgttcttcttgcttttatgtgagtctgatactcatatcactcatctcctttctgagcattgcaggctttaaggaccctctggctggctccttaacccagcttctgaaatcccccggagctgcctgacttcccactctggaccctaagtaaacatttacagaagcagtggatgccgcttatttcttactccacaactatctatccattcttttgccaaccaaattattatgtgccaatcacattgaggtaaagcaaaaatgaacgcactttaaaaacattaaaatgtgctcagattgcaaatgtatacagctattatacccagcaggaaaaaagccaattaatttacgtatttaagaaaattttcttacttgaggacaaaaattaaaaaggggaaggaaactcatgttgaatttcacttagaaaagtcaaagtgaaaataatcagaatgtcttcagctacccaaggatttactgttaactagaaaaaagcatcgtttccatgccacctcagctttccaaatctatcattctaatccatttttaaaaaagaataaaatctgaaaaataaagtacatctccaggcctctcatattgcaaatgacgtgtccaatcatacttctacaaggaaaaaattaatggcaaagggggccaagagttaactgctggaatggttaactagaaaaggcccagtcgaaattaatccccatgatttcatgtgaatttcaagccatagcttaatcctacatgtcagtacaacaggaactgcttagctctgctaatcagattctagaatttttcttttctttttttttttttttgtaagcatcttagtttcgcaaaggcagctggctgtgatggtattggtcactctgctgaagaatatacatgggacctaaaatagctctgggtccttttcaactgtggcagtttcatcaatggcatccgttacaagatcctggtagtaatattgatatatcaaagtaccaattaaaccatctgcacaagggtatccatccacctgtgtctgataccatgtaaggcattctttcacatctggcacaaagaaggaaaaaaggcacaattctacaagattggattttgaaagaacttctgtttgaagagtgaaaagaatagatgtgacatgaatggacagatgaattaggaggcatacagtgtaataacacaaagaaattattgtgggttcatatctaaactccatcagaaaatatattcatatattctgtaacatgaacacatttaatctatagtggttgttctcagagtaacagaaaaaaaatattcttattattaagttcactttcagaaaaatataattaaaaaccacataggacaaggagagacaaagaataaatttccttgaatcatctaaaaataaatgtatcaatatagcaacataccactgtgggctcttcatccttcctgcttcattaattacagtccagtgacacctccatgcccagtcctagctaaaaatcatactctcaacactaaatattaagtctcagattctgacaagtatgttcatgtcagtagttacaacaagcaaaatatgtgaaatcaggattatagctgtgggtgctagaagtggattctctgtcctattattctccattttcacacaactacacatccatccatcttccatctttccgattctgttctgtgccctcagaggttgacacccacaggccaaatcacttgggctcccttgtcctgcaacctccagttgggttttgacaaggggaggtaccaggaggtcaatgggtacagacggaggggagagagagagagagagagagagaaattgactggggcttccctccatccttcctggccctgcttgcttgaaatctctggttccggtggggactgcaaccctctaggatttaccatccaccagatgtcccttctgctagggctccaattctcattagctctgggaacagcatttattcctcttgtccctaaagacctaacaatagtaacagcttcgcaccatgaatagttcaggtgtcttgacatccttctttgttttttttaaaactgttttcttcagcctcctatctgagggtactgttttcttctggaatctgaactgacacaccctggaattacagggttatgtttccctgaagggaagggtgacaataggaagtactaatgaagatatttccccctcaggatgacatatgctctctaatttagtgactctcccacccccccaccaccccccaccccccaaccccatgaggtcagcatggaggcaccagaggacatatttacaattcttggccttcaccttgatgaaagcagcaatcttggggagagggagaatggtaaggaaaaactgccgaggtgcaagctgtttcttgaccctgtgcccatcctgagctgtataagattctcagagcacaggaaaagaaagccagagccagggctgagccaggtggaggaggggagggctggaagcctggacctctgggaggtgctgccccgccatgtgccctgagggccttgatgtgggagcagaagagatggcctggtgtgtccaagacagtgagggcctggttccagcccccgctcttccaggagctaaaaagagcctccacatcctactgcactgaaaagaggagttggccttgctgaagggaggatggcccacaggggctcacagggtcagggcaaagggttgctcttggggaaagctgcaaggaggtgtgaactggaggcagagctgctggaacacatctcagatgccaaccttaacagcgaagacgcatcaggcatctcagccccttcgggcagacagagacactgtgctggatggtgggacgctgcccatgacacggctcactgtgagctcccgacttagattcaatgccagaaacaggggcagagaggccaatggctgaatagaggagacttccaatctgaaacgcttgagtgtctctcccggtgggtaagattctggtttttacccttaggtggaaggtggaatgggcacactagaacactattcttttctccctctttgtgagcagcttcttcgataaaaacagtctatttttttcccaggtgcacccaagtgttcagtggcttcagtgaataaagtcactggaagatatggggctcatttctatttaattagatataacttttcattatcattattgtgaacttggctttaaattatgcaaatatatataaactatacattatcacttccctttatttaatcctttatatatatatgtatttattcctttaaataaatatatacatatatttattcctttatatatatgtgtgtctataggtctgtgttttcatggccatacagtgggctgcaggccactttgcaggaattcttcctacctaccacacttactgcttagcacacaggtgttcaaaagacatctgtaacaaataactaattacacataattgtaaagtaaagtaaagctagaccaaaatgacataaaatctgaatcaatgtttccatgcagaaaatcctagctttcactacagctttattcatttcatacttatataaaatactcatggtatttttccacatacttagtgctgagttacactcatgtttgctttccattctctgctgtctttttttaataatacagaaattttcatacaaaaatgtactgaacacgtgtagtagcattatagaatcagagcagtagctgcaaatgatttatgaaactatctactctggataatacaacagtgctatacatacacaattacttcataaaatatggaatacaaacatgaataggaatgcctatgacattcaatgtgttttgtcggcctttaaaaacttatttctgaacacagtggcttttcttcttctttaaaaaaaaaaacacattctatcagaatccatctaaactatttcagagatgtgaaaagctgtcatatttgcaaagaccaacagagaaaaaggtattacagttatccattccacctcttgatgccagttaaatatctttgggagctcatttaggtttctaaaagagaagatcatgcaaaatgcttattttaggtctccttaatggagactgaagaatgttatgcagctctctgcgttttttttttctttttatgtctaaattatttgacttctttaaacctttcacctggatacttttcaagttttccacatgcatctttaatagaggaggcctggaaccaaccaaacatagattagaacacctcacttctctaaagttaacctttatcgggcaagctcagtcactcaagaaagagtcaagagccaggatgtagacaaaagaccactgagctgccacatcttcacaggaccaactaacaggcaacagaattgcaccaaagcttgaggtctgtaacctgtactcagatccatcgtaacccacttattctttttgtagacaacctaccaacaaccattaacaaccttgtcttcaacctatacattaacaaaataaaatgcatgtcaggacacagatgacagtacctaaacaccaatagcaaactggagctgatggtggagctacatccacagacatgcactaaagaagaatagatttttttttaatggatgcaatcagaactccacagttttataacttctgaaaaaaagagataatatatttatctagtacttcttatacatgatttttatagaagaaatcgtttaattgtatacacatatatcaacataaaaaaaaggccacagaaatgcaaaaacttttttaaaccttccaatgaccaggaagatatgcactatgatttctcctttgtgcatcaagcgctttgggagctaaagaggcttgccaaagtaaagtagcgcgtccatggaagagagaagaccagattccaggccatttaacccccaaggctactgatctttgtagtatagtcaaagacgcagactcagcattcttaaacttctgattgcctttcactcacttgcctgctcttgcctcctaaatatatgtctgttcttaggaactgtatttggtctttgtagtagtcagtgagggatgccataaccaaacactactgacagggcggcctagacaacagacactgattttctcgtggctctgcagattgcaagtccaaaatcaaagtatctggacgtttggtttctcctgaggcctcctgcgttggtcttcagatatccattgtcttgctgtgtcctcacatagccttttctctgtgtttgtgctctcatggtatttctgccttttcttaaaagcatgccagacctattacattagggcccaatacttacagcctagtttaacatgaattgccttggtaaagaccctatctctaaatacagcctcactggggaggttaaacttcagcaaataaattggccggggcggggggggggtgcagaattcactttccctgaaaggcatatttattctcaatgcttcgattatatctccaatatgatgtacaccaaacctgtctcttcaggtctcaggtcttatttgtgctacagtcacaaatgtatttccaactacctacgcaatattctcattctgatatcctgttagactaaacttgtatcaaaccaaactcattggcatcctggtcaaagacattttcttttctcgtgtccttgcattaatcaatggtttgatttggtttgaactacttttcactattcctgtcttcctcatttctccagccgataagcaagtcttactgataactctgttcaaaatgtgtttgcatttagtcattttatcctccccctctaccacttgagtaaaggccttcataacctcacacctgaaagagcacgataatcatctaccaccttggacccaaggtagatgctcaaccttatttaatgccctcctattgtgtatgagaggaatccattaataggatggtatgtcactcttattgttaggttatgttataagacataggtagctttaagaaaggattaacctaagttagacttaacctaatcaagttaccccttaaaagagacgtagctcatcctggtgaaggagacttcaatcatgagagaaattcaacaagaaacagattgttcattgttagctttgaaaatgaagggagcactcactgtggcacggaatgcaggcaggtgacagtccccggggaagagccagtgaggaatggagtcctcaatcctacaaccataggaattgaattctgccacagctacctgagcttggagaatgaccccaagctcctaatgagatttcagtccttattgacaccttgatttcaatcttgtggcactccaaacacagaacacatctatctatgttatgccaaaacttctgagctacagaaatggtgagatcaccaacaggggtctctttaagactctagatatgtggtaagttgttacacagccatagaaagctaacattacttggttaccctctaattcacctcccactgccacatttatatttcttgttcaattagttcattattttggtgcccttttaccaacctcattgaacattatcataatgctaagggcctatgggtgagtattatatgccttaaacatacacacacacacacacacacacacacacacacacacagacacacacacttcccagagaaagcagttacgtgacttttggaaacataaccaaactgtcaaaagaacataaaactagttactcatatttggaaaggtaattcagtactatttgttctgctatggtgtaaaaaaaatccacaatattttaatggcaatagttattaaatagtgaaaatctagcagcatttacatcaactaatgttaagttccataagtactatgcccaaatattattttatcccttatcatgttaattcctgccattgaaacttacacccagttttcaaagaactttgatttttgcctcacctaagacagcaagtctattcccccaatttggcaatacaaaaacttttgtttcaggcaagccaatgttctcagtgctccactgtgcatctctgttcaatgcgattcctttcagaaccacttatgaagaagaattcctctccatcaatccaaacctttgagatgcatctatgcatctatgaacttcttgttcataaattcattaattaacaaacatgtactgaagtacctactgggtatactagaaatgatgagatgctttttcattggaaattggttaaaactaataaagattaggaagctgtaaaaaaaaattagacaaagatctctatgcaagaatatcaaattatactggtcaaaattcatctctactttacaaaagatgtctgtaaaccacaggaaggagacattgtttttaaaagtatacatgtatagttggctatcttttgcttaacagagaaggaaaataagaaaacatttgcttatctttaagaaaacaagctcaggaagagtaagctggaaacatggcgttgatggaacacaagtggtggatggaggtagtggagggccaggaggaggcaatgggaggataggaatgaggagggaggcagccttctctgcagggaattttttgtatagattttgctcctggaaatatgttaaaggtccaaatacattcagtcaacaaaggcaggacaatcctataactgaaaacatactgaaacaaataaacctaattatatctcaaatggatatcattacctctgtgaagggagaaaaaaaaagaaatagaagtaatccaagtgattataattcatttggaataggccttttcctcacctctgaattgcaggggttgttggtatttaagtgattgaaggtcgtctcttatgttgccgcaatcccctattattttggcaggactcatgactcgtctaaatagtcagttttcatcttttatttatgctgtttttttctcctatgtacacactatagaaatggaaacttcactgtagtaaacttttccctctttgttaatgaccactgctggcctaaaaatgttacctttattttaacactgctgcctatggctattagaaaaagttgtttcacacataaacatacttcttggaaccaaaaactttccatataactaaaatgtaatgcttgactcatccagttctatctatctatctatctatctatctatctatctatctatctatctatctatctatttatccatctgtccatttatctatctatccatctacctgtctatctatctatacttcccccacacttatatatgatcctcttttaacgacttggggaacttttcaacattttgttactccactggcttttcacacaaatggggaaaagacagacttaagggtaccagataaacaaaaattactaaatagctaagagcaactgtctcaagggtcctggggacctggaggccctgctgccaatgctgggacccagcacctccactccagctgctgctgccagatgtgagtgccagggtagtcagatgtgttgtttaactcaagtgaaaatggaaatccaggtttttagatgtaatcaaacagtttccaaatattggcattcaattcaagatatttatttctaaactatctgagggccactcccaacccatctataggtcacattcagctgctgaggacattgtgagacctcagatatggaacaacaaagccaactagagatacctaagcaccaagttatgtattacaaacaagatttgcacacaagggagaaataaaactgggagcagaagtggaaagtgctgcagaaggaagacttgaactgaatttagaaggaaaacactacatcttagagtatagaaaataaaagggaaaaaaaagtttgccaatatgtcatggctaattatgccctcagtgtctttgtaaacggaagtgccaggccactattcactgaaacttagcttggttttaccaaacctcgaaaagttaatattatgatacatccagaaagatgaagataaacatgacatgtttataatgtgatttccccattctacctctaattttttaaaaaaattatcattgctttttttttaaagttgtgagtatgtttcatataatgtttctgatcttttctcaatgtccagttgtttttacttcttgctgggtcagagtataattcttgaacgagcttcgctcttatttccaaatgcttttagaccatgggtccaaaaagccatattagctagaattttgcataaactgaagataagaaaactatgagtgcatgacattcttataagaaaaatgttttggtttttagtttcctaattaagttttgttaaatcaatgttgtcagctctgacttctagtgtctctgtgtcactagcatttgattgctgaataagtattattttggtgtattttaaagtattattatctgtcacaatatatatgattttggaactatttgtaagtatactgaaaattctatatctaaaaccatatatacatttatcatatagatacacctatctatagtatctatatctgttttagatacatattttacatatatacatgttaatgtcatgttaatgacatgttgatatcatctcttttcttttacatgttttaatctttttcttgctcaattcccttgactatttcacaatggaaataaaaaagaagttcttaggaccaaatcttctataaccttattacacaattgggttatttctattattttttaaatatatggaaaataatcttcataagttccctttctcccaaatagtatattgtaaatattcttatacaattaaagatgggtcagaaaaagaattctacaagaagtaaccctaaatgaaccctagtctacataacaaaagatgtacaatggtcagagatggcctgactgagggtgtcgggtaatttggtaatgctggttcacaagaaatgatggttctaaggggctgcagggctggagagagtaccagacacccctctctgtggaggccactttctagtaaatgatcagctggtgttaacccctatggggcaatttccaatatgagtaattacttcttgtgcatctaaatcttccctgaatgtgcagctgggaatactttcattacatgttattctttccacaccataaattaatccctacacgtgctgtagatcccctgtgaatctcaaaaaggagttgcgaagattaatcatttaatttgtgtgaattgtgtgaaaattgttttcccctggctctttgagaagctcagtatatgctcagctgcacacaacggaagtatttgaacaaattaatttactgagcaactactatgtgtccggtactacgccaggcagtgggagaatgaagaaaattattagacaatctctgacttcaagggatttattagctagtaacaaaactgaaatgacatggttaggccacaacctcaaatgcctatggccaacgaggcagagctaagagcaactgtttcaaaggcccaggcacgctgccaatgctgaggcccagcacatccactccagctgatgctaccgatggacacgatcaccagtgtgtccaggtgtgttgtttaactcaagtgaaaatggaaatcctgctttttatgtgtaattaaccagttctccaatgttggcattaaattcaagatttgtatttttaaaactatctatctgtgggccaatccccacccacctataggtcacattcagctcctgaggacattgtgagaccatggatctgaaacagcaacaacaaaaccagctagcgggatggtgtggtggcttgtgcctgtaatcccctcaatttgggaagccaaggcaagtggatcacttgaggtcaagagttcgagaccagcctggccaacatggtgaaatcccatctccactaaaaatacaaaaattagccagtcatgctggtgggcgcctataatcccagctactcaggaagctgaggcaggagaatcgctttaacccaggaggtggaggttgcagtgaactgagaccatgccactgcgctccagcctgggcggcaaagagacaccgtctcaataaaaaaaaaaaaaaaaaacaccaactagatataactaagcagcaaattaagcaccaaattatgtattatgtacataataaattatgtattacaaacaagatgtgcatatatgggaaaaatgaaactggaagtggaaaatgccacagaaggaagacctgaactgaatttggaaggaaaatactatacctttgactatagaaaatgtaaggggaaaaaaacagtttgatgacatgtcatgattaatgatgctctattgcatgctaatacaatggagattatcctaaatgatggagacatgaccttcacagaaaaatctggaaggcactgcaaacattgaataattttcatataaactcagatgtgaacaacatccatgctcccaaacatttctccgctagtaataagaagatgattatgaaaatgaaaaccttgttcctttcagctattacgatataaaaagtggttattgttaatacattgtgagatcaagagtgttatacagacaagaatgatgaccctaacatttgctttcaagatgttttgaaatatttgtcaagctggtcattgtgtggagatgacatttaaggattaaaggctctttgcaaactcccctctcctggccatgcctggcctatgcaggatcctttctaataagaaaggatgcaaatgcatgggtggtgacaggcacgtggccttcttcaccgtcactgctaccaggaaccgagggatcactacacatgtctcagttgtttgtagcccctcagggtcaggaaacacctttcaaatccacgttttatttcctgatcgatgaaatgcagccactgtggcatattcatgcatctctgctaagaaagaaataatattcatgcatctctgctaagaaagaaaagtcaaaaatagaaggggaaaaaaaactttttgtgggaagagagaaactggaacaaaatgggttggaataaaagattgatgaagaggtattcaatgcttgcagggaaaaaactgggaaaacaattgatgtcaggaagctttagataagacactcaagaatttcattttaatatttattgcttgtagtgaaattgatcggtatctccggcatgatgaggtcatgaaagaagagattgatgcaggcaaattcattatttctgcttctgttctttctgttttgatattagtctattttctcccaataaactatcctattgcatacctcccaacttttgccatttgtggtaatgtaattttcctgtcatcttttatgaaatactagagtacccatctgttgtacgggtagggataaaatagcttccttcagaagaaaacactgactgtaaacagccaagccccatgaaagacaagtgaatcttctagtggtcctttatcagattatattttctggtgccagggcagcccatcttgcttgaccttttttacttatgtacatgagaaaaaccgtgggtcctaatcagtcatatgataatattctgggtttttttttcctagcatagttattcaactaagatattttaatgcaaatactctgatttcaatttattgaaatcaaggaaataaacataaaaaaatggaaacaaacaatgtaatttagtcaggtatcttgaaagatcaagcactacattatgtgtctcagagactggcttcagaagtcagccgctgtcctcagagacatgactgaccttaaaacgcaggtgacaatgataccccttttcctcagagattgtagcaaatcccaactcaaaatctcacaaaaacaaatcacaacaacagagtctcactctgtcacccagcctggagtgcagtggcatgatctcagctggctcactgcaacctacgactcccaggttcaagcgattctcctgcctcagcctcccgagtagctgggatcacaggtgcctgccaccatggccaactaatttttgtatttttagtagagatggggttttaccatgttggtcaggctgttctcgaactcctgacctcaagtgatctgcatgcctcagcctcccaaactgctgggattacaggcgtgagccagaaaatcacaactctatccagaagatgctcctgaatctgacatccagggggataggatcagctgccttcttggatgtggtgaagggatctttatctcagctgtcttgccgaataagcacatggagctgatttcgattgtgcactgcagatcagcaaaaatctttctacttacactgtgcgtaagctgtatggaaaaagttgtactgttgaaattatttttaatattatcacattgtaattgttagattagattttttttaacttttaagctcaaaggtacatgtgcaggatgtgcatgttagttacataagtaaacttgtgtcatggagttttgctgtacagattacttcatcacccaggtattaagccaagtatctattagttatttttcttgataatctccttcctctcatcctctgccttccagaaggccccagtgtgtgttgttccctatatgtattcatgtgttctcatgacttagctcccacttatatgtaagaacatgctgtgtttggttttcccttcctgaattagtttgctaaggataatggcttccagctccatccatgtccctgcaaaggacatgatctcattcttttttatggctgcatagtattcaatggtgtatatgtaccacattttctttatctagtctgtatgagaatatagacgggaagacaaagagagagtaatgaaagataagagctaaagtcccaccaaaccatcttaatttttgccaccaacttaggatacttccctcatgtcacatgtcaaccaaaactgcagctgtctgatccaccgtctcatgtccaggccaggtggcctctcaacatctgtaataccataatagcttcttccttggatgccctgcctctaccaggccagttccccaccatagccagagggccgaagtcctagcaggtgccatggtgacggaagcagaggatgccagaagcagaggatgccagatgcagggtcaggagctgaggaaagcaggcggcctgcagcaagaaaatgggtccctggagcctgcaggagcaacagccctgccgacaccttgttttctgcctggggcattctgacctccagaagtctaaaggaagaaatttctgttgtttaagttcccacgttcatggtaattgtggggtggggggagcggggagggatagcattaggagatatacctaatgtaaatgatgagttaatgggtgcagcacaccaacatggcacatgtatacatatgtaacaaacctgcacattgtgcatatgtaccctagaacttaaattataataaaaatatatatatataaaaaaaagcagcaatgggagactttacagtactggatacatgaaggttttatgtacaatttttaaaaactagtgaattcaaaacaactgacatacctttagggtcaatgaaatttgaaacaaccacagcaaatactttgttagtgtccatattattacataattattaataacattaagtataccatcttttcagtatttaagtgaaaatttacaatcattcagtaaggaaagttttctgatgaccatagcgttctttttacttggtaactgaaatagtgaaaacagaaaatcataaaggctatctttttccaacaaagccctgactggaaagaaataacaaggtcatagtctctgctaacaagggcaactaactttcctgtaacagttgaagttttgttatagtggtttgaaagattgctgatttataactttgagatttaaaacacttgctataagaatagatttgttaaaatatttgttgtagcaaagaaaaatagctgtgaaagatgcttcctgggagatggtttgtacctggcaactcataatcattagctcacaatgacttcactgatctgggtctaatcaaagcatgaggaatctgaaaatcagaaacatagctaagttattctcccctgtaaaatctattatacaggtgaaaataaaagttactctaacgacacataatctcaacttgtttaagtaataataatttttttcctttttttttttttttttttgagacagagtctcgctctgtcgcccaggcaggagtgcagtggcacaatcttggctcactgcaacctccacctcctgggttcaagcgattctcctgcctcagcctcccaaatagctgggactacaggtgcgtaccaccatgcccagctaattttttgtatttttagtagagacagggtttcaccgtgttggccaggctataaataattattatgtcatattcttaagactgctcagtgcttagggtgagaaagccttcccaagggagggtctgttctctcctgcctggtcatagggcatagtacatctctctccatttattttctattctttgagacaattattcctcatgttccaatattctttttcttttcactgtctttctgtcttgaataaatctccaacatcccccacaactatcccttttaagtttcagatacccagacaacaaagcacataaccaagacgcttgatcacacacacgtgcatgcatacacgtacacacttatacaccatgcatatatgtgtgtgtttgcacacaaaaatcttgcttcgcaaacagaaggcggcatgtaaataactgcttggaactcattggcagataaagaaacagaggagatgtcaattatttaagataacaaatgggtcttttctcttagtattgctcccctgccagagcaggttcaatcttaagaattttacctttatcccacccctctgccactgtttcattttatggccttaggactgtcatttggcttttccttgaccagttctttccataagacttgctggcctttgtttcctttctgatttttactgttctcttgtccttgctgccctcactgtaactggcttctgttcatttctccaacctgtcaagagcatttagaatcccattcctacccagctaggttctgttgccccatctgactttacgacatcctcatgcaaggtgaccatgtactctactccatcaccccagtcactgacgaagagccctgggcacagggctgacccaggcgatacaacacctgtgtctgccaagttaatggcattccattattaattactcgttaggagaaatgtgtgggatgacaggggataacacacacctctaacattcccagacatcgaagcaagcatctcatgggcttctgtggaagttcatttacataagtggttcttgatcctgatcttgtagaggtcataaagcctttgtggatcggataaaagctatggattatcttttcgaaaagctgtgcacacacacatgccacagcattttgcataaaatttcagaagattcaaggatttcccttgaagtacatctctagaactcctggagtttagaacattcaggttaagagtatctagtgaaggtaattttaaatattgtagcatctacattatctttaaaagaaatgtacactagatgccagaagaaaatataatttgaaggattttctttaatctagatgatatcacatatataccttaaaaataatcttgattgacctatgctctcaggccaaagaaagaattattcatgcaatcaaatgaaaatgatttttttctgctgtaaaaagtaaaattattttttaaattgtggtaaagtacacatttcatacaatttgccatcttacccatctctaagtgtacagttcagtagtgctaaggaccacagttgtgcagccaatctccagagccatttcatcttaaaaaactgaaactctatactcattaaagcattacacaataactctcaatctcccccttaacccagtccctagcaaccaacattttaccttctagtctctatgaatttggctactctaggtagttcacagagtatttttctttttgtaactggcttatttcacttagcatcatgtctcaaggtctttgttgctgcatgtgtcaggatttcatgcgttttcaagggccgaataatattctattgcatgttgcatgtatatactgtatcaatttttttttatttttttgaaatgtagttttgctcttgttccccaggctggaatccaatggtgcgatcttggctcactgcaacctccacctcccgggttcaagcaattctcctgtctcagcctcccaagtagctgggattacaggcgcgtaccatcatgcccggctaatttttgtatttttagtagagatgggtttcatcatgttggctagactggtctcaaatccctgacctcaggtaatccacccacaccagcctcccaaaatgctgggattacaggcgtgagccaccatgcccagccgctgcatcagatttttgtttatccattcacacatcaatgattacctggattgtttccaccttttggccattataaataatgctgctgtgaacgtgggtatgtaaaatcaaatttttagcaaagaaatcttactgctgtgtaaatactattgtttgttttaaatttttgaaacttttaaaaatcatttcattgttaggcacaactgacaaaaagagaagtacacaaaacaactcaatgagtcatcaggtagcaaacagtcatatcgccaccacccaagtcaagacacaaagaaggtttccatgtagcgcttgctctctgaggtgtgtctactacacaacacagagttcccatgcagaattaatctggtctccccaagaatgctgccagacagagattagtaatcccatgttctgggttgagtaaagggaagcttagagaatgtcttacaaggtcacatagctagtaagtgatagaaataggattctaaacatcagcctttttcaccccacctccacatgggttggactacatagaggccagctggtgcagtaaaacacatcaattatattaaaattatccagaggtataaatgtgactcatacttggttaatgaccacattgtttatccttttgatattcttcattgtgacttctgaccactgttctaattttgccctttagagtaatttaaacagatgccttaacatttccacatgcaagatcctaagtagctaaagaccgtgggcacatccccaggaagactcattcccaggaattctccctaggttctctcagggaacggcatctccaggcaacttactcccctgactgtcctcttgtggtcacattagtgtgttaacacccctagtaagtaaaggtatgtccagaactgacactgaattttagatgttcactatcaacccaacgaacagttcattcactcattcaacaaatatttctttagagctttgcactattccagactatacctcctctgacaatgctttgattaatgcagggaaagtcacaggcacatttttctactcttgccacactgttgtcttatactgaacatgggatcaagtaaaatctgtatgcgtttcacaggaactactgccaaggaaggtccccagcatcctatatttatataattggtttttcgaaatgatctttgtgctgtcttcacagtagatcaccagggtttcatgtggtaatatttcaaaattagtattttggtggttgatcaacagaatccaataatattttttaaatgttttttcagactttaaaagttaaatttttatatctgtttagaaagaatcctttccttccttatatgcctctccttccttaaaaacaaacaaatgaagtgtgtataattgttctctgttgttatggtttgcatcttatagccatgaactctaacgaccgacttcctatgtgctaaaagtggtaattgatctaactgcattacaatttttcaatataagcaactagttattgaagtggcttaatttggcaaggaaacacctaatgagtcaatggctttattcggttaattcagtgaaaagtgctaatgattcagaaagtttaaggagttattgtaaggccgcctgtaggaaagtactaataaccaagctatgaccaactgcctcaaaagcagggttgccagggtaggcaacttaggatacaaagcactcagtgaaatttgcatttcaaatttgttgttcatctgcaattcaaatttaactggttgtcttgtgttttatctagcaactctattttgcagccttcaacatagcaatgattaattaacaggagatgttaataccagatttacttctccatgggcattcactacccacaaaaaaggtagccaacgtattttgatgtttgacttctgcaaaattagaagacataagtcttttttggaaatggcttaaaaatagaaggggcaggataaaactgcagatgccaactgtcattttccactccatccattcatttcataaaattatacagccagaaaaagatcatttagtccaaatctatttacttagaaatgtcacaagaccaagaaagtatcttacttttcaataattcctcagaatctgacttcgcatctactcaacctatttcattttggatgctgtaaggtcttcagagctagaaaggatgctgcagtaaatctggccatcaggcagctaacaaagagggcacaccagacagcagacaatgggctaatgctggagatggccctggaagggcatgggtcaggttctatgatgtcctggtgatagaagtattccaaggctggacagttctgcaaaagggataggagctggggaaatcaagaggagcagtggccaggaaaaatgtgcgtgacttaggcatacaagatgtataggaccatgaaaaatgggaaagcaaaactccataagaatttttggtaggctgctagttttttaagttacattccacagccggatgtgatagagtcccagtcatgatacctcatgtcactggccaacagggttgattgagccacaaccaggcttatgaagttggctttgcccctactcactgcttcagctgaatatctccctaaactgaacattctggtaaaaatgacatcttcctagaaataagaccaatttaagcataggtgagattcacagtctataatagagaaaaccataatttatgactttttataagctaagtttatcattgctaacactgttctttctttcatgcacacattccaccgacaaacagccaaaaattttaaataaaccaaaaggattcaatacatattcacagttctagacttattggctctagaaattggggccttttccttttgttttatgctaattaggcttgaagtcataatttcccttaaacacatgagcactattaagcgccaattctggggtatttaaagagttacaaagagagtgcaaaaggggaaaaaaaacatgaatacgacctcattcctttctttaaaaggatctcagtatagttaatgaaataagacatatttatatgaaaagttggcatatattgcctgtgcttttatgtaaaagctgcattagtataaaaaacagtaaagattatagaaattcaaagaatccatatcacttttgataggggtgctcaaaatttcattgcagtaaaaaaaagagggaattgaacctggacttaaacagttaagattcaagtaaaactgattatttgagcatctactcaacggggagagtaggcttattcacatatattctctaaatttatgtcatttcattcaaacattaaagcatatcatttaccaataaagcctcaaccatttacttcttccatatttcatatataggtaatgatatggtttggctgtgtccccatccaaatctcaccttgaattgtaataatcctctcacatcaagggcagggccagctggacataattgaatcatgggggcactttccccgatactgttcccatggtagtgaataagtctcaagagatacgactgttttataaatgtgagttcccctgcacaagctctcctgcctgtctccatgtaagacctggccttgctcctccttgccttctgccataattgtgaggcctctccaggcatgtggaggtgtgagtcaattaaacctctttgctttataaattacccagtcttgggtaagtctttattagcagcatgaaaacacactaatacaggtaatgaggtatgctagtagaaattaagtttgtactgtgtttgttttccctatgtcttgggaacagatgtatcagaaactcacacactcactcgattggggagaaacgtggggattctctctacaaagagcacaatcactgaaagtagtctgcctgaaggatagtgtcctatttcaactttgacatgtgatggctcctgagggtagagcattgaaaagaaggcaaaggatggtcgagatacatcccattcacctatttccctgtctcaagtaaatgtatatcctgggaaggacagacagacatgtaatagggagaagtgaggtggctggctacattcagttcagtaattgaatatagatacaggtattggttctgaagtttttttaacatggtaaaatatatatataatctacctttttagtcatttgtagttgcacagttcagctacattaagcatattcacattgttgtccaaccaacaccaccatccaactccagaaatttttaattttcccaaactaaaactccatacccattaaacactcacttcctgattcctacccctctccaggccctggtaactgctattctattttctgtctctaggaatttgactacttgagtatctcataaaagtggaatcatacgatatttctgtgtgactgcttatttcacttcgaatattttccgagttcttccatgtcatagcatgtatcaaaattttattcctttttaacggtgaataataatatcagaatatgaaaaatgcctacagcagcaaaaagtaagccaaatagatgtgaagccaacaaagggcctccatgttatatacatacataccacattttatttatccacttattcattgatggacatttagctactatgaattatactgctatgaacagtgatgtacagatatctgttcaagtccctgccttcaggttttgggggtatatacctagaaatgaaattgctgggtgatcatctatatttcagttgtgtggaaccaccatactgatttccacagcggttgcaccagcaaagtacaagaatttctatttctctacatccctgttgaactttttacttccttttttgttgttttgataatagttatcctaatggatgtggtacttcactgtggttttgaccagcatttccctaataattagtgatgttgagtgtcttttactgagcttattggcgtgattatgaagatttgaaagttacattttataaacatagcatcaatccaggcaggccaaagatataacatttgtgaaagcaaaaacgaattgaaaaaacacaaacaggtgacttttcaatgccattgatcagcatgctacatttagtacttaaatactgaaaaagaaacttaaaaatccaaatatagaataaacggttaagtgtattacgaagcacttgtcacaaaagaacactaagttataaaagtaggaagactggtaggtaatacaccaaaatgtttaaggtggttatttttaagtgtgtttcataagtaagctttgttttattctttacacagtcttcatccttggcactcaagaaatatttcctgattaagtcacaaattgatttttttataatagtgtgtaattacgaaataagaaacaaacatatttgttttaaaaggaaaaataaagtaaactagtaaattggttctgctgtacattagaattgtctagggagcttttaaaataatataaatgtgtggtacttctcttcatcaaagatcagaatctttgggggtggaggagcccaagcatctgtaatattaatacacaaagaaagttgagaactactgttgtggaaaataagaatgaattaggccctttggaagtgttctcttcatcgtccgttgctgcagttgattaaagatgaaccactcaaccagcctaaattgttgacccacaaaaccatgtgcaaactataatagctgttttaatgctctaagttctgatgtggttacttacacaacaacaaattattaactcacttaaaattttccccaataagggcttattgtgtgttaggcacaatacaagtgcgtaacattcattatctcattaaattgtcctaacaaaccaataaggaaaatacattatttcaaatgaaaataggcttgggatgcttacacagtttgctctttagcatccaattccaatcactaatatactaacatttgcctaatataaattagaggaaattaagagagacaaattgcaagatattgcattgtaaatacataatacatacacaaatacacaaaaattcattgtaaataattcatcagcatgcttatttttcaactaatgtaaacactcaacattaggtagtcagttaggtatgcctttggcataactgaataatatatataatatacattgtactcattaggtaacttctcatcattcatcctacttccacccacttaccctgccaagtccattgtctatgactgcacactccatgtccatgtgtacacattctttagctcttacttataagtgaaaaaatgagctatttgtctttctctatctgacttgtttcacttaagataatggcctcccgttccattcatgttgctgcaaagtacatgattccatgttttctatggttaaatataattttattgtgtatatctgccagtttctttatccaatcattcattgatggacacttaggttgattccatatctttgctattatgaacagtgctgcaataaacacaaagtgcaggtatcttcttgatgtaatgatttttcctttgggtagatacccagtagtggaattttaaaactgtaatagaaatacaaaaagccaaaaaaaaaaaaaaaaaaaaaaccaagcattttaagatcaaacaagcaaaaaaaaccaaaaaaaaaaaaaaccccacaaaatttcaagatacttcaccaaaaaaaaaaatatatgaaaagcaaataggtaaatgaaaacatgtgcaacatcattaaccattaagaatgtgcaaattaaaaccattaagacaccactacacacctattagaattgttaaaaataaaaagactatttcaagaattggccaggatattgtgctgctaattgggaatttaaaattatataaccactacaaaaacagttttgcattttcatgaaaggctaatcatatacctcatatggtctagccattccactcttaggtattacccaaaagaaatgaaagtttattatgaaatattgaaaaaatgaaaatgcatttctaaacaagccttgggtaaaagaagaaatgaaaatggaaattaataaaattcaaaagtgaatgaaaatgaagacataacataacaaaatttaggggatgcagctaaagcaatatgcaaagaaaattttttgggactaaacagaaaaaagtttccaattgtcttcacattccaccttcacaaacaaaaaatgaagagcaaatgaaaagcaaagcaagaagaaaaaagaaaacaataacgatcaaggtgaaaaatcactggttgagaaaacagaacaataggaaaaagaccatgaaaccacaactttgttctttttgttgatcaataaaaattatactgtcttgtcaggctgatcaggaaataaagagaaaggatacaaattaccaatgtcagaaacaagagaagtgacaacactacacattgtagagataccacaaggataagagaatattctgagcaattttctacctataaatttggcaacttagatgaaattttacaattcctgtaaaggctaaacacaaggacctactaaatttcaagccagagagaaaagaaaacttgaatagacttatgtctattgaagaaactgatactgcattaaaaaacctcaaacgaagaaaacttttaggcccagatgtcttcactaatgaagtctatcaaacatttaagaaagaaaaagaagcaattctacacaaatgcttgagaaaagtgaagacaaggcaatacttccaatttattttttttcagccattattactttgatacaaaaacaagacaaagatattgtgagaaaagaaaaccgaaaatgaatattccttaagaacacagaaatgttaacaaatagaattcaacaatatgtcaaataacgatacattgtgactgaatggggtttcacccaagaatgcaagtttgatttaacctttgaaaatcaaacataatttaccatggtaagagagtgaaaaagagaaatataatactctcataaggtttaaaataaaagcatctgacaaaaatctgaagtctgtcttatacagtcccacagcaaattaggaaaaatagagaactttctcaacctgataaagatcatctatgaaaatctacagttaacattacatttaatgatgaaagattgtctactttccctctgagattgaggccttaatgttaagtcttacaacttccactcaacattatactggagctgatagccagtgcaataagtcaagaaaaataaaatgcataagattagaaaaaaattagaaaattcctattctcaaatgacttgattgcctccatagaaatttctatagaatctaaaaaatgtcattaaaactaataagtaaacttaacaattatctcggttataaagtcaatatacaaaatatctaaaattggaattaagaaacaccatttacaatagatcaacatataaaatacgcaaaaataaatttacaaacagtttgtgtgaattgtacactgaaaagtataaaacattgctgagtgatattaaagaagaaagacctaaataaatggagcagtatttgctctggaattggaagacgtaacattattaaaatgtcattattccccaaagtaatctacagattgtcaatcaaaatcttagaagatggtgatagaaactgacaagctaattctaagattcatgtgacaatgcagagaacctgaaacaggcaaaaacattttgaaaatgtagtacaaaattaaaagactaacaccatctgacttcgggtctcattgtaaagctacagaaatcaagacaatgtggaattgacatcaagataaataaatatatcaatggaacaaaatgagggtaaattcaaaaatatgttgaccattgagcttttgaccaagtatcaaaggcaatttaattgataaaggacggtcttttaaacaaatggttctagaacaattgactatccattataaaaatatgaactatggtctatatcttgcatctcttgcaccatatataaaaatgaacttgattcacaatagcaaagacttggaaccaacccaaatgtccaacaatgatagactggattaagaaaatgtgacacatatataccatggaatactatgcagccataaaaaatgatgagttcatgtcctttgtagggacatggatgaaattggaaatcatcattctcagtaaactatcacaagaatgaaaaaccaaacaccgcatattctcactcataggtgggaattgaacaatgagatcacatggacacaggcaggggaatatcacactctggggactgttgtggggtggggggaggggggagggatagcactgggagatatacctaatgctagatgacgagttagtgggtgcagcacaccagcatggcacatgtatacatatacatatgtaactaacctgcacaatgtgcacatgtaccctaaaacttaaagtataataaaaaaaaaatgaacttgaaatggatctcaccaataaatgtaaaatctaaaactgaaaatttgaaaaaccacttatagaaaaaaacataagagaaaatctttataatctttgcttagacaagaatttcttagataataatacaaaaatctataaaaatctataaaagacttcatttattttgactgtcaaaataaaaaaaattaaagacttcaaatttaaagatttttttaaaaagccaaatattgagagaatatcttgcaaatcacatatttgatatatgatatattcttgtatctaggatatatataaaaattttcaaactcagtaagaaagcaaacaatcatattgaaaatactaagaaaaagatttaaacaaacacttcatcaaagaaaatacttgagtggcaaataagcatgaaaagatgtgcaacatttttagtcattagggaaacgcaaaataaaaccacaatgagatactactacaaacctatcagaatgtctaaaattaaaaaggctaatcataccaaatactggtgaaggttgggaataactgaaactcccatgcaccgcttctgggaacataaaatggtaatcagtttggaaaagattttggtgatttttacaattgagacataagctgatcatatgactaagctattctactcctagaaatgaaagcatatgtctattcaataattagtacacaatattcagagtaactttatttataacagtgcaatagccaaaaatgtgataaaaacaaatgtcaatcaacaggtaaatgggcaaatactgtggtaagtctacacacctgtatacaggtgtgcaactttctagtgtgtagatttaccacagtgtttacccacttacctgatcatttgtttttatcacattaaatataccagcaacatgaaaaaattttaaaataattatgtttaataaaacaggccagagtaaggagtgcattctatattattccatgtaagtacattatagacaatgcaaactaatctagagtggcaggaagcagattagcagcttcttgaggctgggaaagagtggggaaggtgccgcaaagcagcacagagaacttcttggggaatttctgtgtttactgtcgttactgtggtgatggtactgaggtatacaaagacactaaaattcacaaacatttatatgccagatacatgcagtttattgtatgttgattatgcctcaataaatccacatgaaaagaaacccaaattaacccaaaattatttgtaggggtaaagtaaatgcattagaatacaggtagacaaggagatactggaaatcttgaacagtatcagtaatgctttgctaagcactggcacagggggtccacaggtgcgcagggggtccacaggtgctcagttcataattctgcttcacaacttgcacacacactataaactctagtatatataaaatagtaaaaatattgatccttatatacaattaaaatggcctctatttcacaatgacaaatatgtgtgtatatgtgtacgtatctatgtgtaagtgtatatgtgtacatgtatatgtactggaatgtgtatcggcatgaaggggaagaataaaaataaaaataaaatgacaaaaatgtctcacatgaaccaatggcaatattgtgtcctaaactagtgagtatgactaattcaacttttgcatctgatgtaaaacaaaacaaaacaaaacaaaattactactgttgctttaatccactgggtgatttcccagtaatttaatttaaaaaaactggcattaagaactaagcagaacgaggatattttaatttggaaaaaaaaatccataaatacacaagtaataacattattttaaaattaaatgactgatttcagaaggaaatgttttcaacaactttattagtgctagagccctcatgccacagctcctggaagacttcaggctctcaatttaagctctttgaatgtaaagagagccagacaaacagcttttcttctgtaacactccatttggctggttaacacaagttatcgattctgggatttagggttgccaaatgctttcttaagagctctgtgctattgactatcctcgtttcctctgcacttcttttcttagtcttgggtaaaatttaaaactctttgtaccatttttcaactcatctcgacggaaacagcctcaatttactataaaaatgtcaatggctcactagtgacctaacctcaaaggattgggaacgctgcctcagacatctcttttctatgttcccagggtctacagaggctctaccacaacaagatggggaagcccagtctgtaatccagcaggacagtggaatgctactggtgagacctacaaactaagtctgcagcacagtcctgcagcttccccgaaagctcagcccaacaagcttcctgaatttcacattcattttacacaacatacatgttagtagatatttttaacgtacatatgtctatttaggggaaattattagcatcattattgccaacttacaagttattattttgcaagttttatgccctttagaagtgactttgtaacagtttaaaatattattttctttaggtaaagagtcatatttgaaaaagagtaagtcaaacaaattgtatacattttataaatttgttgaaaaccttattcttagagactgtaaagcaatggagatctttgcaaacatccgtggtcatgtctaatggtgacggcacacataatagccaatcagagctcagtaaaacataagccagcaaatcagaggccgctcatagaaggagtccaaattcctttactgcaggatgaataacttgtaaaatcctaacattcacattctaatcctctgaatgaatgctgagtagggaggagacgaagcttagaagcaaaaggaagcttgcatcctttgatgtcctctattgttgaagttacaacaaattaagacaaaaataatagttatgttagaagacaaattaaatacacgaatcataaagtagaaagaatttttgaagaaatgatattcagcgttcccagggattataagtcaggcaaaattaagtcatgcagcattttaatgtaaatattttgcatgatacatttacccacaggcttatcctaaagcagtatgtttgcacttttatcatttgccttaggatgaaaaaaaatcaatgaatttaagagttttaaacctctttaatatttgcacaatattagatgtgctataatctcatataaaactacctcctagagagcttttgagaattgcttttgcctggggtctctggtactaatacttcaagagattagaaacatcttacttaagaagagttttctttttgcccattaaaatcaaacaagctttgttaaacactgaggcagaagagattcataaatcaatgatactcccctgaactgcccaaggtttgcatcatagattaaaaaccaatctcagaattgaaaaagctacagtgccacatatctgtcacaacactaatttactgaacttaggaagaaaataacactagcatagatttaaatagttttctatgcaatatgcaatgaatcaatgtactgacttgcttggggtttatgaaaacaacaactgacaatgaatatcatcctaagtaaagagaggagttatggtttaaaatcatgtgactacacaattcctacatttttttaaagaataatttacatcaaaatttttctctaactctaccctattatcacagattcttttccttgcattcttttcaatactatttatctgctatgaataatatttccatgtttaaagcattctattattttatgacctaacaaactccaggatttaaacaatgctcatctaacaggaaataccgcccttccaatctaaccttcatatgctttcgttttcttccttttcttctctctgaacatggaaaatgagtgccatttctatgctgaatattgatcaggagagaaaaatatatgaggtgtgagttatattgtgactacggtgattttccatccactcagtattacttatcgtgtcaatcacttaatcctgcagcataagttcttttttgcttatgatggaaagttttgttgtgttttattttttatttttgttttttgaaaaaagacatgagcaatctgattttctttggacttcacaaaatccaagaaagaagatttactgaaaattcatttcttaaaaaatgtgaggtccttgacaatggtcttctctacagtttcaatgttaggttttgaaaatgtgaggtccttgacgacggttttctctacagtttcaatgttaggttttgaaaatgttaggtccttgacaatggttttctctacagtttcaatgttaggttttgaaaatgttaggtccttgacaatggtcttctctacagttttcaatgttaggttttgaaaatgttaggtccttgacaatggttttctctacagtttcaatgttaggttttggtcatctctgagcgtgcataacatgaatggaaagtttttttcggagatcagaccgttatgatttttggaagtgtttcctgtcaaggagaagctcatggtctccaaggtcttatctttctactgggtggatgggccaagggaacacgaagaagcataatggagctctgtctgagagaatcaccagagtcttccccagcgtttctcaatggtctacaaacaggtctgcgggcttggatcacagacggagatccaagatgggcatgggcatttacgtgggcagggcaagcgacgctggccacactgcaaggccctcaacgttcccacgtgaaaaaagaaattgttcctcaaacagcaccactaggtcgggtgcggtggctgacgcgtggaatcccagcattttgagaggccaaggcaggcgggtcacaaagtcaagagatcaagaccatcctggccaacatggtgataccccgtctctactaaaaatacaaaaagttaatgggcatggtggtgcacacctgtagtcctagctactcaggaggctgaggcaggagaatcacttgaacccaggagacaggagacagaggctgcagcgagccgagatcgcaccactgcactgcagcctggcaacagagtgagattccgtctcaaaaaaacgaacaaacaaaaaacagcaaaacaagcacacgtgagaagccctgcttgttctgtgaacacagtcatttctgcctttccttcacagtaattcaaaagcatttactgaacaacgaatgtgtattagaacttacaaagatgggtgaataagaaacagctccttccttcaaaggtctccctatctacgggagaaaagagaccggtaaataaagggccgtgcagacgtatcttataagtgctgagctagcagcaggacaaacgaataaaggaagaaatggcagctctgatattaaagccctcagctcctcctggaaagaggaaccaagccttggtgaagcttcagagaagaaggaacaattaaaacaggctccagggatgaggagaatggactggatggaggaggagcgagcggctgccaaggtaggtgtgcctccaagcacagaaggcagccaatggtcatgcccggttcctgggccagagagcaggggggtggtaccaggtggtgctagggcccctgctacatggctggagtttctcttcttctctagttcattccatgttctaaacacaacaaatcacattgcctccaggtgttaggaccaagaatattaaggtcctgaaccaaaatgccaatatttggtaaaatggcattccctcatttatatatataagtgcgtatctgtatgtgttcgggtacttctataaaatctgccagtttttaacttcctaaatataatggctaactcttttattgtagacaaaataactaaataattgcacagacataatccaacatcatgggtttgattttcttaagggtagaacagctccagccatataaatgcagtgtgtgagtgaaaatgaggacggaagagcgggtgcagcacgggggacccagcagtccttgagccaaggtctggaccctcaaaagcagtggacgtggaaggtggtagctccgatagccagtgggcatatacgcacagagagcctcactctccagctccaaagccttccatatcgatggctccttttagcactacagggtcctaaggagagatgtcaaaaatgtttaacaaccgttgcagcagtaccgggttggaagggactccgtaagcaagttcctacctcctgagcatcaggtctggccttggtgatggtttttctctgtcaaggagattttcagcatttgcagtacattaattttatgcatgaaatttatcttcatgtactgttcctttgtttatttttgagaggaatataaaggggaactaagaacaaacttttgctcgaagccctactctagaaagaattctagagtaacaggatctctaaatttcaaaggaagccaaaaaataaaaaaataaaaaaactcaataattttgtacattttatatatgttttggtagaataaaataaatcctgtaaaaccacagaaaggtaatttaagtacttggaaatctatgtcaatatagccaagataatggaggtaaactaacctggatcagagaaaacaaaagttggaaaacactgagggatcatcttgtcggcctatcagaaacggtatccaatctacaacatcacagcaagtcaacatccgatttcttcttaaggctttccaacagcaagaactttgccatcttacaaggcagtccatcctatcaatgaatagctctacgtcttagaaagttcccctcaggaaagaaatctggtcctctatacctttcatctatcaatccaagttctgtcctctggtgtcctaaagagcaagtcaggtcttttgaaaaagatgtctcttctcatatttccagtgcttatcatgtgcctctataattatgctcttttccatggtttataagcacattgctgatgtgatgtggggtctctgcattttttcttggtgctgtcttgggaagcggcatagtatggtggtatcttctgaaactgcagactccaggcccaaatgggctgtggaaaggggaccttctttatacatgtacataagttctgagcaataaaaaattttattctatctggtatttgtgcagtagctttttataaaagaaagcaaacagcttcacctttgtttctgttatatatcctcctgttggttcagcgcataattccaactataaaggctgaaactgaattctagatattgagtctgtcactcagggcatccgttgttcctgcaagctcagaaccaagtctgctatgcattccttctgtgttttgtacaagcagatggaaaatgtctgaaacaaaaagaaactaaacaggtagtgctttcacatgccactagagatttccttctacttcaactgtgccattgtatttaagtgaagttctggaagttacaaatccccctgttactctgctgtcctatgaaaggctatgaagaaggtgcatgtgtgaaagtgccagctgcttcactgacacactcaccttcacagcctaagcaagggtgttgatcccacttgacacatcaggaactcgtgttgtggaggcattcaacagcccacctaaagccactgagtgggtgggaggcaggtgagtgactgcaatacagaccccaggggtccttcacttacaaacacatcaagagaagacacagtgttgatgcccagatatatcgtttcaggttttccatcactctattacgattttagaaataattttaggcagggcacactggctcacacctgtaatcccagcactttgggaggccaaggcaggccgatcacttgaggtctggaattcaaggccagcctggccaacgtggtgaaaccccatctctattaaaaaaaaaaaaaaaatgccaggagaattctatcacaagaagcacaaggatgatctgtgccccgccataattcaatcgctcccaaccaggcccctcctccagcaatgggaattacaatttaacaggagatttgggtggagacacagagccaaaccatatcaaccatcaatcctaaacagtgggtttaactttcctttcaggtctcagaaaagtacacaggacaataaaatatgcccgcttcatcatttcatttatgtatccatcccttcattctttcatgctgtaaacaacataaactgtagctcattcctttcttctgctctatgaaaacatttttacagcttcccatctttcttcctacttatccttggttacttgtcatttcttcagcatttgtacttcccctttcaaaatgtgagcttggtggacaccacctaaattggttttgttagatatcaccccatttttctttctgagtatcatcacatgtcagtaaatagttggaatttattcttccagaaccttaaatcaaattccttcagaggatctagaccctgccttttctagaaatgtggaggccagttttcctaaaagccatagtacgtgtctgattgacctggcattttctttcttgctgactgagacctccgtagcggtggggttattgtctctgacactgcaactcagtatggaatatgtgttccccttgtagcttcctccaccatttttgagaatgcatgttaaccaataaagtcaaaactttaatgacttttagtgggatgtattcagatatttgttcattcaataagtattgatcaatttcttgcaaaatgccagtcttgtgacctatgtagttaaaatgtcacccctactcttccttcccaagaactctgccatctgctctttaaaggttacaaatgctggctcagctcaaccagaattaatccaggcatgtggtttctttggctaacatgttgcattacaaaacgaagtcatttctccaaaatttcacatacaagatttcacatacaattccaaattattaattcctcttgaaaaactggaagacaactctgagactatatatccatagggccaaaaccagtgagagacaagcagcagcttcccctgcagaaaggttttatttctccatgtgaatgaagataagttctccaggagcagtgtcaacacagcacacaacctggcctgcgcccctctctctcctgagccctgtaggcatccaggtttatacctcctgccctaagtaaagcctcaatcctcctctcctttaggacgcacataaattatttctgccattcctgctcccttggattggtaaattatcgtatcagtataaacccatgccatcactagcccatatggcccttcatgaaaaattggaaaaaggcaccctaattctactttatatccatctgttggaaaattgctgtgaattactgattttgtcatatgaagttacatggcttctttatcccagaaatttatcataataaataaccaatagcaaatcttggaatcgcactgtgtgaatggtgtccctccacatgagacactggcaggcagggcccagacagcaccaacatccacgacagcccccaacccacacctgcttgtcacctactacagttccatccaatagcaccaccaccaacacttccactgccccacacacagcttcatgaaggccattatgccaaggggaggttttttccttccaactattatttctatgaaattttttccttctaaaatttgctctccaaatattttaccctgcacagggctctacatgctgctatttgaaagaccagtagcagaatcttcactaaccttccaaacagatattttgagataatattaaggggactttatttccatagtttaaagaaatattttgccctgttactatactttttcctattttgaattttaactagagaaagagacccatatattcttgatgtgaaaagggacaagttactctttctctgctactctctttttataaaaaataaagcaaataaaatgccacattaaaatctttttttttttttttttgaaacagggtctcactgtccctcaggctagagtgcacatgcaggcacacctcttgtcattgtgcttcaagttgttgtgctttgaagatactgcattttttaacaaattgaaggtttatggcgaccgtgcatcaagcaagtccacaggagacattttgccaacagccatgtgctcacttcatgtctctgcatcacattttggtaattcatataatatttcaaacttttccactatcattatatctgttattgtgatgtatgatccacgatcactgacataaatatcgtctagttttggggcaccaccaaccatgcctatataaaacagcaaacttataaatgttacatgtgttccgactgatacgccaactgcctgttagacactgtctctgtctttctcctcaggtgtgcctcccgatagcctgagacgcaactatactgtattagaccaattaataatgctacgacggcatctaaatgttcaagcgaaaggcagagttgcatgtctctcactttaaatcaaagctagaaatgataaagctcagtgaggaaggcacgttgaaagccaagacaggctttgcaccaggttggctgtaccaacaagttagtcaagttgtgaatgctaagaaaacttcatgaaggcaatgaaaagtgctactccagtgaacacacaaacgaaacgaaagcaaacagccatattgctgatatggagaaagtctgagttatctggatacaagatcgaaacagccacaacattccctaaagccaaagcctaatctaaagcaaggccccaactcccttcaattctacgaaggctgagagaggtcaggaagctgtaaaagacaaggttgaagctagcagaggttggttcatgaggattaaggaaagaaactgtctccatcatgtaaaaatgcgaggtgaagcaacaaatgctgctgtagaagctgcagcaagttatccagagcatctagctaagattggatacaccaaacaacagatattcagtgtagagaaaacagccttttattgcaagatgccatctgggactttcatagctagagaggaaaagtcaatgcatggcttcaaaacttccaaggacaggctgattatcttgttaggggcaaatgcagctggtttaaagccaatgctcatttccattaaaatcctagggcccatcatgctgaaatttctgtggccatgctctataaatggaaaaacagcctatatgccagcacatctgtttacagtgtgttttaccgaatattttaagtgcactgttgagaactccagctcagaatattactgcttattgacaatacaactggtcacccgaaagatacacaaggagattaattttgtttttatgcctactgactcaacatccattctgcatcccatggattaaggagcaattttaacttgcaagtcttattatttaagaagtatatttcataaggctatagctgtcccagatattgagtcttcttatggagcttggcaaagatctttgaaaaccttctggaaaggattcctcatcctaggtgctctaacaacattcatgattcatgggaagaggtcaaaatatcaatatgaacaggaattagaagatttggattccatctttcaatgacttactcctcagtggaggaagtcactgcagatgtggtaaaaataacaagagaacaagaactagaagtggagcctgaagatgtgaccaaattgctgcaatctcattacttgaatggatgaagagttgtttcttatggatgattttgtttttgtttttgagacaagagtcttgctctgtcctccaggctggagtgcagtggcctgatcttagctcactgtaacctccgcctcctgggttcaagcgattttcctgcctcagcctcccgagtacctgtgattataggtacacggcaccacgtttggctactttttttctttttcttttttttttttaattgttgtatttttagtagagatggggtttcgctaggttaggcagggtggtcttgaactcctgacctcaggtgatctgcctgcctcggcctcccaaagtgctgggactacaggcatgggccactgcacctgacctgtaggttggttttgagacataatgctatcgcataattaatagactacattacagtgtaaacataacttttaaatgcagcgggaaaccaaaacactcatgggttgcactttcttgctatatttgttttaccgtggtcttctggaatctaacctgtagtatctctgagggtgtgcctgtaacaataccagagttcattttttctaaatataccttttgttaaatcaccaccattttcttaaaaagcaatatgtttatgccaacaacatactcagagtgagattaaattctttaaaagaagttgactttttgaatgtaataaacttaatatataataattacatcaaactgctcttatttctcctattttatcgctcaccagtgattttgataatgccttcttctcctcacccttctacacagttcaaggccaggcctgccattccttcagaggtagagggctacacaactggtaagtccatgccgagtgaagcgagggtggccaactcttccagcaaagagaggggccctgggacttgagactttaagtgctgaaacaggaaacgtcctgggtaaactggggaggattggtctcacttaagggcaactagattcaagtaattacagtgattctgccacacaccttggctttctctgagcagtgcggcccatctcacactggaatgcgtgatgctaaagaacctctacagggtaagcaagggcagcaaggacaatggaatagttgggctccatctgtgaaataccagagcagcaaacaggagtatgagaggtttccataacactttctgaagactgtttgtcatttttccacttatctaatcaggtgttttcataaaactcaacagaatatgtatacaagtataaaatgtatacaatgtatacaagtataaaatgttcatattactctatcttcacctcttcttctttttcactagaaagatgtcacactctcaatgccaatttcagtctatgttacagctacaacgatacctcctctctctggaagcctcaggggaatgtctgggtaatggagagcaccgtatccacactttacaattttaaaacttaaagccacacatctgcggcacatgacagtgccaactgccaagtactgaactgacagagattcacaccataatgctaattctctgcacaaggaaggaataaaagtatgtgtcaaaaatctgaaaatgattgatgcctgccatctcatcaagactgtctgtcacacgatttcgattgatgatttgagattgcatgtgagcgggacgcaggtgctgcaggttgcctaactagctcaacacttattctcaacaacacaaagacaaattaatctccacatcagaatactttccataaagttcattagactttactacatctacaaaaggcttgaggtggttggcctaatctcagggatactaaattcctaaccatagaggacagctcaacaaatcagccactttcaaaggtactggtgagtccaagagacccaaaaatgtgagaagcagtgctctggccattgtgaaggcactgaattgttttcatcactgggggagaacatatctactctcagataaggatatccctggattttctggctgtccagttgagactgctaaggactcggtcagaggtgtaattagaagaacaacttgtgatttcagtgattatttctaaagcacacagtactgtttaaacatgactcttatgtatcttgtgactacaaatattgaattagtaaactctcatctctaaaaaggaaccccaaatattgacttgaaaataaccacttttagccacaagattatagatgcaacctgttgaaccatttagtatgaatctgcctaattaagcaagaggatttcaaataaccaaatatttctattataaaacacaacccaaaataacagttaagaaaagttatctcacctcccccatcctcacataaccaaggtatttgaaattgttttaatatttgcataaatatttaaaaagtttcacctttaacagaataggtaactagacgatgcctcatcttttctcagagttcaacacatttggacccattctttagatgaatgcacttgtttataaaaatgtgtgatgaatgtcactacattagcacgtaatagataatccaagttattttcagacttaatcagttgtaagtaaagtgtgagggatttgagaacacagagagagggctggtggctctgcagctcctggtcaacatggaaaatatgcagcatttcccgtggagcctctcagtctcgctggcagctgcaggatcagcaggtctcgatccatcatcattcctccttggccccatacgggctgtgaggacacctgggtctaataacagaagctaatcactcggcagtcatttatgaaagagacataggaatggaaagaaaaccaggaaaaatgaaacagatgaatacaaaagtacgctgaagagactgatgttaaatggaatgggattataggatattttaagaaaatgtgagagtattacaagtaacaaactacttctaatagcaaaatattgccataaaaatacattattaatgttacataatacacaatatttcattataacatattataaatgcatctttaaatatctttaaagttttaagaggataaatctaaaaattaactttccgataagtttggaacatgcatagaatgtagagatttaactttgataaataactctgtactaggacagtggcccgggagacagaaggagaagaagcatttgctcctgacttcaaggttcttaccatctccaggagagacaaatgtacaattataaccacagcaggagatgataaggctaataggtaaatctaaaagaagtagtctctgaaaaagagtgttctctccctctccctctccctctccctacggtctccctctctttccacggtctccctctcatgcggagccgaagctggactgtactgctgccatctcggctcactgcaacctccctgcctgattctcctgcctcagcctgccgagtgcctgctactgcaggcacgcgccgccatgcctgactggttttggtggagacggggttttgctgtgttggccgggccggtctccagcccctaaccgcgagtgatccgccagcctcggcctcccgaggtgccgggattgcagacggagtctccttcactcagtgctcaatggtgcccaggctggagtgcagtggcgtgatctcggctcactacaacctacacctcccagccgcctgccttggcctcccaaagtgccgagattgcagcctctgcccggccgccaccctgtctgggaagtgaggagtgtctctgcctggccgcccattgtctgggatgtgaggagcccctctgcccggctgcccagtctggaaagtgaggagcgtctccgcccggccgccatcccatctaggaagtgaggagcgcctcttcccggccaccatcacatctaggaagtgaggagcgtctctgcccggccgcccatcgtctgagatgtggggagcgcctctgccccgccgccccatctgggatgtgaggagcgcctctgcccggccgcgaccccgtctgggaggtgaggagcgtctctgcccggccaccctgtctgagaagtgaggagaccctctgcccggcaaccaccccgtctgagaagtgaggagcccctccgcccggcagccgccccgtctgagaagtgaggagcccctccgaccggcagccgccccgtctgagaagtgaggagcccctccgcccggcagccgccccgtctgagaagtgaggagcctctccgcccggcagccaccccatctgggaagtgaggagcgtctccgcccggcagccaccccgtccgggagggaggtggtgggggtcagccccccgcccggccagccgccccgtccgggagggaggtgggggggtcagccccccgcccggccagccgcgccgtctgggagggaggtgggggggtcagcccccgcccggccagccgccccgtccgggagggaggtgggggggtcagccccccgcccggccagccgccccgtccgggaggtgaggggcgcctctgcccggcggcccctactgggaagtgaggagcccctctgcccggccagccgccccgtccgggagggaggtgggggggtcagccccccgcccggccagccgccccgtccgggaggtgaggggcgcctctgcccggccgcccctactgggaagtgaggagcccctctgcctggccaccaccccgtctgggaggtgtacccaacagctcattgagaatgggccatgatgacaatggtggctttgtggaatagaaaggggggaagggtgggaaaagattgagaaatcggatggttgccgtgtctgtgtagaaagaagtagacatgggagacttttcattttgttctgcactaagaaaaattcttctgccttgggatcctgttgatctgtgaccttacccccaaccctgtgctctctgaaacatgtgctgtgtccactcagggttgaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaaaaaaaaaagtagtctctgatttttgcaattttatttcgtgagaaccaagaaaatcagaaaagctctctaattctatgcattttgtcccaattactcagtttctctatttcaagtaaattggatataacacttgaataggattctgccttgataagtatttatccaaccttattctaaagtttaattcattgttctgaaaattggatgaaaaaagtgaacttcttaaaggtttgtgaataaaaaatatatagtcaaaccataatgaaattcttcctgaataccaatgtctagacatttccctgtagaaaactggcagatatctaatagagtattgcttctgaaaattaactgtgtagttctgtggtacaaaatcacttgtaaaaaatctcctggtgtcaaaacagcatggaactggtaccaaaacagatatatagaccaatggaacagaacagaggactcagaaataacaccacgcatctacaaacatctgatccttgacaaacctgacaaaaacaagaaatggggaaaggattccctatttaataaacggtgttgggaaaactggctagccatatgcagaaaactgaaactggaccctttccttacatcttatacaaaaattaactcaagacctaaacgttaagacctaaaatcataaaaaccccagaagaaaacctaggcaatacctttcaggacataagcatcggcaaagacgtcatgactaaaacaccaaaagaaatggcaacaaaagccaaacttgacaaatgggatctaattaaactaaagagctttgctcagcaaaagaaactatcctcagagtcaacaggcaacctaaagaatgggagaaaatttttgcaatctatctatctgacaagggctaatattcagaatctacagggaacttaaacaaatttacaagggaaaaaaaaacatcaaaaagtgggcaaaggatatgaacagacacttctcaagacatttatgcggccaagaaacatatgaaaaaaagctcatcatcactggtcattagagaaatgcaaatcaaaaccacagtgagataccatctcatgccagttagaatggggatcattaaaaagtcaggaaacaacagatgctgcagaggatgtggagaaatagaaacacttttacactattggtgggagtgtaaattagttcaaccattgtggaagacagtttggtgattcctcaaggatccagaatcagaaataccatttgacccagcaatcccattactgggtatatacccaaaggattataaatcattctactataaagacacatgcacatgtatgtttattgtggcactgttcacaatagcaaagacttggaacaaacccaaatggccatcaatgatagactggattaagaaaatgtggcacatatacactgtggaatactatgcagctataaaaaaggatgagttcatgtcctttgcagggacatggatgaaggtggaaaccatcattctcagcaaactaacacaggcacagaaaaccaaacactgcatgttcccactcataagtgggagttgaaaaatgagaacacatggatacagggaggggaccaacacacactggggcctgtcagggggtggggggatgggagtggatagcattaggagaaatacctaatgtagatgatggattgatgggtgcaggaaaccaccatggcatgtgtatacctatgtaacaaacctgcctgttctgtacatgtataccacaacctaatgtattaaaaaaaaaaaaactcctggtgtcacttcggccattcaaagtcaaatgttcttctaaatctaggtattcattaaattaacattgtagagggtttgctttttaatgaaatagttttttttgaaacctcactaattggtatagtgactcttgcatggctcttccatcggtatacatatttaagtttgaattattgctaaatcctctttgtgaataactaacttggccttgttctttagttctgtgtcaacctatttggtagaaagtggcaaaagtagaggcaagaatatttcaaatcatgcaagtgatgctgaactcagtttctgtcatatatttaagcacatctgattatggccaacgtttcccttcaactttcactctacatgattgcaatatagtttttccacgagtaagtgagaagtgcagataatactttcaaaacaaaacaaaacaacgttggtgtttaataagaccctgaataagctattgatctgtgaattagcaccaggcacgatgtgaagtagtttacatatattatctcatatcaccttcttaataacttaatgaggtgctattatgataaatattatagggtgaaaaggactaatcattaagaagtcaggtcacttgccaaagtttacatagtaagtaagtggtggacctgggattttgactcattgattaattgacacgacaaataattaagtgtctactatgcaccatgcagtgtgctagggagggaagaatcatttacttactcctcagtgactctaaggcagatttaaggcacggcttctctaagctcttgtgttgtcatttgccgcatgacacagacatagaaactagagtgattttcctccttgtcaagcccaatcatggtgatgattttaaaaaatattattaatgattacctttggcttctaatccctaacgtgatatacttatctactgattacagaaatctttgcttagttttattttccaagcaaacacaaaatatgatggtaggaaaaaagagtccaggttgctcctttcataaaatcttattcctaggtttctctcttgtggcactttaaaaaaaagtatccatgaaagccaaggattgatgtaaataaccattaggaagagcttaatgttgacaagtagaagtcgagtttgttttagaaaaacaataggaaaacctgttatatactgtctgcaatgctaaataaatatttctcatcagaagaaatatctgcttattacatttttgtcttcctgattagtatgctttattcctgacatcaacttgaaaaaagatgcaataaatgagaagtttaaataacacaggtataagactgttaaccttgggatcaagggattatttgttaatatttttaaaatgataatacctttatattaaggctaggttctagacgcacctcacattctccacccctttctggctttgcagaagccatgactgggtctgtggaataaagccttagccatcccgtgtggttgttgtttgctactacagcagtagccatagctcttaccctcccctaggaacagcaagttgcattgctatcctggtttcccagaaacagtaataagaaaagagtaggaagtataatggtagactacatggtggcactagtggtggatcaggtgaagtatattggatatctgagactagatggggtttttttaagtgtacttacataggatcaaacaacatttaactttctgaatatgcatttagtaagtataaggcacaagttgtttctgtacattcattttcatggaaggggtgtgtgtgtgtatgtgtatgtgtgcaagcatgctcacaagtgtagaagacagggattatagaagtaaaataataatgcaagatatgcaaaatttaaacagttaaaattttaggaaacctacatgatttctaatgttgcaagataagaaagcttctgctaaaaccaacatatacaaaaacgttacttatgaaatacttttgtagagatttcacccatgagcaatagaaaaaaaggaaagttatttaatatattagaaaaccctaagaaacgtggtctgtggtcactccctctctggcacctttaccacagtgatgacagagctatgcggaaaagaatttctgtgccagttcagccatctgctgttggctcacaaatggagttaacagtctaaaaggaaagtttgttttgaggtgccattcccatgtgcatacaatccacaaactgcagtgtataaacgtggctcagtctaataccaagttaagacttggtttttttgaagagcatattgcacagcattttctggaaatgctcccaatattagatacatgtcacattcgcatagaaacatatggtcttcaatgtgcaatctcaaatcgtctacagagactctgcaatcagagattccctgttttaccttccttttataagtcaattttcacttagcaaactatcacactgtggtgatttggaggcattattttaattcctaatgtaaatttacttttaacagatgtgattctatgaatcatatagcagcatatgatattagttattagctgaaatgatgccaaggggtgttacgtgctggaaactagagcaactgagccaaaccaaggtcacccccatcactgccctcacagctgggtcagggaggtctggcctggcccttgtccattctgaaggttgagagaaaaatggcgtctttatgatgccccctgcccaccgagatactcagatatatttcgccctgtccttgaagcagccccactactactaacagtggctctgaaaatgtggacttgacagatagtacctgtcactggctttctatccaggctccattcctttctgggctgcaggtttgaaaatggatgtgccccagggaacctgaatacagtgagttcacacacaagcaggaaagaagtgagtttcttttggtttgggttgaagcagttgctcaaacgtgataggcagaagaggtaaggatttcactgtgctttaacaaaatgcttccatggtaatcagtcctgtatactgtataatcactatacagaaacaaagtgtgcaccaaaaggtaaagaattttcctaggacaagaccgcagctccacaaacaaccaaggaagctgttcagaaacctctttctgtgctctcttactcccctgagttcatccccaggccccagggcctcccattccagatgtgaagaggtgaagaccacgcctggaataactccgaatacaacacaattgctcctcacatatcagctgttcttttccctgttcactactgagaaaacatagataaatcacggcactttctgtctagcattgaaaatggtcattttaagaatcagggcagatgttggctacacacagaaagctgcccaagggtaggcttgaagcaaaataaattaagaaacccatcatgtactcttgagtgcagggaaacaaactgataatagcaacaagtatgcatccttttcaagtaaagataatgagtcaacctgctgattgcatattgtggtgactgaatacattgtgcaatgattaacaaaagaactgattgttcgtaattcaaggaatatctttccatttactgaggctttacttaacctctagcaatagttttgtcaagttattcacaaaggccgtataaatcttttgttagattattccaaggttcagcatatttttgatgcacgcaattttaaatggtagcttagaaaaatcacatcttctgcctgttgttagcatacagaaatgcaattgatttcagtatgctgaatttttattcagcaaagttatacattctcttatgaatttatatgacttatcgttatattcttttgagctttgtagtcacattagctatgaataatgataggttcttactttccaaccttgaaacttgctatgttttgaatgtgtccctcaaatttcatatgttggaaacttaatccccaaattcgtatgttgatggtatttggaggtggggcctttgggaggtaattaagattagataaggccatcagagtggggccctcataatgagactggtggctttataagaagagaaaggagatcttagctggcatgctcttgccctctgccatgttatgacacaggagaaaggtcctgaccagataccattgccacgttctaggacattccagccttcagaactatgagccaaatgaactcttttctttgtaaattacccaggctgtggtattctgttgtaacaacataaaacaaagacaataacttttgttcttttactagccatattcctttcagtggactggtcataatgaatataatcgtgttttttcccaatcttaaaaataacctttgagcatttttgccgtattttccacagtttttaaatagatctttttctattagattaatgaaaatttggctgggttcagtggctcacacctgtaatctcagcactttgggaggcaaaggtggatgaattgcttgtgcccaggagttcgagaccagcctgggcaacatagtgaaaaatctgtctctacaaaaaaaaaaaaaaaaagctagccaggtgtgatggtgcatgcctgtagtcccagctccctgggaggctatggtgggaagatcacaggagcccaggaggccgaggctgcagtgtgctgcaattgtgccactgtactctagcctgggtgacagagtgagaccttgcccccatacccccacccccaaaaacaagaaaaaaaaagtcctctatttctagtttgatacgtttttaaccatgactgcatgagaaattttttaaaatactttttcagcatctactgagatcatgtaattgttttaatctgtcaatatggtaaattacattattgattatttatgtttacataacatgactatttcatgttactccagacaggtatatctggaataaatcctagagggttgtgagatatatatctatggatatatacatatatctatatatgtgtctatatctatttctaaatttgctttcctagtatttgtagtcatatcatcctttaacaacattttaatttcagatttatatttgttaagtgtacttttttattcctaatattatttgtgtctttagtatttttttcttgatcagtcttgtgagatgtgtatctattttctttgctttttaaagagcaaactattatatttattatatttattttatttttttctttgttgatgtctggaattatttttattattttatttatccattttctttaggttctttctgttgtcttttttctgacatcttatgttggatgcttagttcactaattttcagcctctgttcctttctgatgaaaaaaaaataaagctcaccaattttccttgaagagccattatagccacacatgtaaaaggatcaatttttagtatatagaattttttttttattttgtatttttctacattaataataccatctaatttcctttatgatttcttctttgatccattagttacttaagaggttttcttaattttcaatatgggttgacctagttaagttttctaacttcatttcattgtattcaaagaatactgggtataagaaattaatctttggctttgatgattcttgctttatgacttaaatatgtgtgtttgaataaagagaatgtattatttgtgatgaatatcacatttataaatttgtgtcagatatagtacttatgtatatatatatttttatatagcatttgttaattttattgcttaaattttatctatggctccctcttatttcactgagacaaatagatttagaaatctcccattacattgctgaaatgatctatttcttcttttaaaaagagcttcaagctcattcatatttttttggtaattattttacttgaaacaatggttttgaagatactggctatcaagcattgaaaactaacaatccctaagagacagaaacaaataaggtgagtcttaacattactccaacttactgccttgagagcgtttccaggctggggcctaaggctaaagtgaggagataaagctgagagttgagggagacgatggcctccaaatttcacaggacaaaatattggtgagaggtgctcagagacagagtgtcagagatctgcaaagacttgttcaagtttatgcatgtgagaaaactaaaaagaacctacccaaaaggattagagataacagtgtcagggacccacgagggtaaggaacagtgcctcttatacccaccagtgaaactgaaaaccttgctggttcacagagcattgagtagaatacacagagtggccggcctctggtgggcaacagtaagtcctagactgacccttattccagttctgcctaacaaccaacaacgtgacctggaaggataaaactatttccaagtaacttaactcggtcccagaacaacgaccaaaaatatctgtagaagagaaaaaaacatatctaataatccacaaagcataagtcacaatatctgatatccagatattgtggtcaacagaaactgacgaggaatgcaataaatacctatattagaaaagaagatctcaaatcaatgacattttctataatataaaactaaataaagaagaacaaattaaatccaaagaaagtaaatcagagtcaaaatcaattatataaaacagggatggacaaattttttctgtaaagtgtcagacaataaatattgtcatctttgtaagtctcctatggttttgttgcatattcttattatttctttttacaaccctttaaaaaagtaaaaatcattcttagatgcaaggccttacaaaaacagagctaaatttggtctacagactgtaatttacccaatactgaagtaaaaagcaaaaaagaaaaagagagagagaaagagagacagaaattctaaaaatcaacagcaaattagttgagatagtacaatagataaacatgtaggcagagagagaagacataaattataacatcagcaaaggcaaaggttacatcactacagattgtgcagatattaaaaatataaagacagattatggacaattttataccagtaaatttgactacttggatgaaatggacaaattctttgaaagacatagtcagtcaataaaaaagagataataacctgaatagaatttgttgaagagactgattttgtaaaaacctttcagtgaattctagcaaatatttagggtaaaaattacatgaatctacacaaactttagcagaaaattaaaaaggaatgactggcctggcacggtggctcacgcctgtaatcctagcactttgtgaggctgaggtgggtggatcacttgaggtcaggagttcaagaccagcctggccaatatggtgaaaccatctctactaaaaatacaaaaattagccaggcgtgttggcatgcgcctgaaatcccagctacatgagggggcagaggcaggagaatcgctggaacccaggaagcagaggttgcagtgagctgagatcgcgccactgcactccaacctgggcaagagagtgaaattctgtctcaaacaaacaaataaacaaacaaaaaatgaatgactactttccaactcaatgaagccaccactgccataataccaaaaccagataaaatattacattcctcagaaacagataaaaaattaacatttttcacaaatgaaattcaacactgtattttaaaaagtacattatgatcaagtagagtacattccaataatgagaggtgatgcaaaacgggaagagaagtaaacttccttgccctgataaagagaatctatggaggacctacagctaactttatagttgacggtaaaagactgaaggctttccccttaaaaggaggaacacagtgaggatgtctgctcttatcagttctattcaacattgtactggaggttttagtcaatgcaataattccaaattaagaactccagataaacaaaagacatcgaggctgggaaagaagaagaaaaactgtattccttcaaagatggcatagtttctatgtgaaaatcctatgggaactcctaccagaagtactaagtgagtttagccaagttggaagagaataagctcaatatacaaaattaattgtatttctacatactagcaacaaactgttggaaattaaaacgttaacactaccatttaccacatcatttaaaaaaatataaaacaggaaaacatctgaccaaacaacagaaagaaacagaagagacattgaaaacccaaaacaaaacaccactgagaggaaataaagtagcctcaagtaaatgaagtatgttatgttacaggttagaagactcagtgttgtcaaaatatcaatactctccaaattcatctatagattcattgcaatcctaatcaaaatcacaacaggctttatttatttattttagaaactgacaaagtgattctaaattttatagagtaacacaaatgacctggaatatctaaaacaaagttagagaacactactaaatttttagaactaatcaagctaccgtaaaaaagagtacgttattggtacagatacagacaaatagatcaatagaacagaagactccagaaacagacacaaacatgttgacaactgatcttgataaaggagcagaggctattcagtgcagaatgaatagtcttttcaaaataccatactgtagcaattagagattgatatgcaaaaaatgaactttgatttctgctttacatcatatacaaaattaacacacaattgatcatagtcttaaatttaaaacctaaaactatataacttctagaagaaaacaaaataattcctttatgaccttgggttaagaaaacactttttagctaagatccccaaagcatgaccaaaaaaaagagcaaagttacaaattaaatgtgttaaatttaagactttctgcttgtgaaatatactattaaaatatagaaaagacaagtcacgaacttggataaagcatttgcaagttatatatctgataaagaggacttatgtctgtaatgtagcacatgcagaactcaatggtaagaaaacaactcaccatcctgggcaacagagcgagaccctgactctataaaaaataaaaaaataataaaaatccaagcaaggtggcatgtgcctgtagtcccatctcttcaggaggctgagatgggaggatcacttgagcctaaggaggttgagtctgcagtgatccatgatcctgccactgtactccggcctgggccacagagcgagtctacgtttccaaaaataaaaataaaaaataaaacaacccaataaaaagtggaaaatgaagaaaacaacccaataaaaaaatgggcaaaagatttgaatggacactgcagcaaagaagacatatagatggcaaataagtacctgagaagatgcccagcattactttctattaggaaaatgcaaattaagaccacaatgagatactactacacacctgtcaaattgaataccttttaattaaaaggtagaccaaaccaagtgttgtcaagaatataaaacaactagaattcatctatgtttctggtctaaatggaaaatggtacaactactttggagaagagattgccattttctttgggaccaggacatttcgcagggaagtatttgcacaagaggcaaaaaaaagcacatgactacacaaagaactgtatacaaatgtccagctttacatgtactcgtcaaaacctatttaaacccaaatgtcagaacagataaacaaactgtagtatatatttatgcaatgaaataatattcagcaataaaaaggaaggcacttgcaaaatacactgtaacatagatgaatctcaaaatgattgtaatggatgaaagaatccagtcaaaatgtatataccctgaggtttttgtgtgtgtttgtgtgtgtgtgtgtatgggtgtgtgtttattaaaatatatgtaacttttctgctagagtttttttcctgtggtataaaaacaaggtagttttcctaccacctttgagtagataagtgtacttaacattaaatgccaaaggtagacaccagcaagcttttgagccaccccctccggacaccagagtgctacttattctaacataccctaccgggtcagatacaaatgaaagacagactgagcaggggacacagagctcagtaatattgacagcggggttcaaaaggatttgagacatggacttcacaaacagcagcaccgtaggtctccctgaagcactcccagtgaattcctatggttggcaatatctggaagatctctgcacccaggtcatcccaccagggggccctgagaaccagaactactttttatcactgtgcttcacgtagtctatgaagcagaaaaggcagattacggcaggttgtcacaaagaacaaggtgagtcaaaccgcaggactgcctttacttaagcatacaacagaaaaggctgtgtgtcaaactttctgaaccatttatcttttatagactgctgaagactgttgagttcagcgtctcttaatccaaagcgctgttttagaaaagataatctacgtggcaaaaaatctggtcaggtcagtgtgactgcgcatcctggggccatcttgattatgaaaaactctaatatgggaggagagagactttcagtaacaatcactcaggggaaagcaatggcatcaccctgaagggcatggattaacagataaatagtgaagcaggttaaaatctaacagtcacattcctgtaaaagatatcttcatctcacgtctaattattttcttttccattgctcttctctaattagtacttgcttagtaatggaagcatcgagaaaggacagagagagtattataattctagcaatagaaagctagacacctcattttctagatttgattacacatcttaaaagtatccatttttccccaaatttacatggcacctataatggcataatttaaactttaagtagataagatgaatagatggggactgaatgcagcgtgcttactttaaaacaaaaatgtgggttccttatttcctaatgagtaaacagaaatagaactttcctataattttcaatgctgtattttattttgattatctttactagtatgttgaatgagaagtttttcacacaccaatgtccactgcaaatgtttttagaagttctcactaagtggtggtagcaggccaatgccaccatgctctcaacctcatcgtgtggcaggttgatttagtcagcttcccatattttccaagttctgcttttatttccatccccttaagcaatgaaagtcacaccattagagttggctctaagctacctagggtaagagtggacggttagcagaaaatacataagcaataaccaaatctaatttttatctttctctcgaataggcagcacaaaaattactggaactgctaaaaaaaaaaaatgaaattgagtgctaagcatttcagcagctattctttcacatatattaaatgctatttagctattatatattatgtacataaaataaatgttaaatgctaaaatgttaaattttaaaaactaagtatacgtatatgaataaatttttaaaaaaattcatattcacatatgtatacttaattttttgaagaatattaaaggtaagacaatatagagacatgaataatacacaatctgcaaaaattaactattggattaatcaactatgtagtttaccttgtacatagttcctggaatttttggaaagtggcatgatataatagaaagagtccagacattagaattaggtagactgatattgaaaccccacagcctacttgattttgagcatgtattacttaagttgtagtgtcctcatctgtgaaattccatataaatctaatgtggggattgaccaattttatgtgtctgtagtgtcagtatttgctagcacatattggctagcaaagaatgtacagtttttaatatgcaaatctgctagaagtagggacaaactgcacacttacaacttaagcatgcaattctccatagcttttatgatgattgcagttatattattattttatcgttataagttccacaagtttctttgactatccgaatataaccaaactagtttcctttatctcttcatatgaaatgggtgtatttgtctagaatttaattctgcagcatatggaaatttgcctctgcaatgttatgtattcctgtgacattctctggaccattctcaaccgaagaggaaggtatacacaccattccttgatttttaaaaacttaacaataaaagaaaactaagagagtggttgttatcatacctcggtatttaaaatagcaaggcaaaagcataaatcctctgaccatttactcacaattgctcatgaggcagatagtggcaacttttaagaagacaagatgagaataaaattgcgtcacaaagcagtctcttgattaccaatattaaaatcatttgtacttatcaggaacaatggggagatcagaccttctaactctaaatgagtaatataacagattatagtctctattttggccagaatcacaaaatgtactttttaaagtatactttaaaaatatggatcatatgaagtatgcataaaaataagatggcatttccacctctaattagcagctggaaaagctagagtaagtgtatggcaaatctctactatggccaattatatttccaatgaagcaataaagcatacatttattacataatttaacagatatatatattttcagttccttcctcccttcgttatactgaggaatcttcctctggacagtgctatcctcagatgttttactctttgtattatttgtctttactgtgtctatcaaccatcagcaaaccattaattgaataagttgacgtattagcttttatatttttgaactaagcaaataaattactagtttatttatgcagttatccttatttggagactcttaaaatatcatatgaaaggtttttttttaaatgcaaacacaatttacttttcctcagtcaattaaaaaaataatattgttactctcacttaaaagaatatacatcaacaacagaaatactcattaaatggaactatgtcaggctctgtgggagattagaaatacaaagcctataagacagtctacaggtttgaatttctctttaaaaatatttattatatttttctgttttcatagaattagagaataatatatagtttcatgttatattgataatagagaaattggactttatttacaatttaattataggtgtttgaaattatgttctaggctagagatctaaaacataattatgttttagatctagaacataattatgttctaggctagagatctaaaacatagatctcacattatctatttaattaagagactttttaaaaggcaagatatgagaactggaacttaaattttaacaccatctgtaatctatctatctatctatctatatatatataacaatttagtttttcattttgtgtagatatatatacacacacacatatatgatttctgggaggagtcaggaaatacctctaaacaatacatactgtctctctaaagtccttcaccaattacttcccatattaagtactgaaacaaaaaccatttacctaactgcagctgtagtagcaagaagaaaagcccatttcttcagcatgaataaaaggcaaaagtaagcaggaaagtgggttggagatgaaaaaagaaattactcaggacaaactgggtatttccttttgaaccaaattaaaaaaaaaaaacatggtcaattttgatggattctaacattcatctcagggaccctgagtgacataaaggaaaccaagtcaggaacaatgtctctgtcttcggaagtctcctgtgaagcagaatttgtttacaaggtaaaggattaattaggtttaccttaactgatctatttgacaaaaactcaaatgtaaattattaagagcaaagatcaactcatcaaaagaaatgaagattctgcatacaagtgcccagcagatccatctataggttgatacagggagtacttatacaggagtcttgttggtcctccagtatacagggctatctcagacattctgtgtgagggcactgtgggcactttacacctgccacattcagagacaaggccaaaaccaccaacgtgacctttattatctcccttaaatgtagatttctgtaattaaatatcttctacccttggtcactactacttagcaggattacgctattcaataaattgactacgtaatgtagaaagcagaaaatgttcttgcagctttaatcttctctaactgaaagatgctaatctttctactctgtggtcctaaattgtgccccttgctgctttcatagccgtccccccacccccatcccatttcttccagggccatcatttcctctttcaggacaagaaatgactacagtgttccatgaatataataccatggtttacaccacgataagagactgtgtttcactatgattgctgtaaggtggccacatgggccccagactaccatagtagactacaatatttaagaaataatctaatatataatacatttttttttgcttggtcaaaacaaagtttaaattaaatattaaaatcacataaagttattttgaggatatcaacaaactgattctaaagcttatatagagaagaagaagacccagaaaagcctacacaacactgaaggagaacaaatatcattggtaccacccgactttaatgcttactataatgtcacagtaataaagtgtgattattagtaaaaaaaaaaaaaaaaaaaaaaagataagatagacaataaacaaatcaatggagatcccagaaatagatccacacaaatacagtcaactgatctttgacaaagaggcaaaggcaatagaatggagaaataatcatcttttcaaaaaatgatgctggaacaaatagccatccacatgcaaaaaatagaataaatcattacagtttacatccttaacaaaaatcaactaaaaatgcgccataaacttcaatataaaatgcaaaactataaaacatggagaagataacaaataagatcatctagatgaccttgggtttgctggtgattttttacatgtaacaccaaaggcacaatccatgaaagaaataattgataggcagggcttcattaaaattaaagacttctgctctgcaaaagacactctccagagaatgaaaagccgagtcacaatcagagagaaaatattcacaaaatatatatctgataaaggagtagtatccaagatatacaaagaagtcttgcaactcagaaacacataagtaagggacccatttttaaatggtcaaaagagttaagcagacatcctaccaaaggaaaaataaagaaataaataaatacagctggcaagtaagcatattaaaagatgctcaccatcatatgtcattatggaattcagaaataaaacaaaattagatagtactgcccacctagttgatggctaaaattcagaacactgaaaacagccaatgtcagtgagaatgtggagcaaaaagaactctcattccttcctggtgggaatgcaaaacgttatgaccagtttggaagatagtttggcagtttcttacaaaactaagcagatttaccatgcaatccagcaatcacactttattcatatctggacaatacctggaaacaagatgtccattaatgcatcagcaggtgaatgaacaaactctggtttatccttacaatagaatattatgcagcaataaaaagaattattgagtcaccaatagatatgaaggaaatttaaatacatattgctaagtgaaagtctgtctgtaaaggctatatactttctggctctaactaaaagatatttggaaaaagcaaaactatatatagaagcagtgaaagatcagtgattgccacaggttcaggggaaggagggagagatgagtacgtggagtacagggtatgtttagggtagtggtgctcttctgcatgacgttataacggtggatacatgccattagatatttgtcaaaacctacagaatgtacaacacaaagaatgaagcttaatggaagctatggactgtagttaataataacgtatcaatattgcttcaccaatttaacaaatgtaacacacaaatgcaagatgtgttaataacagaggaaagtgtatgtgtgtgttgggggagaaatagggaaaatctttgtgcaacttttctgtatgtacaatttgtctgtaatcctaaaattacagacaaaagttagtttatgaattttaataaacagtttggaatatttttcgaaatctttatttttcacttgccatactgaaagttacctggcatggttcttttcagccttgtaagcaatcaaaatatttccacaatctaattcaatcaagcttggtattttactgtttgaaaatcttagcattatttacagatttaaggtatttctattccttctttttaaaataataattaaattgtttaatgaaagcatttctgactgtaaacgtttaaatgctacaaatttacatttctctgttcataaaagaacttatttttggtttcttatctttaagacaatgccacattcatgataaaaatatacttcaccaattttgaaatagttctagtagataactattaaagatcattaaaaactcttgagtggatgcattcagttctctaaatctagagtgcagcatatcataaagtgtctcctatccctatcttatcattttagatttttttctccaaagtagtgctcactatcagaaatcaccttgtttaggccaggcagagcagctcacgcctgtaatcccagcactttgggaggccaaggcgggtggatcacttgaagtcaggagttggagataagcctggccaacatggtgaaacctcctatctactaaaaataaaaaaattagctgggtgtggtggcggctgcctgcaatcccagatactgaggagactgagtcaggagaatcatttgaacctgggaggtggaggttgcagtgagccgagattgtgctactgcacaccatcctgggtgacacagtgacacactgtggcaaaaaaaaaaaaaaaaaaaaatatatatatatatatatgaaatcactttcttcacatatctgtttacttgtttcctaaatcatctctcccaattccccagcccatcagccccataggaacagatgtacttggaagtgccacagcagaggaaaaccaccaggtaaataaatatttgggaggtgactgattgaataaattaacttatctagatttggtttgtcaaggacattcggaaaattaggtagaatttagctccatgaatgttgagaaagttgagttttgagagccctaacatggccaattcattttacagaggtggaaaatggggctgacagatgttaactcaccttgtccaaagtcttagtaatggaatcaggaaaaaattcaatcacttgacttttaaccaataatcttttttactacaagagttaatttgctaatgaaatctcctcagtattttctcaaaacagaacaaaaccatgagttaagtattcctttttctttgctataactaaatataccttttaaaattaaaaaaaaaaaaacataaacatggttataagtgatcttatttcctgcatttgaggcagctaaaccagtatttcccaaaatgtcttaatacccacttcttgatctgctgcaaggaaaaatattgttcagtggtcaaatacgttcaagaatcatgattattatatagagaatagacgtttgcctcttaatggaattggaaaattcctacagtaaagatacatgtttagttaagggttggctaaactacttcactgtggcatcctctcttcaaagaacccatcaatattctacagaacaaatatgccatacaacacatttttatccgaaaatcttttataattggcttatattattgttttattcttcaaaatgttttctaaactgtctcagttctcgtcccatgtcatacaatattttataatttttcaaattctcacttttatgttctcacttactaaaatacggcaaaatataatttatatatacatatgtgtgtgtgtgtgggtgggtgtgggtgtgggtgcgggtgtgggtgtgtggtacctggaacacaataagtggaaaaatttgtttcctctgtcttatcgcacccctttaaaaataacacaaacagaaagtgttctttctaatagtgcaacttacggtccatttattttttaatatttgttatttaatccatggcactcacttttttgaactgcagtaaggtgttcttcaacaattcctaatttttctgtgaatcgtttacttggacaatgccacattcacatatacatcccctaacatttgcatttattcagtttccttttaaaataagtgctaaacaaattaatggattttgaaggagaaaggctttcctttcaaaagaatggtaacctttatgtagttgtttttagatatttcctataaaacctgtctactctcgatacagtcagacatcttttcttcttttttaaatattaaaaataagcacataaaataagtcatttgttctttaaaaaacaaacaaaaaaaccaaaaaacaaaaaacctacaaacacaaaatcatgtaaaccagaaatctttcacagaggtcaagaagtcaaaagtaaacaccgacaatgaaacaccgacaatggtaagatccttgtgaggctctcgctccacctttctcattacttctatgtttccgtggcacaccacgggccagtgcttactaagacctctgcttagcgatggagttagtgggtctgcacctctgattgtgctgggcatgagacatactgattaaaaatggtaaaaggataaaggaactggcctttgagagacaacatggatgaatgatgagtttttgaattaaatttttgacagctttgatctttactgaaaatttaaatgaaaaacaaaacaaagcaaaacagagttccaggattttagaagtgccttttatcttaagtgaaatgttctcatcagaaactttggcatcccatccagtgcctttgatgctggctgtgaaacaagacaatccatcttcttagctgggaagacaggcccttcaccacccaggaaaccataacttgtaaacatcagtcaagttcagatggctacatttttacttcagaagttcgctttgcatttggagtggctcattaggggaaaagagagagagagagaaagggttatggaccaaagtgtgtttctcaaaaaattcatatgttgaacccctaacccccaatgtgatcgtatttggaggtagggcctttcgaaggtgattagggttagatgaggtcacgaggatgaggtcacaagccaggattggaaagcttgataagatgaaaaaaaaagagtgagctttctactctgtgtgagaacacagcaagaaggcatctctctgcaggccaggaagagaggcctcaccagcaatcaccttgatcttgaacgttccagcctccagaactcagagaactaaacatgtgcgtttaagtgcccagtctatgagactttcttttatagtagctggagcagactaataccgacagaccaagagagagaaaatggagagaaattttctggcttgtcttttaattattctttatttataaaaaaagccacattgatttttgcagcagtgatgcaagtgtgctgtgcataggtttgatgttctgctcaaattaagtctaagtttttccactaaaggaattatagtgttaatatgccaagagtcctatctgctcacgtacttccagtctctgtaaatacgtgcagcctgatatcaaagcaaaccttgaggccattaactataacattcttggagaaacagctgaagacctactaagaaaaaagtaccaaataaccaaagctggcaattacaattccaccccgaaaagaaggaaggcatgcatatgaattatgaaaaatagggactgtgcagctctcagattttcaacaatgaattgctcacattctacaccgtgtgtgttaaatgtttaaaagtaaaagatcccaaacattttgccaaatatgcagtgttccaaagggaagtatcaaaaggatactcatttataaaattatggttcagtagataaattataaggcctcaaagaacatgctgttacttctacttgccaatttataaattgactcaagtcttcatttaatttatgaaaaatcaaatcatctcaagaatgttttcgttatttttctctaccatgtaaaatatatgttttgtatgtttgataagttgtatcctgtcaattttagaatttagctatttggaacatataaaccacatttctacaactcaaaatagtataatgcttagttacctatctttaaaaaagtaatagtaatgcactgagatatttgggggtgggaggtggcggacacaagtttaactttcaaaaataagggccgtgtaaaataactgaaaaataatcctatttgaattaaaattgaataatattaaaaataaatttctactgaaaattacacctgtttctctattttatttttcttccttttaggatagcagaaaattctgttagataaatcagactaacatgggagacattgtaaatattaagaaacaatagtaggaagaggcggactcacattcatcttgctctttctgctattcccttccaaaaccaactgtgaacaagcactcagggtggccagggtacgtgaggaagcctcctctagcccagaaaaaaactttatttcacaaaaagttatccttcacaataaaaaacactattctataaaaattgtttcccctggccaggcgcagtggctcacgcctgtaatctcaacgctttgggaggctgaggcgggtggatcacgaggtcaggagatcgagaccatcctgactaacacggtgaaatcctgtctctaataaaaatacaaaaaattagccaggcgtcgtggtgggcgcctgtagtcacagctactcgggaggctgaggcaggagaatggcatgaacccaggaggcaaagcttgcagtgagccaagatcacaccactgcactccagcctgggtgacagagcgagactccttctcaaacaaaaaaaaaaaaaaaaaaaaaaaaaattgtctcccctgacttgagttatgggaaagagggttagcttcacttggccctccatgcccctgcccaggcacgtgtctgtattagtgttctgcagaggcaattcaaagtacattgtccaaagcccctctttgaaaatcttttgatgctgctgtaattcaatttggtttctatgttgaatctgaagttctgtgttactactaaccccctttctgtaggaaaaaaatgtatttttctatacaaacccatatgccatcgaggtacctgtatttaatatacctccatttagtagctaataaatatgtctatttgaaaactatttattcttccatacttaatcatagtgaactataaatccaaacttgacagcacaagaaaagtgacatttttcttctttcatttctatgctactttttccaaattatttcttgttctttttaaaaatgaagcaaagacatcatcattgttactattatgccttcagttaacaaaaaccttttaaaaagattatttgaaatgcatatgtaatatgcatgactacgttaacaggattatatgctattagatattgtgatataaaattacaactcactgggagatacagtcctctttgggcctctctcccttctatacatcttgctggacttgccaagatcaaaaggtcctgcccgcttttaacagactattactcagggttgcttatgcaactggtaacctaaagagataaggcaaggtcttcccctagacaaaaggcttgcatgcggcttgctataacagtagtcccagctcagtattcaccggctgtgatgcaaatccacccatgagtaagttccctctgagccaattgcttcattccctgcacacaagctgctgcactgctgagcactgtgtaataaagccctttgcctttggccccaagactcacgtcttccaccagcagcctgatacagtagcaggctcactgatttgtaagaggggtaaaatcaaaccccagacttgataataccatctacacagacattcactggtatgattcaagaatataaataactggtattcaatgtatccaaaaacaatcatgatgaatatttcaccaatgcattgctctttaaaataatacccaaataattatctgtactgtttccataccttgacctttcaactggacttttccttaatttgagcttttttgagttgtcatcagtgtcgtggagacttgcgccttccaattacacagtggtgttcaaacagaagaaattccaaacttttcttccttttgactataactaccctgggagtaaaatgtcccccaaataaaaacataaaataaataaaataaaagaaagaaagaaagtatctacttggcaagtgggaggtcagaagaaaaggggcttcaaacatcaaagaaggttctcaaaatactctttcaaatgaagaaagccccacgctcggtgccttatcttgcaagctcacatggccagacagcaacctttaaaggattatcttaacatgcggcgagctgggccctctcatgtgttctgaaatttaaaccagaaaatggctgcacaactgacatggttgtggggtgtgaaggggaatcaggaagagggaggagaggcttacatttccagaatgagccagagttcagataaagatatttgtgtaaaaaacaaagcaaccaggaatatgatcctgggctgtcaatttgtagaatacaatctaatacttatacgccataggtagtcacagaagttataagaaactacaagccctaaggcattttttagaatagaaatctctcttctccctctctctctctctctcttttttttttttttttgccaatatgtagtgtgggattttctttggctaaaaactgttccaatttccctgttttctaaatatactttactaagcatttttttttacaatcaggagtattgtaacctttgtatattttatcaataataaaataaatccataatttaaaaaaatcacacaaaagtgtataaagtaaaaagtcaaagtcccacatccccacctctgaatttcacctttatctgtgtgtatatgtatattttgatattgtattttgtaagtgtattgttctgtaatgtgctttttcatttaatagcatgattcacattcttccatgtcagtaaatacagagctttctatttttttcatgtctagacagtactttacaagatgattatattcagtaatgtatttaaccattcccctactgatgaatgttgaaatattttcccctaattttttactgtttcaaaatcaaaaatatgtacatcaacttcaagctttttactatagcccgtggactcttacgtgatttactacctgtctttgtcttcctctggaacttcttataccaaatctttgtgcccctggcctttcttccatgcctgggctaagccaaccttgtctctgcatctctgtggaatgtcctgtcccaaggtattggcgtggtggttcctgctgtctcatcactcgctccaaggttacttccttggtgaggtctttctagagctcctgttctacacaatctaatttatccttagtcaatatcttttataccttctcggtttattttctgtacagcacccatcaccctctggaataatcttgttcatgtatttcttactgtttactgttttcatgtaagatttttctctggtatgctctaatgtgtcctttattagaacaatgtctgccacatcataggctctcaataaacgtccactgagaagatgcataatggaagtatacttcaacttggattgtagcacatttacacaaatatttccattagagagatgcctcgaagtaaaattactgcccaaagatttgtacacacaaaatattgatgggtacttgccatgggtactgcaaaaaagctttaatggcaatttatattgtcaccaatattatggcaacggcccttttcccacaaatgcagttttataatgccaatttgacaggttataataatttttttgtaaattaaaaatcaccttgttctaaagaatctttttacatttatcacatttgtgttttatctccaaattaatcattgttgaaaatcttttttattcttttatcttttgggattacagaatgtcattctagttttcttccattattatacaagattgaaaggattttggttggctttcttagatcttatatccaaatgggatttattattatatgtggcataataagaactattattcttttaaaatgtattaattgtcttttgcttattaaaaaatagtcatggtggacatttctttaaattttcaaaaataaacacagaaaagaaaataaaaatcaccccaatagaaacttgcctgatttctttccactgcattccctgtaaaggtgtgttaatagaaatgtttctttgatcatacctataaagtggtgtttataaaaatgtttattcccggccaggcacgatgggtcatgcctgtaatcccagcactttgggaggccgaggtgggtggatcacctgaggtcgggagttcgagaccagcctgaccaacatggagaaaccccgcctctataaaaaatacaaaattagctgggtgtggtggtacataatcccagctacttgggaggctgagacaggagaatagcttgaacccgggaggtggaggttgcggtgactagagattgcaccattccatgccagcctgggcaacaagagtgaaactccatctcaaaataaaataaattttaaaaaattaaaatgtttattcccttatacaacattccctcatactcttttgtatacagtttgatatggtttggctgtgtccctacccaaatctcatctcgaattgtagttcccataatccccatgtgttacgggagggacccggtgggaggtagttgaatcctgaggccagttacccccatgcctgctgttctcatgatgtgaatgagttctcaggggagctgatggttttatcagggactttttccccttttgctcggcagttctccttgctgccatcatgtgatgaaggacatgtttgcttccccttccaccatgattgtaagttcactgaggcctctccagccatgcagaactgtgagtcaattaaacctctttcctttattaattacacagttttgggcagtcctttagagcagtgtgaggacaggctaatacactgttttttcgcttatgctatgaacattttcttttgaaaatgtgatttttaataatggtacagtatcttaatgtgtatgtgtattgtaatttgtatgagtgtattttaatggttcctattgttctacaagtaattcctttttctgttattaaaaattaacccaccaatgaaaacccatgctcataaaatctccaggaccatctctgatttcattcacaggatagattcctaaatgtggactcaataagaaaaggagtataaattatttcacagctcttttcaggccttttacaggcaggttgtgtgtactatttaaagtactattaatcccaccacatacaagatgtattaggtacttcttaagagtgcactgaatataagaaatctgttacaaaatgttagcagagcagaaagagaaaaaaagaaagaaaaaagggatagaatgagattagatcacctggtaaactgtaggaaacagctactgcccccaggactcaggaaactcaagaaagtactttatcagaacttctgagtgctgagtgcatgccaggacccctgaggatgggccgactgagtgggtagaaaccaccaaggcactgcctcccagtcacggaggagtggcatggagaagggatcacagacacttccagaagcaggagagagggaagggtagaaaagagaaaatgacagcgcctttcccctgacctgcctttggatccactgagcagatgtcacaggaactcgctggcaagggcatctgggaaatacagtttcctcccgagccaagcattgcggagcagcacaaagggcgtggctggggaagggttgggagaacagggaatcactctcacacccaagagtgcatggagcatatctgggtgtctacacaggtaagagagtgaggggtcaaaaccgggcttcttatgactctaaaatgtatttttagagcagttaccaggagagctgacattgttgaatctacctgagaagccagaagccagactctttgtattactacagaatgtgattccatgctgttgccaaatgccaggaatttctacatcgactgccatcaggacatggaagtctcattgtttcttaaaacgcaactattcttgaagacatggaaggtcatccttcttacatccttacatccttctttctgtggccctcctaggcttgtcacgagtcagcacgaatcccaaaggtaccagcagcacagaagctcacactctgtcatcagagctgggttggcagtgacagaaatgcttatgcaaacacaggctgacttctcactgaatgtatagaacatctaggaaagaaaggcaaaggatttaggccaaagcaatacctcaatgcagacaactaactagtggcagctagctagtcacctgctctcaactcttcaacgtccttcaaatattttctctaattgatatagcataatttgtgatgccaacaaccaagtgttttttcacaattacagagagccaaacctgtgtctctgctgctcccttaggctacttataatattggcctagttctcttagctgtcagcacaattaccttgtgattaaaaagataacatcaataggaatttcttttttatcagctaagccatggttacatgttgcatggacactagcactcattaccccatccatattttggtgagatttttgcccatttccttcgttttcacagaaaatgaaataaagcataagcttgttggttgcaaaggtgacatatagtaagtcaaataaacccataatgaagttcccttatacttcaggttagcttcaaaatcccactcaaatatgtatccaaaaagaaataaaacaggaaactttctggaataagttcttttgttgctatttttatattgaattggcaaatgtcatttcactgtctgaggtcaagggaacacaagggaacaggcagttctcgaaacagaaaagttggaggtgctgtgccgtctctagctaagaaaactctagttctatgaaatatcattccacctgagaaaattttcacatgattaaaagataacagtgccataaatctacccttgaacatcaggtgtgactcttactatactacccaatgtcttttaaaaaatatttagatcattagccaatttgtgtgggtgatacaattgtacacattccacaaaaatatcagccatttgtctagttcagcatctggtaatgtcaattaagggttttatttactcacaaagagaaaaaagtaaagatattagtttcaaattaagtccaacagtctattgagtacgtagtttaaatgtatttcagctcttcatcctccccagggcagagatcactggcagaaattagcatccacggataggaaccaacaacagggtagctgatgatgtttaggtgaactcccctctttataataacagaaataaccccttttcccctacaaagcccgtctacattttgcatagcactaaggatggcagacctaggagctgagttagccaaccctgaaggtatcctgcctcaagacttgtggctatttggaaaaataagcatcctcgtcatggggtcagtggaatcggggcagtttgctggagtgaaagcccccaattaggtcaccctgtacttgtcatcaagaatgagtacacatggcctctctatcatcaagtggccacctacgctttttgagtggtaattcttgaaatatggttttctctatgaagaaagcttttctctccatagaaaaagcttaacagcaaatttcactgtagtcgaaatgtttcacctttctttcctttttgatgtgatcgtcagctcttgactgcatctcgttttctcatgcctgctttctttctgctgtcagtcacaatcctttgtgacaaggtgggatcacctggcagatgatttggatgttgcctctcatggagatatatctcattgaccctttcgaattcagagatttttttttaatatagaaaaaaaggcatagcattttaacatcactaactaaggcaaaagataaggacactggactgaaaaaccaaggatgttgtataaatattcgtccttgtgtcactattttattggcttgaggtatccaggaaacaacttcatttccccaaattacattttattaccaaacaaaagatgaaaaaagtactacttatcccattaaactagcataatggttactttaattggaggggtgggagagaaagaaaggtgaatctacttagatttcttggagaaatgaacttacaaaaatggaagctggtggcaaagccaaagtgaaattcacgtttacttattccatgcaatatttctctgtccaacctatgtaaagcactacaaatgaatacagtcatagcaactaattgagttatcagcatctccagagtagatgttactagtatgtcctggcatatgaatggtagtattatgtgggatattagtagttcactaagagtcctataggacttcttgtgtctggaaaaagagtttagtgagtgatactgaaaaaccaacagcttggctcacgggcatcattgaacaaatggtactgagcatggaacgcagctactcagaacttatgagccaaatgggtgttttccgtacatggcttcttgtccagaatgctactgctattagcccaatggccatcactggttatcaaacatcctgacccaagtcaaagccagacgaagacagaaggccatcgtgggaaggtgaagcgattcatgcttagggcaagataattatttggtatcctttcaatccatttgttcaacatttgctcccaggagaggcgggatgcttcctggggacagattagagaagaagggacactgctaagtgctcatgtattatttcaagcagttcactctgggccccgacccaaatcctcaggcaacaaagcagcaccctgcaggtaataggaactgtcttctttagaaagcagtgtggtgaccaggtgttgctaatcatcagagtctcttggtgactcacagccgccctcatgcagctttgcgagttctgactgccaacacacacaggactcttcctaagtattatttcagctgaattctgggatgtgaacatcagactttcaaacccggctttctcactttctactggggtgaccctaaatacaagttatttcatttctctggactcagtttcctcatttataaacatgagaataacattatctactccactggttgctgtgaggaccaaataaaataacacaattaaggtgttatctggtatataataaccattcgataaaacttagcgattattatttatggcatccattccacaatggtactcaatggtactgtgtacactgcctaagaatcctaacctttatttttgctccactcatcacttctatttccagttctgtgatgccaacaaattgggtaattgtacagcagcatgttattatgtttcttcacctccccttcttactatgggtcccttctccgccttcctcaaacatggcagccctgtgggatgttgaggctcttgaggctcctcagtttgaaatgaatgagcttgctgaagtggaaacattagaagggcatgattggcagattattttgctccagcaccttcttgacagaagtgcacaaagctcttcaagaagatggagctgctgccagatgccctctgtccagcctcctggaagcccaggagaaagctggagtggacgccatccttctggcctcctcctgaaggacatactggtttccttaatttcttttctactttttgtccttcagtctgttgtccctgcacagctatagagaaaacaaggattacagattccatgtcgttttgcagccagggaacatctttggctagagatttgacggaagtcagtgccaagtggctgtgtccctgtaagcagtccattatttctaatggtctatttgcatgcaaacctccaggccagaggcagaagtaaacatcccagaaacttgtccctggagactctgggacactctcatttacacgctgtgctccattcacggcgctgagtttactcacacgtgctacacatgcgatcctcacgacagccctgtaagatggtattagcatctccattttatcagaagaaaaataacttccgagagggttaagcaatgggtaaacacggacataaatatggcaacaagagacactggggactactagagaggggagtgagggaggagggagggttgaaaaactaactattcggtgctatgctcactacttgcgttgcagaatgatttgaaccccaaagctcagcatcacgcaatatacccatccagcaaacctacacaggtaccacctgaatgtaaaataaaagttgaaattataaaaaattgtaaattacaaataaatgaataaataaaattttttaaaatacagttaagaaggggactttgcagtctggtgtacctgacactaaagcccgtgtatctttaccatatcatgtttaaaaaatcattttcaagagaggcaagaaatttcagtggagaaaaagactgagtatgtagaatggaagattctctagatgtgttgattttgtttatcacggtgtcaactaccggaggagtaggcaattttatgtggatgtagaccatgcacctttatcaggagtactttttcaggtcaattcccttccctagcactaaaaataattaatagatctctttgagagactaagacagtgaggagaaagtacatttacctaccacaactaatgagacctgaataactggaacagaatatttggaaaaaaataatggtttaaatggttaacgatgtgtaactagtaatataatagctacttcaacggagctttcatgtaaaacagaatttcattgcaagtttaagttttcttttgagaaaaatttggctatgtaaaggtgagtttggcaattttaagtttacaacttattggtcaataagtagtagtaagcctcttttgtgtttgttgagttaataaactatggttcttggacaatttctttgttggatgttaatctataactcttatttgacctgttatttgacatttctaacctcttccttaaacattaaccagaaccctgagtactttcttttccaacacgggtaagggattgattttttttcttaatttcataacttatgaagctaaaatgtgcaatattttgactgagtgaattaggaattcttgttgggatttgggaaaaagaaagttatgagaaactgatgactgcctatgtaatacttcctttataggaaattcttaatacccttatataggaaattttaatacccttcttacatatcttttgttcctggtgacatagaagaacaagtttaacaacatcttaagaaagaaaattattaaatatttacagtcacaaacctttgttcaaaaaagcacttaaaaattatatttaatagagtttaattgagtaaagtgaatcacatagccctcaaactagaataggtttagagagactagtgtttttgtgtggtcaaagaagacttatggaaaaaaaaggaaaatgatgtacagaaaatggaagtcaggtacacaaacagttgtattggttacaccttggtgtctatttgaactgctttgaagaatttgtcacctttcagaggccaaaacttggtgatcttcgtgattggaacaagaggaggttatagcctgattacacagtttactctgtacagggaaaactttaggccagacttaaaatacgcaaggaggcagcttaggctaaatttgctttaacaattctctctttatggtcaacctccaaaaatcatgaggggttaaccaaaactctaggcactgatgacattttgtcactattataaacatattcacacagttttaaattttattgggaagtagttggatagtgggttttgtaaagtgaaaagaaggactttaggttacttttctgtaaggattagagtagaaggaacctctgtgtgttgaaattttttgattttaggagataaaacctggtctgctatagtttttttttttttttaagttttagtttgtttatgtgatatttagtatgagtgactttagtttggtttggtctggtcggttggagcctagtacatgagtttagtcaaaagcaatagcctcttataattttatgttttatttatttatttgtttgtttgtttatttatttatttattcatttattggataggtgagagggtgacccaaactttactgttggcttcgtggtacttttagctattattattttcagttttcggtctcagtgtgtcttatatgttacagtgacttgttgatcactttttggagtttttgttgtttgggttgaagagggaccagttgacagtttatagatgtctgtatgtaaacatttgagaaaatatagtattttggggaggctactattatgactattaggaagataatattaagagtttgaaatatggtttctggtcagagtctctatgaatcaattaaaattgaagagttttaaacgtgagttagataaatagtatttgttttagccaagtagtctgttaatctctcacaattgaatctttataatttttatgtataacaaaaagtgttcataacaaaacagattctttttgtgtagtcaatggataatctagtgtgattttattattaggaacaattttagtaacagaatttagtcttttgtgtaacaatagtctttgtagtagaatttcttatggagtctattatgagggatgcatttataatgactgtcccatttattttaaactatggaaaaagagacctaataagtcatgtatcctgagaagagtgaaggacaaaatctttaggccaaacgttataaatagaatgaaacagctttagactaaacttcatgtaacaccttcaagtgtgagccacagtgatgagtaaccagggtctcaagctggtattttttcaagcaaaaaatacttcaaaaaagccactggagtaggggtggggagcgggtaagaagatccatatctgcttatcaactcctgtttttttttttttccatttctttttgtatttggtgtctacaaaagagccttaacatggtttaataaacatgtgtcatagactgcatggagttgcttatgttgtttcaggatacttaaaggaaatgctcactggaacgttctagattttggatttggaatgttcacccagttaagtatactgtaaatattcaaaactccagaaaaatagtctgaaatacagaacacttatggtcctatgaattttggatagggatactagacatgtacttacaaaatggttttgaaaattccttagtacaagaaagactctgccaatctgatacaaatatggctttgtacacacacacacacacacacacaaacacacaccccactctctctctctagatatatatacatatatatacatattaacatataacacatatacacaagtaaatatacttttcactgaattttgggtggacatggacccacggttcttgtctgggacatcagctactaggtctgagtcccctgtctgtgccctgtgcatctgggaatgtgtacacactcttcaaaactccagttaatcaccatcctccctgggaagcttccatgctagaggattgaggaatccaactcttgagaaacaagaacatcctcttcagctcttcattctaatacttagcagatatcatagtgttttcttagttgggagactagattctgtctccctcatttgccccaacttcatgcccactggagctccagacacccactggaggaggcagtgacaacaggatttgcctccaaagaacacagaccgcacccttgtgtgaataagggaattttgttactcctgattactttacccatcctagaatacgctgaatttagccataaaagaagttgaaaaagatactcagaagaagaaaaaagaacactagagtggcaaattgtattatattaccagttttacacatatccacatggatccttatgtttgtggggtccacagcctgaccactgtaatccctcacattcatgtttccccgccgtgtagaaaagctatacagggtattcctgctgtacacgcagccactgtgcaaagatgaccctactctccttggcactgaggagccgaagtcatcccctgagagagaggcagcctacaaatgaatacctggggccaggggcctccagagaggggagttactacaccaggcaatgcttctctcccagacagcttgaatattaaatgtgtaaacatactagacagcaaagtagtgccgaaaccaagaaatggacacacggagagagagggggaaagggaaggggagagggagggagtgggagagggagacggagagtgagagggaaagggagggggagggggaggggaggaggagagagagaggcagaaggagaagaacagggagagggagagggagggaggggggagggggaggggaaagggggaggaagagggggagagggagagggaaagagagaggtaggaagagaccacgaggagagaggaggaggaagacaaagtaaaggcaggaggagaagcccagtctgggaggtagagacagcaacaacttgagtcatgcgctggacacagtgcccacttagcaggaaccgctgcagctacagatgggtcccaaatcatgaacgaggacgttctggttgcacttccatcctaagaggatggtggagggtgatgctttttgtttcttactcatttccctgtgcatccatacagttagccaataccctctaaagtaataaaagtgtatttctgctccgagtaacttggttgaactaatattcaaatccaaatctgcagactggtaggctgactaggctatgtgaatgtgtaaggaacacagaatgtgcatacaaattccatacagacagagaggactgggctggcattaaggaagaccagtcacttcagaggactggccaagaggccagtgacaccacgctcggtgacaccacagctcttctcatggtttcaaccccagaggcagatattcttggctgccttcttgagtgccctgacgggggccactccttttgtctctttctttgatttctctgggtgcagactaaaattctccttgaatctagttcaaactgtccaaaagaggggatctattcagttcgattcatcacactggatggagttcttagaccaacacacgccacaggcccatggccagcctacagatcggctccctgatgtcatgccatggccatggaaagactgaaccatcacagaaggggctgccagcactgggacaggcatgtaagtcatatgagaccatctaccttggtcaaccaggcagtgctaatcgggagagtaagaggacagcacggagattagcaacccaaagcaataccccagcaggtattagagttgaccattggagcttggcatgttttggttattaatactccaaactattcatgcttaaggcaatgtggaatttcaagtgaaagccagatggttcttgggcaagaggaggaaagaaaaacaaagcatcatgtgcttgggagaacgcctagtaaaacaagaggatcccagtctctcccagcagagtgtgggcatcgttcactccctttggtacaatccattccctttctcgtcgggattcacacagcatggtcaaaggcaatactttaacatcacgaaatcaagctaggtttacaaatgtaaggtaagagataaagaaagaccatctatctggagttcttttctcccctttctttctatgtgtagaataaaaggacagagaagagacagaaatttaaagggaaacaaggcaagtgctgaaataaacctgccatctattttaagtgaaacaatttatttgggtttcaagaatacttttttctgtctctcgttcttcctaaatcccagattatcagtctaatcgaagatcataaaggagatgacaaaacaattatcagagagaaaactggattccacttagcagcggctaccaaaagtacagtttaatgtgttttcaatgaggtgggcccctgggggcctgaacacccacaggccaacggatgtttctatgtaagaagagcaacgtcatcagcaaaagcaatttcccacttttattaatccagtttattttaaggcatgattattcaagctttcgtctgctatagttagtcttgtattttcaggataataagactggtgaggctagttatcaagtgcctatgcacagaattcaaatggcctttgttctacctggcagtctcaagaactgttaaatgagcttaaactttattacaagaagaaacagaacatgctgagtgaaaggtctgcttagttgcttaccataaaaccacaactacttaggaaacttatgctctgcatattctaaacctgaaggagcctctaatggggcatttggggtcagttttaagatgattcctcaaaaatgcccccaaataagacctggaaggggattccacacttggctgtctctgcagagccacaggcaacaacacagaggtgccatgatttatttaatggaagcttggtagtgactcaatatcaagaactcaccttgagaagccacatttcaagtatctgaaaacaactggcaggcctttattcaaatactttaaatagatcaaagctgtttattctctaaactcctctccccttcttacacattttaaccaagtcaatgttttccttctatttctctcagaggtctaaacatctctaaactatatttggcctaaagttttgcttgaccacatgattttaagaactgttgaatttgagtgccattgccagggaagctgggaagatggctggataccagcatttacaaaggtctcatcactccatgagtgataaattcccatttctcacatggttcctatgggctgggagtaggagtcctcaattcattgtccttctgaaaggcccagatctatgaattgggagattacttgtattcagcagttacattttctactttttgtgggctttgaggagattagaaggggtaagagaaagatatttgacatacttctttctctacccctcaagactaaataaatactaactcaactatcttactacttcaagtttctaaataaatctcccattcagggtcaggctaatccccttaactctcctctccagtatcattctgatcccatccgacacctcccaaactgagcctcaatgcctttcccgcatggacccgcctctggctggtgaagccaaaggtcctgagagcatgcatgtggacagagctaggcaggtttccttggcgtctcctggggacgtcacatattatcctccattatgattgtcacagtacatggtatgagcagacaatagattttaaggcactttaaaaaaatgcttgtgtaaatgaaatggagcatttggattcaatttagtagccttatacaatatctgctttttatttcagagaagacttctgaggtagctgatgaacatgccggcagagaggttgaattccgaggtgaaccagtcattccaatccaagggagacagcgtttggaagctttaatgtaaacagaaaccctgcgggactcacttgtgcatacagctgtcaaaacaattcaatatccagagataaacagggtataagacacccactagtatattatactggaatgcaacatctttttaaaattatgttgccatattctgtactttatcgagtaccttccattttaatatttcatctaatagactgtaatttggcactttgggtagtaaatagtgaattaaatgctgatgtggcttattagggcaagtaaatttgaaatcaagtatagtgatagcattataatgtgacatgtcatcagtttacagaagagatttctcaaaggaacacagagttctgaatacatgggtgttggtatcatcatagagaacagcaagtattcattattcatttaggaaaggaaatgtgtacctggataatagtttaaagctatatatatatatatacacacatatatatatgtgtgtatatatatatatgtatatatacacacatatatatgtgtgtatatatatgtatatatacacacatatatatgtgtgtatatatatatatatgtatatatacatatatatatgtatcattaacatcaaggctgcatgaaccaatttgctttgcacaaagacacaggagaggtggtatcaagtagtggaaggagttgtggctttggagttaaagatactcattcagattctatcatttgctagatataagccttgagaaatatacttctgtgggcttcaatgctctctactgtttaaaaaaaaaccttgaaaaattccaccttgcagcattgttttcaaattgtcaatttcaactggcgctcagtgaatgggaggtgttggaaatgaagacattcagcacataaataaggaagtaaggtgtttaagagtctgtatcactggacctatgggcagtctttctgggccactgtcaagcctccctttttgagaagctacaacagccacatgggagagtccagcgaccagagtggccgccgtggtccagataaggaaaaccgccatggattcagccagacttagagcaggatccgcaggcgaaccgttcttcctcttccagctatttctggataagcccactgtgtcccttcctctgcagagcacacctgcatctttgattccccaccttgaagtccttgtcctttcctagcctgagtcattccactcagctcaaaagacagtgtctgggcatcgtctccattggaagacagttcctgatgtttcctaaagttctctttactcccccgtcacatcctcatagcatgcagcaataaatagaaattaccctgtttttcaattatatttctataactattgttgccctcctccctttcagtaatgtaaaaaattttcacagtatcttctgtatcctaattttccccactcaattcgatttttgagatgaactggcagctgcctattaccttttactttttcctctctaagtgatacttttagtaagcaatttacagctacctccaaggtgaatttgtgtgtaacttaattacattcacttataccctcattataattacagtagcttaaaatccccatctgtggaacaaaagatgtttccatttatcatgtttctattgtgtataagctgtccttaatattaaacaccacaatactctcaaaagatgagactatctctggtaaatgctatacctgtcccccccactatctctttataaatgcctcagttaaaaatgatatgtttttaccattacgcacttttttctgatttttttttattagtccaaagaaataaagtgctaacaaatagctgggtggatgaagtgagtgaggccattaatattctatactgatagttaatatacattctcttttccacattacgtccttagacttcaggcataactccaagtaaaaattcaacagaataaggaaaactgcattcattagtagaattgtttttctttttcccttataacacagcacaattgcagatcaggagacacacaagcagacctcccagactcgtgggtcacacttagggggttattggtcaaaaatttctggatatctgctttctgagaaagtagcaagattttgctggcatttactttttgataattaaaactagatttttattttatcctataatcggtagtattctcccccactcagagtcataaataaggttaaatagtacaagacgtatttagtcacctaatgatgctgatgatccatctcagccaaaacaaatccttaaaaccaggcaaataatattaatctcacaaaagaagcaactgttaactagaaatggaaatccaattaaatacatttcctgaataattaaataataatgaaaacttgaggaacatgtacaggcatacctcagagatactaagggttcagtttctgaccactgtgtaaagtgaatatagcaatacagggaggcatacaagttttgtggtttcctagtgaatagaaatgttacatttatacaatgctgtagtctattaagcgtataatagcattatgtatataaaaacagcatacaaactttaatttaaaaatacgttattgctaaaaaatgctaacaattacccgagccttcaacaactgtaatctttttgctcatggaaggtcttgctttgatattgatgactgctgactgactaggatggtggttgctagaagttgggatgactgtggcaatttcttataaaaagacaacagtgaagtttgctgcactgattggctctttctttcatgaaagatttctccatagcatatgatgctgatagcattttacccagagtagaatgtattttcaaatttggagttaatcctctcaaaccctctcaaagccactgctttatcagctaagttatgcagtatctaaatccttggatgtcatttcaacaacgttcacagcatcttcaccaggagcacattccatctcaataaactgctttctttgttcatccgtaagaagcaactcctcacctgttcatgttttattatgagattgcagcaatttggtcacatcttcaggctccaatttaattctagatctcttgctattttcaccacatctgcgatgacttcctgtgctgaagtcttgaagacctcaaagtcatccatgaggactggaatccacttcttccaaactcatgttaatgttaatattttgacctcttcccatgaatcacaaattttcttaatgacatctagaatggtgaattatttccaattaacttttcccagttccattagaggcatccctacctatggcagttatagcctaatgaaatgtatttcttgaataataagacttgaaaattagaattactccttgattcatgggctacagaatgaccgttatgttagcaagcatgaaaacaacattcacctccttgaacatctccatcagagctcttgggtaaccagctgcatcatgaatgagtggtaatgttctgaagagtcatttttttctgagcattagggcacagtaaggctcaacagtggacttaaaatattcactcgagtatgccctaaacacaggtaccatcatccaggctgtgttgttgcatttacaaagcaaggtcagagtagattcagcataatccttaagggccctaggactatcagaatggtaaatgagcattagcttcaacttaaagtcaccaggtacatttgcccttcacaaaagggcaggctgttcttggaagctttgaagccatgcattgattttttctctttagctatgaaagtcctggatagcatcttccaatagaaggctgtttcatctacactgaagatctgttgtttactgttgtcaccttcatcgatgatcataaccagaacttctgggtgacttgctgcagcttctacatcagcacttgctgcttcaccttacatgtctatgcagtggagatggcttctctccttcaacttcatcaaccaacctctactaccttcaaatgtttcttgtgcatcttcctcacctctctcagccttcatgatattaaaaagagttagacccttgtctgaatcaggtcttggctcaatggaatgttgtaactggcttgaacttctattcagaccactaaaatgttctccacatcagcaatgagactgtctcacattcatattatttatgtgttcactggagtagcacttccctcaagaatttttcctttgcattcacaaattggctatttggcacaagaggcctagttttcaacctgtctcagttttggacatggcttcctcattgagctaaattattcctagcttttgatttaaagtgagagatttgcaactcctcctttcacttgaatgctcagaggccactgtaggattattagctggcctgatttcaatattattttgtctccgagaatagggaagcccaaggagaggaagagaggtgggggaactgctggtcagtggagcagtcagaagacacacattaagtttgccaccttgtaagggagcagttcatcgcactccaaaacaataagatcaaagatcaccgctcacagatcaccaaagcagataaagtgataaactttaaaatattgcaagaattaccaaatgatagagatagagtgagcacatgttgttggaaagatggtgctgctaatagacttgcttgatacagggttgccacaaagcttcaatttgtaaaaaaaaaaaaaaacaaaaaaaaaaaacactcattatctgcaaagcatgctaaagggaagcatggtaaaatgagctgtgcctgtgataccagcaaatatttattacacgctgcatttctttaaattgtcttatatggcgggtattactttttcctatttcacaggtcagaaagctgcaatgcagagaggagaaatgatttgtttaaggaagtagagtaagtaggcatcagaggcagcattacattagcttcgaagtctttattttcactaaaataccctgccttcccctcccttttgttgctctgtgtcccactttagtatgaaggggcctatgtttatatcacagtaaagtcatgacttaagtagttttagacatagtatttcccccctcatgaaatttaactcctgcagcctattctatttctttaacaaagacatacagaatcatattaattatctttttaaaaaacctgaaaataccatcaagatacttatggaactcacatgaaagtgaaatagggagtatgtccccattccctcaaggaattgagtaataaactaagttttaaccaccaatggtagcaggtttgcatgccacttcacccagataacataaacacaccagttatctgcaacccctgtacgcccaacatggtataaagcaaaaagagaaccatttaacagcttttatattagctagtcattccagtaataaaacaggaagacaatcatacataaatgtcaccacacaaaaactttctctattacttattaataaccaacctgataatatcattaacggcttgtagagctaattgcggtggctttttactgctccctttgatatgtgcactatcctgaggaggataacatctgttagatctaactcatcccaaacatcaaatgtgacaccgtggtgtttaaataacttgactgcgcgctatttcagcaggtcctttcccgctctcctttctcatcttcacaaggctgaccacaggcagaggccttcctgtgctcattactgagtttcatgcagacacgatggagtgggagggaaagtttattaccttcattctgcttgaatccatccctgactttttggtccttcacagatttctttgggaaaataaaaatgatatattgttttctgaacaaaaggaaattaatttcaatcttttaaaaaccaacttgaatgttattcagttcggttttttccctaaaaaaaaaagtttcagattccaaagtttttcaaaaagtaacttcaaatttcatctatgtcaaaataagtaaaataggtcctcttgtcctattgagaatgacaagctcagtataatcttggaaaaatcaatttctataaatgactaacccgccaattgtattttgattttttttaaaaaaagaggtgcctatgcagatgcaggatacatataaatatagagtcaaccatctcctagtgactcaatcattaaatatttagctgacttaaattacactgcatgcatggggactacagttaatgacgatgtattgtggaaaatgctgagagactggatggtgtgttctcccagcaaaatgctaactaagtgaggtaatacatttgataatttgctaaatttaaccgtgccacagtgtctgtctacttcaaaacagcacgtggtatataataaaaacatataattttatgtcaagtttaaaagtatatttatactaaaaattaaactcatttttaaccctatagtttatgtgaaactatatgttatgtaactgaaatattttcacctaatgtgaaatcttgtctctgctcctgccacaaaacagaaacatgagaaagtccactcgtacttgtcagaggtgggttctcttcatcttgctgattcctctggtgggtctggtaaggctgagcttggtgttccctggactcccagaatggtttgggtccagcactgggctggccctcaggaggctgccctgcacatccccgtgcctgtgctgggttccgccccagcctgtctgtgaaatatgcgtgtacgtacgtgtgcacatatgtgcgtgtatgcatgtgtgtgcgcaggtataagggacagagacagacagatgaacacagatggagaaagaaaaattggtaggttgtattgagattccaatcaaaatctaaaatatgattttatagtttcaaactcaatctaaaccttttttgcagggtaatgttttatgactaagcagacgcagaagtcactctcaaataaatatagactacgtcaataaggtaacattgcattcaattatctccccaaggcagaatccctgtcttttctaaatgatgtaaataccttgttctctgtgtccacaatttaaaatggaagttaattaaaaagtcgacttgagcagggaccccaaatatagattcatttatttatttatttttaagttacacaaaagtattactatactagggtgcacactacaaaatatgctaatagaatttttgaagcaatgatgtgaataaaatgaatgaaacattttagaaggttcataaaggcaacaagaattgaaaatccagtaattacacactaagaaaaaataagcaaaaaaaaaaaaaaaaaaaaatttctccaaccaaatgtttactggaaggctgtgataatttttatactaaaggttattattctcaacaaaagcttatttttttccttagtaatagttcttaagctcaatttacaagcacaaattctctaatcttattgtgagaaggctgttacgaataatttttgttgttcatacagagaaattgagaaacaacgataataattgctcaaattattgaagttaagaagaaaataaaaattaatggtctagtgtttattcttataaaccctcctcacaacacacacacacacacacacacacagagagagagagagagagagagagagagagagagagagagagagagagagagaaattttccacttgtctgcaaatagtccctaaggttcttagccaaggtgtgtacctcaaagtctaaagtatgaagacttaaaagtggaatcaacagagcattttatcatgaaagccacacaagtgtggtatctgaaatggtgttctaaacatccttcgaatgctgccttttcttcaccttattgccaggaaaagcacagaagaatgcgtcaggtggaaatctgcatgggaggacaagcaatgaaacaaggtggcctctggctgagtagatgcactcactcattcctccaaccagcgctgtctgtgctaactccatggcggaattcctctgagtgctggggaacacaacagtgaacgtgacagacaaggtccttgtaaaacacacggtctcgtggggaaggcagagccaacaacacaaaaatattctctgcaaagcagagaactgaggtaaactcgtgtggttgtcagtgactggggtgttattttaggagaaggctgaattcatgcaattcttgagttaattatgttcttcgggctggccctggggactgcagtggcaatggaccaggtttcattgcaggaggagggtgttggcagcgactctgggcagtgtggggctaggccgaggaaggcgcctgaggagacagacacccttcctctctgacctctagggcccaggtccagcttcccaagacacccagcacaaggaaagctccaatcgtcatctttcatttctatcaagagtgacacttacggatctctaacaacgtttctatccaattttgggtctctaactatgtttctatcctgatgaaaaaagccagagggtttaataagaaaatgaaaattaaatgcactacttcctcacttagcacacagcaaggttgaggggcagcttttctgagcctgaccctaggaatttcctaactcaggtcaaaaggtgactgactcccaagccaaaggtctctaaggacaggtgtgttaataacaccactgccatgggtggagctttcagaggtctccaaggacagatgtcttaacaacactgctgccatgggtggagcctctctgtgccacgtactgtgctcggggagggacatgaaccacctcaccctggacccctctctcttctccagtatctgcattacatgtgcccagggggcccttctctactctgctgggatgccagcatctggcccagcatctggcacagaacagactcagcccaaatgtagaatataaagtcgggtatgggggtctgatgccctggcaaaggaactgaaagacttacccactgtccagtccaaagtccctaaaagaaagtcacagaggccaagaccccagacactttttgtccccaacacccaaagcttcattttaaaatcctttcagttcctccagaaaaaaaaaaaaaaaaacaaaaaaacctgaccctcaattcttagacattttatgtaaatgaggagaaagtaaggtgctagcccttcccgatcacttcttgttttgaatggatgtgtgagtcctgccaaagtgcaggctagtttgtgttctccaaatgcctcctagctcagtgagggtggtgtgcgcagggctgggatgggccacacaacatataggagcccaaatagcaagaaggcagttggagcacagcttaatcctgttgaaagaagccaccaagaagagctggggcaccggtgggtgcaggtgatgagcaaagctaccttcttccctaggtaatgattgcccatggggaaataatcagtaattcttcatctaggaaaatactagttgctgttcagagcctctgactggaagtgaggcatttccaagtatcaaacaatgattaaaagaaataaaaaacctttgcatcttggcatgctcatttaagaaagaaaacaaaatagacgtacacacagcccatttgcattccctctacccagtctaaaaggtgtccgatgattcattttaatcatttaccaatttcttggtaaccagtgtgtattgcagcagatacttggcaaaagcatgttaatttgctactaatatctgtataaaccagacattaatattctcaatttacaaataagcaaccagaacttcagcgaagataagtaacttagccaagattatccttctaataagtggtaaagctggaattcaaacacaggcctagtggagtccaaagctttccccactcctcagtaaaaagctaaacaaacttcctaattttctgagcttcctacatactctttgcactagggtaacaaccccatggctggctttattgcagagtttctctgcactggcatttggcctttgcctgtctaattttggctagttgcataagattctcacttagtgcaggctcaaggtgagacagtatttttgttttttcttaggtttatctctggagattgccaatgcttgcaagaatagcaatgctatcattaacctaataatgttggattaacttcaagagctgggtaatagcgccaatgttcatttcccgtaaatgttggaaactcctttaacctcatgagatcctacataacgtgggaaagagtccagttctgactccaaaatcttaataattcactctttcgttaactgctttttaaaaattaaatgtataacaccaaatagtgaaaaataataataatcagtttgtacctaaatttctttaaagaaatttttagttttttaaagaaatctttccaatgattctgactttttggaggggaatgccacatggtgattatactgctaaggtatatatatatatatatatatacacacacacacacacacacacacacacacaccttatatatatatatatatttggatttttttgagacagagtctcgttctgtcacccagtctggagtgcactggcacaatctcagctcactgcaaccttcgcctcccgggttcaagtgattctcctgcctcagcctcctgagtagctaggactatagatgcccccaccacgcctggctaatatttgtatttttttagtacagtcggggttttgccatgttggccaggctgatctcgaactcctgacctcaactgatccacccacctcggccttccaaagtgctgggattacaggcatgaaccacaatgcccagccctgctaaggtatattaacggtcagtttagtattatttgactatttgttaacataataggagtaaaacttaacactttttagggtagagatggtacaaaaaattaaagtgtaataaatataaatctataaaaacagaagttaaataagaagaaatcttctggggaagaagaaataatagagtatagattattcttaacgtaagtcaaatatttgataaggaccacaggcaccttcttttaattcagatgctgaattttctttagtcctagaaagaagtgttgttagaattccaaggatatttggatgaaacttcgctgtaaactcacgtggaaactattttagctggccacagatgtgaaactaaaaatgttgaaatacttatttcaagtgcatctcgaaaatctgcaatgacttcctcctggaagataattttcttactacgcatgcttgacatggatttcgaacatctgcaatgacttcatccaggaagataattttcttactgcgcatgcttgacgtggatttcgaaaatctgcaatgacttcctcctggaagataatcttcttactgcgcatgcttgacgtggatttcgaaaatctgcaatgacttcctcctggaagataattttcttactgcgcatgcttgacgtggatttcgaacatctgcaatgacttcctcctggaagataattttcttactgcgcatgcttgacgtggatttcgaaaatctgcaatgacttcctcctggaagataattttcttactgcgcatgcttgacgtggatttcgaaaatctgcaatgacttccttctggaagataattttcttactgcgcatgcttgacgtggatttcgaacatctgcaatgacttcatcctggaagataattttcttactgcacatgcttgacgtggatttcgaacatctgcaatgacttcatcttggaagataattttcttactgctcatgcttgacagctgggtctccacactgcatcacttccaggctcctttcacacagccctcctggcattctgcctggaaatatgtcatatagcaagtttcacacttttttaacatacttgcaaaaaatcttaggttagtgctaacctaagattagtgcattgtttctaaaaggccaacgcattacatttttcctgagaataaatattgacaactccaggatttaaatagtgcacttggctaagattatggattttaggtagtctgtatatctttatgatattgtcctatgtattttaacattcttcacttttcttagtactgccatttcatgatttttttttccttttggatgctattgattagtacataaattccttggttgtacaccctgttttcattgctaatccagtagaagaaaagcaatatgcccaaaatcttttacaaaaaaaaaagctttcttgcatctgctgcttgcattctttgtgtgatacagtattttctctcattattgttggtcttcaaaggcaacaacagcataaggtctgctcaggccagagggcctcctgatatagtcctcatggagaccacacagagcctttccaagaggtcaaaggaggccagaagtttttggttctttttctcctaacttttatgttcatcccaggtaagcctccatctccaatctctgtctactagaatctatacacaagctggtgcaccagcttgcctgctctcacttgccttcctttgatgataccataatgtctctgattctacaacttaatttttctttcactcaagtctagtccagtagatacacattcctgttatggcaaaagatcatgtactgctatttatggaactgtaatttattctgtacttataggtgaattaggcaaaccaataatgccagcaaagcatatagattgaggccaacatttgcagtcattagacaaagtggactcagccactatttctaagtctttagtttggcctaatacctaatgttacattgatgccatactgtaagctccttgaagtaattttctacatttttaaaactcagcctatcattgctaaaataataaaaattctaatgcaagttgctctttatttctattacctgtaaggacacttgtatttgagaatacacacttgaaatgagttaaatataccaacatggatgtttggcttcaaagaccaggagcatgtcggatccgggctcactgctaagctttctctgactaggcatataaatcaacatcttcagtgcttttagggccaccatgcagcaattccatgatgcttggctcaagctctgcgcatctcacattagtcctcctttcacccaagctggctccagtaattgggtgactgttctggcagaatcatgtgctaccatttaaagtgaactagacaaccagttgatactgggtgaggataggagattcttttttttttttttttttttttgagacagagtctcgctctgttgcccaggctggagtgcaatggtgcactctcagctcactgcaacctccacctccagggttcaaacgattctcctttctcagtcccctgagtggctgggattacaagtgcctgccaccacgcccagctaatttttgtatttttagtagagacggggtttcaccatgctggctaggagttggtctcaaactcctgacctcgtgatccacctgtcttggcctcccaaagtgctgggattacaggcctgagccaccatacccggccgaggctaggagattcatagaggacagagaagacattctaggcttcatattgaaattgtaaatgtgaacccataaacaagtcaatagagatcaacttttgcatgcacgatcttatttactcttacataataccaccaactaccacttaactggaatgtcataatgtagaatctagacaatctttattaaattattaaattagctagaatcactcaacatggtattgtggtaagagtaaataataaattttatctagcaaatttatttttggatatacattacttcaaatagttgtgtgaccacaggagcatcataactctcaccggttttttcttctgggagacagctaataaacaactttactacaatttagaaaataatcctttagatttagttaaaattaaaaacatttcatatactggtagctcaaataaaattttggttgctcactaaaccatattatttctcagacatgattatatggtcattttgattacaaaagaaatacaaagcaaagtttatttggaaaccttttcaaatgtttctacattgttagcaaagcattatatattttcaaaagtatccaaaattttttttgttacactgtagtaacttataatctagcttgtatttcctattttcccataatattaacaaacatttacgtatttgagaaagaattccttgaagcataatgagaatatacttgttcaaaaatctcgctttcatgttttcattttaggactataaacattaggtagttcagaagaggaggtgcaatgcaaaaggtcctctgcaatgctagggagctctgggcaaagtgagagcgttctgctttcccttagagaggtcctggcctaaaatgaacacgtacttccacgagcttcgggtgtgatacagaaatatgtatgactctatgtaatccttatcatggcgttcctaccaactcaaacatttttaaggttaactgagtactcgatgtaattgtaatacatccacctagtcactactacaagatagtctgtgtggctgcaggctatgaaggatagctttttattttttccttatcaaggtaatatttggaacacttcaaaaaagccatcacagtgccattatagatgaaaggcttcccggtagaaatttcatttcctatacctgtaacaggctttcctgcagaaatgatagcatatgtgatacatccaaaaggcttatctcatgaagtcccagtgaaatgtattaattttgcttttggaaaataaaaacatcactaatttactgagaactctgcaatgcagtgtaaattctgtacccaagaagtagagctcatcacttaagtgaatagaaaagtagcctatagatgttactgtggttatgataaaacacttttaaatcctgtatatgtttaaagtttaaagaaaagcatttgcatctcgttttcctagtgtaattaattggaccttgaatgttgtatgtttccctgtgatatttgaatgaaagccaggggttgtcttattatttgccttaatatctatttgcagtaaaaagctaacaaagaagtgtccaaatttgcaggtagtgaacccccatttaaaagatatactatctcaatcaactcacctatgtaactttattaatataaaaagagatatcctggctgagggcagccagaagttactctgggataactagccttcaagacgtacctcttggtagtcatactctagcataataccttcccacaatgaattatggctgccctgtgtgatcaatacaatataacagcagtaacaatatgtgctagattatataaaggaatgcagctgccacttgaacatttggattgctcatccaggggaagccagctgtcctgccatgggaacacagacactgtcctgcagaaaggtccaaacagagaagaactgaaggcccttggccaacagccagcatcaatttgccacatgcacttcagtttgccacagtgccaaccacattggaagtgaatcttctatcatcagttaagtcttcagatgaatgtagctcactgacatctaactgccattgcatgagatacccaaatcaagaatcgcccagcagtctctccacaattccagacctacgcaaaccatgaaagataatgcatgactattgtcctaggccatacgttttgaagtaactcattatgcagccatagacactgatacaaacgccaaagttacaagaaattctcctttgtttgcaaaaaaaaaaagaaagttcttactccagatgcccactgtcacctggggttgttgtgtggtttagcagtttgaatttcaaggtgcatatgctttaaaataaagggctggctctcaggcctagtctgtctagctgagcatacatataggactattattatctgagttattaacatttcttcaaacacagcattatccagtttaaattctgtcttcctcagtagacactaagttgtagaactcaggcactgtgctgtacccaatgcaccaggcaccttttctggtatacagtaaaagctcagtaaatgttggagacaggaatatgtcattcatatgtgaataattaaatgtagacaaagcgaatcgaatcatttcttgaagcctaatgagttctgggcaaggccttaagctgagttaagagttactattgcagagcttttgttttcacttccaggcagtccttggaatgctgctgggccattttgtttgtatatgtactaaaccagctgggattgtaggagttttagaatgttttgaaagaataaatttctctgaaatgagaagtggattgtcattttaggattcggagtagttgaggatgtgttcctcgtgtttgaacaggagtgcagtcagcattagtgttgtccagccctccttgctgccccaccacatagaatatcgagccagctagtccctttgtttttaggtgggacgtgtcactagttctggctaacaaggtggaacgatgggtatcacttcccagccagagcataagacgccaactcttccctgcctttgtgactgtggcaacttgtcatggtggagcctcgtgacaaggaccttgtctgtcgcgttcactgttgtcactcagtcagcctggagcccgaggtcccacatcgagcagacccactctggacccgtcgcttgtgttagaaaacattttttgttgttgtgtaaagccactggaactattggcacatttgttacagaaacataattttctgtgctgataaaggccagtgtaagatcgatataaattaatcaccctcccatatgcacatgcacacacacacacatttatacaaaagaagcaatcatatttactgtgtttttacctgcccagaattcttctccttttttggtaagaacaacttcactgacttctgagaaaccacaagtctgatgcatttaggttcaaggtgggctaacttatcccctaaacacacaggcatgaacacacacacacaatatacacacaggcatagggtttgactagggtgggcctatccacctgtttagttcccatggccatagtggtgttggagatagtatgcaaccgaggacagcgcaataagggtcactcctatgacttttgctggaactattaagaaagaggccttctcttcccactaggcttgctaactgatagaatgtaagcctgaagcttatggtgcctttctgtcaccaagaggacacagctgacttaatgaagtaaattccagaaaatttgcttaattattgttaaatgattctgtgaactctcttcatttagcaactgttcaggaaggtaagaaaaagaagcaaactcgggaatatcaacagatttgagatgtctgaattaacttcgagcacctggattaagtcatgtctaggccaacattaatgccaggaactcaaatatttaatccaacaatctctctttttttcttacgccagtctggctggatttctgcttcttgtaattgaaagagtcctagctaatacatcttctatatgcacacggctgtactagatatttggaggtagatggaaatgcagaagccgaagacaagcaaatataacatggtccttgcttcagaaatttaaaatttgtttacagggacaactataataaatgaaaagctaaacgctccaatccatgagctcttccagcagcgttaaggaggtctagaaaagctacttatttcctgcactgtcaccgctgacattgagtgttagggaactccttacccatttttattgaggcagaagagcacactcggcagtagaaatgtaagattttggccggtcacagtggctcatgcctgtaatcctagcactttgggaggccaaggtgggtggatcacttgaggtcaggagttcaagaacagcctggccaatgtagtgaaaccccatctctagtaaaaatacaaaaattatctgggcatggtgactcccacctgtaagccaagctacttgggaggctgaggcctgagaaccacttgagcctagtacctggacgttgcagtgagctgggatctcaccactgcactccaccctgggtgacagagcaggattctgactcaaaaaaaaaaaaaaaaaagaaagattttctcaaatttgtggaaaagaaactaaacaaaaattcactatgaatcaatttactataaaagttctatttaacacttgcaacataaagcaaatactttaaaattaaaaatcccagagtgctatgtaatacaaacatgaaaaacatataaaaggcttctagtatcatttcctaactaacatctggcttactgaataaagctttataacatcaacttcatttttccacagttattatcataggtagttataatgtttttcttaaaaaaatgaatatcaacacaaatttgctgttataaagagtaagacaacttcagccagatctttctctttttgttttttttttttgagacagagttttgctcttatcacccaggctggagtgcaatggcacaatctcggctcactgaaacctctgcctcctgggtgcaagcgattctcctgcctcagcctcccaagtagctgggattacaggcacccagcaccacacccagctaatttttgtatttttagtaaagactgggtttcaccagttggccaggctggttttgaattcctgacctcaggtgatccacccgcctcagcctcccaaagtgctgggattacaggcgtgaggcactccacctgggccagccagatcttttaacttcatcaggatcttcactttattttcagggaaacaaatatgcaaatctccttttctctacagtaatctgtgtgtatattacatgatgtggcaaatgatacattcctgcttgccacaactaattttcactaatttctccagatattctatttaagagggctattttctaatgggcaatctttaatattgatccagtaatttaccatacagactcaagaaaaagaaactgaagatgtaaatttttacttcagcaaaataccttcttcacatgacttaaaacataaacatgattatcaggaagtattatgaaaaatgggactatgaaaaatgggacaataaaaattctcctagggaaacttccatcaacaagaggggacggaaaaacagcattttctctcaccaaggaacaatcccctccccattttttttcatcttgttggtgaaactctaaaatgaatgtgaaagccacataagcaacagcaattgggtaggaactgtggaaggaagccagagatattgtcatggagagacatcttcctgaaagtgaggggaacactgaggggtcaaaatcagaatggggtaaaccaatgggtggatagctccactagaccaaatttggtttagagtaacagaggaggcaggtgaaaattaataatcacacagcaaggccacggttggaagaagcagtctgtatccatgaggcagagagtaagaaagtgagcaatactagaatagcaggtggactactgctctacgccccaccacatacaggacacccctccacaatacatgtccatgaaacccaagtattcaatgttgaataacacatacacacacacacatgcatgtatgcatgcatgcacacaatctatacaaacatactacaagaaaaagtctatttatagactaagaaatctcatcagaaaaatgttgttactcaacagaactctctggcaacctattctagtaagaaatgaaaaccaaacaatgaatcaaccaagcagttgtgtccatgaaacaagacaacagagcagaaatacaagagctggagacataacagagaaacttaaggaacaactgaaaaaaaaataaaaataagatgtgaagtgacacaaaggtacaaactcactgcaaaaagcactacaaggaaaaagatagaaaaaagaacaatgagctaaacggcctgtatgatttggaaaaaaaagaaatcaaagaagaggctgggcacagtggctcacgcttgtaattgcggcactttgggaggccaaagtgggcggatcaccttaggtgaggagtttgagaccagcctggtccaccatggtgaaaccccatctgtactgaaaatacaaaaattagctgggcatggtggcaggtgcctgtaatcccagctacttgggaggctgaggcaggagaattgcttgaacctgggaggtggaagttgcagtgacctgagattgtgccactgcactccagcctgggtgacagagcaagactctgtctcaagaaaaaaacaaacaaacaacaacaaaaaaaaaaaacaaagaagatttgaatctacatatggaaataacactttgtaataaaaggaaaatgacctgtagacaacaccagattataacttattaaaatgatcagtttgtggtttgtggagcaaaagaatcttctggacagccaagcagaaagatcaattcacttatgtggagaaataaatcagacttgcctctgactttcccacagcaacatgtaaatatcaaaaaaaaaaaaaaaaaaaaaagctaaaatgacaccagtaaaaaacacaaggaaagagtgttccaagaaaagtaatacagcatgttgaatattgttctcaaaattttttggaaaaaaccgaactatcattagcttaataatagaactaagactgaaatcattgtggattttagggtaatggaaaacagtttagtgcactttgtcctgactgtaaaacaacagcatttctttaaaatgggaggtgaaccagaaaaggtagatgggtgggaagcagaggaagtacatttcttaaaacagaggatacatcttttctcaaatgcttatggaacagtcatttccttgaagagactgcatatcaggccccaataaaatatgaattaatttgaatgagggaactactatatacatcatactctgagtacaatgtaatatacacttagaaattaataaagcaaaaataacgtgttattaatttaaaataattattttaagcaattcttgaataaaataggaaatccaaatgagaatcacagaatatagtaaaaacattgatgataatggaaacgcaacacaaggcaacccacgctgtgcatctgaactgatgctcagagaaaaattcatagttgcaaaagcaagtgtttttaaaaacaaggaataaaaagtatgttttcatgccaaaatgtggcaaatggagacagaactacgattaaatatatataaacaacataaccataaaagtcagaaaaaaagaatattaagaaaaaaatagaaattgctgaatcagaaaatgggcaaaaagagcagaaacatcaaataaactaaaaagctagttcttcactgggaaaaaaaaaaacctatgcagatactccttgacttacaataggtttatatcaccataaattcattgtaagttgaaaataccataatctgaaaatgcatttaatacatttaactatggcatatcatagcttactgtagcctactttaaatgtgttcagaacacttacattagcctacagctgggcaaaatcatctaagaaaaagcctatttttataataaagtgttaaatatctcatgtaatttattgaatactgaaagtgaaaagcagaatggctgtgtgggtagttcaattacggttcctactgaatgcctatcacttttccactattgaaaactcaaaaaatcatgtcaaaccatcataagttgagcatcatctttaagcaataaacttcaaactaatataaggaaagagaaagaaaatatacaaaattaaaataaggagaatggtaaatatgagggaaagaactttgcacaattctttgtaaatttattaacttgaagtaaatgaacaactttataagaaaatagaatttatcaaaattgagtcaagacaggaaatctcatcagaccaatttccacagaagcaaacagttattttggactcgataactttttaaccagctttaagcaacttctagagattattctgagtatttcaaaccacagtgttgccgggtgaagtggctcatcccagtaatcccagcactttgagaggccaaggcaggaggatcacctaaggccaggaattcaagaccagcctggccgacatggcaaaacccagtctctaccaaaaaacaaaaattacccaggtgtggtggcacacacctgtaattccagctactcgagaggctaaggcactagaatcgcttgaacccagaaagcagaggttgcagtgagctgagattgcaccactgcactccagcctgggtgacagagtgagactctgtctcaaaaaaaaaaaaaaaaagtttcaaaccatagtgtcattccgataagcagtattattccagcgtttgccaaccatgctcaggcatggagagttaaggaaattaatagccatatgtacttttctccaaaaggaatctatcggaacacaaggccgttcccacactttccacttcccactcacagttgcccccctactccctcacggtaaaacaaatgcagaagtctcactcttgagggctcttagcttaattcattgtctcggggtataagactttaggctgacccccaaaaaaggaaaagttaaaatatgtgtgtccactcagcctcctttaactaaagcactatacaataaatcataaatagtaggggtttgtgtctttccttgtcatatatatatatatttcttttatttcctttttttttttttaagacaaggtctttctctgttgcacaagctggagtacagtggtgtgatcacagctcaccgaagcctgaagcctcaaactcttggcctcaagtgatcttcctgcctcagcctccttagtagctagaatgccatcatatctgagtgattgttttttagctttcttagagacaaggtcctgctgtattgcccgggctggtttcacactcctaggctcaagtctcgggctcccaaagtgctggggttacaggcatgagccactctgcctggccctgtcatgcatatatttctgttaagggtatagggatatctggccagtgttgggatggtctggactcagatacccatgaagatctcatctagtctcaaggctttaaacaccgtctggattctcactcccagatttatatcttttccgccttgctttgttctcaacataactggccaacttcttctcaacattggtttacagcatgtccatgaacgtgaaattctttcaactcacaaggcccaacaccatctggcgcctttcgtcacttgtagctcgcctccagctctcctcactcactctggcctccagcctctcctgccagcgaatgcttgcccccttggagctttgggcttgctgctcctttaatctcattcttccccatgcagccctgtgcctcactccctcacccgggctgcgtctttactcaaatgccttcttgtcaaagaggtcgaccactccgccttatttagaactgcactctctgcttcctatccccagcgagttttatttttatctacagcatatatcaccatctgaaataccactgtgcatatctgatggatttatcttgtctgtcgtcagccttttctctttaaaaggaggctccaagagggcaccggtgattcctttccattgtgtgaagctgtaacccccacacctaaaacacagcctgacacaggtgtcagaaatagttactgaatccctggaatcatcaccgtattcctggattcaggaatggggaaaaaagtgttccatctgaggacagaactggatcaagttccaaagcagcctcaaagtttggatgggattggagtggggagtgacacaagtcgttgtaattacatgggcggggaaatcatggagttttgtgggaggaaggccaatgtcagaagaacgtttcagggaaatgggtccaggtggctcacttatcatcattaaaaagctatgcaagtttttacttctctttctcctctatccataaagtcctggtggtgaaggcttacctgtttttttcatggcattaaaccgaaccattcacttcatgattttgcctggtatcccagtaggtcttccctatcctaatacataaaatagaggttggttggcaatttgctgcttcatctgtcagtttagaaataatcctttttggccgggtgcagtggctcatgcctgtaatcccagcactttgggaggctgaggcaggcggatcacgaggtcaggagttcgagaccagcctgaccaacctggtgaaacccccatctctactaaaaatacaaaaattagccgatgtggtggcatgtgcctgtaatcccagctactcaggaggctgaggcaggagaatcatttaaacacaggaggtggaggttgcagtgagccgagatcgcacgattgcactccagcctgggcgacagagtgagactctgtcagaaaaaaaaaaaaagaaagaaagaaagaaagaaaatccttttttcttttcctcattagcaaagagctcagtgcttcctccaaaaggatattgggtctagaaatttgccaaatacctgtgagcatgtcctttaggattccaaatagtacactcatattttgaaatttggcaaaggcttgaaaccaacacttatgggtttttggtttgtttgtttcactcttgttgcccaggctagagtgcagtggtacaatcttggctcactgcaacctccacctcccaggttcaagcgattctcctacctcagcctcccgagtagctcggactacaggcgtgcaccaccacacccagctaattttgtattttgagtagagacggggttttgccatgttgggcaggctggtctcgaactcctgacctcaggtgatctgcccgcctcggcctcccaaagtgctgggattacaggcgtgagctactgcgaccggccacttctgattttttaaaaagtgaacatagagccacacaccaagtaaggaaatacttttagcagcatagaatccaacgcttgccttccttcatagatctctatatacacaaaatagaaatgaaaccaagcactaggcctatattattaatgcaagaagtgtttgcttgggattggatgagcaaaaatgtcataaaaacaaaacaccatgaatgtttcacaatatgccccgctcagaggtcagcccctccatgtgtcctgcagagctcctgaagcctttaagagacaactcaaaaaaggagtgaggcagcctgttctgacacttggacgtcttccaacgcagactttcagtattatttttctaaacatcctaaatctctagtgagaacatggaatagactatttctgtaatggcagatcttacaaaagagaaacaacttcccgaaaacatgcctatgtccagtcacagagaccaagcatcaaaatcacctgcaggggtttctctaagtcgccctcacacatgcttggacatctgtatgaattcaatgcacagtaaatactcctttgagggtctcttatggacaagacttcgagagaagaataagatacattctgcctccaaggaactcatcatctagtccacggtgtgtggtgatgggaatgcagatgccaggtgctatgaagtgaaccgtgtcacccccaacatttacatgctaaagctctaaactcagatacctcagaatgttttgggggacacggcctttaaagaggtgatcaagttaaaatgaacccattagggtggacccgaatctaatctgaatggtgtccttataggaaggcaagattaggacaggagagatactggcgttgcaggagcccagaagaaacgctacgcgggggtgtagtgagaatgtgccatccgcaagccaaggagacaggcctcaggaaaaaccacctgctggcactgtgcactcagagtaaaccccgagtgatctcagagttctagactccagacctgggagaacatataaaccacgcagtctgtggtatggcggccctagcaaactaactcacctgaatgtaaatatacaactacaaagcaacaaataaaaagatggcaacaacaagcaagcaatggaatggaccctcctgctgggctgaacatcaagacagggatttagaaccagctttacacaaggagcatcatttttccctaggtatgatttttatccaattcactttgattaatgacagctaccatttagcaagggctttttatgtgccaggcaccaaactcaacacttttcatgcattcacttactcaaccttcactgcaaccatgtaagatcgttgccattgttattccaaatggacagatgtggacactaaaacagagaggtaaattttgacctttgctgaagtcagatggctgcaagagttggaactagagttcaagtccaaagagtccaactctagaatccttagaaccactgtgcatactgcatgaacagtactcttaccttctctagtcaagagttcaatgtgaactttattccagaaaaacacaccattcaacatcttcatcaaatattataaagaatgcagtacttagatatagactctctatgcagcatttcctagctacatttgacctctctgtttcaatgtatctgtgtagcaaatattctatgaaacacaatttcttaattattgacctcgttgtgtctttaccagcactgtgactataccatgtggtgtgagagtcactccagtgaataaacacagactgaggtcaagagtctaatcattaccaaggccctgggaaccctccttgaagagaagagataggagcgcactatccaccatgaaaagttgaggtaggtagcaaagtcagtgtctacaccacccgccagcttctcctcccctcttccacacgggtgcatggctgccaccacttcctgatgggaagcttttcagaatacagataacatcctcactctcctgcctccctccccaccccagtatttttatttagtagatctggtatggctctaggaagctattcttgaaagtttaataatgattccaactttctgccaggtttaagagccataataatgttgaccaaaattgtagattttccaggatactctaagctttgataattttgtgcggacagttactagatcatgtgatctaaacgagggttggaaatacccccatttatattcccaggcagactttcccttgcccacttccaaagcaacctagactttgggactactctattccctcactgctcttgccctcactcacttaaaatacttttatctaatacaaaggtgctagatgttgacctgattgaagtagagctgttaagaggtaactgaagcttcagctaaataatgccagggggtaacattgtccagggaaactgttcaccagcagacctctgttgctcctgatgtactccaagttattttcagtttagcctttcataacgttgtacaaagaggctttattcataaaacagtagctttggttggcctcccacatcgtgaaaacaaatgtaatatagtaattaagtgtgctgatatgttatcattgcaaatgtcaagttcattgtagcagatgtgtcaactgaagatcactacccattaaaatcaaacaaccagtaggccccaaactcaccatctgatttcatgcgtcaacttcaatgcttaagacagtcaatcacaactgtcttccatgtaattgtcttaaaattattacataacaaagaatcagatctcaattcttatcacctgctagtcataattaaaatgtgaatgaagggctaatgactgacacagttacagggtataaaatactttcacaattttacttccccaaatagatggcattattattaagaaaaattactcaaaatgtgaaataaggaaaaaaacgactgatgtgttaatgtcttgctagagcaaagctcactaaatctccttgaactctctagagaaatgtaacttggttaaacttactacattttctattcatttgggcccaggtattttacacattttaaagtttgggttcctaatttaaaaaaaaaaagtgataaaatcagatgactaatatttttatcaagttaaaaagttttattatccagtaggataataaattagccactatgatatctacatcttttcaattttatttcagcatttctttttcatctgactatataaaattcctactctcatatcttcttttgaaccagttttgtcatcctgctgattccctcattagtagtcacatggatcttatgaaaataaatataatatcccattagaaacatatctgctactagtcggggtacttacataaagttgcagcaattatcagaaaaaggtaatatgcaagtctcctctaaaatttcccaactatattcagaaaaaaaaaacaaaacaaaagcttaagtgactgcttaggtgaaaataagacttccagaagaatgtctgtcaaagttgtaccaagaacattttgaaaatacaggttaattcaaagaagcactcacaaaatgccctcaatatgattttgagaggaattattacaagtggtatgtattcttgaaagccaggtttagggtacatctctaaagcagaataggttgttttcaaattgctaggtcattcaaggcctttaaaccactatattctatccataatttgcaaacgtaccactaacttacactaaagagatagtgagaaataagttcttgtggaagcaatttacacatacagagttgactataaagtcctaggcactttggcaaacatgcttaggggtggaaagtttcttttttggtaaagatcccatagattactatttacattttagcatcatctaaacaatctggaagctcctgaagctcatgtctcatcttcaccatggacacaatcacatattcttactctaagcatctctcatttttattctagttgattctcattcttcattcttcgtaaatgattataatgaatcctctgcctcttccttcccctcttcttcacctcactttcccctcccctcccagctttccctctgccttctcctcccctccccgctccttgtcttccatccctgcctctcccactccccctgtctctctgacactgttgtctccaaccacacacaggctccctgggtttctttcacaaataaaggaacgatttgcatagatggggtaatgtgcatctgcttttgtggtgtaccttccattcttcctttcttctgggaatagtaactccctcccttttcttttcttttgtattttttttttatagacagtgtctcactctattgcccaggctggagtgcagtggcacaatcataactcatgacagcctcaaactcctgggcttctgcgatcctcctgcctcaacctcctgagtagttggaactacaggtgtgctctaccatgcctgccatatttttttttgagagggggtctcactatgttgcccaggctggtctcaagcttctggcttaaagtgatcatccagccttggcctccccaaatgctggcattacaggtgtgcaccaccacgcccagacccctctcccttttctgtagcacaccccaccctcaccccatgcacttttgcatgattatcaatatgggttgaaccacatgaaattgccaattttgtagatcaaacatgatagaatattagcaaatagaatcatgagattgaacatatccttttaataacactaacgtattcagtattttatcaagcatataatttaaagttgtattactagttataaatttaatatttacctctttcaagcccaagcacaaaatatttggtttgtttaaactacatcatgtaggatgaaattaatacctcaagtgggattctcaacacactaactagaaacagctctcagagaagataattcaaagacgaatttaaaatcaatcccacagcaagtaaaaccaacttttttaccaagtagttcagtcacatgggagcagcggaatcagtgtgacattttcttttcacgggatatgtgcaaccatgctgtttaaaagggaagaaataagataagctgattttatttccaccagtgaaaaaagttttcaatacagcagctttcatcgactcagcatggctaacaaaataacattatcaatgaaaataaaataatagatcagctgcacaatctaggcatttttgtttttagaggccttctctaacatttctctgtagagatctgtgaatgcctggttcctgtgaatgaaaaccaccctgctgttttttctgctcctgctgagagacttgcaaagaataaaatctttttttttttccagctggagatcaattggtttgaggactgctctggcccccaggaagtattctttgcccccatggggggaagagatcctcagttccccaccctgaccagagtttgcccccattggatagttttcaaagctgaatccagaaacagacctaaaagcatatccaaaaaatgtgccactgaaaaacagctaacgattcacatggaaagtccacaccctccatctagccgggtctcctcctgcctcccttggggaagaagggggagaatgccctttccaatttcgctcgactgaaagcaagggctgtgtctgtcccccttgctgaaaagcctccttttgtttttcttttctactgtcaggaagcctgcctcagaggagtggacaatgcataccaatgaggaaaggagagcagaggtgattgaaagtgaagataatttttccctgtcatttacaggctgcttctcaaaccatgccccttttgtgattccacttcaaaacacattcttgccaactctcatccaggaggcttttccttagtgatctgctccactatcttggagtttggcttctgttatcacctgaggagctgaaaagcgttcagattcaaggaagcctctcctctgcccaaatcagcagaatttaaggctcatgaggatgaggactgtgacagggaagaaggaggtgacagggaaaggaaatgatactttagcttatttcattgttgaatggagcaaagttgaaaatgattcttctggtgtctctccttaaatcttggggtattgatacagactcatacaaaaatgaaaaggagagaaatgaacatattcatatagtcctttggggtttcacagtgatctacctacagcgacatgttattttaaattacaataatctatttaaagagaaatatggtggaatttacttttaaaaaggttacgttgcagggatgttttaaaagataaaaattaaatggcaactcaaaaaatatctgtcaggcatttaaaaatggatttcaagacaagcatttgaatcctactttacaagaagtgactaggttaattaggaaaataaggtatcttctgataacagtaaaccttgagatacatgtgtagctcttataccggaatgaccatgaatcactaacaaatttactttctagacaaaagatggaccacttagacagcacagtataagaaacaaggaatgttaaatgaagcttaacatcatgtaacagatgttaggttttctcctctcccccaaggaggactgtaatactgttggagatgacacttgtcaactgtgcaatgtgtgtgataaattacagaagcaaaaacataatattattatttaataatccattttaaatatcactgtcatttaaataccacctgtaagaaaagttgtataaatttggcaatgaaaaatacacaatccagaaaaaattacaattaaggatcaggtttttctttgaatatagttataatttttaaaaatcccttatcacttttattaactataattattaggagactggagacaaatataaccattgaagcaaactgagtacctttcaagggccaccgtctttttcctctaacctcctcaggctcacatccccacctcaccccaccacatttaaattactttaaaaacactaaaaaatgtttcctatattagaaatttgaatctatcaaccctgatacttctttagatcctggaactccctttgctttaaacacaatgtccaactattgagaaagaaatttcccataaagaaaaccatagtatttctttggtcacagctgagaggcatttttttttttctgatctggaaaacaacaatcacagaaagcaggttgtttgcaaaatgagatcttaatttacttaaaaacagaatagtaagatgaacctactaaaagtaacaccatagcactgctacaaatgatttacagttgttcacattactgccataatattggaacgataaatgacatgccaaggggctcaaagtaaatttctggagttgaactgcacaaagcaaattgctgagtttgtgtcatatcctaccgtgaggatggcatatctagagcaaggctcaatctagaaggtgtctggactgaggattctagggtacgatgaataacaaatggaacaaagatgtcacccacaggaagtggggactacgggactcactgtggacacctaagccaccgcctccctatgcgatgaaaatctgttcttcatagcaatccagtatacattcaaacaagcagaagaacaacacggggtaagggctacttaactaacttatattatcctattttccatggaattccagcaatcataagaaaaagttccatcttcttggttttgaatgttttaaattaaaagaatttcccttcccaacactacaaatatgtacaatgacacattaaatacaactgtgctttctaaaacctgatacttgacagagagctcttcttcaaagctcaactgcaagttaaattttactgcttatcttttgtttatcaccaacaagaaaaaaattgagcttgagaactgtaagcttataactgggtaaattatgttttgtataagaaatacaagtatccatatttggattacttttgtatagatgggatatacaaaggtgccgacattacaggactgaaaaaaagagccaacttgttttgcattaaaacatttttttaaactttcaaaacaataagagactagtggtctcttaaacacagtttaatgaatttatctctggcaatgtattgtgatatgtttgtgtgataaacctgataccatgaaaacatgaaaataatttctggaatgtttcatttcttaagcaaaaatttcttaaatatgaaaattgggggcttcttctgtgcagtaataggtaagaccagtctggtctgaagcccatatcaaatatttcaacatttcatgcctatataattggctttaaaagactaaaaactctctgtacagtctgttttttttattgttgtttttctcagtccttaatatcctggagtcagaacaaatgaagaagccccatcagcttcagaccacgacacacagcttgcaagagtaaatgatttatggagctacaagcatgagttatgagggagcggtctacatatttgcgttgtgtagctatgcagggggaaagagacaaatgagattcttgaaacatttgtgaaatatagaaaggaagaaaatagaaaaaagttaataagctgcctcagatagtaactaattagatagcaaggtattactgacaaaatgaaacaagaacaaaaggcaacaaaagttggtttagggccaaacattatctgtattttcacttttggatctctactcatttcctttttttccatttcattcaaaaaactattgtgcaaatcaccattctattgtcttctaacattgccgctattttcactggattttattcaatttaggaattaaattaaaagtttcaacatttccagtcatgttattctttcatgttttttgccttaaggagtagaccatagacatcacctattttaatagtttcatctagtccagaatcggcacttggagcttcaagctgggggttagggagaaagcacagacacaggcaggctgctatgctgggccctaagggcaatgtcaaactcaagattgcagatacaggctgggcgcggtggctcacgcctgtagtcccagcactttgggaggctgaggcaggtggatcacttgaggtcaagaattcaagaccagcctggccaacatggggaaatcctgtctctactaaaaatacaaaaaatcagccaggtgtagtggcaggcacctataatgccagctactcgggaggctgaagcaggagaattgcccgaacctgggaggtggagactgcagtgagctgaaatcatgccactgcactccagcctgggccacagggtgagactctgtctcaacaataacaacaaaaaagatttcagatacagagctgttggctttaggaaatgcacagaacttactgctccataatacaaacaaaactttaaaagggtgatgactgattccagattactcttgcttttatcttaagctaatctctgtgttaggtaaggacaagcaggtttgaacggctgttaggacaaggcatcattgtctacaggtgttatgatgaccatgaagattagaaagtagtgaatctgccgggcgtggtggctcacacctgtaatcccagcactttgggaggccaaggcggctggatcacgaggtcaggagatcaagaccatcctggctaacatggtgaaacccctatctctactaaaatacaaaaaaaaaattagccgcgcatggttggtggtgcctgtagtcccagctactcgggaggctgaagcaggagaatggcataagcccaggaggcggaggttgcagtgaaccaagatcgcaccactgcactccagcctggtcaactgagcaagactccgtctcaaaaaaaaaaaaaaaaagtgaatctttgaagttttaaaataatgctatctatggatagaataaaataatcagaatggaaagtgtaaagatgacatatatatagtgagcattcttaaaactgattatcattgatgtccatctattaattaggctgccttacaaaggaacggattttctatcactggaggcactgtatatttttataacttgttcccaaacttatgattttacagaccagtaaaatttctgttcttttatttaagaaaattaagatatctgatgctaaggaacagttaaaattttcactgatttctgagagatggcaaaatgctagtaaacaacacctcttcaaaaacaataggattctacttccttcacttctgaatgtttctgaaatcgaagatgcggcagaaccatcaattccaggttcaccttgccggcaaccctgcgtaatagacttagcgtagctacaattggttgtgcctacgcaaaaatagccaactggggaaagttatttggactggtaacactagaaactatttaaattttaacacgagtgtcacaccactttgtttaaatgtgttcaaacagaagacacaatgtggcaccgaaatgcagcaattgtgtggaggcaatcaagtatcacagggcagataatgaattcaataaaggcagctgaaattgccaaatcttcaaaaggtagaaacagatcgtgtgaagagtatcactcatgtatctaaatatctttatggtgaaagcttcctactttaagagtagctgttcaacacttagtgatatgtgattaagaggtaattaagaagttaagaaggccaggctcatggctcacacctgtaatcccagcactttgggagggtgaagcgggtaggtcacaaggtcaacagatcatgaccatcctggccaacatgatgaaacccgtctgtactaaaaatacaaaaattagctggacctggtgacacccatctgtagtcccagctacttgggaggctgaggcaagggaatcgcttgaacccgggaggcagaggatgcagtgagcccaaattgcgccactgcactccagcctggtgacagagtgagactgtctcaaaaaaagttaagacaacctcaaatttaaataaagaaatgtatttttagaatatattattcagactattctgactaatgggagatcttcataggtaatactcagcaacactcgttaataggcatctctccatttgaaagactgcaaaacgctgaattctgttgtttagtgcactgaattttaatcatttaaaaattgtgatgtctttaaatcaggcatgccatctccagttctcagtggctccactactttccaatatttgacctccagtatcatgctttaaaataccggcctggcacttgtggacatttgtgctaatggcccttggtttccatttataccactgccataacaatgacaaaattgtcgagggtgagtatttgtttgcacattctgtcctattttcctaaataatatattttttaaatcctcatttaagtgctttccatattttcccaccatttgaatcccccagaccccacctctacctggtgacattcaagataatcgtagcagagcagctttagctgtcaagaagtctgtcctttgctaagaggtggtaaggatggttaattattctgatcaagtctattcggtctgtgccaagaagaaaactatgtttctggaggtaggatggaagcaaagtcactagatttccttccttctccttttcatattccttacaagttgctgagtaagtatattttatttggaagcattttgataaattcaattaaacctgctgccaggctgtaagaatttttctgtgtgtagtttgtgggcagaacatcatcaatcagttttctccaccatttttggtttctagactattcctgtagttaaataaaaagtatatttactatattctcaaattattttctttctgctctttttcttaataacttacctacttactgacacgtgattggggacagacaatattttacatttctacaaagcattttatctcatttttctatttctaaaatgaaaatttgagtaaagatgtacatccttaaattctgtacacagaaaatatactaaaatgaatcaacttaataatcaattaaagaaattttttatttaaaaatggataagaatgtgtttgaaatatatggttcagtcttaaactaaacacaaagcagttctcctaactaaacagctgttttaaatctatagctcttctgctccagcatcctaacagctggaggaaattagagtccagagagacatgtgcataatttgaattaaacagatgcgggctgtgaagacaatcaaacaacacagggtaagagatgcaaacaatattactgaaactccaaggagtttttattttttattttcataatgatggcaaatgtggccatagttgtgatacaaactacctacccatcctagtaaaaagtcgtgactttttttcaaaagtgcaaaaggaaacatgccaaattctaaatcaaagccaggacagggccatctctgtatttttccatttatagcactcttgatgccacgcgttgactgtgagctaggggtcgctgcctttcctgcccccggcagccgggcatcccctgaggggatctgcatcctgcaaaacatgccaggccactcacaccatcacatgctggcagctgtgggggcagaagactgaggaagagtgagagatgaccagaagctgaagggagacatatgtaaagtagaaaaggagtaacttaaatgtcattttctgattcaaaatatgagtgacctgctttaatgagcaaaaccctgcatttaaagccacaagtagttcaagcactgagggccagatggtaccctttgaaattaaagcgctctcaaatggaacatagcagggaacctccctgtgcccgactgtgtaacaacacttctcccagataatgtccgttaacgtttatggctttcggtttctagctcagttcatgaacgtgtttacgggtcttctgttgagaaatcaagagttagtgtccacgtggcaggttttccaagacctaagtgtgaacgtgatcatcacatttcttccacctcttcaccttcatagtagacttttcaatactccatgaactcttgattactgatatgaagcacaataaatatagacaagcatttggaaaacagcctgagggttctgtaaatagctaaacattttaccacatgacccggcaattctactctaggtatacgcccaagagcagtaaaaacataggcctatacaaaagcctgcacacaaatattcatggtagcatcattcacgatactcaacaagtagaaacaacccaaatgtccatcaactcattagtggataaataaaatatggtacatacatacaatggaatattatttggcaataaaaatgaagtgcagattcatgctatgacatagatgaaacttgaaaacattgtactaagtgaaagaaggcaatcacaaaaagatatatattgtgtaattccatttatatgaaatgtccacaatagacaaatccacagaaagtaaattaatggttgccaggaactgagaaaagggaatgactgctactgagtatgaggttttcttttggggttgatgaaagtgttctgaaattgattgtggtggtggagtgaaaacgctcccaagatactaaaaaccatagaatggtatgcttaaatgggtgaagtgcatagcatgtggactgcatatcaacaaagttgaggccagcactcaaagagattgcagaacaagaattggagtgttcctggagcttcagatgtaggctccacgaaaaagtgatgaagagagagggacagacagtgtgtgtgtgtgtgtgtgtgtgtgtgtgtgtgtgtatgcgtgtgtgttgaggggggggatggctggaacctgtggaaaacacccattaggagggcagatggacccagtggctgatggtgtgcacggttcctgcacactcatgaaggaatccaagcacacccagggcactcctgcctgcaccaggggagctgcagggagggctcctgtcagcagaccactgcagcccccaaaagccccttctcaggaggaggggagggagaagccagctagaatcatctgcgagggtgtggggcaccaggacaaggacccaccctgtacccagtcccaccccccaaccctggaggtgtcacaaactgggaagcaggcacaagggaacatacaggtaggcaaggcaaagaaccagagacaaagcccattccttccttaggctccaggaaaagcaggtgcaagcaggggcggcaggggtgggaggggtgttggtaagaagatccaacatcaaattaacttcgacgttcgtattattgtcttggcttggatgttctaattacatccttaagactatgtctgtgacttctagtacctgtaaggaagtttgttaaagagtgaataaaaatgtcaggggaccttctgatttcccatccagggacagggaaaaattgctcttcctcaacaaaaggctggtgagagatgaaaatagttttgttttgattatattgcaaagtgttcaactttattataagatgtgtgattaataataatagctaaaatcaactgagcttaagaagacgtttacatgcatgtggtcagtcctcacaaaaacactatgaggtgtataaataaataaatgtacaagaataagacatttactattctcattgctcagatgaagaaactgaggcacactaaggttgagccagcaggtgcagggtcaacaagctggaacccaggaagttggttctgcagcccagtcctagccctggaactccacagtgcccacaacgctcccaagtgaaatatatgatggagcatctatgggaggtgaggttagggggattttactttttgaaaaatgctttttggtatttgaaatattctcatataaacatccatgacctataatgacagagagagagagacagacacagagatagagacagagccagagacagggacagggacagggacagggacagagaaagagaaagagagagagagaaccattttagaaagttgctggaccagggaatattttgcacaacatgaaatgattacttactatcctccctcctgatttgggaaaattttagaaaattacagtggaaagcagcagcccccaacctttttggcatcagggactggtttcgtgggagacagtttctccacagactggagcagggagatggtttcaggatgattcaagcgcattacatttattgtgcaccttatttctattatttgtactttgtaatatataatggaataattatacagctcaccataatgtagagtcagtgggagctgtgagcttgttttcctgcaactagatggtctcattgggagtgatgggcaacagtgacagatcatcaggcattagattctcataaggagcgtgcaacctagattcttcacatgtacatttcacaatggcggggaggggggactcctggtgtaaagcattatgtttaaaataccatagcctgagatcaaaattttaggcacaaatttaatcacattgaatcctttgtcttctattagttaaaaggttgtcctgctgccatcttggaatgagtgcaagttggaaaatctagatccgagggtttcacatctgagcatgcataacagtgccctggagagctgctaacagtgcagattgcctgcatccagccagcagagtcagggagatttcaggggagcccctgcccagtggaactcttaaaactgcatttataacaaccttcccatctcctttctaggagattcggatacagacagcccatggcaaatgttctgaggagtaatatggtattatttttaaaagctaacacccataaatactacattaaattaaaattcagggatgaatgaaggacttgtagctatgactctgtagctcagagacataaaaagtgtaagaagcaaaattattactcactaagagataagcaggaaaaagatggggacacttacagttttaacggcttacctcttttgtagagccagaaaagtcagcagcggttggaactctggtaacaatacagttttggtcttctacttatgtactctcttctctattactaaattttaaaaaccagaacagcaaacctaaatcaagcgatacagtcgagctcaaagaaagactgagctcaaatgccttacgtctgccccaagagaagctagcattgaactcacacatcctccctgtgagcacaggcttgccagccacagctcaccaccgctttcttatgacccaaactcatgtccagagatctctgattctccttaacagaactccaggtaatcattaataattgagaggaaacaggcttacttggaaatcttattatgcacgatgtttatcaataaccctccatcaggaaggaagcaacaggcagcacctgcgtggctgttttgtgccaggcactctctggatacttgcctaacattattaccctcacagcgccctgaagatcagatgttatcctgatttttattatccctgtcttctcaagtaaagaatctaggctgttaagaacaataactaatttacctgccatcccatgagacacagttgatggagctaagacccagggtggttccttgtgactttcaactttccctttgatattttggcctctcttaatttagctacatgaaatgttaacctattatgtactcttagttcaattttttggtttatttgtaatcagaaatgatacaatatggcaccttctcaatgagtccatcaattcatatcattgtctattaactcaggatggctagctactcattaacaaatgtctaccaaattcctccatggccttgctagatagtataaataaacaggagaagaacaacgcattacaggaaaacagcaacagtctactgcaaacaaggagaatcaagtaagtaaggcaaagacactaaaggactcaggaacatcattacataatgttgaccagtaactattaatataatgcaatataaaataggaatgcaaaggtattgactgaaggagctacaaaattaagagatattctactaaactattaaagtatgtattctatttataaaataaaaataatttatctaaataagttaaataggaagtaatatctaatttcagcaaggaaagcttatcttcaagtttagatgaagtccttaattacaagtaactatcacatatggctgctctgggacccacaatttgagctgagcagcagatcatggtttgccactgggaattctttagtcttgtccaggaaagattcttagaatctgcataatggaaacagttactaagacaccatgtatgtatgctttacttgctaacttcaaagagttctagagttctgttttcatattttctgagttattttgttttagcatgaaagtatatttagaaagaagggctacttaataatatttctttaatcaaattcttcatataaaaacttctggtccaaataccatttctgctagaaaaatttacctgcccctagtatacaacagtaacattgctgtcaagccagtgatgcatcattgatagaaatgcattggccacagcatgaaacagtatcacatggtagtttttatgccactgcacatgagctgacagccttacttgggtcttgcatgtagagctctcacagggcagggaaggtccagaatacagcaggtttgactgcacatcccaatattagtggtacttttaaaaaatgactttgggtcacagagttctttacgagtaagaactggggataattgagagggctcaggtatctgctacttttaaaaatggcttataggacattaagagtcataagaaggaggctgggtgcagtggctcacgcctgtaataatagcactctgggaggctgaggcgggcggattgcctgagctcaggagttcgagaccagcccaggcaacatggtgaaaccctgtctctactaaaatacaaaaaaattagctggacatgatggcgtgcaccagtagtcccagctacttgggaggctgaggcaagaaaatttcttgaacccgggaggcagaggttgcagtgagccgagatcgcgccactgcgctccagcctgggcgacagagcaagactccatctccaagagaccaaaaaaaaaaaaaaaaaaaaaaagcatcataagaaggaaagtaaaaatgattattcttctagtcgctttctggattctttgcctttcattgcttctatagtacatattaatattacaaagaaatctgaattggaatagacaatcatttcccttacatataaaaatgtaactgaataaagacattaccctaaccatcctggggttacattcctagatactcttggattccatctacaccttctcaactaagcacttacagatgtctggctttatatatgtacacatcagtaactagaactaagtgttgaggtaatgaacaacaaggagatgacagagtgactaactctggccatgatgaaaatggcagatctaagatggaaattatactaggaaattccccaatcctagaaatacagttggccttcctccctcccttccaccttccctccttccttcccttttcctctttcattttttatttcctttgtaagacatctagacaaagtttaggtgctatataactcagggacaatcttcagcttcattgtgtgagattttattcatgattgccttatcacacacaatgacagggagtaggagaaacctcatttgagtatataatctgctgagtgtgatgcaaatgtcagtatctgtggtatctttgcagttacaacccactggtttcctctattctcttaccacttagaggtgaatttctaattctaggaactggtcgtcatcagaaattgatgaagacttcaagacgttaaatcaattcagccactgctacatggtaccttatagaagagaccattaattatactaaataatgtctattcatttattcaacaaatatttatccagtgcctacccactggataaaaataaccaccctgagtgtttagatgaatgcctaatgacaagggtgatgcttatgccattctaaaagtgatgaattgaactgaacatttatttccacacaaaaacctacacacagatgtttatagtagctttgttcataattgccaaagtttggaagcaaccagcgtgtcctcatagggtgaacagataaataaactgtggtacattccattcagacaaggaaacgccattcaatgcaaaaaaagatatatgtgaccaagccatgaaaggtacaaaagaaacttaaatgaagattatcaagtgaaagaaggcgatatgaagaggcgactttatgattctatctataggacatcctggaaaaggcacagctataaaaagggtaaacagatcagcggttgctcagggtagagggaagaaatgggtgatgaggtagagcacagaaaatctctaaagcagtgaaaagactgcacaatcctacagtgttggatccatgtcactaaacatttgtccaggccctagaatgtacaacaccaagagtgaaccctaatgtagaggactggctctgagtgacaatgatgtgtcaatgaccagttgtaagaaacgtaccactgggggtgtgccgggcgtggtggctcacgcttgtaatcccagcactttgggaggccgaggcaggtggatcactaagtcaggagttcaagaccagcctggccaagatggtgaaatcccgtctctactaaaaatacaaaaaaattagccgggtgtggtcatgggggcctgtaatcccagttactcaggaggctgaggcagagaattgcttgaacccgggaggtggaggttgcagtgagccgagatcacgccactgtatcccagcctgggtgacagagcaagactctgtctcaaagaaaaaaaaaaaaaagaaaagaaaagaaatgtaccactggcggatgggggtgggaatgttgatagtggggaggttgtgtgtaagtaagggaatgaggttgagaattttccacaatttccacacaattttgctgtgaacccagaactgctgctctaaaaaacaagtttcattaattaaaaatcaaattgctgctttcaaggttcatggttcacagccacataggagatgggtgtcttagcctcatgtaaggtggagaattagaactaaaatccttatgtagaatggagtcctagaaaaccaatgactttcgttaaaggattgactagaaaaaaaaaaaatctacccatcagaacaggtagaagaaaacttattgacctgatactagaccttacatttgatggtttgtaatcagagatctgctcttccttcgacaaaaggtttaaccttatactatttatatagtccatttttcacaacgctgaaaaataaacataaaaaagtagttacacactgcatgccagagacaagcttaaaactatggtgaagagacacactgccagcctgccacgaagcagccccacaaagcccaagaactcacattctaacacagaaaccttgtgaaaatataatcttccaagggagagaagcaatacacccagtcaccatcaggattagttacctaagaaccacagacacagaattttgtacagatatcattaaattactatttttcaaatgattaaagacttaatggaagaacattgaaatataaaacaagagcaggattccatcagaaaaggcagtgacattggaaaaagaatcacatagaaaacccatcaatgaaatatccattctttgaatgccactgggaatgcaaaatggcccaaaaatggtacaactatgaatatacaactaagggcaaaagaaaggtatgattaaattacctggaatgcagcacaaagagataaagtgatgaagaacttagagaggaagtgagaggtactgaaaaaggaataaaaagtccaacatataatgaacttatattctagaattagaggaaaatgcaaaaggaagagaagcaatatttgatgacactggtgtatatttttctagaaccgatacgaatgttctcatacaggaatcacagtgaatacggaaagaaagccaaagctgaacgcatggatgtgatagcgactaaccacaaagatttgaaatgatttctaaagctgcaagagagaaacagattacctccaaaaatactgcaagtagactcatagcatacttaccagtagcaaagataaaagctatacgctatgtcttcaaaggactgcaaaagaataatctcaatatagaattatctttcctgtaattcagaaaataagacaagttattcctaaagaacaacaaggtgggtgatgtgaaatgccttgtcagataccgcaaattataataaaactatagtaatataacaacgtagtattggtgcagggaaagacaaatagacaaacagaacagagtagacggttcaaaatagatccaggtatacatagaaactatatatatgtcaaaggtgtccttatgaggcatgactgttcaatcatgggaatacacaacaggtgatccctgtgaagaaaataaaataaaactggatcttgcgtggacagcacatgtacacaaagataaagtccagttgttaaagacctatatttaaaaactaattttcttttttctgagacaaggtctggctctgtcacccacgctgtaatgcagtggcacaatctcggctcactacaacctctgcctcctgggctcaagccatcctcccacctcatccccaagtggctgggactacaggtgcaccagcttgcctggctaattttcatatttttttgtagagacgggtttcaccatgttgcccaggctggtgttaaactcctgagctcaagggatccgcccacctgggcctcccaaagtgctgggattacaggcatgagccaccatacccagccaaaaaccaaaactttaaaatgtatacaaaaatattctttaaaaatattcaaggccacaacatatgaaaactttcacattagacacagaagatacaaatcataaacaaagatgaagtaagttttccacattaatgtgggaaatcttatacatccaataacagcatcaaagttaaggagacaaaccagaggttgacaggttatttgtttcctacgttagccccaaaatactaatatacattgtgcattaaaataattcacattttaaaaccatcacaggcccatgagaaagtttggccaaagtatactaaatgctcagaagacaaaatgcaaatgaatagtaaatgtgaaaagatgcttaattgagaagtaattagagaaatgcaagttaaatctacaatgacagaaaagtttacaccagtcaggctcaaaatttaaaagtctgaaaatattaaacgttggcgaggatgtgaataattgggagttaaattgttatgatcacctagcagagcaattatttagtatctattaatagtaaagctgaagttattggtgcacaaataccacacccaggaattggtctagagaaagtcttatacctgtgcacaagacttgtataagaatgttcagtgcagcactatttgtgaagcaaaaaaattagaaacaccttaaattcccaatagcatgagaataaatccattgtgatgtcacacatggtatgctattcattagtgaacacaggtgacctactgctatatccactaacacgcattaatctcaaaatatgattgaacaaatatgttcagttgcatacaataggtaacatcatatcatttatttaaagtttaaaagcatgcaaattagcagtattccatattacttataggctggtaaataaatgtttttttttctttttttttttgatggagtctcgctctgtcgcccaggctggactgcagtggcgcaatctcggctcactgcaagctccacttcgcgggttcacaccattctcctgcctcagcctcccgggtagctgggactacaggcgccccagaccacgcccagctaatgttttgcattttttttagttgagacggggtaataaatgtattttttaaagtataaaaacatagttgataatgacaaatcccaagttcaggataatagttacctctgtagagaaggaagaaatggaacacaatcagagagcagtacatccatcgcttcagttttagttgtaatatttttcttaagttgaatggtgggcccactagtatttgtcatataattcccatattgttttccatccctggggttttgcaataacaattacaaatatgtatctccctacaaagtttatacaatggtttatatataattcattcatctttgacttgtaatggaaatctgacttgcacaggaagtcaagattgctaatgtcagacttgcaaaagaacaagcatgctaatcaaattcaaagtcactaatgtaatttccatgtatttctattatagttctcgatttagattctacatctaacctcatcttgactgagaatgtatgtatagattctcaaataagctttatctgaagaatgtcttactatatattatttggtagcactaggtatcaaacactgaggctcaaatttatatttctgttctgttctaacctcaacaacagacagataaacaaacttcctactggagatcgccacctaaaatttatttgaaaccttaaacctctcaaataaagtttatttgaactgcccctcccacaataacccattcctctttttcttccactctcctctgtgcctggtggcatcaacatctaacatgagttctatatctcacatagccaagtatcaatgtgtcatacttcaattttctctttcccttgcatctcacaatgcgtacatctgctagtcccattgacacaacctctaaaacatcacaaagctacatgtgtccctccattacaacgtctagtaccctagcgaagccccatgctccgtcccccaaacacctagactagcctcccaattagcctccttgcttccaccaacttccagccacacttacctcccttatggccttggcatgtgcttacctaatgcccactctaggtcctttgctccctctctctggaatgattttctgcagatattcccagggctggctcctttagctttcagctcaaacttcaccttccaagagaagcttttcctaaatttccaatataaggtagtgtcaccagtcctcagcctattttaattctttccaagcacttatcactaactgaaatttaccatttttattgctttacttgctttaaacctgaagattgtatttggttgcatgtaccggaatactgactacagaagtataaccaattggggtttatttttcgcatgttacaagaagtctaaacaaaagccatctagaactggctgggggctccctgatgccctcagcaacccaagtttcttctatccttctgccctgtccttttagcacgtggcttttatcttcatggcactctgactaaaagcattaataaccttcttgcacatggaatgcaggctccacaagaaaagggaccttgtctgtcttacccatcaccggaagaatgacaggtgctgtgttaacagcttgatcagctagagcagtgaaagaggaactcaagagtcctcaacctcagcatcattcctgcatcctgggagtcctgcaccacagcctccattcattggccctggagattctacccggatttctcttctcatgaagccctggccttcatggccttctttattggccctgccttagtccagggcttagtctcacgctacagtctcctaagtggcccgccacctgccccatttcgcctgccaccctgtcacacccacgacacaaactgatcatattcatctctagaactcttatgttttcttaaagtctgcactcaaatagaaagctccacaaaagtggggacgcaccggtcctgcttaccactgctctccaggcctaggaaccaggagtgcttgctgtggaggagacacttggcaagtatttattaacagaatccaaggaagcatctaaattcccgaagattatgtgcaaagcccctctgcgtttgacccggctcatcctcttcccggtatcaccttcctcattctcacttttgccatttgtttagtcacagcaaataattgtaattctaaagtagtgccagacctttgcatcttttattttataatatctgcataaaatattccttccttttaaaatcagaaatcttctgttcatcacttaattcccagcttatgattctcctcagcttagaggccttactgactcagcctaggggagcagacagtgcctcctggatgcagcactttgatgatgatgacgatgacgacgacgacgacgatgatgatgatgatgttaaaatcacaatgccagcaactgacatcatggggtgttacaacgtacaaggcactcttgtaagtatttctgtttggtgactcatttaacccttgtagcaaccccatgaggtagataacacaatttttctcattttaggagaggaactgaggcacagagacattaactaatgcaccaaaggtcaaaatggcataagctacattccaacccatgtggcccacctcctaatccatgcactatgacttgtggacatatttgtacactgtgacctgaaagattgttgggagcagggctcataccttatgatacataatgggtgcccaataaaagaccgttgagtgaacagattttaaaacaatcagttgtataaatacagaatggggaaactggcttacatatatatatatatatcttgtaaaaacagagttggggtttaaatggactgtatggctctctaagtcatatcattgatcctaaaaataaattacaggccacattaataggcagattataccaaggggcatgtagtaactccagcatagatcaggccactttgagaatctagtacagtcctctctctttagaaaagaccaaatggagttcgtccaaagtaggtaaaacatatggctgctaaaataggaagagaaataactgaagggcatatggattatcgtcaagtatctgagaaagtgttatgtacaaaaatttcttctgatttaaaagggcagaacaaatctaagggtggaagaacaatgtgctcagataaggaagcaaattccagttgtgtgtgctgggcccactcaggctgcctcctaagaatggacagggaacacctcttcccaacgccgccttcagtgttattatgttggtcccttaaaaaaaacagggctggcaggttttgcagggaaactccaaagtgacaatcagagctttgtatttatagagagtcagtttacctgcttatcactgcatttatcccatttagttgctaaaaaaaaaaagaaaaaaatggacttggttgccttgtggagaatggatagtagttgagccttgtggtgaatggatagtaattgagaatgcggcagagagagatgacttcgtaaccaacagatacatatcatcaatgcgcacagaaacttaaggaggggccaatgtgatacgcgaactgttgtcagtcctttacatttagttatttttaaatttatttttcaggaagtatctataaaaacactatatgtaaaactatttataggtcaggaggctgaggcaggagaattgcttgaactgagacccaggaggcagaggttgcagtgagccaagatcgcgccactgcactccagcctgggctacagagcaagactctgtctcaaaaaaaacaaaacaaaacaaaaacaaaactatttataggttaaacactctttataagtaaaactcatttatttaaagaaacagactgatatttttatagttctctcatcaatctcttctattaaaaacaaacaaaatactaaaagaaaactgccaatcattttgaataagagatggtccactacattcctccaccagaggcaagaattaaaaatttaccaagtcaagcaggaaaccctaaaagattatcaacaaatgtattatatttttcaaattcgtaatgcaaaatctataggtatgttttctaatcagtccaagactccaaagtaattagtgaatttattgccattttcaaaaagtaataccccttgatatttaagtttcaatagtatggttttaataaactgaaatgaatcattagaagaatttcccccctttatcataactgattaagtctattttaaagcttatatgccctcttcagggaaatctttaaaaatttccaattgtttatatcagtgaacagggctgaataaccaatgtataattggttaaatcagatacattatttccccctcaaaacaatgccattgagttgaaggcaaaggatagaaatgaactcaccagctatatacaatattatatgacataagcaatattaaagattggtatataagaaaccaagcttggctgggcgccgtggctcatgcctgtaatctcagcactttgggaggccgaggcagacggatcatgaggtcaggagttcaaaaccatcctggccaacatggtaacactccaactctattaaaaatacaaaaattagctgggtgtgttggcacgcagctgtaatcccagctactagcagggctgaggcaggagaatcgcttgaatccaagaggtggagactgcagtgagctgagttcacaccactgcaccccaacctggcaacaaagcgagacaccgtctaaaacaaacaaacaaacaaacaaacagaaaccgacctttaaaataaatacaaacacaaaaagattagtatgtatttaatctgcaaggctaaagccacacaactggatttcagtgtactacaaaatgacagatcatataaattcaaaatcttcattctgcttatcaattacagaggcaaaaatataactatttaagtgggtcttagaatgtattttctcttcagagtgcttcctgatcctcttgccctctattttacattcaagcgactcatgaattcttaggagaaatctgaaattacttcatgccccttgttaaacagattttgaatggtaagtactcctgcaaaattgctcccccaaataaaatttcacatacagatacattcagtgcattaaaaaagtaaactccattagaatagaatatagtattttcttaagataactgtttagacttaactcaaaggagttcccacaaatatattctgttctcagttagttcaagtgtggaataggcaatttggcatggggtaaatctgtccccttttgcaatgttttaaaacagaataaatcgtgggatgaatttactgcgcattacaaataaaatgtttatattttctttgtgaattattcatcaaattaaactaataacatgttaaaatttgcttatgtgtcagtcctttgtaggtaaaatttcatataacactcaaaacaaacatataaaatataggcattattactatctacacttcatatagatcagaaaaataaagactggagagcttaaatgacttgtccttcccagagagtctgactttagagtgattcatatctactgtacttcattataacagtgtatttgaaagtctagttgaactcttaagtgatttcatctagtgtatgacattcttgaagttttgacttctcatttatatatagcaataagcacatgtgtaggatggcatcataaaactcccttggaatgaaaaaaacatataaaaagttttaggctcctacaagaacagcatgtatctcaatgttcctcaaaatgagaattgactccaaggtacaaaacaggtaaactgaggaagcagatgttaattaaccactttagcaggttctgaagttcttagtgtccaaggtttaaataacactagaactatcttaaacaaatgtttgtgtttatttcctgttttctgaacaatgtttttgatgaattacgcatagatggaatgcaaacacacagacccaattccctttgaaatatgtaagcctataaaaatgagcagaaaatatccttggcaaaacctgcactgagctttcaaaagcccacatatttgaaattgagtttgtgatgtactcaaaacacaaacatcagtgggttctcgcattcctcatttctccctctaatgtcagaatattctattaatttaaaaagcagagttctgtgccataattagtctacatattaaatcttatctgagtgacacctctgaatgcaaagtatccagaacaaataataagacaagaaacattccatgcaaaataaaattcaatgacagaataaaatcttcaatccaatgcagtttacacaagtacacccacaaaaattataatttttcccaggaaatgcattccccaaatgaatgtatgcttctctgtgtgaagacatatatgtacaaaaggctaaaacattttttaaaaatccaaaaacaattgatactagaacactatactgacaccaactttataaatcatgggcttgcccaacaattcagtaaatacttgatgttctgcctccattcaaatgagtctgtgcatcctctgatttagcacatggccaaagaaagatctttcagcccatccttctgtgctttacaaaggctactatggcaatcttcacttgtccaatgtgaatttcagttaatttaacttctgctgctaaattgtttatgataattttatttttatcaatattaaacctaatatttgaaaaaaaaagttaacacaacatattaggccagactctcccattcccatttaattgtgttttctgtgtcttatgggcatcactaaagttatactttaacataaactattataacataaaggatcacatcccacacatttaacttcatctgccatttaacttatatctaaggaagatcaatgctggaataaatatttactaatggtaacttattaattaaagctatgacccaagcccatatataaatagaaaatgaaggagcacacatactcccatatgtattcatcataagtgagtttggtatataagcttcaaagaagtttctcatatacaatcttattgttccttgacagtcatctcaggcttgttacaatgacttagtaaaaagggaaaaaagtaaagatggaatttcagtgaatcatctttgggttcagagcttttgggtgtatagacacaacctctcatttcttaaattcttccctaaaggatgatgactgtattaagcaaaatctcagataacatcaggtcaattggatgatggaatcttagtccaataatggagacaacagaatatctgaaactaggacttcagtgaacagtaacacagtttcagtatggcatctcttctctgtcatttatcaggtttcctgtaccctaataagatgcatcctatgttaagagtttggagattggattgctgcagagtttcaccctctcacacattgcttgccttggaatgtgagtgtaatcacaatggaaacatctatgagatgagagcctattaaatgaatccacagactatatatcttcagcatcttataagctataagaatcttagctttttttttttcttcaagtctatgcttattgatggcaatcctcagagatgttttgtaagtccacatgggcacagaaatgtcaaggcttcctttcaaagaaaaataacatttctgagagttctgaattatgcaaagaggtaagtcattcagggatactttctgacatgtagaggcaaccagacacaaatagatgaaataacggtcttcccaaagtgagcatttgccctgtacagatgatcattctttgattctagactcggacacgtagcaacacttactagttcgtataataatgtacctgttctttggaggaactcaagaggatatgtacatttgcctaaataaaggaggccagcagtaagttccatttgcaaggcaaaccttcagagagaagatgcttgtatcagtcctgtagtgaatgagcatctcatttacatgaccaatctcttacacagaaataaatcactgcgtgactgtgctctgggtataatggtattgagcctggcctccttttatcttataatcagttaaaataggaactatattggtcatttgcagaattcttttatatacaaacaaaaaatcatggtggaaatgtattcagtgctctaaattgatactagcctctttctgttttatagtcaatagaaaaagcaatctctactaaaaatacaaaaattagctgggtgtggtggtacatgcctgaaatcccagcgacttgagaggctgaggcaggagaatcacttgaacctgggaggcagaggttgcagtgagccaagatcatgctattgcactccagcctaggcgacagagtaagactccatctccaaaaaaaaaaaaaaaaaaaaaaaaaaaatttgaataaattaccaaaaaaaaccatgaaatttcaataaatttagttcagaaatgaagccattacatccctaaattctattacataaatatgttactaatgtttactctataaccacagcagatcatctgtttccttttttttttttgaaacagagtctctttgtggcccaggctggagtgcaatggcgcaatcttggctcactgccacctccgcctcccaggttcaagagattctccgcctcagccttccacgtagctgggattacaggtgatttttgtatttttagtagagacggggtttcaccatgttggtcaagctggtgtcgaactcctgacctcgtgatctgcctgtcttggcctcccaaagtgctgggattacgggcatgagccactgtgcccgatctggctcatttatttcctaaaattataatgtatgactaacaaatcaatttaaaaactatgtacaactggagtacacaattgtcaagaactatttacttttgcttagtttaaatatttggtaaagagtttgcaaataaatactcatcatgtctattcagatctataatgtgctaaaaattctgtttaagacttcaagaaagaggccaggagtggtggctcatgcctgtaatctcagcactttgggaggacaagatgagtggatcacctgaggtcaggagttcaagaccagcctggccaacatggtgaaaccccgtctctactaaaaacacaaaaatgagccaggcgtggtagcgggcgcctgtaatcccagctactcgggaggctgaggcaggagaatcgcttgaacccgggaggcggagcttgcagtgagcagggattgtgccattgcactccagcctgggcgacagagcgagactctgtctcaaaaaaaataaataaataaataaaaaaaggcttcaagaaagaggcattaatgtctctataagttttactcaccctgtactcttagtatgaacaagtctttaaatgtgtctgctaatcaattaaattatttttctcatttcttatgttaaatatcactcattgaatacatactctccctttaaaagagagacaaatagcaagcttattttctaagaaagtgatagtttcaattcctctgtgaaagtggacagatatcctaggttttttttaaattcaactttatattaaaatgcttacacattctaacgcagttgtaagagatagcagagaaagatgccagctaccttttccccagcttccgccagtggtaacatcttgccaagctagacgttataattgtactataagcattgttacagtcagcacagaggacggccgtcaccaaagggtcccttctgttaccctttcacagtcgtaccctcctctcacctgcttccacccccttcagaactgctgggaagcatgaatctgccctccatttctatcattttgtcgttttgagaatgttatataaataaaattattcagtgtacgatctttggggatgggctttttccacacagcacatttcccctgagatccatccaagatattttgtatatcaacagtcggctccttttttactgctgagtaatattctagggtgtggaggtaccagtttgttgaaccacagatccactgaaagacatcagagttgtttccgtgttctgctaatgtgaataaaactgctataaacattcatatacagatttgtgtgtgtacctacgtcttcatttctctaggataaataactaagagtataactctgtcatctggtaaatacatatgtcattttttatgaaactgctatattcttttccagagtggttctaccattttatattcccagtagcaatttgcgagtaatccaatttctccacatcctcaccagcatttggtgttgtctttattttgtattttaatttacctactttacctattactctagatatttctttatacattcttaacttgtcatgctctactgcagttgctattttgtaggtcaagtttagaaatcttacctttccttgcatctgtgtttatgtttgcctgaaatgtttcttctacatgtagaactacattagacaatgctataacttttgctgcaaccctctaacataatttagaaaactcaagaggagaaaaacagtgcattgtatttaaccatatttttgcttactatgtttttccctccttcctagtgttccaaaattcctttttttgttgtttcatttgtttagaaaatttctttagccattcttttagggtaggtctgctggtgacaaattcgcttagtttttctttatctaaaaaaaaaagtattgatttgttctttcttcctgaacgacattttcactgggtataatattacaggttggcagttcttttctttcagcatttgaaaaacattgtgccacttccttctagccttcatggtttctgatgagaaatccactgtaattagaacaatgttagccctatagggaaggtgtgatatttctctggcttctttcaagatctaaaatttgtctttagttttaagaagttgaattacgttgtgtgttggtgtgggtttctttgggtttttcctgttttagattcactcagctttataaatccatctataactttatgtctcttgcaaactttggaagtttccaacacttatttctttgagcatttgcccaccattatcttctccttccaggaatcccctgacacaaactttaaatgctctgttggagaaccacaggtctctgaggctctattccttttttctttttccagcctaccttttctttgccatttggaccgtgtcatttctatgttccaacttccagttcactgactcttttctctgttccttccattcttatgtcaaacccatcagtgagtgttttatttcagaaatttcaaacaagaggctctccactcagcctttactagtgttggtggggacaaggatagggccgcagtttttctgttgcatttggctggagtagactggttattgtctaaatgttttctatgttgctaggcagcccctttctgagtcctctggataaaaaacaggccattgttggggatttcttccttccttcctttcttccttttcccttcccttcccccttcctttacccctcccttctctctctctctctctctctctctgcccctcccttcctctctgcttcttttttcttctcttttctttttgtctatatatgttgacatttcctggttgccagcttcttcagttccacatctgaggtaacgtagcaaaaagaaaactcaagaaattcacctctggattcttccttgggttctaaaatccctactctgtccacattcttctcactactttcagaatcttcctaagcttgtacagcggacccttgaataacatgggttgaaactgcatgggtccatttatatgcagattttcttctgcctctgccacccctgagacagtgagactaactccccctcttcctcttcctctttagcctactcaacatgaagacaaagacaatgaaaatcttgatgatccacttctacttaatgaatagtaagtatcctctctcctttttgtaatgctgttaatgttttctctagtttttttattataagcatacagtacatattacatatgaaaaatatgtattaatcaactgttcatggtatcagtaaggcttcccgtcaatagcagactactggtaaagtgtgaggggagataaaagtatacatgagttttgtctacatagcggttggcacccctaactccatgactccacgagtcaactgtacaatatgcaatgtctaggctttttagtgtagttgctgggaggaagagggaaaagtatgcctactccagcttcccagaagcaaaatctgtgccagatcattcgttttcaatgtctatattttttccattttcctttaattttttaaagttcttaaagtcttgccaataacaaaactgaacagatgagtgtgtaatgaaaataactatactctaacagtgcttctctaagtggcctgtggatatgctctcccagaactgaaaattctatgaaaattttttagatgtgacatcaattctattataatcttacaaataccctttgccagttaaatagacaaactcgctttttaaaattatgacatttcataagactgtggtctcaagctatagttccccaaagtacctgaggtgaggcactaaaactaatttcctcctcaaagaaggtgaaactaagtgtgagagatactgctcagtatgtggggtgaccattgcctcagttttcctaggacactcccaacatataattttgtcctggaataattattgacagggtcttcttttatactcacaatatctcattttgcatgataagctaatatatatgttcatatcacctatgataaagaatacgaaaccaggaggaagacacccagcaagcatagacaccaccccagccatctcttcttctcttcaggacaccaaggtgtatatttaacattcattaatggaagcattaagtagctcatatggaaggtccatcttctttttctcagcagcaacttattattagatattttgtgcttatactgtgaaatatagcacctgtaatgataatgggtaactaaatgatattgactaaatagttgtaaacatatgttctaagattatacaagaatatctaggatgctaaaattctgccagttgtacacttaaagaaaacatagccatcaatttgcaattacatgtgtaacttcctagtctttacagtgaaactcttctatgaacaaagtttgccaacttctcggcacctaaatcatttaactgtgatttaatagaagttccataagtatgaacctttctttttcagtgtcctcagacacaagttctcaacagccagctaggcatctccaaacacacgtactcagctggcatcaactcccatcatgttggaacaatgcagcatccttcccccaaccaaaccgggtcttcagacttcccatttccttctatggcatgacatttttctctagttccccaccaatgaaacttcaatgccaagttagtcaaggttatgtgaaatatagcccatattttattttttgtccaatcttcaacatctctcttcaggttctagaagaacaagaacccatcctttttggcaagcattctctatgctcattcccctattcctccatctacagaatcctacctcaactcaattcatccaagaagttcttcctggtgacttccaaccagatgtgttttctccacctttaaaacttcataatattttcaggtgcgatacggcagttatgtttcatattcttatattatagctattaggttgaacaacatgaaattgttgaacctgtaaaaatggcaatcccatatggttcaatctaatatttctctcggttttagggctcataaataaagagcagtctccatgaaaacaggggctgagttaggtctctcttttggatcccctgagaagcctaggacattggaagtgcttaagaagtgtttgtcaaaatagactcataaatcaacacatgtcttaggcatatatgtttgcaaagtcaatcatctgaagcaattagtctaactacatatgaaatcgctaattgttttatgaatcagcacaaatggcagtttagaacctgaaggttttggcaatataaaatgttttgattcaaggagctgttttaaaattatttatttgtgaaggaaacatccttggatttagaggttggcagatacagtgaaaatctttttagttgactgaaatagaaaaaaaaaaaatcaaaaccctttttagcacatgcacttcccttataaaaccaaattgcctgaaagcagaggccagcagtttgtgcacaacgagtatgtgcctcaacaccatcagcaggagatgcaatgcagaatgacaggaacaatttgcatttctgtagcttctttgtatacccaaattctgagagcattttacaaagccataaatatcgttacccacaagagacagggaaaggatgcagatacaaggacggactttgtgtactctgacccaggagcccccctgcgcggagcagtgatacccacacagctgtaaacctgagtgcaattaattgatgctggttaagaaaaggggaacatacatctgcagggtccttcacagtcacagggaccattcccagaaagcgtttcgtctttcttgcattcacaaagaatagcgtcaacaaatgttgagttgtatttgcgagtttccccaacaaaggacgggtctctagttctaggtgatggtggtattatcagtcacctcaccagtccccctaattcctacaaaaatcaccaatccgaatgacatgtgtgtagggctttcatggggctaggagcagtgggctgccagaagctctgctggggccaggagagaagagagcatcgttcacacttattacgttgcaggggcctatttccagggacaatgttactgaaccttggagaaattcatgcaaaggtatactgttgttgtgctccaggcttccttccccatcagctgcagaactgtgcgattctggtcctggccaaggagtgcccaaagctagttgccaatgggccccggagcccacacctcctctagcgcagcatagcagcagccctcactaacctccaggggtcacaattgggttacaaattcctcacagtgcagggactgagcagcctgattgggaacaatttattcgaatccttcttcgttaagattcaaatggaataagtaaggtagaaattgaacagacacagaaattgtgccttgctgctcctgtagtcagtagacatttattcactaagcctagctcgtgtgttctttctctctctctttctcactcgcagttgttcttccaatctttcctgcttgctgttttaatgcataattaagaaggtcagaattaatgaagcagtgtggagtaaagttcaaggaatccccaggcactatttattctattagatctcaggcatgaatgtcagattggcagcgcaggcggcatgagcaatggagctggcggcatcccaagaacggccgccaagggagactcacctgcacagtccagtcattcctcagctccttccctgcgaaaatcacacgcaactggtcagccggaaccccctgtcgcttagcaaccacctccttgagctggaagatgctggtgtcagaatcgacctccactgggaaaccatggctggagttgaacctgacaaacactgaccaaggaaattggaagggagaagagaaagtgagcatcactcgaagcccttaaatggtgatagcaacatttctcaaccgatttacccctcgcagcccttcagtgaatggtatatattttctttcacttacaacaaaaaacttaatgctatagagcaatatttgggaaaaacagagttagttacccacgagatttccctttcatatattcgtcagtgacctgcaaaccaaaattgcattctccctttgacatccatcctgggaaacagagagacttgagcaggacacttgcttgattggaattgaaagagtcccatgagtttattgaaaagactcagctctgacagcatgtacacactcacactccctccacagtgaccctcttaataaaaataggaggcgatgtgttagcactcaaggtatagcaatggaaaaaaatctaagctgctctatagaccagagtgaagacccactcggggctatggctcagagccctagacttgggtggtcctggccaaaatgctccactgggtctatgaagacaattatttgccctctttttggcagggagggggtggagacactagtgacaccatttgtcttattgaagccactgttccccgtgagacccaggctgcatcctctagtctgtctgtctgcatgccgtcttctcactgcacctgctgtcccacctcttcagcgtctctcactgccctttactttccattctttctctcactgcttgaagtcacgctctcatcacatcttttctagagtctcataatagcccccaactggagtcttgatccacgccatcacctccaaaaggccctacatagttctgcaaaatgagccttattaatacagagctatgtcacaccactcaaatcctttaagtctcacactgtcggctggtgaggaaagactccaagatccctttcatctagcacaaacctacattccagcattttcttcattaatctccatgtgtactcttttaaactaaatgctcccagaaaaaaaaaaatcacaaaaaactgctgcacacaacttcttgcttttattcatgacctccctccttctcctcttcctattgaaatcctgcctacctccatggcccacttcaaatgtgacctcccccaagaagcttctggctatcagctactgcaaaagcctgatcttccttattcagggcaccagtggcatttactatatatgtcttttaatattcaccacattcctcatggaagcaggatagcacacgggttaaaagaacatcctgaagcattaggaagacctatgaaaaatccccacagactcctttaattggcttaggatgctaggggtcaatctattaacctccctctttaggtctcagttcccttatcttgaaaacataaataaaccacagaccatattattcggttcattaaataatatttatagtatttaaaactatcgtcttgtaacatttaaaaataatggacatttagctgtttttgatatacattttgccttctttaaaagataacaaactcctcaagggcaagtgttattgtttatttactgctgtgtttcctttaaatgtagtactatagctaattatttctcaataccaatgtgagatgacccacctcatcataattataataatcattacaatgccaataataatcaggcacttactatgtgccagacattgtgctctcatatggtttttctaagcctcccagtgatctggtcaggtccctattattatccttattttacagaataataaacgaaggcacagggaatgggacccacttttctaaggacattaattactttctaatggaactgggtttcaaatttatttcaatctaactctaaagctcattccatttctactaaaataggcttcctgaaaccatctcagaagaaaagtccaggccaggcacaatggctcaagcctgtaatcctaacactttgggaggccaaggggcaaggatgacttgagcccagaagttcaagaccagcctgggcaacaaagtgagaccccatctctacaaaaaatttttttaaacaatcagcagggcgtggtggcgtgcacttgcagtcccagctactctggaggctgaggtgggatgactgtgtaagcccaggaattagaggtttcagtgagctatggttgtgccattgcactcagtcaccctgggtgacagagaccttgtctaaaaaaaaaaaaaaaaaaaaaaaaaaaaaaaaaaaaaagtccacatttctatccctcatgattaaaaagataacaataaaaaggctttatgacataaatcagatattccctatatgggtgtgcagtacaaataaataaaagctccagtgaggagctaagagcaaaggaccgtgaacaataaccatgaacaacatgggccccaaaacagacgtgacactccagtgagggcaggtggtccagatggcaccacaagaacaaaggcctgacatctctgaccagcacggaaagtgtttagaaaaaggaaggacgaccagtgacaaagtgctccaaataaagaaaattcatgaaaaatactaattacggaggaaaaggtgcttttgatacacttttaagtcaatttcatttgacgcctttgaaaatagaggggaagaaataaaaatgtattggaagccctgaggtatcttcacagcatcctcagatcagagaccataagacaaccaattcatcagaaaagacacatgacaagttaggggctatagggacaaaagatatgaccccagttctaaatttcattttctactagtgagaatagatttaaagtaaaacaccataggaaggaatgtgggaagaagtggctggaatttgtgccaaagctgctataaaaccagataaaaattccaggagatcctaagtttatgattttgctccaggggttcaaatcatggaactcctactgcaaggatgagagtttttttgtaaagggaaactgcaaaaaatattaaagatacctctgtccaactactgaaatcctaagtatatacaagttttttctataatagaaaagttacagatttaaagttacagtatttagataaatcataaatactacggatatgaatatttttaacagtaaatctaacatacaatataaatttaaaatggaaagataaaccaaatacataatatttgaccaactaaaacattcgcatgaataagaaaaaacatcttaagaaactcactgagttcataatcaagtgccattatgtgaaaaatggctagtgctgaatggcagtaatgtgatttgagtgggtctcaacctttttctgacatatgtgggaaacatgtcatgtcccatctgtaccagcccctgaactccagccatgatttccaaaacaggagtggaaggaagtacccagttctccccacctactacctctttaaagtcacagaaggcagaacgtctttagagctacataaagagaaatttgaatgctggttgtaacgcttgctaattttatgacaagttacctggccaccttgactgttagcttcctgatctaataaatcggtataagggatgcaacaccaatgtctgttacacaagatttattgagattatggatgtattagaaaatctcagaaagagactagtacagggcctatcctcctagtgctgggcaagtgtgtgctccaaaaatagttccctattctaggcacctagaggaggtagagctaatgaaagcagtgtcctttgcttgcatggtaactaagggagattagataggatgtgggtaaatactaaataaagtagccaatttttctggattctgctcctcttggtggacagaaaacttccagagaccaagagatatgatagagaatatggctcacctctactttctaaggtttaattacatatgaaaagcttggaaatgcattgttttaataattgttttgatgacgtataatatagtatcagaaacaaacaacataccagtaaacattatcaatcatgtgtattatcaatcaacatcataatgcactgataacaaaaaacataatgagatatatccagattccttttttatgatatccctaaccagggttgagaagtcccagagagtaaggaagtgaatgggtgggaagaggggaaagggttattggtggatgggcccttatatttcttttaagacaattttatttaccaagtctgaccagggtataaacttcataaatatagtagtcaatatcaataattaatgattcttaaatgattctggctgctcctcaagcagccattccgcctcctgcactgagaagagcaatgtcattcatcagcacagccccatcctccttgtcattggtcaaatgattggttcagggatgatgcaagccaatctgtgcctggcactccccttgttccagtgattgattctgcagaatacaggtgacataaggtggactaatcaaagtcatatccagaactgtcaaaggttcggtgaagtccttttagatggcaaataacatcatgtgatgcctcagacagttttgctgagagacccaaagaaaatcacagcccaagatagaccattaacatgagcacaaaaatggactcagtgcactgaaggcaggcaattcttcctcatgagagggtttcctaagctccgtgggatgttcggctccacctgcagcccagtaagtatcagaggcacgccccggttaattgcggcaacacaaaagtaactccacatgtttccaaatgtcccttgcctgggaagtttcttctgcacctttgagaactatcactaaatctagtattccctaactttagcaaaccaaccaacctgtcctcacaccctcctgcgattactaccccatttttctatatagaaattttcattgagaatttcttatcaccctggtctccatttctttattttatactcttccgtgagccaacacttgaagactgctcttggtaaagcaatgagctctacacttcaatcctgtcatcacatttcagttcttatcaggttgaccttccagggacattcaatatagttggcttctgttctcatcatcctttcttctcttggcacccgccagagaaacccttctggtttcccctacaaaagaggacatacttttgtagcttcctcttctggattctctccctttattggccctgcagattttggagcatcccaggagtctgaatctgtgtattctcccaggtgacctcctctaatcccgtggctgtaatgcaatggatatgtcatcaactcccaaatccttatttccagacttgccatctccctggacctttctttctctttctctttctttctcttcctccctccctccctccttcccttcctccctccctcctttatttctttcttttcctctctctctctctcccttcctctctctctctctctctcatctcactctgtctcccactatagagtgcagtggcacgatctcagctcactgcaacctccgcctcgcaggttcaagcaattctcctgcctcagcctcccgagtacctgcgattacagatgcccaccaccacacccagcaatttttgtatttttagtagagaaggggtttcctcatgttggccaggctggtctcgaactcctgacctcaggtgatcaattcgcctcagcctccctaagtgctggtattacaggcatgagccaccacacctggccctcactggaacttcagataattgcatctactagcatttgatatctacacggatgtccagtagataaataaaataaacattctcttcctacacctgtcttagtgctttgccttattcctaccctctttgatccatcaataaattttgttaacggtagtccttcatttctaacctaatctcatctacagcaatctatttccctacccaataatttgtggtggaacacaaatctctagaactgcatctttggactcatagctcaatgttaagtgaccttgcatgtgcaatttcatcttcattgggttgttataaggatctgcattattactagctacaagcatttttatagctcgttttttattttttaattgctatttttatgttttatattttattatttatttttatttttataactattacctgcatactcatttagcacttgagtatatgctgtatgataccatcctctagtagcttgtttcataattctttatttctgtctttgaagatctttgtgacaggaagcctcatttcatctccccacttatacatagaggccaggatttttgccttttataatgaattattaaatgctatcggatcaaccctcctgcaaaaaaactactataaaattgggacttcactaaagaaagcagattcttgaaaagccatagaagagtgaacaaaaaaaatgaagatttctagttagggggtccacatcaggagaagtacagttacgtaaagggagtgcccattctcacagctttaggcttgaagccaggtgcagtccgtgcacatggcatgtgggccagcaggcactttggttgcaaagccacagtttttctggctgaagaagcaaaacaccaagactgggacacctgcctccgaggagacacagaagaaaatgagtcagaaagagaaacccaaatttctatctatccacgtctctggctaacccctgaatgatgaaggtgcgttatcagactcaaagttgctcagctaaaggaaggatgtgctcaaggaggtgaagtataatgcccctgtgacagtaaatcccctgtgaatgtaaacgcccctatgactgtaaatgcccctttgagtgtaacacccctgtgaatatgaacgcccgtgaatgtaaacgcccctgtgattgtaatccccctgtgaatgtaaacgcccctgtgattgtaatccccctgtgaatgtaaacgcccctatgattgtaacacccctgtgattgtcttcctcctgaagaatacagcatggaaaggggaacaaaaacaacctcacagtggagaaacctgacaggcgctaccgcagccaggtgatcaaggtcaacatcaacagtggtaagtcatcttgatcatgtttacccttgacacagtgtgatgcaatgggcaatttatctctgtgggctttctctcaaaaacacataagcccagtctaatcttcacgaaaacatcgcacaaaacgcaattgagggacgttgtaaaaaacacctggccagcactgcgcaaacctttcaaggtcatccaaaacaagaacagtctttagaaactgttagagtctaagggcctaaggagatgagtaaatgcaatgtggtagcctggatggaatcctggaaaagaaaagagacattcggtaaaactaagaatatccaaatacagtttgaattttagttaataagaatgtatcagcattctttcattaatgataacagatgtagtataacaatgtaagaagtttaaaatagggaaactgggtgtggggtacatgggaactccctgtactatttttgcatctttttctgtaaaactaaaactgttgtaaaataaatgttcatatatattaaagaaaaagatctagatggagatcagacttgcacacaaagaacagattttcttttcaagatcaaccaaaataaatgtcttccaaaacaaacaaacaaagaaccaagggtcactggagaaaaaattacagaattcagtgtctccagtaattacgtttataatgtctgcgatataattttaaaagtatctaacatttcaaagaaccatgaaagtaaaccattctcggagaaaagaaaatcaagtgagacaaaaccctgaaatgactctaattttgaaactaggaaacaaaattttaaaggagctagtagtattactgtccttaaaggagtaaaaaaaaaaaaaaaaaaattgcaatgagtggaaagatatgacagataatcagagaaatagaaattataaaaaggaatcaggccgggcatggtggctcactcctagcaattttttgggaggcccacacgggcagatcacttgagcccaggagtttgagatcaacctgagcaatacagtgagaccttagctctattttaaaaaaaagaaaaaaagagagagagagagaatcaaatagaaattctagaactaaaactacaattgcctggaataaaaatctgttaaataaatttaatacccaaatggagattaaagaggaaagcattagtgaagaataaagaattgtttttaaatgaatagatgttagggacatattagataatatcaaatgatctaatatatatgttgttggagtcacaaagaaaaaatgaaagaatggggcagaaaaatttttcaaaaaataatgccctcaaattttaatatgtgatgaaataaataaatttacatattcaagatgttcaacaaatgtcaagcaggataaatatgaacgtgcttgtgtcaaggcaaatcatagcatagtcaaactatggaaagccaaagacaaggaacaagctttgaaaacaacaagaaaagtttgtctgtcacatacagggttaaaatgatgtaattaagggttaacttctggtcagaaacaatggagtccagaagtgacggcacaatattacagttcaggaagaaaacaaaaagcaaaaaatgcttgtcaatgcagaagtttatatccagtgaaaatatcttttaaaaatgagaataaaataaagatattttaagattaaataaaattaagataatttatcacaagcagactcatatcacaagaaatatcaaataaactcttcaggctgaagtgaaatggtacaagacagagattcaaatccacaagaaacagtaaaagcatcataagtgctaaatacagaagataattaggtaggaatttttttgctttattcaacataatttatttaatgcagatgactgggtaaagcagaaattctattccatggggagtttagaacatataatatgtatgccaagtatggcataataggtgcggggtaaatatgggtcttttatttattttatgaagtggagcaatattaacaatgaagaaactaagaagttaaggacagacattatatttcttatagtaaaaatcaaaatgaataaaaatattgacccaaaaagcaagcaaaaatcataatggaattccaaaaaatattgaaataatccttccaaaaagggcaggagataatgaagaatggaagaaaaatagagaggtagatagaaaaatacaataaactggtgaccagaactcaccacatcaataattacattaaattttaatgaagtaaacactccaattaaaaggcagggactacgtggacagagggaagtgggtccagctatactctgtctacagggctgcattttagatataaagacacaaatggtttcaaaataaatgaataaaaaatacgccaagtaaaatgtaatcataagaaggcagggatgacaatattattaatatcacaaaaaatagattcaaaggcaaaactattttgaaaaaacaaaaagagagaaacttaagactatgctgccaccacttgaaaaggtggatcgcaaggctcaagaatcatagcccaagccttcccactccttccctccttgaggtggaagaggtgcccggtactgcatcgggccagactgggaatgtcaaggtctcctgccacttccaggttccccggctggaaacagaatgaggacttcctaccctcctcagggagtaagagaccctggtcttagaacatagcaactgatgaggacatcgcgcatagcctcaaggaaacagctttggttctttgacgagggtgtatctccagtagaattccctcctctctctctttttccttctctctctccccaacatactctttttttattctttgattaattcttccacttttaaaattatttagtagaaaccacattaagggagatggagaatgagaggtaggaaaaaggcaactgaaaatctatataataagacgtgtatactgtggctaagaccatggatgttagaaccctctgtgtgggttcacagactagctctgtcccatcctaaccaactatgtaagcatgtcacacagtttctctctctcaatttattaccaacaaaataggcaataataatagtatctggccagacacggtggctcacacctgtaatcccagaagtttgggaggctgaagtgggcagatcacctgaggtcaggagttcgagaccagcctggccaacatggtgaaaccccatctctactaaaaatatcaaaattagctgggcgtggtggcgcacacctgtaatcccagctactcaggaggctgagacaggagaatcacatgaacccaggaggtggaggttgcagtgaactgagatcgcgccatggcactccagcctgggcgacaagagtgagactgtgtctccaaaaaaaaacgatgagaaagtggacataataataagggcaaaactctttggggaaggagatgacaaagaaaggagaagaaagactggatgataactagagagggtttgtgtcttataaggtatacgttctcagtatactttgtacctcatcaaaaataataatcatagtatctacctcctaaagttgttgtgagaatttaataaatcaatataagaaaggtatttagaagagtgcctaggcacattttaagtttcagcaattattgactcttaacttcaggtccaacatatagtgtaaaaattattgtaattatcacgtcagttgtgccatattaatgtttggttttaaaaatgtaccatttattttctttaaataagaaaagtgttcccaatggagctctattccactacactttatagtaaattgtaattggtctaaagtgtcgttagtatactgatagtgatatcttctgtttaaatagagctctcaattttcaaagtgcttttacagacattatctcagttaatcttcacaatagcactgaaagataattgggagaccatttactattcctatttttaaaataaagaaacagatgcacaaagaataaaagtggcttgcccaaacttcacaaggaaagaagcaggaaaaagaatcttgggtcctaaactccctcctctgtgtcagtggctttcacactggactgtatgttaccctgagggtatatgggacgtgccaatggaaagttctcctattcctcacacaccgttccttcaaacagatatgtctggaaacacatttatggctgtttcatgatggatcattttgtcccagcttcccttcgaaatcaacattctcccacttcacaaaacaaaggaatacactcaatctcccccacggtggctctggtgcaccaccacagggtgttaaaggagcatgccttgaacaactgggaacggggagcctcttttaacccaacccgttaactcacagtagagctttatttctttcagagtaaggtaaaggttggcattaggaacgatgatgtattttttagccatttcggactgtgttttcagcacgtgggttgagttaggctggtatgaatacagatacacagtaaagagggacaagagagatggtgatgttcatttaactctcatagctcttctaccccttggtattgccaaagaagtaattcctcctcagggaagttctcagaagatcagagctaagattgttgtctataatactgaagatgacggtatcttatatcacccaggagacaaactgctggcaaagttccatctcttacctaaccatccatctgtccatctgcccattcatccacacatccacatagccagccatccacccatccatccacctactcctctgtagtatagttatgcgttttgagaaatgcatccttaggcaatttcatcattgtgcaaacatcatggagtgtatttatgcaaacctagattatatagcctattacacacctaggctatatgatatagtatattgccccaaggcaacgtgtacagcatgctactgcactgaatactgtaggcaattataatacagtagtgtttgtgtctctaagcatagcaaaggtacagtaaaaatatggtactataatcttaagggaccaccatcatatatgtggtccctcattgactgaaatgttactatgtggtgcttgacagatataagatggctatgggggcccatttttttctgaaaaattaactcctattggctgtctgatttgaaaaagattggttttacatcatgtcaaaaggcggtcactttccacaaatggaatatgcagctccaaggttttgatttaaaaaatgttaaataaaataattttattataaatattgtattgacaaaagtgtattaaactgaagaacatttcaatttttcccaatgtttcaaaatttgtcagattgaacaaaatacctctaaatgatagaatggcaagaaaaattaagtgagttaaaaaaaactttataaaatatatttgatacatttcctagaaattgaataggtgaatgtctctatataattttgtccaagtaattagcttcaaattctttattttcaacaaaattaaagatggattcaattgggttataaattgacagatcactggagtaattatgacaaatattactaataaatttttgttacaattttgaagacattaaaagaatgaagttgctataataaaatctcttctattccaataaacttattagttagaacacgggcttacacccataacaatgaaaaggaagaacaaaatgatgctgaatccatttcattccagcaataagtaagattcatccacagacaggttaccatgcataaaaataagcccattcatctaattaagggatttatttctaatatttttatgcttagtaattatttgtcaaaaataccaagaaaccattcacccaaatatatatttatatttttaagtgatttgtatactaaaaatagcatgacacatcatgattcactagaaattaatactaaggcttatggtacaagagaatttaaaaatatatcataaactttaattcttatacatgtttttgttgcaaagatatattttgagatgatgtgtaaagatatttaaaacaaaaaatagttgattcttgttattttctataggctatagttgtagtctgtaaagtcaccacgaacagtaaactgctgaatactaaagcattgttcctaggggaaaaatacagggttaggttcctttgagcctctggttacaacattttcatccaccagtcaatacataaccttgttttatgtgtgtttctgtttaaagacagcttgtttattacattttattgattcattaacattgcactcatagccaatatcactataactaatgccttaactaggtttctataatgtgtatttctccacaacggacatcaccacctacttaaactcaggaacactagccagtacttcagtactatgcttggggccatttcgaacaatgaaatcaccaataaaaagcaccaaaatatgaaaaacatgacactacatagacctcaaagagggcatttgtttgcagtacgaaagttgaaacaagaaagcagaacactcaacctcaactgagaacatgcttattgagcaactcaaatcttcacaactctgccatttctgtgaatgaccttaaaagcttccagtactgattttggggcaaggaataattttaccatgttggtgaatttgcaaatatggaacccgtgaaaaatgaagattaactatattacattgggataaagttatgcaggagagtagaatagaaatgaaaaagtttgtaaaaaagaaacaatatcaaatttcagactattaaaaatcatcttttacatgtattattagcaagatgatactgaagggtaaatcatcagttttaatatcccccaaaaacatttttaaaatgatgcaattgctgtataatttaaccttaatatttataatctgaccatactgcaactacttaaacctataataaaatttttatatcaacttaaaaatgtgcaaggaagtatatggtttctcaaggtgttttataatacatatgagcaaaataatttcaagattactaactttagaaatagaagctaaaatcacaatgaggctgattaatacaaacaaagaaataaaaactacacaaaatcccaaacttaagagtcaggcgttgaaaccaaatagccattcagtgatgcagacacaaactctggggctcacactgtaatgagtgtgttgtgtttgtcttattaataatgatgaagtatttttttataaatactgctttgctcatttttatatagacaattttcaaacaattttatatttctcagttgcttcaatcaaaaagaggtttgtggccgggcgtggtggctctcatctgtaatcccagcactttgggaggccgaggtgggcagatcacttgaggtgaggaattacagccagtctggccaacatgacaaaaccccgtctctaataaaaacacaaaaattaggctgggtgcagtggctcgtgcctgtaatccaagctctttgagaggctgaggtgggtggatcacgaggtcaggagtttgagaccagcctggccaacacggttaaacccagtctctactaaaattacaaaaattagccaggcgtggtggcacacacctgtaatccccagctacttaggaggctgagacagggagaattgcttgaacctgggaggtagaggttgcagtgagccaagatcgctccactgcactccagcctgggtgatagagtgagactctatctcaaaaaaaaaaaaaaaaaaaaattacctgggtgtggtggcacgtgcctgtaatcccagctactcaggagtctgagacaggagaatcacttgaacccaggaagcagaggttgcagtaagccaagatcgcaccactgcactccagtctgggtgataagagcgagactccatctcaaaaaaaaaaaaaaaaaattttttttaaattaatagaggtttgtaagaatatctaagaaaaatatttcctcagacaggagcattactttaaggaaaagatagtactatataaatatattccactgttaaatatttccagtacgtgtcttttcctcccagagatgggacagcttgctggctctgtgagtaaaattaattagtcctagctttttgttgcctttttttttttttttcccagtggcagcttgtaactttatctcttttttttaaatatccataaattttccatgcaacaataggataaatttatttcactaattttaggataaagaaaatgaataaaattaaatgacttatattgagtaaaataaaagaagaggaagaaataaatgtttttgttttgtttttaagacagggtctcactctgtcactaaggctggagtatagttgcatgacatcggctcactgcatgcaacctctgcctcccaggctcaagggattctcctgccccagcctcccgagtagctgggactacaggcatgcaccaccacacctggctaatttttgtttttttagtacagacgggattcgccttgttggccaggcaggacttcaactcctgaccccaggtgatccaccctccttggcctcccaaagtgctgggattacaggcatgagccaccgtgcctggccagaaataaacgtttttattgtgagccaacagaaattactgattcatgcattaaaaatattgaagcagatacagtccaaaggcagcatcatattactgtagagatactacatgcaatctgcttggaagactgtgcatagtaagcacttattaggtagataatggcactcccctgaactgaaaacagaagttataaataatatttaaaatccaaaaacatgatggtactaatattagtacaagaaattaccaccttatatcttatattaacttagcaaaaattattaattaatatttaatgaaattgtcagttagatggtcagtaaaaggaagtctttggcccacagatcaaaattcacaatacaattttatccttaatctttaaatacaaaattacatttacgagcgtatttttaacttcgcagcagagatttaagccagtggcaaatacagaggctctcaagccagactacctcagtttaaatgtctgcttctcaactttcttgctttaataccttcaaaagtaaaatactgttcacatgtatcttacagagttgttataagtatgaaatgtctgactacatgtaaaattcttagattaatgcatagtatacagtaagcactcagtaaatgttagcagctactaaataaaaagtagccgcattttcaaaaatgattcggaactttctagtaatcaccaacattactttcagaagctctagttggaaatatttgttaaaatcttctcttaaaatctcaacagatagggagaaggtggaatctcacacactgcaggtgggaatgtaaaatgctaccgccactttggaaaacagtccagcaatccctcaaatgctcaaacctagagttatcatatgatcctgcaattctactcctaggctatatacttgatagaaatgaaaaatatgtccaaataaaaacttgcacatgaatgtccctatcagcattattattaatagccaaaaggtggaaaccacccaaatgctcatcaattaaccaatgatatatgcatgtgtttgttgtatccatacattggaatattactcagcaatgaaaaaggatgaagtgctggttcataccacaacctgggtgaaccttgaaaacattgtactcagtgaaagaagccagtcataagatgttgtatgattccattgatattgaatgtctagagttggcaaatctatagacacagagagtgcattagtgattgcctaaggtggtggtggacagtgtttggggagaaacaggagttactgctaaagggaagtgggtttcttttgggagtgatgaaaatcaaaattgactgtggtgatggttacaaaactctgtgaatatactaacaaacaatgaattttagaatttaaatgggtgaattttatagtatgtgaattatatcttagtaaaactgtatctcctccgctgtccctccctaaaataaaaccaaccaaatctctgtatacccatcacttattaaagtacttggcaaaacactgtgacttagtacttttgggataagcggatgaatgaatgtgcattcacttcactttaaatgttttttcccctattttcatctattagagaaaactgtaatcatgagaagaaacttacaaaatttgtaaacatcatctttcacatttagagtttgtttttataatgtgacaaagtttttctgttaaatatctcacagttgctgtacctagaagtgctttaagaacctgaaatagtactaatggtatgaaaaaggtagacttatatttcaacctttaatatagaaaatataatttgctcaaattactcacactgttctaatttccatatgctctaaagtaagtatgaataagatttagacctaattgctggtgacattaaaattcattcaattcttactgtcaacaaatatttactgaataagtaactatttgctaggcacagtgctagaaagtgatattacaaaaatgaataacacagcctggtgacagagatattacaacagaattatgtacaagaatatgatacatgctatattagggcttgtgccatgcgtaccacaccaaatgttttaagaatgaagagaaaaaaaaggaggctgggtgtggtggctcacgcctgtaatcccagaactttaggaggccgaggcgggaggatcacttgaggtcaggagttggagaccagtctggccaacatggcaaaaccccatctctactaaaaatacaataattagctggacgtggtggcacacacctgtaataccagctactcaggaggctgaggcaagagaatcacttgaacctgggaggtggaggctgcagtgagctgagattgtgccactgcactccagcctggaggacagagttaaagtgtctcaaaaaaaaaaaaaaaaaaaaaaaaaaaaagaaagaaaaagaaaagaaaagaaaacaaaaaaagaagagaccagcactttgggaggccgaggtgggtggatcacttgaggtcaagagttcaagaccagcctggccaacatggtgaaatctcatctctattaaaaatacaaaaattagccaggtgtggtggtgcgttcctgtaaccccagctactcggggcggggggctgaggcaggagaatcgcttgaacttgggaggtggaggttgcagtgagccaagatcacgccactgcactgcagcctgggcgacaggctgagacttcgtctaaaaaaaaaaaaagagacaatgaagaagagtggctaaaagctggagtagttcaaaatatttcagagataagggaaaatataggaatgatagagaaaaataagtaggggatttccaggtagagatttgttttttattgctacaggttaaagacacagtttaggaattactcttttagacaacaacagtgtattttcattagccatgaggttgtcagtattataggatggaggtatttacagtagtgagcagagagcaggcagagtcttatataactgtgagaactctggagctgtcccatgaaacttttaacgagctaaattttctattttacaaaaggacaacgtaaataattcatctttcaatattaagacaacatgttaactaatcaaaaatatcctggctatcacaaaattcaaaaggaaaatgtcaaaatatctacatgtttatattttgaattgaaagatattctaaaagttgtttcatgattatgaactgcacaatggagaccaatgtttggttcacaaatgtgtgctgttaattagattgagagtgattgtatatggtttctcacaaaggcatcttgagttcaaccatgtaaattgatggaattatcaaaacatcagacctatttcatttcaacctggcttttataaccaaggtgtgtgtgtatgtgtatggtgtgtatacatgtgtggatgtgtgtggatgtgtgcgtacatgtatagtctcccccaatataaatgtgaggctacattttcaggttaagagggctaatgtgtatcttgccttctcatcacaaattgttctacaagtccatccataatgataattatatccttcaatagacggctgcttacttcccaaattttaaactgaacaaaaatattacggatccaccagataattttaaatctatctacttgaactgcaaaattaggagttgaatgaaaaccttacttagtgcagtatgtttaaaactcatctttggctaggtgcagtggctcacgtctgtaatcctaatagttttggaggccgaggtgggtgcatcacctgaggtcaggagttcgagaccagcctgggcaacatggcaacatcccatctctactaaaaatacaaaacttagctgggtgtggtagtgggcgactgaaagcccagctacttgggaggctgaggcgggaggttgcagtgagctgagatcgcaccattgcactcccacctgggtgacggagtgagactccgtctcaaaaaaaacaattaaaaattaaaaacgaaaaaaaaaccacgtcatctttgagcatgttagtacttgctttgatacaaagggtctgcttgagtttgtattaaatcatttaactctccttgtagtttcctctgttattaaatgatgagaatgttcctaacctattgcaaatgattacttaccatggaaatacaaccacaattatactcaagattattccaagcacaaagttttgcatggaatcactgtaacattaacactgtctaataagaaacaaaacccaaatctttctgttaggagattattctccatgggtctccggccttctgcaatcttacctcactacctctatgctggactagctttccaagggggtttgtataggaagcatccttataagacaaaggtagtgtcttcctctggatcaaagggcagaagtgcttcctgtctgtcataaaagattcgggttccctgagctccgggttcctctccttttaacacatcctgctgtgtgtgcaggtgtcacttcacattgccctgtggaaactggggcctggagatgttgacaatgtgactactgctatggggcaagtaataaactatccagctccctgacccaggaatctcatgtcttggggccaatgtttggttcacaagtgtgtgctgttaattagattgggcaccagctgagtgactgtatatgatttctcacaaaggcatctcgagttcaagattggcatccatgaaactgtgagcagcctgcaagagggataaagtctcagatacttcacagttcctgacactgtctatcatttccttgacttaggcattacattcttactctctgaagctgttattttgttgttgtttttggggacttaataagcacattttaaagataaaaataaagcttaaactgaaatcaaaataccagtctttattttattttaatcaaagactgccctgacctttttttgagatgagatcatgaggtgacgtttaagctttgtaaatgcttatacataacaagtactttcaacaaaaaattctaacaattcttgatgccttatatgccagcttagaagaaatcaatcattgtttactttttcacttaaatttgcagatgctgattaaaaggcgattactattttttttacacttaggtctttctttaatcaaaattgactatatctctataaatgggaatcagggatctgctattacacaaaaatagatgtcaacatatgaaaattaaataaatgaactttgccactgccctgtaattaagtgataaagatttcattcacttttctaaggttttaatcatttatgataacttttattttcttaaggaaaaattgaactttgattttaaaaattctaaagttttcctaaaatatagcactaatatgtaatggagcaaactttcaaagtcacattctatttcattagaaatttgtctacaaatggccgggcgcagtggctcatgcctgtaatcctagcactttgggaggccgaggcgtgtggatcacgaggtcaggagatcaagaccatcctggctaacacagtgataacccatctctactaaaaatacaaaaaaaaaaaaaaaaaaaattagccaggcgtggtggcgggcgcctgtagtcccagctattcaggaggctgaggcaggagaatggcgtgaacccagaaggcggagcttgcagtgagccgagatcgcgccactgcactccagcctgggcaacagagtgagattccgtctcaaaaaaaaaagaagaagaaaaaaagaaaaagaaagaaatttgtgtataaatacaagttttaagagccccccctcctccttcttaataaatattaatgcatttgctcctccactaaaaacactttaagaaaatcaacagccatggcgatctcatggctgtgatgtgctcagggcaagcatctatgtaacatatccctattctgcaacacctcacccagcagacagaatgtttacctaaaactccctgagcttatgaaaacttcaacaatcatgtcaacatttaagctcgttcccaattaaccagtcttaccaagcatcacttctatgaacattttaaagaaaaaccagtgaagtggtgaaatcaactctgtccaagcttgcatgcaactctaggaaggcggttagcttatctctcaactagttcttatattacaccactatatttaacatctgacttttgttgctgtttataatattaccctttattttccttcaattttagaacctcagtttgtggccacctacagaataaactttcagctttaccaaattttctcttcttatgagagatgcacaacacttaatagagagaacactatttttcaagctgcaatatactgtggtgttttcatgttagacataaatagtgtcagtgaaaatgttgatcaaagaaatgaaattctaataggatgtcagaagaagcagattaaacaaatgatctagctgttccaaagacatcaaaatgcaaaataattcttttctggaggtattacttagccaaatgtaatttctttagcaatttcaagaaagaataggaagtgttaatgttagtttaattatagaaataatgtcaagtgacaatggcagggaagaaactgaatgctgatttgatctacacacagtgacatggacatttagaaaatatattatatgataattatataatcctggctaaattctttgataggtttcagttgcccctgtaaatgttctaaaattaaattcaggagggtatattgtgatatttaagaatttaacaaagttatctcaagaacatctcacactctcatgctatctgcaatccttgaatatatggtgactaatatatcttaatgtatttttgtatatcaatattttatcatgttatttcttaagacgacaactccaaataacaaagtgttgaaagaaaatatcagaaccaccaatatttttctttccttgacatacttgcagatatatatttttatgtttataacagaagttaataaagaaacatgcccagcttattatttctggattgattgcagaaacagctactaccttttttgatgatgtggaagtttatgcatgtattgaggaggcaatagctgtgataaattacttcaagaaaataacactttccattgcctttctttttttccttacaacctgtgttatggagtgaaatgtacttggccttgtcttcaggaggcagaagcaatcatttgcagaataggctttgtgtgctaacatttaatattaatctattcccaggcattatattattaactttgaatagatgctgacaagtcttgtttttggagggaggtggggcagggtatcgctctgtcacccaggctgaagtgcagtgttgccatcatggctcactgcagccttgacctcccaggctcaagtaatcctcccacctcaccctcaagagtaagcaggacaataggcatgtgccactacacagggcaattttttttattcttgttttttttttagagacaggagtctcactatgttgcccaggctggtctcatatgcctgtgctcaaaggatcctcctgcatcggtctcccaaagtgctggaattacaggcatgagccaccacatccatttcacttttgctttttttttaatgtgccattgttgcatctgtttctactgaagaataaaacagataccactatgctctttgttttccttttttttttcttttaatcactacccatttattaaaggctaggtggatttgggtaattcatcactgctaagtaaggtaactaagagcacgtttatggatatattatatacactggttacctcgtttcaataaataagcagctggtaagtcatctcccagttttatccccaacttctaaaagaaaaataggtcgaaaaaattaacaaatctggttaggaaaaatacactgagcccaactattatgattccctggattctattattacgtttatttattagtattatgagtctttgctaaaatgttgacttcttatggaaggcctctcaacagtgctgtttaaaaatcacacgtaatcaatcctttcactcggcacaccctaacctttttcccttcttcctttttctccacagctttcatcaatatcaaacacaattcatcatgaaaatcaagatttattcgttttgttcactactctatccccaatgtctggcacatactagctgctcaataaataagaatgaatgtgtagtataccacatggatgaagtatgggaggtattcattcaagcacttatcatgcgctctcctaaattacttaacatcagtgactgcccccactccacccgctcctcatccagcctccactgaatgaggaaacagcaccatgaatgaatagctcatgataaaaatttagcgatcgtcatcagtgtatccctttatccctatcattgagcctttggttctatctccaaaatatttattagatttctctacctctctccatctgcattgtcgtgaccattatctgtcttttgaatcagagcaatactctcagaacaggactcccaaaggcagtcagaggaatcccttgacacaagaaaaaactcacgtcacttcctactttaaaggcctcaatggccttctattgttcacaggataaaatctacactccttactgcagcctacagggctgcacggcctggctcccacttgtcctccagcctcaaccccctgtcacgctcccgctacgccgcccaccgagctcccgctatgctgtgtctggaagaagccaaccccttgctggattttacaccttggtacttgttgttccctttgcctggagcactcttgcctcctatctttccatgactcattcacagcctctagagagtatctcaaatgccagctgcacaggtcttcctgtgaccaccctaattaagcagcctccctaactactctctcatcaccttgtttactgctaccgtggttcttatcaccactttgttaacttactctttgttaaatgtaagccccgacaggacagggactttgcctctgtatattcacagggactaataaaatacgtggaacatggaaattgctccatatataacaaccgaatcaataaatagaacattctccctcacttgggtggcatccctcgtctcactaattagaatgcctgacacagaagagacatgctacaaatgttgaagtgaatgagaaaactgaaatcttttattgtatcctgagtggcacccagaaagatctttgttcattaatatttgcatataataactggactgagagaaaaatgaattcatttgattgacatttactcagtgtctgtccagtgctggaaagagcatatggcaatttggcttgcaagcacagaacagaggatatcatttctaaactgttcggtaatcccataaatataggacacacacatttcaccaaggcatttggcaaagtttctcattatatcttgtctttaacatgcaggaatgcagattggatggtagcccagctgatgggtttggtactagagagtggttagatgaagacagcttaagcatgttcaacagctctttcaatgcagcaaatatttcttgagcagctccggccagccaagtactgagcttgaggctagagtaataaaataattaagtgtggtctcttacctagaagggtgcataagtcttcccgtaaaacatttcagatctctgccctgtaccattgacattatttttaaattaatatattggatggatatatacagaatgtacttctatcaaaatcatatgagaattttaggggaaaaaacagaagaaataataaatcaggatccaagagatgataggtatctcaaaggctggaatgaattctttaaattaaatttagtgcagatatgaggtcctaccaatgaatccaaaataccaactacatatttacaaaatgggggaaatatggaatgtatccactcataaacattccttagggattttaatttacagtactctataaaaatctattgtgatatagtgatcacagaaactagtttcaccttctggtgtatttacaaggaagtaatcagcctgtgctcagaccacacttaagactactgtgtttgaaggcacgcaccacactataagaaaagttcagaggaggcggtcgagatggacacgaggatccttgctgcaacagccaatggtgttgctaaaacactgacactaatgaagaatttgtggaatgttaagaaagtgggggggttgcaggggggggtgggtgacagaggaagtcattctacaaaaaggtacttgcagatgcatgtttatagcagcacagttccaggttgcaaaaatgcggaaccagcccaaatgcccatcaatcaatgagtggatcaagaaactgtggtatgtgtgtgtgtgtgtatacacacacacacacacacacatacacatactactcagccattaaaaggaatgaattaatggcatttgcagcaacctggatgggaatggagatgattcttctaagtgaagtaactcaggaatggcaaaccaaatatcgtatgttctcactcataagtgggagctaagccatgaagatgcaaaggcctaagaatgacacagtggactctggggactcaacaggaaaggatgggaagggggtgagggataaaagactacaaattgggttcagtgtatactgcttggatgatgggttcaccaaaatctcacaaatcgctactaaagaacttacacatgtagccaaatatcacctgttccccaaaaacctatggaaataaaaaatttaaaaaaagaaagtgtgggtgaatggtagagaaggagggagctaactgtccataagtattcaaagagcaggtatgcagaagaaatagtaaacctgttttacacgatcctagggcacaggactaggaaactacatgaggacagattttgattcaccataaaaaggcctgactatcagtgctgtcctgcgaaagtgaagcatctcgtgaggaagtcagctctctatcaatgacaggtctcccacggccactgggacatcctctggacaaagacatcagactcaggacttaaacgctgcatagacagcagatttctagaccctatgtccttgacattttatgatataatgaaaagggaactaaaaaataaggaagtatacattttcattcactcaaccaatgcttgctatggctaggcgctgttttaggcaccgtggacacagcagctaacttaggcaaagtaatcccagcattttgggaggctgaggcaggcagatcacgaggtcaggagttcaagaccagcctggccaacacagtgaaaccccgcctccactactagtacaacaattagccaggcgtggtggcaggcgctacttgggaagctgaggcaggagaatcgcttgaacccgggaggcggaggttgcagtgagccaagattgcattactgcactccagcctaggcaacactgcgaaactctgtctcaaaaaaaagtatgcttgtgaagcatacattctagatggtttgggacaaaatgaaacacaagcataaaacaccaatctttgggtttgagaggatacttggtgctagtttgaggcaaagctacacctgaggcattcacactttaattttgtttatttatttttaaattttatttatttgtttttttgagatggagtctcattctgtggcccaggctggaatgcagtggtgcaatctcggctcactgcaaactccagctcccagtttcaagtcattctcctgcctcagtctcctgagtaactggtattacaggtgtgcgccaccatgcctaatttctgtatttttagtagagatggggtggggcggtttcaccatgttggccagaatggtctcaaactcctgaccttaggtgatcggccagcctcggctacccaaagtgctgggattacaggcatgacccaccacgcccagcccacactctattttttatttatttatttattttcatttttatttatttatttatttattgacagagttttgcttgtcacccaggctggagtgcagtggcacaatcttggctcaccgcaacatccacctcccgggttcaagcgattctcctgcctcagcctcctgagtagctgggattacagtcacctgccaccgctcccggctaatttttgtatttttagtagagatgggttttcaccatgttggccaggctggtctcgaactcctgacctcaggtgattcacctgcctcagccttccaaagtgctgggattacaggcgtgagccactgtacctcgcctccacactttatttttaagctggaagttatcatagatagagccatttgttacaataactgcagtagaccttttgcctttattcccgctatatgttctcctttcctttctaacctgtggcttccactcctcaccactgcaaaacaatttacaattaattgcttatactgcaattattaataaaatatattttgccatttactaaactattagatatgttttctgagtttttacacattaaaactttccacagtaaacattataagtgttcattattagaattcataaattatacagaagtgcaaaaactaaaggatgtatctacttctgttactttcacagaataatctatgcatatgtactaatacagatttagacatatgttatcccaaatctggtagtacttttgtagcttttcattttattctagtactaaaattattagaacactagtctttttggaattgatttttaaagtcccctaattggaattgcagccatctttttggtctgtcctccgattgaagaagatctaacagtgcaatcatcatatgacacttaataagcatccttgctgggcacctggtccataagaacattgagaataaatactttcctgacattcagtcagattgattgatgcacatcaagtcaatgacactggggaacgctttgtggatggaatgactacataataacaggaaaactctaggaagatacacttaatgaatccttattgatctaaatacacctaaaacttgtttgtaactttaacctctgccacattatagaggaagacattccaaactcaaactttttttttatatactttaagttctagggtacatgggcacaacatgcaggtttgttacatatgtatacatgtgccatgtgggtgtgctgcccccattaactcatcatttacattaggtatatctcctaatgctacccctccccccaccccccaccccaagacaggtgtgatgttccccactctgtgtccaagtgttctcattgttcaattcccacctatgagtgagaacatgcagtccaaactctaacttttattttattttattttattttattttattttattttttgagacggagtctcgctctgtcgcccaggccagactgcggactgcagtggcgcaatctcggctcactgcaagctccgcttcccgggttcacgccattctcctgcctcagcctcccgagtagctgggactacaggcgcccgccaccacgcccggctaattttttttttgtatttttagtagagacggggtttcaccttgttagccaggatggtctcgatctcctgacctcatgatccacccgccttggcctcccaaagtgctgggattacaggtgtgagccaccgcgcccggccccaaacttttattttatatatatatatcttagtagaagttgaacaaatatttccgaagctgttcagaacaaggtagaattcaacatactggaaatgtgtgtgtggcctgaaaattatagccagctactccagaaacctatagttgtggtgttttggaatttggtgacttggccatggttattcaattaaggaaaatattctcatacttatttttatatcagtctttcctactcaggtccttcaaagaaaacatggttaaacctattctctccccttcatagttgcttaattttattttttccaacccaggaagtcctaacttgtacaagtgtatcctcataaaatactaatgccttggtcatgttatctactctgaagtcattttaagcctttccctttgctaggatgcttaccacaactggatatttcaagtatggaagcaccatgatgtgaagcaaagatgggaaagtagttttatttctgtttgcaaacaaatgatgtctccttcttcactggtattttaggtaaaggcattaggaaaaactactggcttcagagaagaggacttaatgacactaagttgtgtgatctggtgaacacactttgaatcagttttgtccaaatgcatttccctatgtttgccaacatcaagctccctattataacatagtttctagaacagtgctgcccaatagaaggactagtaaagccaccgatgtgggccacatataaaattttaaattttctggtggccatgataaaaaagtaaaaatatgcagatataattttaatattttatgtagatgcaaaatattatgatttcaacaaataatcaatataggaggtattaataagatagtggtcattctttttttgtaccaagtttttgaaattgggtgtatgttttgtaattacagcacaactcagttgggactgtccatatgtggctaacggctactatattggcagacaattctagaaccaagctgaaaaccataaactgatggcaagtgtggaaagagcacagtttgcactctcagactactagattacctagactctttactcttgaaacatcaaatatgaattcatctattaaaaatgtcaccataattatagatgtaggttagcctttcttttacaatgatggggtaaaaataactgatttcccaccagctttccggtgcaacatccattaccataataaagcaaatttaaatttaattagaatgtaattaaaggtaatgtgggtgattccaggatagctgatttgttttactagtaacagaaacgccctttgccacttatatgaagctggaacaatattaatcaaatgacttattatctgagagaacaaagtacagaaatatttacataacatagtaccataggcagaatatccacgttaaactaatgttaagaacgacaaagggaagatacgccagcataatacatcttacttcttttccaataatacaactgggacattgcaaatacccaacttctagaatctgtcaggaagagtaatctacatgtatttaattctctcctgcacatgttgaatgactaaattgtgaaaatatatttgaatgcttttttttagaaatcactatacttctttgttaggttacttaatttttagcataaacccaccaaatcccatgtcaattgttaaaaatggatctattcaagcctacagtataaatttatggtttcccaggaaatcacaggaaagttgttgtaaaaggtattaaaattattgccaataaatcccatgtttaaaaatattctattaaatgtaaatgttgaaagtagtattaataacagctatgttcaaagaaaactttaagggcaaacataaaacaatttacttggaaggccatattacaagattcaaagatttgctagattctttgaacaggtttcgatgggagatgatgatcttgtgatctgtagataagagactctgaatatcaagtgatcagaaaccaaagcagagataaggctactgaaaatagcctatttcctgtgctggtctggacctaggctttggggtataggcaggcctgataccagaagtccgatgtagcaaaaggaatgaaggaaaaagatgaagagacaaaaacatgctgacactgtcattatttctacaaatgtcaaaataaaattcaaaatgaaatcgattttttaattataaaaattcttctgagaattgtttattttcccctccagacataagtaaacttaaggcaaggaatcatatttaccttctgatatgcttcacatagaatttgccactttttatcagcaatattaaaaatgattatgtgatgaatagctttcagtctatacgccctgagagcaggcaagaaaaattattcaaaaaaacaaaatgcttctcactattaaccaaaaaacagcctatgaaaaggcacagtcaaatgatcttggtcaacaaggctaaggcacccattcattatttattgagggcttattgggtataaggacatctaagaattattcaacgtcaagtgttgtgggccaaaagccacaagagaaaaggattttcacttccaagtccagcctaatagttccaatcttggaaagaacgagagaaataacagaggaagagaaaagaaagagaaacttggaggaggaacaaataaacagcagacatgttgttactggagaagacaaaaaatgcagtgagaagatagagacgtaagaaccgcgcaggtacatgcatgtatgcatgtgtgtgcatgtgtatgcatgtgagtgtgtgtgtgcatgagtgtgtgtgtgtttgcatgagtgtgcatgtgagtgtacgtgtgcaaatcaagagacacaagcacagggctgcgtgtgcaatgcggctagctgcgtcatgcctccggaagtacaaaacaccactatttatttatttacgcctctggaagtacaaaacagcactatttatctatttatgtattttgagacggagtctcgctttgtcgcaatctcagctcactgcagtggcgcaatctcagctcactgcaacctccgcctcccgggctcaagtgattctcctgcctcagcctcccaagtagctgggattacaggcgcacaccaccatgcccagctaatttttgtatttttagtagagacagggtttcaccatgttggacaggatggtcttgttctcacctcgtgagccgcctgccttggcctcccaaagtgctgggattacaggcgtgagccaccgcacctggcctaacaccactctttttttttttttttttgagacggagtttcactcttgtttcccaggttggagtgcaatggcacgatctcagctcactgcaacctccgcctctcggtttcaaacgattctcctgcctcagcctcccgagtagctgggattacaggcatgtgccaccacgccctacttatttttatttatttatttatgtatttttagtagatacggggtttctccatgttggtcaggctgatctcaaactcccgacctcaggtgatccacccgcctcggcctcccaaagtgctgggattacaggtgtgagccaccgcgcccagcccactctttttgagggtagggttcacaactgtgtatatgtaaaatttttagtctcaagatttctttaaagtggtaaacagtcatgctgcagactcataaactgtgtaaattcatacaaaagtttagtaaatcttctcaatcccgtttgtataggctttcttaagtgaaacaaaggggcagaaataaacaataggtaatgataactgtggaaaagaaaacaggcagcacagcatgaggaaaggacgagcacagggaagcccaatgggtcagaatgatgtgcaagctcggtcttgcctggttcaacctcatgaacaagagaagatcagcaaacgtgataccccagccacaagagtaacactgataataataattacgattctatcgtcatcattcatgtggaggtgcatgccaggtgctttcgaattgttaaccacccacaagaagcctgaacacctagagttctcctcatcgtgtacataagcaaagggaagggagagagagtctttaattggccccagaatatacagcaataaatggaggagctgaggagtaaggccaactggttctgaaatcctgcctgtggtgtctggctgtaaaactctgactcttgcctaagctgaagtctagcctgggacctgaagtgcagcaactctgactgaagctggatggttactctacttccagtattgtgctcaatgaagaggtcagtttttgagcaaatacacttgactctttgagggagttaagaaaaatgaaattgaaataaagccagaatatacaccagagaaaattttggtgtctattttcctgaaatcacacaatctatcttaaaatttttacaatgctcaaaggtgtttcatcattgcccaccaacttctatcctggtaggtaccaggaaattatcatctctcaggtttcaaataaagcaggtataggccagctgttcttgctcacagtgatactacaggcagtcaaaaaataaattcgctgatgaatgttacctcctagaacttccacgcgtgggacttacacactgatgcacgagtttccattggcatttttgacagcatctatactcctcttatatcaacagaatatgtccagaactactggctttataagagtcgagttatgcagttgctacacagggtcattttgccagtcctttcattcaaaaccatctttggtgactcccttcattgagaacaagatgcaaagtcttcaggtgttcacagtcctttacgattccctttttccacctatttcttgctatactttcccctttcagtatccactcttttctcatcctcctcctctctgctgcggcctctcctacttcacaaacaccagccacagggagcttgtttctaggtcatgcttcatattctcctgcataactgcatgttctctgggataacctttcccctacagcatctctaactattcaggaagctaaccttgtggaaggtccattcaaattatacccgtcttacaaatcctgctctatctcttgctgttgtttggcaacactaggatcctttactgtttgtcagcctcatcctgtttcccggcttctgcaactgtttttctcagtacagtgcagagtcccagagtgcagggtcctaaagcgcagggtcctagagcacagggtcctagagcgcagagtcctagagcacagggcgaacatggttatccacggtgagatcttcttcccctagtacctaccacagtctcccatataggagacattcacatgtatttgtttaattttatgaacaactgtagagcttactctgagaaaagaggtttcatactgacctgtaattggatattctctttctggcctagtatataacctccctgattcaggctgcggctcagagttcttcaaagagtaagtacagttatcactgttgaaagtgactctggctgtaaacatcaaagacgtgatttctaatgttgttgtggctgaaactccgcttaaacactagggagaacaacaagtccacagaagtcacatgtctgttcattaaacgcacaggaagaccttgaactaaacccttcacaaaacatctaacacagagcttgcaatggtgaggagcctctctctcctgcacagccagtgaacaatctaggcttggagagacagagagaagagcaagagcattctaataagcaggtgtctgtgacctcctgagtaaccaaccgtgaaaccaagagataagtacagtcatgggtcactgaacaacgaggacacattttaagaattgcgttgttaggggattttgttttgggaacaccacggaagggacttacataaacccagatggtacaggcgactccacacctaggctctatggggcagcctgctgctcttggctacaaaccggcacaacatgtttactgaatgccttaggcaactgtaacacaacaagaaacatttgtatatataaacacaaaaaagtaaagtaaaaacacagtataaaaggtaaaaaatgggacactcgtctaggaaacatggagtttgcagaactggaagttgctctgggtgatcagggagcgagtggcgagtgaatgggaagacctaggacatgactgtccattaccacagacttcaccaacactgcacactcaggctacgctaaagttagaaaaaaacatttcctttcctctgtgataaattaactttagcttactgtaactttttttactttataaactttttaactttttgactcttttaataataccggtttaacacacaaatgtattgcacagctacacaaaagtattccttcttcatatccttactctatatgctgttttccaccttaaaaaaaaaaacaacctttaaaacttttttctttttttttgagacggtgtcatgctctgttgcccgggttggagtgcggtggtgtgatcttggctcactgaaacctctgtatcccaggttcaggagattctcctgcctcagtctcctgagtagctgggattacaggcgcatgccaacatccccagctaattttttttgtatttttagtagagatggggtttcaccatgttggccaggctggtcttgaactccgtatctcaggtgatttgcccacctaagcctcccaaactgctgggataacaggcttgagccaccatgcctggcctatctttaaaacatttttgttaaaaagcaagacataaacacacagtagcctgggcttagagagggtcaagatcatcaatatcactgtctcccacctccactcacatctggtcccactggagggtcttcagggacaataacaaacatagagctgtcatctcctgtgatcacaatgccttcttttggacacctgctgaaggacctgcctgaggctgttttacagttatctgtttttttttctcaaaaataattagtaggagccaggcgcagtggctcacgcctgtaatccagcactttgggaggtcgaggcaggcagatcacgaggtcaagagattgagaccatcctggccaacatagtgaaacctcgtctctactgaaaatacaaaaattcgctgggcgtggtggcgcatgcctgtaatctcagctacttgggaggctgaggcaggacaatcgcttaaacccgggaggtggaggttgcagtgggccaagattgtgccactgcactccagcctgggtgagagagcaagattttgtctcaaaaaaaaaaaaaatagtataagttctataaaataactataaatacacaaaccagtaatatggtcatttttctaatcacgtactatacataattgtatgtgctggacttttacacaattggtatcgtagtaggctcattgaccccagggtcaccacgcacacgaggaacgcattgtactaggatgttaccatggcgaagacatcactaggctataggagcttttcagctccatgacaatcttatgggaccacccttgcagatgtggtctgtcactaactgaaatgtcatggggcacatggctgtatacatttttttactgtatttgaatgatacggacaattactgacgaccaaaaatagggaggagaggaagaagatgacatggaagtaagtagaaactatttctgaaggagaaaaacttacatgggaaaaagactccttctttgtgccatggatttgccagttgacatgactgaaaagcagtcacccaaacaatgaccaggaggaccgagtgctgctggtgaagcccaccagagaccagcggacggggactgctgctgtgttagcgaggggaaaaacagcctaggacactgcccaccccatcttcaagggcttccctgactctagcaaatcataaaaaccaaaacccataaatgatgaggccaccaagtcataaagaagaagtcaaacccaatcattacccttttgttagatagtatggaaggagacagtgtattttaactgattctctttttttttaagacagagtcttgctctgtcacccagcctggagcgcagtggcacgatctcacctcactgcaccctccgcctcctgggttcaagtgattctcccgcctcagcctcctgagtacctggcactacaggtgtgcaccaccaagcccagctaatttttgtgtgtgtgtgtgtgtgtgtatttttagtaaagacagagttttgccatgttggccagcttgtcccaaactcctgacctcaagtgatctgcctacctcagcctctcaaagtgctgggattacaggcatgagccactgcgcctggcctaaactgattttcattctactagaattaatgttctcatataaagaattaagtagtcagctatatggaaaagtgaagctttcaaaaataacccattccctattgatctagccagcttcagatttataatagcaaacaggataccaaattataacgagaccacaaattcttatctgcagaatcctcatgtccatggagaggtaaacttaagtctcttcaaaatctgtaaatactattagctaattattctgaaactggttgctgatacattttaaggtttctcttaaagttaactcactttctaagattctaccactactggtgggggaaaaaaaagcagtttttttgttaacgtataatgtttccattaagtggaaattcaagggcaggcagatgctatctcttaagagttgagcattttgtattaaaattaaccagcatgatatttggcatctcactgggatgcaaaagggaacattatttgctgctgcgtgccattagtgccagaaacattttttcataaaatgaagagtgcagctccactaatctattagtcctaagccattttagatcataccattgattaactaaaatatttttttttcaaatgacggctgatgacagagcactaccttaaaagtcaaagaactataaattaaacatgaatccagttaccatgttctgtcaaaacaagaaatacatgcgtgtgtttgtgtcctttatatgggccaacataagcttttcctattatttctggaaatattcagatttattagcacacataaaatcctcagactgaaattattataacatttatttcaaactgaaaaaaataccaaaggagtaatctggggggcttggtgtctcatggtggactcctatttgcttttgccccttttcttctttgggtcttaccttccagcatgcttaaacttctagttatagaaacccatggcaacactcactgcccagaataactatgtttactcagataatgaaaagtggtgtgataaccttatctcctgggataattaggttatgtccaaaaagccaggctccttaaagatccttttcaatgatctccatgcttgatacagggcactgactttactacaaaaatatttaaaacactgtggcttttcatactttcacaactttttattttatgttcagctgctactcaaaaaactaactttgtgcagtattccaaccaatacatcatcacataaatacatcttttacacaagcaagtgcacttgaagaaattccagttgaaggcatacaagaacctccaaggttacccaggaaacctattctgacgagttatgtatatgtcaaaacacatgagtctacatcttcataaaactgtgtgactgagagtgcatcaggggttaagctacgtaaacaaacaaaaccagcaataatggcaacagaaatattcacaatattggaatcaaaagtaactatttgtgacatctaatgttgattggttatccataattttttaaagccttcatattaaaaacaacgaaagaaaaatacatgaaccaagtatactatgtaaaatggataaatgaaagcagagaaaagaaagcaagcaagaataaatatctactccaaaacccaactctaaaatgagatgcataggctctttaaatcacaaaatctgtgtggcttactaatggaaggatccttagagatcatcttgtccaatctaccttccaacgtggaaatttattatccatcatacctaataccaaactgacgcagtccagcagaaacactccggcctgagggtatgcactgattccattgttggacagctagctctatttgttacagcccaacttttgacggatgtgtaagacttgaagacattaagacccagaaatgactctatgattatactatgattataatgactatatgattatacctcattataattactacagcctccataaatatatgctactcaaagtgtaaaaagtcacatcaccagaagacaaacataatgtgaacccctatcccaaggataatttatctgccatatgcacaaaacccagtctcacgatattcgagtctgggtcctctctgagaaacagacatcaagatctgatgacatgtgcaagaaatttattgggtgagacacctgtgaaggaagcggggatggattctttggggagttgcgattgttttgtgtcttatgtgtggtggaggtaaaagaagttatgcctatgtaaaaacacatagaactgtgcaccaaaaaagttaatttaactatatgcaaatttttaaaattagaaaatatatatttaaaaatttggagggaggtgtaggaagctgagaagcatcagactgggatacagattcaactctgtgaaggaggcagtggcggcagtgggggcggggaaggaaggaaagaagggacgtagggaaggagggagagagggagagagggagacggggaaaggaaagaagattttaaatatgtgataacacatgatgttccaaaaggtgaagaaaaacaagccatctcacagattgctggaggcagtctacaatggtaaggctaccaagaaggacaagttggacagctctatcaaaattagaaaggcacaagccctctgatccagcaattctacttttaggtatttacatgacagaaatatgtagacatatgtaagatgatgtgtctataaaactactaattgcaagattgcttataacagctaaagctgaaaaaattcagctcagtgtcaataataggggacaagttaagttaaataccttgtgttccattcatttaagggaataccatacattcttgaaaaatactgatgctcatatgtactgatgtagagatatttccactgaatgaaacattgcaaaaatatgctatcatttgatcatctgtattaaaaagatatatatggttgtctatgcataaagtatgtctaaaaaagaagaaagcaacgatagcatcagatgcctcttaatataaaggaactggctgtttgggcaagagaagttggtgggaaatgtcccactgtaaatcctagtggaaaattttgaaatttgaatcatgtaaatatattacctgttttgaaaggtaagcagactctattttaatgaagatgaaaaagatcattctaaatgttaggtgaagaatacggttcattagggaataagtgtcaaggcaggaagacctcttcaggaatggtggtagcaaaacagggggtctccgtggggctgacagaccctgcatacatgctaaagatgcagccaacaggagttgatactgtaactagatataatggatcgggggaaggggactcaggctggactgacttttggcttgagtatccagataaacaatgttggcatctgttgagatgggtatgactgagttacaaacagcttagcaggtgtaagaagacaaaaacaagaattctgtttgggacacattaacgtagagatgtttgttagccttccgaatcaagagagtaacagtacatcggagtccataaacgtgcctactgagatcaacagtgcttttaatttgcggttcttcagctgcagtgagacggggcatgcttcttaggagtcctggtcattgtgatgtataacactgtgactatctgttcatcatgtttgctcatttgcctattgggcattttgttccttattatttgtaagtgctgttagcatattcaagaaaattggcccttttatcacttacattaaatggttttcttcagttcatcaattttacttttacattgtttatatcattttccctagaggaactctaaatttttatgtggtcatatttactagtttttctatggcctgtggcatatattcttttcataatcaggaaaaacaaagacaaatctcatcagtaattattaatgtgaatgtaaattctataacataaaaaatacattttatataatttcagaagttttgtagtacttacacaagtgttgagggcattcattcgtcacttttgtagttaacccactggaatatctttaataaagtaataggatttttctttattccttagaaaaattggatatttagggatattcttcaattcaaagctcatgatcaactaaggattctttagaggaatggtacgtattattttttacttacagcattaaaactcagctagagataacaattgtgtttgcatagcttatttttaaaacatgtgggcacagtgactttgtgcaattattttagaaaacaccaaagtagtatgagagacactgctattttttaaatgctactcagcacaactaatgacttataaaataggtaattatttcctttgaggtcagaagtagacttaaatgttacagcagaaagccaaaataaatgtgattggtttttctcaaaatagtaaattagcacttgactcccacctgcacactggtatttatcttcctctccacaactagtaactcaatttgatgcagtagcagggtactgggatgccacacgtggtttaactcaccaaggagacagctgctttgtactgacacccactacacttgtctttaccccaacaactgttcacattaatctgagttaactaccctttggagcaacctgttcaatctcagttagtcgcctactggagtgcacagacacaggtgattgagatttgagggaaccacagtcacactgacagaaatggaatctcacccactgcatcttcagtctggctggagaacctgaaggagctaaaggcttgttagaaaatcctaaagaaccataatcttctatcgcatatgcaaagcctgttttacgtcaaatgattgtcagtggctattaagttgcattcacacaaatcgctaacaaattaatatctgacattaagaggggtttatttcagtcttttgtttttcttaaattataaaatgaattgctcttttatttttgaaacgtgcatacactttaaaaatgaaagtgactcccctctccacccaaccccctcctaattccactctccaggggaaagtgctgttaatattttggtgtacaactttgcaggctcttaaagctgcattactactcatacatatgtatatgtacgtatgtatgaatatgtatgattgatatatatgatgcacatatcaatctagcctgctgtttaagcaaaaatggtatcatacaaaaagttctacaattccatttgtactcaataatgcacaaaactccttccgttaaaggaactacagttctaccacatttttttcttttggtgtcatggtgtaccacaccacgtgcatatcagaatttatgtaaacattctcccttggggggccattccagttgtctctgtttttcataattaacaataatgcatctgtgaatatgtaccaccatacacttgctcatctatttgtgagagaccgaatatgagaagtgaagtttctgggtcagagaacatgtccacttgcatttctgataggtattatcaaatgccttttcaaatggtggttgttttacttgacattctaccaacaagaaagactattttataaggctgcatattcaaaagttattttaaaagcctcattacatgtaagacaccatatggagcatgtcacaagataaacacatcagtactctcatataaaagtagattttggccaggcgtggtggctcatgcctgtaataccagcatattgggaggccgaggtgggtggatcacctgaggtcaggagttcaagaccagcctgaccaacatggtgaaatcccatctctactaaaaacacaaaaattagccgggcgtggtagtgcatacctgtaatcacagctactcgggaggctgaggcaggagaatcatttgaacctaggaggcagaggttgcagtgagccaagatcgcaccattgcactccagcctgggcaatagagtgagactctagtctcaaaaaaaaagaaaagaaaagtagattttaaggaaaaaaacgcataatcacctactaagaaggtctagaaagtgtgattaactctttaaaatctaataagatatgaactctacctccttgaccacccagtgtctaaagggttattcctggggtcagctttgcagaaagtgcttccttatggagtggttgttagttgactttgccagacagcctctgcgttttcattctctaacggaggctggcaagactttgtatagagatagaaacaccaattctagtttgttccttgagaaggaaggccaagtgactggttttctgaggctgtgtgtatctcccaggcacaagcctctgtccccaggagagcctgcacgcgtggcaggacacatttgtggtggggctttttacgctccctgtcatcactttttatgattttctcagtaattccttttctttactgaggaaatgaacacacataaaactggaaaaacgagcaaagaattacataaaatctacacaaggacttcctggcaaaaagcttcactaacataatagatttaagttcttacaatcagtggttcccaggcctttgaatttcatggaccagaattttttttttaagtgaagaattcaacatagaaacaactattatttgttctttaaaaacatttttgaaaacctcactcaaacaaataacctagcaaaactgttttataaaataacgcctggctgggtatgaggactcatgcctctaatcccaacactttgggaggccaaggtgggaggatcacttgaggccaagagttccagaccagcctgtgcaacaaagtgcgacccccatctctactttcaaaaaataataaaattaaattaaaataatgggtattttaacaccaaaaagaagagttttgcctagacagcctcccagacataagaacagacactacatccaccatttccctttttttttttttttttttttttttggcggagggttaaacactcactaatatttaggaattagtcctctgcaatttttcacttgtcctgataaaatccagattttacaaagtttaaacaccacaaaaatcacagggctgtctatagaaggaagaattcctgttactcttagctgaatattcccaataattctttgactttctttctttgtcttatcaaaccaatgagaatctccaggcatgcatgttttaggtcaaattaaggaaacgcccctatgcctgatcctatttggaatttccatttttactcatgtatgtcccacgacaataaaattattgaaaagcaagtgccaccagtgtggatgcatggtctccacaaatccactcttcactgaggagatttccccacatccactaaggtgtgggtcgcctccagctgcagcgccatacctcatgagatcagcagagctcaggctgaatagcattcctcctttcctcctctctactcacacttcctcagaggctatccagcatgataatgaagaacacaggtggtggggtcagacagccactgactacctctgtcactctggatgggtgaccgtcctctctgagtatcacttcctcctctgtaaatgagaacaatactgctcactgcatagggctgcttgtgtgagaacagcacgagcaggcccacatggtgttggaaaaggccccgacgcatagcaagggacaaatagtgctggtgattgacactagcccctgccaggctcttgggcattaggaatccatagtcaagcaatgaaagggtcctgccctcatggagtttacactctagcaggaaagacaaatatttaataatcatgcaaactgaaattagaactctgataggtgatactaagaagggggtaaaggtgttcctgaagcctggggtctgggtctgtctgtggagatccaggataagccaccactcctgaaactttaaagatgagtaggagttaacaatttggcacagggagaaaggagcaggggtccagggagaaggagctcacccttccttccttccttccttcctcttcctttttcctaaattgtaaatgtcacctactctaaataaggcagtgtcttaaagaacaacctaataatctatgtactggtataaaccttaaacaaagttcaaatttactccaatgcacaaaaattcagttaatctctatgaaacaatcaaggatggcattatattctagaattcttctgctggccctcctccaaagcgacatatgaaaagctgaagcagcatacatttagcttgtttcacagaagaatacttatcttctaagtgcacaaagtaaaacattagaaagggattcagtacagaatattaaaactctgtatttttcaactgcctgcactgaggaaagatagaaaatctatcccacaaaaaagtatgagtttggaccagtttgtttaaatttaacaaaacaaagttcatcatggctgatgaatcaatctttgttttgagtccctatttttacgcaaaaccgcactttgcccgacagcatgagctacttgtgaaataaacacttcaagcctcaaatttcaaaggagttataagtatgttgggggcagcaatgcaggaataactttcccaccccctggtcactatcaacttggagaaaaattatttccaatttgccttctactttgtacccttgtggtgtctcagatttcacagtccctgaaggatgtgctgtccgtgcactcacaaacaccccactctggccatctccactttgctacagatcacagtctctttgcttccagtaacttttctctatgttccagggtcacaacccctcctcattatccccaatttccttggggtaaatttctaagaagtgtctttataccttaaatccttgtttctttttaaagcaagaaaatgctggcatgaggtcagatgcaaatcactttgcatcctcaaagcaactaaatattgtcccattgtagagatgggatgtccttaccatagtgacagtgacagcatactctctcatggctccctgcagagtccttggaagcgatgtgacaggttttcataaagagggaagagaaaaggacttaaaacactgcctgcaggagcctctacacccttattactttctgggttattgcctcatgaggaaaaagaaattcaatcatttgtcggggggaaaaagtgtgctttttcttttcaaagtctacccttttatgaaatatttaagcaaacatttatttacttctaaaccaccaggaaaagaaagaaaagcaaccaacatttaacttcacagaagaaataaacatttcactaactgttatacctttaaatttgttttgatatacagaagatcatgaatacagtcatctatattttcctagtcagtgcaacaaaaaataacactcactaatagatcagaaaatggagatgacaacacttaattccagaatccaggaattttttcccatagtttcctgtaatccctttaagactctaaacaaagtattctaccttttttctttaagaaaacaaaacgaatttcatgcttatttgatatttctaataaatgattttaataatagactaagccaaaaaggaagctggtctatattcattaagaaaaatgcaaccataatcacatttcgtgaatggacaactttcacatatccacactctcaatgcctacaaagtttaaatggaaagatggatcgttcaggaaaagcgttgagagcagcatccagacctcagcactgccctcacactgagcccttcaaaaggacggcacgaggggccaggtgcagtggctcatgcctgtaatcccagcactttgggaagccaaggagggtggatcacttgaggccagaagctcgaggccaccctggccaacatggcaaaacctggtgtctactaaaaatacaaaaattagctgggcgtggaggctgaagcaggagaatcgcttgaacccaggaggcgggggttgtggtgatctcagatcgcagcactgcactccagcctgggtgacaagagtgaaactctgtctcagaaaaaaaaaaaaaaattagccaggtctggtgacacatgcctgtagtcccagctgctagggaggctgaggcacacgattcatttgaacccaggagatggaggctgcagtgagctgagattgcaccactgcactccagcctgggcaacagaatgagactctggctcaaaaaaaaaaaaaaaaaccaaccaaccaaggatggcaccagggaccactttgtagggtgtaaacaacaaattgctcagcataagaaccattttgaaaacacaatgaaggaaaacctgagatcaccatgcttcactgggtctccagggcccagacagaggtgacgcaccaggtgtgcgtgacgacgtcaccctacaacctttagtccaccttcatgctccagccactgcctgcagctgcgcccagacagcacctgactgcagttgccgtgcctcactcactttccgccttcatatgcctcatacactgccagctcgtgggacgcccatggagactgacttagccatccggctcatacacaagcctgggggagcaaggcagctggctcagggggtcaggcttgactagggagaaccagtcttttgggcagatgcctttgaggcccattcgtcacagctccttggaaggtctgcagcagggtccacaccgggtagcttgttgaggtgaccagccgcacaatcagggacttccgggcatggctccatgtcttgataacatgccagtggctagaacactcctgagcaaaagtatcctgtcagcagatcacgtgttccctgagaaataaactgctgctgagaagctactattaataacagatggcggacagtttgctgtgatacctggactgagtacctcggtgcctctgctgtctctgggccatctggatttctaggtgtgactgtggcagacgtgtctcgggtgcagaggaaatggaaacaagatggtcctgcttctgaactcggcctcatgccctcatgccccaagtctgaagttcttttggtctcctcttctgtacttctggaagcttccactagtctcttaccatgctcacatgaactaaaagccagatgcctaaatgactaacatgataaaagattggcctgtaaggccacagtgacaaatgtcacctgaaagacgaaggggaaataatttgcattgaagggtgcgcttgcttatcctcaccccttggctcatccaagtagcagaagagtttgggttgcatgaagcttccaaccattcaatgcaggctgagctccacagcagtgcctaggggagcacagctcagattgtgctgagagccacctctcttgtctcacaggtcccatccctgggctgaggctctttatcgaggaaagaaagaaatgtcctgtctggcctcacacacctgaaagtcgagaagcagaagaatggccgggtgcagtggctcacacttgtaattccagcactttgggaggccgaggcaggtggattgcctgaggtcaggaggtccagaccagcctggcatggccaacatggtgaaaccccctctctactaaaaaatacaaaaattagccaggtgtggggccgggcgcggtggctcacgcctgtaatcccagcactttgggaggccaaggtgggtggatcaggaggtcaggagatccagaccatactgactaacacagtgaaactctgtctctactaaaaaatacaaaaaaattagccaggtgtggtgacacatgcctgtagtcccagctacccaggaggctaaggcaggagaattgcttgaacccgggaggcggaggttgtagtgagctgagatcccgccactgcactccagcctgggcaacagagcgagactttgtctcaaacaaaaaaaaaaaaaaaaaaaaagaagcagaagaacatgtctcatgcacacttgtgcttcctgccccctcccacacccaagggaggaggatggtgctcatgcagaagacatgtaatctcttcttccagagttttttgttttataccagcctatctcttacttcccttgttcggccagcaggataaaaatcaatggacatttctatcgccaacctgctgcagctgcttctcagaaccaccatccctttatgtagaggaagagagaggcaatttaaaatggaaaagggagaactgcgaagaggaaggaccaaaggtgacttctccctttatccttcctgaaggccaaaggttggagacagtaaaaggaaactttgctgggtttgtagaggcaaagagggatattatggacttgaaagaacttttcagatgcggttggttacaagaatgaaaatcaggcagcaatgagccaaggacactcagcaatgccatcagcagtacttaattccacaaatagagttatcaggtgactataaggtactcagagaaaaggttcatattttagatataaaaagatttatctcttgggtctaagaaactacatatttcaaagagaagaataatcagcttataactaagaagacagactcaagaaatatgagcagtgaagaagataaatggggaatactgaaagttttttgaatttgcatatttaagctggtgataagaaaataagaattgtgttatttcatcctttgacgaaagcgtccatgcatgaccactccttccataaggaagccctggtacacacagagcctagattatccactgataaccccacaccatctcaacgaagctaaataaagatggagaagaaggggctttccacctctcaccagctggcctcatccagtgtcttcaggaaaaccagcctcctaggctttgactggacttccccatttgtgagatgagggagaaaactcaatgacctctatatcctcttcccactctgcaatgtggtgactgaatcgcatgatggatgattacatggcctttacccaatcccctccttactgttactgtccatctatttcgtctttcctgcctcattgtggagatgctgcaatgtgccactgtggctgtctggactacatttcccagaatcccattctctccatgtctcccattgtggtgcactataaataagagaggttcttaggtgggatctggaagatgggctgaagcagccacccttcattctgcagcttacacaggctgttgtcatctacagcctgggcgttggcatcaggcaacagctgggcctgcagctgtgctgtgtcccctggcctttcctcaacatctctgacccagggccaggtgtgcttgtttagcaccctggtggggaaccctggcttctgcaagaccccagtaagcccagaggcaacaacagtgacacaagttccagcatcagggttgagattttcttgctctcccccacttcatatcaaccttctcttctccagagcctgccatgtggacttcaagctccagcatccaatgtgagacaacagccttataaacactgcttgatcagccctcacaattgcagaaggtcaaatccctataacaaagctgcttgtatatatgatcagacatatgtgggttggaaccttgaataaacctcttaaatggggattgtaattgtgaagatctcataggatcactgggtggtttaagggagatagtgaatgtaaagttggcatggaatgcacagtaaatactgtgttattattaactaaaaatcccagttaccctgctgagaaaatctctctcattttttcatagctgtagaatcaagcgaagtaggcattttgcctatgtcgtaccagggactaagctaacagaaccctggctccactctaaacctaagagaatctaatcctatttttattagagaccagaacatagtagctaacaagtacttaacctctccctccaaggaaatgatggcgaagccaaaaagaacgataccaaactggaaaccattgatttcagtaagatatttcactgtcactgaaggaaaacatcattttaatggtggagtttgatatccacattaaaagacagttaatcgagagacatcatacaatagagctatttgggtagagtacttggtgaactgaaagcctaatacataaattttcctctttcagctcttactaatgaaaaaagttattcaaagaagtatttgagatggacttaaatatcaaaaccatacttcttacttttttaaactacttaatacatatcgtgttccaaaaagatctaagtatacaaaattagagtttttctcatcagagaattaaatttaagtccatcaagaaacctcaggctttctgatctgtacagcactttttggtctttttatttcagtctcaaatattttgaaatggtattaagttgtgtccaaatgacacagtgggccagtggctgggggagggaggtgagacctgaatgccaagagcttggggaaccattgtttcccactctattctgatgtccaagctgacacccacagcccactgactgtctcacctccagtgtgccgtgtgagccacctggcacacacacacttcaaagccagatctcagtgtgatacctaaagagcaaacgtcatcttggtcctcagagccatgagcccttgcagattctctgccagtgtcatctttctttctcactgtcactcaattttaaaacactgccgccaagtgttgttcatctttccctgatggcactcagcaccatcaccgacgtccacaggtgcttccagacacatctccactgtgcctccagcctcctcaccaggttctcaccatcccacacctggacagcctgtgacacagccggtccggggtcaccaactcctgccccctttccatacattcattcacatatgatctagtcccctcccacatacacttcactatactatctttcactatataaacctttaatgtggccaggtgcggtggctcacagcactttggaaggccaaggtgggtggatcacttgaggtcaggagtttgagaccagcctggccaacatggtgaaaccctgtctctattaaaaatacaaaaatagtcaggcatggtggcgagcacctgtaatcccagctactcaggaggctgaggcaggaaaacagcttgaaccccaaaggtggatgttgcagtgagccaagatcacataattgcattccaacctgggcaatagagcgagactcagtctcgggggaaaaaaaagaaagaaaaaaacagtatagattaaaatgattgattgtagagaattctgctggtagaaaagtaaatttatacttgcatgagtaacttctacattctttgtaatggattttacataataggagcaggtattttgtgacagtaataggcccactcaagcagctggatatacagctaactctttatcactgttagggctgaaatgaaacttggtttacttcttacatggaaaaaaagtccttttcccaaatatcaaatatataaacttagattcatttagaaaagttgactcctcagtagataataaatgtctcagatgaaacaaatctctctctctctccttaaacacatacagaataggaaaggcttatacacatgcgtgcaaattctggctcctcgcaatgatcctgagtgtgttattttccatttaagccttggtttttctccttctaaaaatggaagcaatgatatctatgtgacaaagctgtagagaagattaaattagacataataagtgcctagcagaaaagagacactttagacgcaattgataaattgtagccataattatgtatatgaaatacttgtaactataagcccattttccatgttgtttattccttcaaggctacacttgtatttgaatgtctatctgccactgtcctggtttacagcaaaatcaccttataatgaagaaagaggctgccatgtttcgaaacctcctttaggtggaatccaatgggaaataacttataaatacatatttttattgtatatgtaacagtatatttttagatttatcttagtgatgttgtaatggctaattgtataaattctgaatcagcctcacttttccttttaactcagttcatatatcaactcttcagccaatggaaatctcctttatagggtgtggcataaccattaacctccctttgtgccccatgtaatttgactataataaatttcactatactgtcactgctttgtgcatagtagatgctcagtgaatattcagtgaatttaaacttggcaagtagtcaaagagaaagaaattattttaagtaactaaacttaacaaaacacctaactacgcttccggaaataggtaaaagaactaaagattacataaagtatcaggtgttagaagtctagaaaaacataattctccaaattgtgattgtcaaaatgtgagcccagagataaattcccatgcctttgcatatgagcaaattggctctacaatttttacaaaagaactatggctctgcactgttggactcaaacgccctttgtgctgcattttcattaattcaaaacacttagaatcattttgcagagcagctcattttgtgcagcagagggaggccatgaattatctgttgtgcctgaataaagctctgcaatgttgagccgtgtctttgctgagtctaggcgcctccacttcttacatgccatgcgaatgacacagtttgaaaaacacaaccaaatgtacacagtattccatcttctacgaaaagcataaggggggaggaggaaaagaggttggttaatggaagtgagtatagatagaaggaatatgttctagttttcaatagcacagcagaattcctatagttaacaatcatttattgtatatttcaaaatagctagaagatttgaaatgttcccaacacaaagaaattataaatgtttgaagtggtggatattctaaatgccctgatttggtcattacatgttgtatgcatgtaacaaaatatcacatgtacccataaataagtacaattgttatatgtctatttaaaaaaggaaaaaaacaccatttaaatagaaaacaacataaaaagaatgtatacatcctttacattgatgagatctctaaaccagttgtgttcagttccacctttgaaccctcagaacaagggatttgtgcttattgctacttacttgactctacctggtgttcagtctattgtgtacaagtctcctgtacatcttatccttatacccaactctataaattgtaagctccctgaagaacggagctttgtcctgtccttcctgacacaggcaacactcaacatttgatgtctatctagtctacgtaactatctcttccagcagaatcattttttttctttctttccttttttttttttttttttttttgagatggagtttctttcctttttctttttttttttttttttttttttgagatggagtttcgctcttgttgcccaggctggagtgcaatggtgcgatctcggttgactgcaacctctgcctcctgggttcaagcgattgtcctgcctcagcctcctgagtagctgggattacaggtgtgcaccaccacgcctggctaattttgtatttttagtagagatggggtttctccatgttggtcaggcttctttttagaacagtccataaactgccgcctttaagtgactgaatcctggaaataagtgtcaaaaaacctaatgtgtatccatgaaagtattacagtaaataacatgtaataatgtgtatatgagaaagaaattgtattattctgtaaggtaaaatgaggtttatgagaattggacagtagccgttaactgctgttttattatttatccttcatgtataggcaagatgctactgaaaatgatcattgtctaggtatgactgaaaaaacaagcatgttcattcattcgtttgctcatccatttattaaacaaatattttaatcatttcagcaacatgtttgtgttgctgccaaagagaaattagattctaacatgttcaacttaaaaagacttcagtggctccctgttgtctctgggagtaagtccaggtcttctgcgggatacgtaagttctttcctgatctggcctctccctgtttccctgtcttatctctcatcacgcccctacttccaccctttattgttactgtcttgtttcacaccctccatgcctctgtaaatcttgtctctgcaaggaatagttttcttctctctcctaactcctatatgaccttaaagacttacctgaggcaactctgtgccctggtaaatctttcatattattcaaatctagagcagctgttcctcctctaggtacccacagcatcctgggctttcctttgtcatagcatttgtcacacctcttcaaatctgtttctttatctctcttgtccactagactcttgcaggccgtatgatactcttatctgcatgcccagtgcctagcatggtacccagcaaattgtaggcaaccaatacatatttactgacgactgaataaatgtggagactggggcaactatgacaaagagaacagacaattaactggaattcaggagacccggacactgtcttcaaaggttgaaagacttttggaaaattaatctttttgtgcaactcctggcattagctaaggtggttgtccaaagcattccttagctctgtggctacctgacattttctaaaagtgacaaagttctaatgtgtctctagccgagaggaacagttacagttggcacttaaaaacattatttgtttgcttagggagacattctgtatcttaatttcagactacttatgacaggtctctgatacaatgtatggagtgtcaaatatatcatcttttctaggttttaataaaaagaaaaccttaccaaaaaaaaggttgccttgacaatatatctatagacaatatctgaattaataaactgaccatttattttcttttctagttaaggatgccatctagaacaaggacttggtcatgacaattggaaagccatccaatggttcatggctcatggcactcatattagcaaaggtgggttcctgtcatccctaccctgcccttctcagctcaggtgcacatctcctcccatcacaccaaacagccacaaacagcctttctcttttcttctttttttttttttttttggtgacagagtttcactctgttacccaggctggagtgcagtgcatgatatcggctcactgcaacctccacctcctgggttcaagcgattcttgtgcctcagcctcctgagtagctgggatcacaggcgcccgccaccacgcccagctaattttttgtatttttagtagagacggtgttttacatgttggccaggctggtcttgaactcccgacctcaggtgatccacccgcctcagactcctaaagtgctgggattacaggcgtgagccactgcgcccggcccaaacagccattcttactgcacgtctatatggtggagttaactccatttctcaggaagacggacggaatgagtattctcaacagataacagattttcataggctgtgaaaccttagtaatttgaacaatagaagaatgacctaagtcagtagagtctcttttcttacaatggcttaagtgctttcagacacaaagaactaaataaggcatgctaacaaatagattggctggtgaatccttatctttttcttaatgaatacacaatatgtaattgatatgctatctgtatataacttgaatgtattgaaagaagggccttaaatgtacctcaaaaactatgtttctctaggtatatttaatattatttcttaaatactattaattttattacttacataataaagatgttttaggttgggtgcagtggttcatgcctgtaatcccaacactttgggaggctgaggcagaaggactgcttgaggccgggagtttgagaacagcttgggcaatatagccagaccccatccttacaaaaaatttgaaaaactagccaggcatggtgttgaatgcctgtagtaccaacaactcagggaggttgtggcgagacgattgcttgaatccaggagttcaaactatgatcacacctctgtagtccagcctgggcaacacggcaagactctatctctaataataatagtaataaaaggtgttttaatatccctcctcccccaagctccaaaagataaattctaaactagtggagtttggatcagtgagggttgatggggaaaaatgtaaatatagcagtcttttcacttcaggccaggcctcgtgaaatccatatctttaaacttcattatgtttctaaatcccttttttcctttttttttttttgagacacagtttaactctgtcacccaggctggagtgctgtggtgtaatctcggctcactgcagcctccacctccctggttcaagcaattctagtgcctcagcctcccgaatatctgggattacaggcatgtgccaccacgcctggttaattttttttttttttttttattagtagagacgaggtttcaccacattggccaggctggtttcaaactcctgacctcaagtgatccgccctccttggcctcccaaagtgctgggattacaggtgtgagccaccgcgcccggccatgctcctaaaactctaacctgtgactctggaatatgtttacaaggaagctcaagattgaggacactgcaggccatctcaaaatgatgtcagagggcagaaccaacgcttacattaatagaattgctggggcactagttgccttgccggagtggcacccttgaagataagaaacaaaatgacagctcgcaccaagtattcacccttaggccacacagataaatgtgcagcaaacctcttcaggctccacttgtctggagaaggagacacatgatatattgatgtaatgtgggaaaaagacgaattaagtaattttaaaaattattttaataggtcatctatctagaaagaatggcaaagaggaagaccagggtgggtgggcaaaatgcaccattttgtttgttaagcaacatcttaaaaggtgcagttaaaatatatgtacacttcctcaaattaagcaaacatcatcattaggatatttcagatactgaaactgatgagaggcatcccacgcccctcttttttgagacaaggtctcttctgttgcccaagctggagtccagtggtgcgatcatgtctcactgcaaccttgaccttttgggctcaagcgaccctcctgtctcaacctctgaagtagctgagaccagaggtgtgcaccaccacacacagctactttttacattttttgtaaagatgaggtctcactatcttgcccaggctggtctgaaactcctgggctcaggccatttccccaacgcctcccaaaatgctgggattacagctgtgagccaccttgcctggctgaacagtacctcctgagatgaagcaaggtgtgggcaggcttcactaaagggcagcattacaacagggaaatagtcatgcgatatgtctaaagcaaattatcatgcctaataatatttctttcagttgaataattacaattcattatggctcatttcttatcattaatattttcatttaaaattataaatgagatgatcacataaaatgaaaaactgactttaaagttaaaataacacacgcttttcctcaggaaaagcgtgatcccagcattttatagaattggaaaatatttgggtgatgatcaaatccaatatcctcatttcacaaatacataagatactcaagagtctaaatgatatttcaattttatccaactagtttggaataaatccagcagaaccagtgtctctggatccccaacccagtgtttccagaacaatattctgtgttacataattttatatttatttggcaaactacattttaaagttaaaggatctaaatatagaaatagtttcgtatattatctttcttaatattaaaataaaatagaatatcttgtattgtatttggtggactgtttttgaagcatcaaatttatgtattaataactatggatcatgtattattattcctcaatggcgaatttggcaccctacagaaaatagtcttcatttctttttttttttttttttttttttgttggccggggggtgtttttttagacagagtcttgctctgtcacccaggctggagtgcaatggcatgatctcggctcactgcaacctctgcctcccgggttcaagcaattctcccgcctcagcctcctgagtaggtgggattacaggcgcccaccactatgcctggctaatttttggtattttgagtagagacggggtttcgccatgttgggcaggctggtcatcaacccccgacctcaggagatcttcctgcctcagcctcccagagtgccgggattacaggcatgagccaccgtgcctggcctatgttccttcctttcaaagaaacattcatatttgaatgacttgactacatagaaaccttgaagaaaattccaaaatgtaggaaaattacaggccatgataacataatttaaaacataatctaataaaagtataaccaagcaataggaagatagtttagtatttaaaccatttgaatataaaagccttttaacctttggtcaacagagaaaatccaattatatttaccattatctaaacgtaaattaagtgggaaaatacctacaatgtgaatgttgatacagctgaactcggaggatccgaacagctttcagatattgaaaggagagaagacataacctaaacttacccaatgtgggtaaacaggagggtgatggggcaagtgaagaaggacaaggctggaacatcatgctaattctaagtcagattacaaagtgtttcaatgccgtgcaaaagaaatctgaattatttttagatgacaaaaagagcacatcagaattttttaagaagcagagaaggacttcttggcaacacagctgactgaattgagaagggctcttcttcctgctccaggcagaactactggaaagagagacagagaggacacagagagagagagagagatcacaaaggcagagaggaaggcaggctgacgggaaactccaggggttggaaaggcagagggaaggccaacccggagtggtgagaacaccagctgactccgcatcagcctagggtcctggtcccagaccctgctgtcaaggctgaaggatggagctgagcatacttgctaatacgagacacgtgttttagggcctgcaagaggcagaaagctagatctgagaatctgtgcataagccatgaccctggaagacacacttggaaaaggggtttacaaaacttcacccaaataagtggcaatgaagcccagggctctgggaggataaaaacacacaaaaaatgttataataaaagtagtaactaaaacagtgacatactggcatagggaacagataatagatcaatggactggaatagaagccctacatagatatgacatcttggtgtacgacagatacagcattctgtattagtagggaaggatagagtcctatataaatgagacctaaatgtgaaaagcaaagtgttaacatttaagagagaaatataggagaatgctttgtaacattagtataggaaggctttattttaaaagttcatgaaaaaaagaactgatacatttgtccccactctatttaaagcatctgcacgtttagacaaactataacccaagtgaagacaagccacaaactggaagaagacaccactgataaaagattagtatccaaaatgagtaagaaaactgtagaaatcaatatgaaaattcaaaaaaaggcccaagggaaaaattgaggaaagacagaactaggcagggcacagaggaggtaacctgaagaaccactggccgtaaggaagatgctccacctcagcatgaatcagggaacgctgaggaacatggcaaggctgccccatcttatagccattttattgtggaaaaatctaagattccgaagatactaagggagaggaaaatgcagagcaatgagcacttccataaactgccagtggccacgtaggagtttatttgtatgaccagatagagagaaatgtgtaaagagctactaaggtttagtattcacatttcactggacctagcaacttcgtacctatgttctaggggcactattttcatatgttcaagtaaacacgtacaaggatttttaatgcagccttatttgtaattgcaaaaaatttggcaacatacaaaatgtttatcaacaggacaatgattacatgcattgtggtagtgtcataaaaaggcatggcatgcccctattaaaataagcatactagagcaatttttctcaaaatgttgttcaggaatagcagaatcagcatcacctggaaacgtattaaaatgtaaattcgcagaccccactcaagagctactgaatccgaaatgctggcagtgggacgcagcaatccgtgttttaacaagctcccttcccccatgtcaggttgagagcagttatactggatttacctgtgtccacatggataagcttcaaaaccaaaatctgagccacaaaagcaactatacaatacaattaacataaatcttaagaccataagtaatatatggacagaaaggatatatgccaactttaggagggatgaaggggtaatagaaatagaagggagaggatttcaaatgtacccataatatgtgatttacttgacaaaatgatatgaagcagatctggaaaactgtgagtatttgtcacatcagcgtgataagtatagaggtgtctgctagattattctctgcatttttcagttagttttgaatatttcacaagcatactggcacagccaagtcagtgtttctgtaggataaccacattgtaagggaaggtgtaaggcaggagagatgggaggcaggggcaacaagttcctatattgcttcagttacccagcaaaggaagggagctttaactgaggtctcagttttctaggacttgatcctccatttggtgctgggagtgaagaaaaggggcagccaaagaagattccaaaatgtgcagctatatggaatgaaatctgaatctgagaagaaaatgtatgtcctcattcaatagttggtatttgataatagagacagcaaatggtggtaaggcaagatgaaaatatcactgacaacagaacccttgggaaaataaagaggaagcaaaaaaaaaaaaaaaaaaaaaaggaatgcctttagaggtaggaagaaaaaaggaagcaaaagaatttctactgaagtcaagagagttttacaatggaaaggatcatgtggtagagaaatgtctagcaagctaaagactgagaagagacatgtgatactaggaagagaatttgattattacagtcctccctccagccccctgaaatgcttattttataagagatcttggagaaagtctatttcattatttgaaagattaaatgtgcgatatggaattggcaacagcaaatatggacttaccttctaagatgttctgagacaaaacataaacacaggggcagtaactggtgattaaagtttaggaagaggtgggataaaaatggaatcatgatcccgggtgaaagggtcagctttgggaaagatgaggaattcttgcttcgggagaagaggtaaggaggagatatcaatacagtgggaagagatgacgagatgagtttaggaaagttcaaggagcaaatagctccatccagcaccagcttggaggcaagagcacatcacaggtgccttcatgcccttaagcgcatcacagtggacttaaggggccgaggagaagagacaaggttggcactggagaatggaaaatggggtttgctaagaaaaggtcaaagaatcaccatcccatattttgaggaaattagggacaaaaatattttatataatgagtgagcatagttatttcaagtagcctgatggcagaacaggagagggtaaaaaagacctgggttcttctgaaagtgaagaatgagaaggcaagcactccaatatttgcattatctcaacatacaatgatctggaagatatgctagagccacctccaaaatatactgaatttccatccattcctctttcccctctagttcttcatgctatgatttctcacccagaacaagacagtagcagtaactattctcatttccactatgctggctccctaagactcattctccctagaagccagagtaacttctttgaaacgcaaatcgtatgatttcactcctatgcttaaaaccatccaatggcttctcactgtcctagaatgaaatccaaagatggaccctgggaagcagaaaagatgacaatcaagagttcttcctgtctctcaaaaaaagaaaagaaaaaaaattatatatatatacgcatattccttaaggttaaaaatacccagttcgctccttttgccagcaccatattgacagcctcaaattctattcaatgattttgaagaataaatgtttttataaaacttaagtaacaaaaagatctactacacaaattaaatcactgttaagtgtgaactaggtaaattaactgataggaacacatttacaaggtatgtataggatttatgaaagcctatactctacttttcctctaaaagactgatttttaattatattatttgagtgatcatttgatctatgtctgtctcccctgttggagtgtgagcttcaacaagacgaagatcacctctatctactttattcacaggattatccttggcattctgcacagatccgacatgctgtaggggctcagtcaatactggatggattaccgaataaatgttagttaaattactgaatactcaacgaagtagaacagaaaaggcttgggcagagtcccaggcaggatgaaggactgcagtccaaactctatgattaagaaagtatgagacttgctatattagtcaattttcatgctgctgataaagatatacccaagactgggcaatttacaaaagaaagtggtttaattggacttaacagttccacatggctgggaaagcctcagaatcatggcaggaggcaaaaggcacttcttacatggcagcggcaagagaaaatgaggaagatgcaaaagcggaaatccctgataaacccattagacctcctgagacttactcactactgtgagaacagtatgggggaaactgcccccatgattcaaattatctcccaccaggtccctcccacaacacatgggaattacaggagtacaaatcaagatgagatttgggtgggcacacagagccaaacaatatcacttgcttatgtcacattatctttctaagccttatttatcttgtttagcaaatgacataacatgatctgcaaaagcaaatgaaaacgctgtagtgtcccattatcataagctgtgatgactaacaattacatggaacttagagtcaatttgttttctgacacactaaaagtcctcagggttgaagaaagcaacagcatctgccatttcattttctgagaggcatcccacataaagcaaacaatgtcagtcacctgccatctctctaaagacccagtgtttgtaagccatgaggccccagggttaggggctctctttaaggcctctcagactctttaaggactttcaagcctaagcatttttacccagcagcatctcagaagcctctatctaatactagaaataagacagaagctatataagcccgggaggttgaggctgcagtgagccgtgattgcaccacttcactccagcctgggtgacacagcaagaccctgtctcaaaaaacaaaaaacaaaaaacaaacaaaaaacaaacaaaataaaggaagataaagtttctttacaaaaagaggcagagaagacttcatagagatatttgctattcaagtgagaatgctcagatcttctcatgagcacaaatccattatcaaaataactaagaatctaagaatgaggaaacaccactgacctcagtgacaagtcattaaacttcaaataaatactcatgatgctttgcagatatcattgttgtggccaataacaaataaaatttaacccagcagctttaatgtcacagcccttctattttttaagtgggtatttctacaaacatatccattaaaccccgagtttgcctcaaaattttaaaacacaattttaaaacatttactaccatcactgagttgttcctttccaacctggtatccattagggacccttttgtttggtttggcacagacagcccattctatacatactgattaagattttactataagaacatttcttacaggcaatccagtatatatgaccaaatttgtatattttatgttgccatattccctgaatatttaaatgaaaagcctcaacaaaaagaggatttgaaaaaatgtcaatatgctaaatttagctgatcttaaaaacaagcctatcttagaacattctctcaggtaaatcatgcataattcatagatttttcccaaaacattatatacacatccatgcatctcaaatcattaaaaaataaattagtttgaaagtgacaatagtcaaataccatcctgggatagaaaagttacagagatagcaaatgtcttacattacaaaggatgtacctttgctatccccagagcagtattttacgcagacactgctgtataaaaaagtcattagttgttttattacatcgttctgtttatttatttttaataaaaatggtgtaaatcattaaattattctgaatttgaaaggcaattcccactcctgctggaagctagctgaggactggatggccctgctgttcctgcttgcgtgaactatccctcctggtgaattatacaactagttaatatacaaaagaaaataggcaactcccatttggcatgtcattcttttatgcccgagagctcacttcacatgcaacaaatctccacagcagtactgaaagggcctaatgaaggaacacagtgatttaggtcagcccagaaaggctttgctttcttcagtgaagagtgtcttgacagaaagcattttctccgatgtaacattacagcttggaatctgccaaaacaacagtcggcacccaacaccgacacctctacgttcactaaatagacgtttttatttacttaatccaaaaccagagtggtccaaagcagttagataaagttgagtattttcctcttttgcaattgtaattgaaattctgttggttgaataaaaactggaacttgcctttctgaggaatgaattcatgccacagaacttgttcagaatttggaatgcattttccatatgatgatggcaggtgctttctcacgtgtgagagggcgacactcctaggtaagtctggccacgatcaaatctctgtattttcttggcatgcagcccttgtttagtggcctccttggccagctgcaccgaggaagcagggactgctctctggggagcagggtgaagacatccagctctgagccctccagggcctatttataatagaaaaacagcctctgttcccttttcaatgcaaagtactttctcatatcaccttaaaacttatttatactgcaggtcatgcacaatggctcacacctgtaatcccagcactttgggaggccgggcgagcagatcacttgaggtcaagagttcaagaccagcctgtccaacgtagtgaaaccctgtatctactaaaaatgcaaaaaattagccaggtgtggtggtatgcgcctgtaattccagctactcgggaggctgaggcaggagaatcgcttgatcccagaaagcagaggttgcggtgagccgagattgtgccactgcactccaccctgggcaatagagcgagactcagtctcaaaaacaaacaaacaaataaaaaaacaaaacatatatacatatatatatatacccactgaacaataaaattttcctacatttgggaagaaaagtaggtttcataaaggaaattttaatgaaacaaccatttataaagaccaatagcatactgttttccactaatattttttcatgattgagatcttaaagtttttctatagaaaataacccagtaattttacattttaattatgtccccttttatatgttttctttgtgtctgcctaatttaatattacttttttttttcttatcaggcctggaagctaccactctttggtattacttactaattgtgtttgtagcacttactgagatacattagctcaaattgaaatggcaacatgaaatgcaattatgcctacttatagacattctagatgtacatgtaccatattgccttaaagtgcagtttgttttacctgctagaaaaactgtgaaacaggaacacagacatgtacacagaactgtacagaatacaaaaaaaaatgtctacagtgttttcctttctcacagttttcatgtgatttagacattaaatgtcttatatgtaaattctgcaactgtagaaaatgtagataattaaaagggaataggaaatcagaatctaagccatcatttaggttctctatattgttcatggactattaataatacatgtatacgactaaagagatcatactaataaagcccatggtctggggagagtaagggactagtactcaccccagaccactctaaagaccaccatctcattcttgtattaagactccaaattggcatccctgcacctgagtctaaccagccccccatgatacgtgatctacagctttgtatagaaaaaaggacacaattctagtgagcactgtttcttgaaaactgcacttcacataaagagattttaatttttaataatttaaaagtaatggagattacactgaaaatgatgatgtctcaatgaaaataagcctcagctaatacaactcacatggagttgtatacaatggagagttatttgaagcacaacaccttatatttatgctgtgttagtgaaatagcacagaaaggttgatgaaaagtgttcactgcatgccaataagccaaacatcacaggaagtgtgtaaatggattaggattcttagacgaatctatctagcacagcaatatgtaacaaattaaagtggaagaatgaaaatgttactatcatcactttccttacagcttctccttactaaaaatgggttgtgtcatttcttattacaacaaaagattttcttgatggggatctgctaatatggtcatgggaggggtggaaatcaagcattaactatggaatttagcacaaagtatacctttactcacaaaaggggggaaaacattttagcatgaagattgcttggtgcttatgttgcactgctaactgcatattctagaaataattaatgctagtctcaattaccagcatgcaactcacattttcagctaaatcaataactgaaataacaacaagggagaattccccttatattatgaataggttctcagccttatttaagcatcagaatacctgggagtcacaatgttctttgcagttattgttatacctagtgtccgtcataggtgttactaattttgtcatgcataagtggcaacaatgttattacaaaaatcaaaattatgagcatgcacatccacaaaagcagtaagcaactgatctaagtatgactggctgcctctatgctgtactgtgatattcgtgtgtgctatctgcttgcttgctaattcctagctacactttattaacaaaggtaggtttaaaaacaattataggataaaaactttaaatttggaatatattatccatttacttatttttcctgaaaaatgagaaaacattgcaattattcaattatagtgataaaagatcagtctagcatacggtgctatgcacaacagtactaactgttggtcagacgtaatctttgccttcgaggtatttccagtctgttagggctggcacaaatcctaaacttttaaatatgtttctcatatagagcacagtagcactgacatgggctacttggctcactaaccattgaagatgaagaatgcttctcagggaaaattatacctgaagcagttattaaaacgagagcctgaaaggaaaggtggaaattatatccttggcagaggaagcagcatgaccaaggcaaggagacaaaaaaaggcattccagctgggcgtggtagctcatgcctataagcccagcactttgggaggtcgaggcaggcagatcacttgaggtgaggagttctagaccagcctggccaacatggtaaaacttcacctctactaaaaatacaaaaactagccaggcatggtggtgggtgcatgtaatcccaggtactccggaggctgaggtgggagagtcacttgaacccaggagggagaggttgcagtgagctaacaccactgcactccagcctgggcaacagagtgagattctgaagaaaagaaaagaaaagaaaagagggaaagaaagagagaaagaaggaaagagagagagaaagagaaggaagagagagacagagaaagaaggaaggaaaaaggcataccatgggcgggaagccaagtgatagcttttcatgactggactgtcaaagttcaagacgagtgactggagaaggtaactggacataaaccagacttagaggatggaatagcaattatgaattgggagacaaggcaaatgttgacaattttaggcatcaggtagtaaaactgtcctcattcttttgaaaattaacctcgctgggcacagtggctcatgcctgtaatcccagcactttgggaggctgaggcaggtggaccacttgaagtcaggagctcgagaccagcctggctaacatggtgaaaccccatctctactaaaaatacaaaaaatatggtgatgcgtgcctgtagtcccagctacgtgggaggctgaggcaggagaatcccttgaacctgtgaggtggaggttgcagtaagccaagattgcaccactgcactctagcttgggcgacacagcgagactccatctcaaaaaaaaagaaaaagaaaaagaaaattaacctaaaaactaaaataccaggaagaacaattgtgtttataataattccccaaactaattataaattttgcagtagacaaaaaaatataaaatatgaaaatagtaagtaaaatagggaaacatttcttaagactaatttcttctctttcaaaccctcttggttggttagtttttaccttccatcttgttgaaattgactttttttttttctgaaaaagtaaactgaatcaaattcaggctaagcttaatgctaccaatttattttcaaagacagataataaggtcacgtagggcagttgtggggaaaggttagaaaaagtgagtcgccctgtatgataaatgacaggctcaatgcatccgttccttccagaaaccctcaacacaactggctagcttttaatgtaatcagaagatatccacatggtctttctctctgtcctcttctcctcacttggtgattttaagaagcaaaagtctggccgtgatggctcaagtttccttgaacacagcacaaaaagataaatgccagtattgcacaggaggagaatatacagaacaagagttctcagttctggccaggcatggtggttcatgcctataatcccagcactttgggaggccaagatgggaggatcacttaagcccaggagtatgagaccagcctgggcagcagagtgagacccatctctataaaagaaaaaacaaaaacttttcagtcctgatgactaaaaccatcaaaaatgagactatattttagactaaaattagactaaaactataatttttctttaattaaatctattcatgtagtataagtggttaatagaaagtatttctgatttgtaatattatattgcagacattagattgatgtttaaaattgcaaaattgcaagagtgatatacaaaaaaaaggaattattctagacaactagagactctcctatatttaaaatttaaaagcatggtattgaatatcctatttaggaggcctttgacaactatttttactttttttttttttttgagatggagtttcactcttgtcacccagactggagtgcaatggtgtaatctcggatcactgcaacctccacctcccaggttaaagtgattctcctgtctcagcctcctgagtacctgggattacaagcatgcactaccacgcccagctaatttttgtatttttagtagaaacgggatttcaccatgttggccaggctggtcttgaactcctgacctcaggtgatccgcctgcctcagccttccagagtggtgggattataggcatgagccaccgcacctggtgacaacttattgttacttctaatggtttgggagaattcaaattatattagtaagtattttagaaataaaaagccatatagtcatgttaatatgctcataaaatcagaagaaatataaagttgataatcaagaaagggtatataagtattggtagatgtaagtgttggtaatataagtattggcaaagtattggtaagtattggtaaaactaatttctaacttcaatgttaagaaaagcaacagtctttgaaatgagttggttatcgggtacattgtagattctggttttacttattcaaatttttttttttacttgaatcagctttctcttcctatcccccatctctaattatgtctaaatgttcttttctgttcatggagttattaaacaaataaacaaactctctgggagcccttgaccctaggggataaagaagactgagttcttctttcttcctgaaaagtactagaaagttcctaaaggagctatgtctgtactactaataggctagggccgcatgtgactgtcaaaaagggtctctataagaggagtcccaggaacgccctgaagtatcaattaaaatgcagctgtttggtaccacttgttcctgcggaaacttagcagtggagggtgtttcttaccccagtaagctgcttctttgcgctaatgcagcgattgctgtgcctgagggcagccctccctcccagtcgccagttccgtctttgcactgcatgttctctctgatccttctctgatccttccctccttcacagctgatgactgaattcatctttgacgtgtggtccctcaactcaatgtaatcttgcatgaaagttcaatatctgccatctggccaggtgtccacttatcccactacccttgaactcccagctccttctccctaactcctctgctgagtgccttgctgtggccccagatgttgcaccatacacatctgcacacctatccaatgaagcagattaagtcccacccacttccactggacagaacagtagtctcttacatcagacttagctagattcctgtatcactactcggttatattatattatttgaaaacatttctggccaggtgtggtggctcacgccagtaatcccagcactttgggaggccgaggtgggcggatcacttgaggtcaggagttcaagaccaggctggccaacatggtgaaacactgtctctactaaaaatacaaaaattagctgagcatggtggtgcagcctataatcccagctactcaggaggctactcaggaggttgtggcatgagaatcacttgagttcgggaggtggagcttgcagtgagccgagatggcgccactgcactccagccggggcaacagagcgagactctaccatgaaaaaaaaaaaaaagaaagaaaagaaaagaaaaaagaaacatttcttattgaaacattcctcacttgcattcagtgaatgacatttatttgatgcctactatatagctggaattctgctgagcatagtagttaaagaaattgctcagatatacacttgcccttgaggagtaagcaaggcagtgactatctaaaaagtgaggcagaagtgtaaataaatggataaaagagaatgtcctatggtggaaatgcagtgaaaacaggaggtaattcctccttaatggcaaggttaaggatggaggggatgccaaggaggctctcaagaatacagatatcttcctggcttacatcaacagtttatacaaattgctgcattttagactcttgtggggagctttaaaactcttgatgtccaagctgcatcccaaagcagttaaatcagaatctctcggggtggggtgggggagggctggggtagaacccaggcattttttttttttttttgagacggagtcccgctctgtcgcccaggctggagtgcagtgacacaatctcggctcactgcaaggtctgtctcccgggttcaagccattctcttgcctcagccgccggagtagctgggactacaggcacccgccaccaggcccgactaatttgtttttttttttgtatttttagtagagacggggtttcaccacgttagccaggatggtctcgatctcctgaccttgtgatctgcccacttcggcctcccaaagtgctgggattacaggcgtgagcgactgcgcccggccaatatatttttttaattccctaaattaaaaattattccatcgagcagcaaagcctgagaaccagtgaactagatcattgcgtccttgataaaataatcttacactaatcttagttcaagagcctggcaagcaccatgcctactacatgttcttatgtgattttggcattgaatttaaaaaactgaatgaaggaatcattctggtaaactaaaatggacaaaaaaactgggttttatgttatctcaaaaattgtctacatcatatattatattaaccaacaatcttttagactttaatagtagaagctgtagttatgaatagatttatgtataccatgaaaaaaatgtacggtagttattctttcctcaattgtcattttaaacagagccatttatttattaatacacttagctggatgctataagtgaatacaattagtaaaagtgataaaactaagtttatgcacaactgtgaaaaatgtgtggtagttgttttaaaaacttgttttcataggtcaagagcttacaatgcattctccatgaaacagactattcattagtttgagaagataaaacaacacatttatggaacactcacatggtgagctaatcagttaacagtcttactacataaaaattacaagaattttcattaacaaaataatagaaaattaaaatgtaacattaatataagcacttatcattacattaagtagttctatatacacacacagacatccacacttatgtacacacaaatgcatacatttacctcactgctatttataattatttaacagtaggttagcatatttattgatatattttttgagacagaatctcaactgctgcccaggttggagtgctgtggcgcaatctcggctcactgcaacctctgcctcccaggttcaagtgattctcgtgcctcagcctcctgagttagctggtattacgggcgggtgccaccacgtatggctaatttttgtttttgtagtagagacagggttttaccatgttggccaggctggtctcgaactcctgacctcaagtgatccgcccaccttgggataccaaactgctgagactgcaggagggagccacaatacccggccagcaaatttaaataatgagaagcaaatagtcctctaatagtaactattgcatttagcatgtttcattctaactctaaactcacaagacatagacatgtaagtttagtaccctagaaaacacagctacataatttgaattattcacaacacttcatcacaacaaagaaattactaaatttgccatgtatgtgtatactacacatggagtagtttcacaaagcaccattgttacttacgttatttcatgttttaaattctgccttcatagcatggactttcagctatgcctcatttaaaacttactggctcgggggctcatgcctttaatcctagcactttaggaaaatataaaaattaaccaggtgtggtgacgcatgcctgtagtcccagctacttgggaggctgaggcaggagaatcgcttgaacccgggaggcggaagttgcagtgaaccgagatcgcaccattgcactccagcctgggcaacaagagcgaaactccgtctcaaaaaacaaacaaacaaaaacctactggcaataagggagggtcagtatttacgaagtgactcatttaaaatacggaataacttaaactagtacaagagtaggcatgctgtcggagtacagatgccagcgaattaaggctctgtgctgccttccatgttccaaaggtagcttgagcgctagtgtgtcaaatcaattgagcattcagggctctgggccagttactagtattagcctatgagggctcttggatagctttattttgggctttgtgtggtcaggaggtgccccagccacaaacactttgagaaacaggccctattcttaggtgatgcttagatgaagtgataatgtattattaatagttttgatattaacatatgtgagattttgtatgtgtgtgtatgcataaacatagttcagactgatataatactgacttctttctgaggccatggaattataaataaagaggcccacatgaaacaaacccatctcatttattctatttcccactgaataaatggcacttagtccaaatgcatttatttttaatatatctgatgcttaacccatgaccaaatggactcaggaaataaactgtcttccttgggtaagaagaagagatcctatgttttaaaggattttacattgtttttgctgtaatttcatatatgaaggaaatctaaaaactattcatgatttagattcattcatgattcacaaattgcattctgtgaatcaataaaataattgaagatatcaaaatatattcactcatgttaaaaaatacggctgatggttgagcacagtggctcatgcctgtaatcccaatgctttggaaggccaaggcaggaggactgcttgagaccaggagtttgagaccagcctggacaacatagtgagaccctcatctctacaaaaatatatatatatttttaaatatggcttagtgtggaagaacacatttttggatttgcaaatcagttaatgaaagccactgatcatttaccttccaaagaagaatcagacatttctaagacatctacactatggtacacttcactggctactattttagtttaaaaaattaacataaatttcattttattagctgatgtttttagtataagaaccagttgcactaaaaatcagtagcacttataatgaactctaagcattgtaaatggtgacttgacataatttagcattgagatgaattcagggaaacatttttcttttgctgtttgtttgtagcatctcagatctcccctcccaactcctctctgtccaccagttccctcttgcccaagtgctgctattctcttggtcactcataatcatttagcctgtgaaatttattctctatttacaactggctgctacatcactacttctgaacctcttgccaaatattattacaaaccaatgaatttacaaaatctgttcaaacacaaagatgggcaagagagactgtattgtcttacaattgcctctgtgttccttaagatttagtgtattttcttccctgggcacaaatttggtatttacttcactatttcaagtaattacttacttggttttgtcattcaaatttttaaatggaaagaaaatgtctaaggcccttagtttaaaaaaaaaaagattaagagtgtcagaattattctgatccaatgactttcgctaagcaaatctttttaaaacagctcaaatagtatgagcattttacaaatgagctttaaacatccttaatctaaattgttcttaacttctgaatacctagaaaactactatttgcagcttaaatataaacattcatgccagactaatgcagaaaaatctagggcaaatccatgattaatatttttttccagtttgcaatatccagctctatttaagaaagggccttaatgaatgctgctgtaataatttaaatagaaaattgatttcatttttgcattctcactgtcatttcaatcagaattgtcactatcactcacatcttctattcatcattttgatttctatctacactcatttcacaaatgaaaaatacatcattaaactcatcacattttccaaaactataagcaagcacatgaaatcctctcttctttgtaaagaactgccaacatgagagggcagactctagctagtaaagcaaaggatggatggttcaaatttatccttgtaagttatggctgcatttaaatttaattgtctataaactaaagggtgcttttctccctctggataaccttaaatatttcaccatggcttattcaaactactgtgaaaacttaaacatatattcctcatgattacatccattttggtctttagaagaaaaactagcagagcttaaatgtattataaccccttcttggacacacgatgttaaaaaactcagtttgttggaaaaaacatattactattctatacacacacaaactccatatagtaattccatatatttacattataagcatattatatatgtgtgtatgtgtataacgtacatatatataatgtatgtattatatgtatttatagtgtatatttatagttttgtcaaccaaatacttactgtttaaggaatatggtttaagcacaaaatattatatggttcaaattgttaaaaaatcacagcttacttaataaaagattaagaaaacctaagcaaattgatcataaatattaggggcaagtaagcatgaatagaattttaatttaacatctttattttgactcagtattattgttttcaaatcataggaggtttgacgcaatggaatatcaaactaagaaacacttagtgagattacttataaagatgtaactcactttttattcgatgtccccagttaatgcttattatcctcaacctgatagttttctttgagtaagaattatttagtgctagaatattaatacttgtatgatcaattacaattttattttattttgtttttttgagacaagctctggctctatcacccaggctagagtgtagtggggcaatctctgctgactgcaacctctgcctcccaggctcaagccatcctccaaactcagcctcccaagtagctgggactacaggctcagacaaccatgcccggctaatttttgtattttttgtagagatggggttttgccatggtgcccaggctggtctcgaacttgtgagcttcagtgattcgcccgcctcggcctcccaaagtgctgggattagtggcgtgagccactgcacccagccttacaatttgattttgatgacactagtcaacagtaaacacaacaatggctattggtctataccatcatgataaagcagattaaagaatatttggcttttgtttgctttgttaaactgtttctaataaagtgagcaagttttgttttaagtcacccattccaatgaatttgctacgtaggctgctggtcagcacaaaccatgatggggcaggtgaacaccttactccaagagctattaggtgagacacacctaacaacatcactgggtttttctcccatgctctaaagtctttctaacactaaccagaagtactacatctgttacacaataaatagtcctctgtcctataacactgtgagtcagatgaactgatcagaaaaaaaaaaaaaatcaatgtttacagagttataacttcagactaaacaacaacaaaaagaaggcatttcagttggaccatagagccttgaaaaatgtaaatgatttaccttcaaccctgaccattccagcaaataaccccaatcaactcttgctcctcaaattttccttcctcttctattttctgttgattctattaccagcatcgaaaccttggagtcatggctcatgccttcctgatacagtcacatccaagaagctctaaagcccaatggctcaactgtgttccctcctctccatttctgctgttacctaagttgagtgcttataaagtgatcagaggagcaatttagaattcatcaaattaggaatgactcttgatgacgaaattacagatgaggcagtgggaattcacaggagagtgggaattcacaggacagtgggagtcaagggagaccaaggacaaggagatgagttcatggcttgttgtttagatattagatgtgacgagctgaaagtctcaatggaagcgatggaaagtagaaatagtataaaagaaaccaagaaagaaaaactccattgggctaggtacagtggctcatgcctataatcccagctctttgggaggccgaagtgggtggatcacctgaggtcaggagtttctgagaccagcctggccaacatggtgaaactccgtctctactaaaaatacaaaaattagctgggtgtggtggcgcacacctgtaatcccagctacttgggaggctgaggcatgagaatcacttaaacccagaggcagaggttgcagtgagctgagatcgcaccactgtattccagcctgggtgacagagtaagactgtctcaaaaagaaaaaagaaaaaatccattggttattacaacagatttgtttatggggtcaaaaaatctatgaagtttggctgggcatagtggctcatgcgtataatcccagcacttcgggaggctgaggtgggaggattgcttcaggctaggagttcaagaccagcctgggcaacatagcaccaccccatctctaaaaagaaattatgtttaaaaaacaaaaaattatgaggatcaaaactataaggataaagaaaaggaagagtaaggatagtgtgagtgtgaataagcacaacggctagatttcaaagcaaatccagaatacgggctttgctggtgaccttggagaagttacttaacctttctgtgcccccgttataactcagatgtttaaaaaaaaagaaatggggttaacaaccctatatcctatggttcttttgaggattaaatgaaaaacaaatatgcttatgaagtactaaaatcacattattagtgaatttaaaaatcttttagccctaaaatttgattttctgtgtaggagctattgtaaccctggatatttttaatcaacatattttatgctacaatatacctaaggcgtcctgcttcaggatgaccacatccaataaatattcaacaagcatctgggattgcacttttaataaacgtctctgtgttgaaagagaattcttatcatttggaggagtcattttatttatttattggccttggaattacttcagactgttgataattctgattttggtaatagtcttgggtgagaaaattgttcaaggactaagagtgacctgtcatggtaacaacagtctgtgaattctataaaatataatgcatggaccttggtttggagaagagcaatttactttagggtgtattcatccataattctcttctcttgagcaactttcatttttatgtgaattctttacaaagtcaaaaacaactgatgcattgtcttagctacatacaattcatttaccagcacctaaactatggaactgcagtgacttaaagggctagcttaggaagactaactagtttgaggtaagtttgcaaactaaaacaacccactttttgatactacatcaaaaactgctttccaaatttttagtagaacttctcttttaagcagacagtataatcattttatgaaggtttttgtgtcctctaaaaagaattcttgtgttccaaactctcccaaggttataagactgaagtcaaaactatgtgatgtatactggccccatgtacacttttccatgtgaaatatcactgattcttcaaaatggaggttaaaatgtaagtgactgatctttcctcagagaattccagaaacaaatatgctttcctactctccaaagacaggaagatgagcaaagtgagaaataaaatgtcaactacttcgatcaaggatgacacctgagtgggaggccccagcccacacctgggctccaagcgccagttagtcctgcttagtcctagctctgcccctttctagctctgtgaccctgaggaactccctccaccaagaccactctgaccctctgtgtgtgtgtatttgttctctctgtaaaagaggaacaataacctcttgccaggtgctctctgacttcatctccagctgctgtcccctgggttcagctcactccagactcacgggccttcctgctgcccggtcctcccacccaacctcccctgagcctgaagggcctctgtacttctttcctccccctgaaatgctgggcccaggctggccacatcgctcactccctcagagaggccaggcttgatccaaatcccacctgccccgtgaggcgtggcctcatctaaagtcagaaattggctccatctcctcgactccctcccacaattccaatttcccattctgccttacatttctccttagcacttatggccaatacactatttaacgactgtgtgttctcttccttccttaattaaatgcagccccacgagtcagagattttggccaattttgttcacttcatatttttaggatccagtatagtgtctggcatgtagtaatgcttaaaaaaatctgtggaataaataaatgaatgactcttctccacaaggttgtcaaatgaatgagatgtcatcggttaaatcgctaagctgtaaaacatatgattcactatttatttttaaattgttaatttattattattctttggagacagggtctcactccattgcccaggctggagtgcaatggtgcaatcacggcccactgcagccccgacctcccaggctcaggtgattctcccacctctcagcttcagactacaggtgcaaaaccacacccagctaatttttatatttcttgtaaagctggggtttcactatgttgcctaggttggtcaaaatttctgaggctcaagcgatccgcctgccttggcctcccaaagtgcagggattacaggcatgagccactgcacccagccttttaatttattttaacattctgttcatgaaataaaatgtagatgacaaactatcggagtcaaggtaaaaataattaaatagaaattagttataagaactataatgcagaacctccacaaggctaagggaaaaaaaaaaacaactactacaaaatacttggtatcattagaagtaaaaaaaaaaaaaaatcagaaaacagtcaaaagcttaaaaatgaaccaaaggtggccgggcacggtgggtcacgcctgtaatcccagcactttgggaggccgaggcgggcagatcatgaggtcagaagttcaactccagcctggccaacatagtaaaaacccatctctactaaaaatacaaaaactagccgggcctggtggcgcatgcctgcagtcccagctactcaggaggctgaggcaggagaatcatttgaacccgggaggcggaggttgcagtgagccgagatcgcgctttaaaaaaaaaaaaaagtactgaaggtttgtggattaaaccagagctgtgacctctggaccaaagtaataaaagtccagcccatagcctggtagaagatagctagatggaagaaaaagaaaagctgcataagagaataacaacaggcccagagaggcctggagacagaggaaaacacagaggattagattttcagaagctgtggacttaagcaataaaaagtctatcaaagtgtaccttgttgatgtatggcacgtggctaataattcctaggttagccctttaagacacattgaaagatgggtcactccctaagtatgacatgatgaaatgaaactgtgtagaccatcaagcaccaggggaaaataacctgtgtgaggcttgagcttttctaagagagaaaacaagataaaaaaataaaaacaaagcccacaacacaaataaacaggatttactctacaaaacaaagctcacatttgcatatactaaggcttgttctctgcttaatcgaaggtaggaggagccagggtgattggctctctccctgagaacttgaactttgcttcagagggcagtttctagcaaggatgagcactgtttctgatctgaaaccgggataaaacataactgagtatccacagctcagagcaagaccgacaagcaagacgcatagttacagtgagtgtatgatagagctaatctgcattttaaattcgcacataacagtcttcgaaggtatgcaaaaaccgttttcaccaacaggaaaatccaaaataagtacattcgaggatttttttttccacaaaataaaatagttacaaaggttgaataaaaaattatctaagtgaaaatcacttcatactgggaatataaatctctggttctttggtaaataaaattaacaagaattattcaactagaactatcagcatataggtttctaggtttctagatgaacagtttactaactgggtcacgtataaaggtcaaaccagtttcttcgttacgactggttaaaactgatcgaataaaaaacaaatctgctatcagctgataaatactaactttaacaaaggctcagtacatgtagacatggtccatgtgtgttttaatttttaaaaggagtgaggagggaataggagaaagcaatatagctctcatcagcactttcttcccatcaggcgctttacatacagtcgctccttttaatctcatatccaccctgggaaggagaattaggacattacagttaagccacctgcccaaggccacattaacaagtgacaatggctggttctgctggatccagcctgggcctccttccaccaccaatctcagaggcatggcccaaagagacagctcagtcttcaggaacaatcaactgaatttaatatttactcagggccaggtgtggtggctcatgattgtaatcccagcactttgggaggtcgggggagggcgggggggcgggaggggtgcggggcggcgggtcacctgaggtcaggacttcaagaccagcctggctaacacggtgaaaccctgtttctactaaaaatacaaaaaattagccaggcgtggtggtgggtgcctgtaatcccagctacttgggaggctgaggcaggagaatcgcttgaacccgggaggtggaggttgcagtgagccgagattgtacctctgcactccagcctgggtgaagtgaaactccgtctcaaaagaaaaaaaaaaaaatttactcagataaaccaaacaggaagtacaaggcaggactcaagacaagttataatagaagagcaaagatcagtaagaaataaatataaataatagttacataatttacagaaaatagtcattaaactgcattcaagccaagatataaattacttagaagattctattcacaaaatattttaacttctccttgaaggttagtattgtcttatttagtgtaaatttaaagtatcatgtacgcaacaccacagaaaagatactgtctggaagctaagacattactaattaaatgcaaagagttgatatgaaaaggaagtaaaataacctagaagatggggcacggtggcaaggctgaggcagtcagattgattctacgagtcctgaagtttgaggttacagtgaactatgatcccacagcgccactgaactccagcctggatgacagagtgagatcctgtctctaattaaaacaaaacaaaacaaaacaaaacaaaaacctagaagagagtaacagcaccatactcagctttctcagctttttacttatttattttttttggagacggagtcttgatgtgtcgcccaggctggagtgcagtggcgtgatctcggctcactgcaacctccacctcctgggttcaagcaattctagtgccttagcctcccaagaagctggactgtcatgcaccatcacaccgagctaatttttgtattttcagtagagatggggtttcaccatgttggcctggctggtctcgaattcctgtcctcaagcaatctgcccacctcggtctcctcaagtgttgggattactggcatgagccactgtgccggtccatacttagctttttttagtgatacatttatactgattagtttaattctaacttgatgggaaaaaaattagtagttgggaatgaatgtataaaaatacttcattcaatagttacaattattcattacatttaaaatatccttacacctgaagggaactagaaaagcatgcctatatattctaaatttctttttctcctccacactctccaaattcccctgccaaaacagaatattgatattacaatggaaaattataaagacgatatactatgaaagttcttaatattcattcattctgagtttcttaaaatgtatagaaagatggcccaaacacctctgtgttctgcagcaggcaggtctatgcaacccacccgccaagttcgaggaagctgagctgacccatccagtctctcgaaaagaaacatttaatagggacttacggacagaagccatgtctcaggcagcagtgaggccagatagtggattcctgtgctgctacccaccacacccagggcttatataccctaggaaaggaatgtgtaggacaactgaagtccatccctagggaaaggcaagaatgctacatcaacctatgtaagggcagggtttatggtcaaggttgttttgacctaaggccaggatttatagcaacagtagataaagtaaaaatcttaagctgggcgtggtggctcatgcctgtaatcccagcactttgggaggccgaggcaggcagatcacccgaggtcgggagttcaagaccatccttaccaacatggagaaacccccgtctctactacaaatacaaaattagccgggcgtgatggcacatgtctgtaatcccagctactcaggaggctgaggtgggagaattgcttgaacctgggaggtggaggttgcagtgagccaagatcacgccattgcactccagcctgggcaacaagagcgaaactaactcagtctcaataaaaaaaaaaaaaaaaagtaaaaaagtagaggcattcccaggagttaattattagttaacatgattagcatccaagatggatttgcctggaaatggaagtgggatggggcggagaattatcttcatttgtatcacttgaggaatagctgagtgaaaacttgctgtaggcagctgggtactcaggttagactttgaagactcacttaggggctagatttagagaactgccgcttaatggctcatagtcagaagtcaaagccacattgaaattaaacagactgccataaaacagtgtggcctagttgaaagacaaagaatctgaagtgagaagttccgggttaaagtccgagacccaccattaccagccatttccttgggtgaatatttaaatctccagtctcagtttcctcgtctgcagaatgaagaacacagtctgcctccctgggagcagaaatacatctaccacttagggttgctgtgagaatgcagtgagaaaagcactggaaagcgtcttatgaagtccaagtcatgcatgagggatcgctattagcagcatgtttaatggaatatatgttctcaattcaaatgacagagactcgcatcctaaaatttaaagaaaagtaagttaaaaagtataagcctggcgcagtggctcacgcccataatcctggtactttgggaagccgaggtgggtggaatgcctgagctcaggaatttgagaccagcctgtgcaacatggtgaaaccctgtctctactaaaatacaaataattagcagggcatggccgcgtgtgcctgtggtcccagttacttggtagcctgaggcaggagaattgcttgaacccgggaggcggagattgcagtaaaccaagatcacaccactgcactccggcctgggtaacagagcaagactccatctccaaaaaaaaaaaaaaaaaaaaatgtacaggccaggcgtggtggttcacgcctgtaatcccagcactttgggaaaccgaggtgggtggatcacctgaggtcagtagtttcagagcagcctggccaaaccccatctctactaaacatacaaaaattagctgggggtggtggtacatgcctgtaatcccagctactcgggaggctgaggcaggagaatctcttgtgtaaccgtcaaggggttcaccttgctcgctgcctagacagagccgattcatcacaacaggggaattgcggaattgcaatagagaaagagtaattcacgcagagccggctgtgcgggagacctgagttttataattactcaaatcagtctccccaagcattcagggagcagagtgtttaaggataacttggtgggtggggggaagccagtgagccaggagtgctgattggccagagatgaaatcataggacccggagctgtcttcctgcattcagtcagttcctaggtgggagcacaagatcagataagccagttaatccatctgggtggggccagctgatccatcaagtgcagggtctgcaaatatctcaagcactgatcttagaggcagtttagggagggtcagaatcttgtaggctccagctgcatgactcctaaaccgtaatttctaatcttgtcgctaatggtagtcctacaaaggcaatctagtccccaggcaagaaggaggtctgctttgggaaagggatgttacaatcttgataaactgtctaagtcataattttgcaaaggtggtttcacttgaacccaggaggcagaggctgcagtgagccgagattgtgccactgcactccagtctgggcaacacagccagactctgactccaaaaaaaaaaaaaaaaaatgtaacaaaacttactttatctacatttggccacagtgttgtaaaccttctaacattctttacaacagcacctaaggcaacgacaggttcttagcgtcaaccacatcttcactttggcctacagcaaaatatatttcccctatttacccaaatggaagaagtttcccctgaattgtgtttttaaggtatctccccccaactcctctctccagatagcacaaatccaagtatgtccctagactcccaagagctgcttttatggactataaaactagcaacctagctttccacaaacatctttactgctattagtgaaaatatgcacttatgatatatgcacgcacacaagcatattcctgtcaccttacagagctaagtctacatcacggagacgtgagcacacatctcatagtgcacatcgttacacatccccccaggggctgacaggcaggggcttggttttatctttgcttcatctcttgcactttaagagtcccttgggtagtatcttttttgtgctcaggtttgatatttcttactcagtctttatgatgtctgactgaaagctcaatggctcaagatgtcctcgagggtgctaatgtttttatctctgtgtcctagcaccctgcccactctgttccctacaaatgttgagtgaattaacttccgtctgaattaataagaaatgtaaaccacttgtgataaaaaataatctatctcttccacacaaaaggtcagtgtaaatctggattctgaacacagactagattgaacaaagatttcttatctgtatcggaagcaaaactgagtatggtgttttgtacaaggaacaaaggaaatagctacacctctcctactgtagacgtcactgaaaaagtctgtttctctccctggggggatactgtaaactcagtagccagcactcaatactgttgccagaagcaggaactggaagtcatcattctaagtcgcctttaataaagcagaaaagatgcaataatgtcttggcaatgtcagttcccaaacactgacaacctaaactacatcttctggccctaggtgcttatcggctgtactgacgtgcttcacattttataatgttggtaaaatgagggaaggcctgtggctctcaaattcttgtatctgcttagctaattccaacccattattgtaagcagcaacaacagaggaaggacagtctctcaagactgagcactcatgttttacccagttacaatgctattgttctctgggtgaatcagttttaaagtaaatacatttatggctgggcgcggtggctcacgcctataatcccagcactttgggaggccaaggtgggtgggtcagttgaggtcaggagttcgagaccagcatggctgacatagtgaaaccctgtctctactataaatacaaaaaaaagttagcagggcatggtggcaggggcctgtaatcccagctacttggggagctgagacaggagaattgtttgaacccaggaggtggaggttgcagtgagccaagatcgcaccactgcactcaagcctgggtgacacagtgagactccgtctcaaaaaaagacaaaaaatccatcttcaatagaggcaatgtggtgcattacaaaggggatgagtgaaaacaggctggcttcaaatgcgggttttacactttaccaactcagtgatcttgcccaaaatactttgtctgagcatgtattttctatcttataaaaagagatatatgccgagcacacacctgtaatcccaacactttgggaggccgaggcgggcggatcacctgaggtcaggagttcgagatcagcctggccaacatggtaaaaccccatctccactaaaaatacaaaaattagccaaacacagtggcacacatctgtaatcccagttacttgggaggctgaggctggagaatcacttgaacccaggaggcagaggttgcagtgagccgagattgcaccaatgcactctggactgggtgacagagccagactccatctcaaaaaaaaaaaaaaaaaagagatatgaaggaggattaataagacaaatgtacataaaatatttcacacaggcccacatcatgaaatcccagatgttagtcatacatcatctgcctaagtctttgaatatttggggcatgcaaaacaaaccaaaaaggagttgcctattgaagaaaaggcaaatgtcttgacatgatgttcagatcttatgtgattcttcgccatcttacgctagcaggttgatgtctttgtcttcccccacagctctactccagttgaaccggggtaggcgtactctctaagctacttcatgtctctccacttccagaagcttcttcctgctggtacctctgtccccatctctcaggactccatctgccatgaccctttcatgattccactgagaagttacttttctttttcccttctttgaacatcgaaagcatgctgtgcctctttacggtagttcttttacaacttggcacggtgctttgcaatgtaatcacttgattacaagtttcattttcttcattagaccgcacactccttgaagtttatatggctttattttttgcacagagtagttattcaatatacactgactgaatatattttaaaacttcagggagtaattaaatcagccaaagtaaatttagtctacacatacatttatagaatgtacaccatctccagcctcagacaactgcactcaagttgcccctttcccgagccactttctggctaattgctaaacatgtttccaccagatctgcccctccagctgcctgcagctccagtagaggctgtgtggagaagagccatgcagactgcatctgtaaggtcctgcctgtgcactttccgcttcccaaatgaggacagagagcactcctgccagctaccaggcagggcccaatttctaaactctgccttgaccccctgccttcccatcagaggagaagcatccttacctaagaacactacttcttcaatgaccagtcttccttccccagttctcttccttccccagtcctcttccatccccagtcctcttccatccccagtcctcttccatccccagtcctcttcctgggggtatgagaaaaaactcttaacaggtgctggctaaagggaagcccagggtctccaagatctatatctcaccagagtccttcacagcagtgccagtcggagttggctgtgttcatgttccccaagctatcacttgctcggtctttctgcagctcagaggggatggctggactaccaatcctaatgggttgggacctttctgcaaactccagtctccccatctgccctggtcctgccttgttagacagttctcagtttgagttcagataacttttagagtccctggttcctattataatacttaatattttgtccaatgtctttcttcatcatatatatgcatatatatgtacatatatacctgaaaatacacacatatataatgacctcatgcaagatcatctgtctctcagagtacccatttcctatatatgaatagatggtgtgtgtgtgtctatatatatataaatcaaatgactgttttgtatttatcccactcaatcatccatattcataaataataatatttctctagcattccagaatcaaagttaaaatatggcatgaggaccaggctcactgcctcatgcctgtaatcccagcactttgggaggccgaggtgggcagatctcttgagctcaggagtttgagaccagcctggcaacatggagaaactccctttttaccaaaaatagaaaaaattagccgggcacggtggtacatgcctataatcccagctactcaggagactgagtaggaggattgcttgagcctgggaggcagaggttgcaatgaaccaagatcgcaccactgcactccaacctgggtgacagaatgagaccctgtctcaaaaaaaaaaaaaaagaatttggtctgagcctggtcagcactggtctgatgtactgaaaaccatctcctaaacttctctctccaacaacaattaagtaccttatttacacatcaaactatagcaaaaacatcaatgacaagtacaacatctgactgttccatgaagatggtaggactgttcccaaagctttctgcttacaacttaaggccaaaccaaagagccgtggttctcctgcactaaaatggtttcagcctatttccagtcatgctgctttactaacaaactataatgaactactgtaaaacatgtgtgctatacttcactcagcaatgccttcactataagatgttgaaaatctgtgtttctggatgcataaaaatgacaagcagaaggtgttattttctattctaagggtccagaacaaaagaatgtgctttcattgtgactaaggaagtattctgcacagaccaatataatcttctactcacaatgtttccagttcctttgggtacctggtgtcattttagctctgagttatgtattaaggtcacctgctttaaaaaaaataaagacaacacatggaactcagtagagaaagtgaagtttcttgctgcatctccttcgagccatcttccctgcttgtctgtagggattccactgtgctatctcacctacctacctactcctctcattgccatcgatgctgtgataccggcaaacttctttatggctaggccttgctgtcagtgagtttccttaatgatgaaggtctctgctacctgagcagaaaagctcaagctcagcttggtccatgacattcatatgtggagtgtcatgagtttacttttaaagaactgcaagaaatatgaataaacacatttttttgaagcctatgttcaattacagcacttcaaagatgctgtaggaaaagctgaagtataacacagcatgcaaagatgcattgatttctttctccaaatcacatgtaacatatgtaagtctatacatatatgcatacatatatatgtacaccaaagtttaagaaatagatggttgttgaccaattgtatgtttttaaagagttttctaacaattatattagatattttataacttttaaaaatttacttcgaaaagattctcataaatctcccagagaaggcttagaaggctggcttcaaactccagttgcctgaactaggtacagagaaggctgagatgacagcagtttctagccctggctgcacatcacagtcacctggggagctttcaaaactattaaacagcaaaatatctgacacacagtagctaatcaatacacggaaatttctctgttttcccttccaccctatatccaatcccatatttcccaaaatgcctacagagcatactctgccatctcactagcacctcactccgtagcctaaagcttccaacaagtatcaccacatgttcccgcttctttgctcaggcccagtgagttgccaggggtttccgcatcacctatattttatgcctgtttcttcctcgtgttccctgtcacctggcataatggtcttgaactgtcttcccactttaggcccacagtttcctccctgcagcctgggggatctctccacagtgcacgtgtgatcgcatctttcccactgccacctcctccaaggcaatctgccggcagggatctccctgtctctgtacttctgtctccatgttcccctttctgggaccctatattgcaggcaaacagaatcagacagaatgtgtgaaatagatgactcctgcaatcttgtcctgtccctatttctacatcagcttcctgtagatgtttcctctttcccatctcctgttctctccaccagcagtgtccatctccatgtcaactgttcccttcccaaggcccttgtcacttatgtgtatgtgggatgctttaatatttataggaagacttgtgttggtgaaaacacaagtcatcaggttcattgtgggatttattcaagggcttgccttctctcttaagtctacatttgtggattctcttcttaaactacattaccccaaacacccagtggacagctacgacattattgttttgttttgatactggtataaatatagtcatcttctcaactgaatatatctcttccataaaaattcatgtaagagcaaaatataatttcaaaagtcaaagttggaaatacccaaatacctcggcgggtgcggtggctcacgcctgtaatcccagcactttgagaggccaaggcgggtggatcacttgaggtcaggagtttcagaccagcctggccaacatggtgaaaacctgctctaccaaaaatacaaaaattagctgacatgatggcacaggcctgtaatccaagctacaaaggagactgaggcaggagaatagcttgaacctgggatgaggaggttgcactgagctgagattgtgtcactgcactgcagcctgggtgacagagccaaactctgtctctaaataaataaataaaattaaaaaaaagaaaagaagtatctaaatacctaaaggcaacacaacttaaaaaaccatcattattcatcatactaaaattacatgtcttcatgaaaaacaagtggcagaaagtttggtgtgctatgtggtgcagaaattcatccagtagtcagtcctgcccagactgattccatgtttttgtattttctcatagctgaaaatattaaatccagacagaatctctgaggcaacgaccgcgtgtgggaagtcagcctatttaacttgagatcaaccgatctacagagtatgcacatggctctcttgtaaagaggtgagaaaagatttcaaaaagcactgtcgtcagcagaaaggacctttacagccagatgaagctctggttgttttcagccactttcctctgctggggaaaaggcacattaaaaagacacagctgtctatttcagtgtacacatgcttggtagcatgggtgttatttactgataaaaagcacatgacagcaattttaaaacagggcttgtcctgtcagtcaaattagagaggcaggatgtcctctccaagtgattaccgtgggggcccacaatgtggcggcctgccaggtcaattacagcagggctgtgaggacacatgaagaaggatcgccttaattctaaacaggagcatcagtaaaatagaaaccaggggacatattaacacaatgaacaataccttaagactgtggctttggctagagctgtaaaatgtatttatattgagtgtttctccatgtaaacattttttttttaattaacgagaatgaatgtataggaatacaattgcaaaataacatttgtatatttctggagaaaaacatttctcaaaggaaaattgggatgctataattttcatctcatcaagaaaattagacacatgggtaaattagcatttggaaacctgaccaatgatatttcataattgttcatgtccctgatatgtcaatttgccttccatttctcctatactaagattaatttcagtttcaaatgtccttgtcattttttctcctctctattgcacctacagcttctttgtctacaggaaaaaatattaagagatcagcagcatcagttggaggatttacatcatcgactatctgaataccagggacacattcctttgttttacactcatattccaggagtctcatggaaatgcattaaacatcagacaaaaaaatgtaggctgcttgaatcgcagcttaattgtttaggaactagatcctgatagtgccccaataacagaagaaaatccctattcacatctacgtagagaaaatactgggctgctgacactgaattttgcagctatgcgaaatttaatgctgattagtaaactctcaaattaaacagtgaaagattataaagacacatgcaaaagatgtaaattaaacccaaaatatcagaaataccacagtcataatttcccacctacctaaagagttatttctcaaaaaaaaattgttgcgaatttattttattttgttttgttttgagatggagtctccctctgtcgcccaggctagagtgcaatggcctgatctcagctcactgcaacctccaggttcaagtggttctcctacctcaacctcccgagtagctgggattataggcgcccaccaccatgcccagctaatttttgtatttttagtacagacggggtttcaccaggttggccaagctgctctcgaactcctgacctcaggtgatccacccgccttggcctcccaaagtgctgggattacaggcgtgagccactgcacccagctgaatttattttattttttattttttattttttgagatagagtcttgctctgtcacacaggctgaagtgcaatggtgtgatctcagctcgctgcaatctctgcctcacgggttcaagcaattctcctgcctcagcctcctaagccaccatgcccggccatgaatttaaataaattcaaagatcccattaatgtttattacaaccccaataatataggtaggcagaatacaatcctgaaaaaggtgccaaaagttgaaacaatgtaagtcaactcagtttccccaagttaaaattataagagtatattaactggctgggcgtggtggctcatgtccgtaagcccagcactcagggaggctgaggcaggtgatcacctgaggtcaggagttcgagaccagcctggccaacatggttaaaccccgcctctactaaaaatataaaaattagctgggcatggtggtgggtgcctgtaatcccagctactctggaggctgaggcacgagaatcacttgaacccaggaggcagaggttgcagtgagccgagattgcgccattgcactccagcctgggtgacaagagtgaaactctggctcaaaaaaaaaaaaaaaaattaaaaatgatactaaagaccttagaatttctggacatatctgtccaagtatctgtcacgtgtcattctcactatacagaaaacaatctctaaagtcattgatgtctacatgtctaaacttttcaccatttttgacatcttaatacttttaaattacaatccaagttaaaagggcaatgtaggattagaatagaaagaggtgaggattcagaaatcctcacatcaatttcacaactccctgtacgatggaggcctctcttccctgattcttccttagggttttcaaacacggagtccctcctaggtgccagaggttgttctgggctcaggcagtacaatggtgtataaagctgccaaaacccttgccctcatgtggggagacagacacgaggctgagtaagccacacaatctgttaggatggtgatgagtgcgtggtgcatcatttcatatagggtgatcaggaaggcctcaagataaggtgacatttcaggaaggcctaaaagttgaggcatgcatcatgcagataactggggagagccatccagacagggagggcaaaggcaggggcacagggccaggggccagcaaagaggccagtgagaaaagggccatcctaggctctggactctactgctgctgggatggatggccctggggagttcttgcagaagaaacataagccaatcacccaaggtgactgttaaaatgaaaatccccaggcctctcaatctggacttctgattcagtaggtttgaggcccagggattaagatttcttagtttgcaggtagttcagctgagagtggcccaaagagcattctcagaaacacatttctgaatccctgatagtttggcatccctcctctatttccttatttttggtcagctgccctctacaacaagcagccatcattttgcagccgtttagcgttaaacaactaggagagagatgataagaaggaataccctaagtataagagttaaaaacgaagccacttagtttttgtctagcaagagagtctggccccaatatcttctgagctttgctgacattcagtgattggcttgtaactgacaaatggttgaattctatgagtatgggcgtcctatgactatcctggtcattgatttgactaatgattcctgtgcccttgggttgactaaaacgcaaggctgttgtgtttggtgagtttgttaaggtgaaggtcaagtcaaatattgactgcagaagtgatattacagatacccaagttcccaggttgcggaaggtaagagaattcagatgacagggattacaggtgcaaagaagtagtccaatgatcctaaatattttcagttcaagtgcttcttttagggatattacttagtatttcatctcttttcctttgatgtctagataggtattaaatattgcagcaatgaaaacaactgacatcaggtgcattctctctacattattttatttaatcctaaaatagccctgtgaggtaactactgtatgggttaaccaaagcccagagatgttacttgcccaagagtcacagggctattaacaggcagaattgagactctaacctatgtctgattaatccaacacccatgtcttaaccactaaaatatactgctccttaaatctataagaaacatacttgccataaatgttttacatacggcatttccacaagagagcttaatattgagatgctggttaattatcagagacagcgtgatgcatgaggaacactagttttggagcaaaacagatctgaggctcaaatcatttgaccactgaatagcaaatgacttaataggcctgagcccccaaaccttcattcatagagaacattatgtctctcagaaatttaagtgagaaaataagtgcaatgcatggggcatatagcacatagcatagatactaattccttccctactgacttggaagcaaacactgaccatcacctccacctccacctccacccggggcacagagcacagcactcgcgcaaacccccaacagagggtagagggtcatctcggttgggcttgggcttctgtagcggggggctcactgctccgccgagtgccctaaccactgatggacacctccagcccctctgagggttcttcctcctactgacccaatggtcgactccccccaggactgcttctctgaggcaacactgagcaaactgactgctctttcctagtgacagtgccactaataactgaagacagtcagttggtgtcccctggtctttctttctctaaattaaacatgtccacttcagtcagaagtccctctgatcacaatttccgaacaacacagtatcctaattttcctctgctgggaaaactctagtttttctgtgtcctttaatgccaggaccagggccaaaaattgagattgacatattaagccaagaatatgattggactattacataggctaatctagaaaactcaccttgataatcccaggcttcttggctaatcttagcgccttggcccagagcagtcacatcggcaaaaaattcccgcccacttctcctcccagttccacccctcacagcagctgctcacatctttcctcctcccttttttccctccgaggccctccctcagcctctgtttcatctcttcaggaatctcctcttcccagcccaatcctaaacccaggtagcctttgttctaaatttgtataagtgtgttctaagttcctcgcctccccagtcagccagtcagctcggcaaaacaaaaggaccttcccccaaaccagctctccttattaagtagaggaggagagagttctgtaatacttgtaattactcagaccctgtcacactttaagtaactcagcctaagaccattattatacctgtacttcataccgctggctgaccctgagcttgtggtcaaccctgagtcctagagctttcatcatcttaactcctgcccaggccaatagatagcctcaatcctgttattgcatacagtcatgttttggaaagctaaacaaacaaaaaaacatggcaaggtgcaggcccagcaaaggggccaatgagaagagagccgtcctaggccctggaccctctgaaaggtttctgactatgaaacctttactttcatcccaggtaagtccaattttggtttagcaaaatcaaaattcttcttgcagcttattgcaatcatttcatttttgcttctgttatctcttgtactctactagctctccttttcggatttgtaccttctgtgaatgtggtatgactttatgaggatcatggacaaaaatgttgagaagaaactaaccaaggaaaacttttgttgcatggataaatacatagatgcatataaaacaggcagtacataatggatacataagcatataagatgctcataaaataacacaaccctgaggacacacagagatgccaggtaacatcactgcactgagtctaatagtctttagcactcccacacgagcaaacctggctgcaaaatcatgttacacagcaacagaggaatgctcatagcacagaattaaatagagattctaagtcatgtgagggggcagccaggaaaaagggatgtttatgttatttaagtgacaatgaaagttaattatacagcacaggagactagaaaagctttatttgacgttgcagacttttagtgaccacagaagcagttgtaggtattaaaatttcatccatctcagtgtcatttatttactttgccagataatcagtgatcttgcatttttatcttctcactttaaatgtatgcacagaatgttctctcctatgcgatctcacatttattttattttttatttactttattgttgatttttttttttttttttttttttgagacagagtctcgctctgtcacccaagctggagagcagtggcgcgatgtcgactcacggcaacctccgcctcccgggttgaagccattctcctgcctcggcctcctgagtagctgggattacaggcatgtgccaccacgcctggatatttttgtatttttagtatagacagggtttcaccaggttggccaggctggtctccaactcctgacctcaggtgatccacccacctcagcctcccaaagcgctgggattacaggtgtgagccaccgcgcccggcctcaagttcattttaaaatctgaattgtcagctgggcatggtggctcacacctgtaatcccagcactttgggaggctgaggtggacgaatcgtgaggtcaggagttggagaccagcttggccaacatggtgaaaccctgtctctactaaaaatacaaaaaaaatgagctgggtgtagaggcaggagcctgtaatcccagctacttgggaggctgaggcaggaaaatcacttgaacccaggaggcggaggttgcagtgagccaagatcacgccactgcactccagcctgggcaacagagtgagactccgtctgagaaaataaaaataaaaaaatttaaaaaatatctgaattgtcctggtattccatccagtatcaggcttaagttgtcaagaagagataccagtcttgatttctgtgaactgccagaattacacagaaatttgctccacttcccggaaaaggcaaataaaacataccaggattttaggtggtgcaagtaagttgcttgccagagcagccatggctacatataatttgcccaattcccatcaggcatttggttatttaaattttaagcatgcttgatacagcggtcatattaaccttccttatatatgaggaaaacatttcaagttataattatgttaatggtattctaatagtatttttaaaaaattatataacatttattactccgaggaaattaatgtcagatgacactaaaataattaagtttgaattaatcacagattatatcactttgttctcttcaacttttaaacatgtttgataattataatctaacaaaggaaaaattaatagagaaaataagtctaaaaattttctcctccgaattggtaattgggggaacaaaagatgtgggcaattagcaaatgaatatggtgcttcaagactgaagaatttaggatatgtaacaggtgacttagttcagggttgttcctagaggtaagaagtatcaatagaatttaagagtctacactgttcattctatcagtatatcttctatggcacacaagaagcaatggttattcagttatcttaatttcttaagttataaaagttaaatttgagccaaaagcaattaccatgtaaaagtgtatgcagtttttttttttttttttttttgagacagagtctcactctgttgctcaggctggagtgcagtggcgtgatctcagctcactgcaacctctgtttcctgggttcaagcgatgctcctgccccagtctcccaagtacctggcattataggcgtgcgccaccaggcccagctaaatttgtatttttagtagaaacagggttttaccatgttggccaggctggtctcgaactcttgacctcaagtgatccgcctgcctcggtctcccaaagtgctgggattacaggcatgagctacagcaccaggtcggtgtgcagttttgaccttgttatttgaccaaggaaaatttagccatttgaaacaaactcttttttttttttaagactgagtttcactcttgacaccctggtgcgatctcggctcactgcaacctccccctcttgggttcaagctattctcctgcctcatcttcccaagtagctgggattacaggagtgtgccaccacgcccggctaatttttgtatttttagttgagatggggtttcaccatgctggccaggatggtctcgaactcctgacctcaggtgatccaccctcctcggcctcccaaaatactgggattacaggcgtgagccaccgcgcctggcccaacacacactatttcttacattaacttgatgtctcctttcacctaacagaagcaaaatacacgcctaattgaaagacagtcagtgtgtcagactgaaacaaccaccaccaaacaaccaaggcactgatcaggaaaacagcacttttcccttgattctgactttttttctcacatacctttatttgcattattcataggttttatcagaggtttatttccttgggttaataatgaaacatttttcatttgtttccaccaaggggcttgctattctactattgcttagagcttcgggtgtctccatatgacaaatgccaaacatatgccaatcacaacattcaactggtagcatatgctgaatttcccagacgccagatccagtcaggaactttctggtttaatgagtcttgcctattatgtttctggtacacatcattacagaatttttccccatctacttccaagaactagaataaaccagaagaacaaaacaaactacaacaaaaccataataaatcctctcttcgtttatcatctatatgtcacatacgaaattagttacactagcagcatttactgagggcatggcaagatttactaagtcttgtttctcatgttacagccaaattttatcaaagttgaaaataacaatattttacatccatatagttctttgtattatttatttcaaaggactttcagaacttttacctaattggatatttacaaaaacccgtcgattgaagtaggcagcaattctttctcccacttaatagaggagataaatgaagcccagataaattaagcagcgctcccaatgtcacagttagttattattattatattattttttgagaaggagtttcactcttgttgcccaggctggagtgcaatggcacaatctcagctcactgcaacctctgcctcctgggttcaggcgattctcctgcctcagcctcccaagtagctgggattacaggcacacaccaccacaatgggctaatttttgtatttttagtagagacgggggtttcaacatgttggccagggtggtcttgaactcctgacctcaggagatacatccactttagcctcccaaactgctgggattataggcatgagccaccgtgcctggccaacagttattaacagggccaagatccgataagaagttgccttgaacctcacatccactggtctcccactattcctcattaggctgtgccaaggacacaaagtcagcagggatcgagacaccattaacctccctcctgacactggaaggtggcccctacttcctctctgagttttttgtttttgtttttgtttttgttgagacggagtctcgctctgtcaccaggctcgtgtgcagtggcgcaattttggctcactgcaacctccacctcccaggttcaagtgattctcctgcctcagcctcctgagtagctaggactacaggtgcacgccactacgcccagctaatttttgtatttttagtagagatgggtttcaccatgttggccaggatgatctcaatctcttgacctcatgatccgcctgcctcagcctcccaaagcgctgaaattacaggcgtgagccaccgtgcctggtcctctctctgatagttttttaaacattcagaaaaatgtgaatgcatacttaggtttctgcctatatttcctgagagaaaatcatgcctcaacatcaaacgcaaagatcagtcttaaatctggacccaggaacaggaattctcctaattaagcacataatcccatttatctctctagaaacaactgacattcaaataatgcttcatttcgtttgtaaatactagttagatggattgtaatacaaaccaaagagacattaatacaattgtccatttcctttggaaggatggctatccttcctatttaagctaaaagacattttcatttgaaagccatttgagcttgagctgcaatgagctcaggtgcaaatttcttgatgaacgagtctaataatgacacaaaatttcaaaaagaccaagagctatttcatggattatttcctgtggcaatcatctcaagttaaataacttgacattttagaaatggcattgggtaaataactctcgggtgcttttttcactggtccgctcactccccttatcttcctgctgactaaggaaggtaaagggtatcctccacaggaggtgggaattcttggtcctttgaggtaaagggatttcccatcatatcgttccatctgaggctgttatggactcaatcttcccctcacatttatatgttgaaatcctgcccccccaagatgatggtattaggaggtagggcattcggagggttattagggcacaagggtagaaccctcatgagtgggattagagatcccagaagctagctctgcctccttcctcagtgtgaggacacccccagaagacggccatcttcaacccagaagacggccctccttcaaacccagaacttgcggacacctgacttccagcctgacttccagcctccagcagtgtgagaaatacagttctgctgtttataagccgtctatggtaatttgttacagaagcccaaactgaccaaaacacaggtttctatgaagtttgttttgagaaacagaaaaatgcttggtagttctgctattggttatcatttctcagacattataaaaattatgtcaacagcaccctcgacatgttatctctggacaaactgatgtgcttctagaattttgaatttatttacttaacttttattattagcgattagtttctacacacgtttgcaaagacggataaaatcagagccctaccattgagtagataacagcctagcaggggaggtagaaagacaaaactaatagtaatagaatgcgataatctttttttttttttttttttgaccgagtcttgctctgtggcccaggctgaagtgcagtggtgcaatctcgactcactgcaaccgctgcctcctgagttcaagtgattctcctgcctcagcctcccaagtagctgggactacaggcatatgacaccatgcctggctaatttttgtacttttagtagagacgaggtttcaccacgttggccaggctgtctccaactcctgccctcaggtgatcatctgcctcggcctcccaaagtgctgggattgcaggcgtgagccaccgcacccagccaataatctctttaatagggattaatgtaaaacaaaaagaaaaagccacacagtggatgatgaagctaaatatgtctcaccgtttgtctggtgttttatagaggtggtaaaatttcagttggtggttcctaataatatcaccttcacaatagaaaataaagatctatgtgcagataggttaaggttactccagtgatcaaggtagtgtaaaggataaagtaagaatgataataataatgagtatgtagctaaaagtcaaggattgtaaaatatcacagtagcttcggcctttaggtggaacgaagcctgtcttaggtaggatttcctagaagcagacactaagtggaagtgaattattaggaagggctgtcccaagggagaaagaaatagagcgtctgggggctagacagggaaaggaaggaagcccaacaagggtgtgtcattaggtaaattcttatgaagggttattttggctcattgctacaagagaactctagagacacttctcagagttgtcccgtttgggggatgggcagatgatgagagttgggagaaggaggagctgaagtaaacacccccatccttgtcagtctttggttaaagactctcctaggggtatgtaagtcaccaggcgaggctgggctctacagctacttggtaaagtttctgagcagtacagcatctgttacaggcccatttcagaggagttggttctagagtctattttattaatatctaagcatatgttaggttttaaacagaaagcgtcaagtctctggtggatgtgcaataacatcacaccatatttaagttcttacaaagatgtagaaggaagatgtgggtttcagaaatgttctggaaactagaaacacttccctgtgtgtcatgctgcgacggtgccatgtcacgcagcccactggagtggcgtgtgaggtaatgacattgacttcaggtcctggtgagaagactattgctaggaggcatctggctggctggtggctgctcatatcctacgcatacccacctgacagatctctaggattgaaacagagaatgtatgtatgactaagcataacagcaaattttcttctgtatgtaatttcaagacccttcttatcatctctcttagtgatctagtgatctgatgcttgtaataggccttcgtgaatattcctcacttcaaagtagtctgtgagacacacatacaaacgagattctattaacaggtctgccagtgaaacagcccaagtagcaaatttgatagagaacacgtacttgggcatacaaatcccaaaactatgtactaattccaccaggtataaatctcacccaccagaccaacgtctgaaaactatacccaatttccagtccataacaagttaaatggaatttaaggaggttcgttaaagtgttataaacttacaatataagagctacaaaagaatatcataaacaaataatgagaataactccttttctctaaatatacagttattcagagatttcttttgttcttagagaattgttgtcagtcttcctgattataaaaataaagtcttgttgcagaaaattaggcaagtacttcttagcatttttcccttttcctttttcttttggatatgccgttttattgaggtgcaaccatatataaaaacatacacaactcctaagtacatggttgagtttttataaagcaaagaaacctgtgtaagaaccacccagaagatggtttggtttctgttgagggcagagtaagttcatacagaagctccggcctcatcgttgtaacatgtatttgtgagctacttgaagaaacagaccatttcttctcttgtcctccacaatccttgaatatttcatttgttttggagattgacagatcaagttattcattcattaacaattattaatccctactatgtgctcagcagtcagtgtgtgatgatgagacttggagtctagtggaagacacaggtaatacagaagcaaatatacaaagtgttcactataaaatacaaaatgctagggaggaaataaaactgatactgtggtcaagaataactaggtatcctacctagaaaaaatggttagagaaataaatcagagatgagatttagatagaaacttgaataaaaagaacacagccatgagaagagagaaggaaaacacattccaaacaaagggaacactgtgaacaaagtacacaaatccggcttgttgcacaaatggaaaatcaggtgactaggcgttggtggccataggtgtgagtcggacagcaaagacagagaccaggccagtcatggctatactggccaggagagtgacttaaagtgctaagtgcaatgtagggggaaaaaacggggttttagcaggaaagtgaagggaccgatctacgttttaataagagtaccttgaacactgtatgagcgggtggcgagagacaaagcaaggtgccggcaggttatcgcggtggcaatggaagatgtactctggaggtatatcaaccatttctgtggatggattggatgtgggagtgtgggaggtgcagaatcaaaatccatcaagtctttttacttcggcaattatgtggaatgagttgtcattcactgagatggagaagattcatggagaaataagtttccatgaaaaaaagcaagagtttagttttgaacatattacatttcagatgtttgagaaacatccgcgtggagttgtcaggtaagtaatttggataaatgagacgggagtgctgagaggagagctgagctggagatataaatttgggagtcattagcatatagatggtttctaaagccatgggaatataactcaaggagaagatagagaggacgtggggccaagctctgaggaccttcaaccttcagaagttgttcaggttcaagccagaaaaggctcaaaacgctaagcagaaagaatcgtagatgtaggagaaaaaccaggtctcagaagccacgaaagcagagtttcaaccagagggggtggtccacagtgcccagtgctggagagaggctgcgtaagaacaaacgagaggagcatctaactgggcttggcattgcccaaagctgttggtgatgctgtctcaggggaggaaagattaaatgggaagggaaaatggggcaagaagtgaagtgagtggggtccaggtaagttctttaagaggcagacgctcttacaacacaatgtgcattggggaaatgagagaagacaataaaggagagaggggaccagccaaaggaacaacctctttgatgaggcagaggtgggtgtccagcacaagtggaggcctttgcatctaagaggagaaaggacgctttttctcaagaaatggaagacaagaaagtgagtgctcttggtgtcaccttcttaaattgcagtaacatataaggcaaagtgagcagccggaaagaaagaggcaggggagggtgggaggagtgggaggtcttattagaagcaagggatagatatagggggggtgctgtagagagtgggagctcatacctcaggaaaccgggtactgacaaggagggaagagccatctgctgatgtgaacttacagtgtcctcggtttacccaaatgtttactaccaaaaaaaaaaaaaaacaccctaaagcttcaagggaaagaaactaaaacacagaccaccacagtcatttaaagctatgcatttgctcaggaagtgcaataaaaagcgtgtgggtaactgggcgtggtggtgggcacctgtaatctcagctactcagaaggctgaggcaggagaatctcttgaacttggaggcggaggttgcagtgagacgagattgcatcactgtactccagtatgggcaacagagcaagaatccatctcaaaaaaaaaaaaaaaaaaaaaaaaaaaaaaaaaaaaaaaaaaaaaaagggtaaaagtgagtggggaaaaggcagctgaaagaacatgagtgaaatgatgaactttggaatctcaggtggataaagacaggagtcatggcaggagggctggggaaggagagaaagcggcgagggactcccgtggaggttaacacagcaagggctctgcaagcaccgcagctgtcgctggagacgcgaatgcttcattttgttattttggaggtgaagtaacatctagttcgactctgttacactgagagtgttcgatgagaatagagtagaagaaaatgtcactgaagatgagcagatcaatgaatgaagatacaggatactgaggggaccattcatgtaaataatgagttgccaagaaaacggacagaatggccaggcgcagtggctcacgcctgtaatcccagcactttgggaggctgaggcgggcggatcacctgaggtcgggagttcatgaccagcctgaccaacatcgagaaaccccatttctactaaaaatacaaaattagccgggcgtggtggtaatgcctgtaatcccagctacttgggaggctgaggcaggagaatcacttgaactcgggaggcagagtttgcagtgagccgagatcgccccattgcattccagcctgggcagcaagagcaaaactccatctctaaataaataaataaaaaagaaaagaaaacggacagaatttggagaactgggggtggcagacaggacagataaacatcctcagtgaggtggcggggggcaggaggttaacagatgacagtggcaacacggggtggggggagcacagcgcagcgcaatggcatgaagatcaggggcttttactagagccatgggaatggcagcttggctggtgttgaggaggaagcatctcatggccttgccggagccaggcgtacattgggacggcctccagagaaggcgaaagacccagccaaggccaggtcaccacagaaatgttctaaaatgagactgagaatttaacaatggggtttgtgattgtgggaaaaattccaaaagcagagtgtatcaactatcaagaaaaatgatgaaatatacttatttggggggctttatagaaaggaggaattctgtgctacacctattatatatctaactcaaaagtcacttattcagttccttttatacgcaatggactatgcttctaacagacttttcagccacatgcaacaaaaaaccaagtaggaagggcccataggttggtgcacaggtcagtatgtgataccccaacgcaaacacatggtaaatgactggcaaaagtcaataatggctatatatattatatatggaggcatttatacaaagaggaatatatagaaggaggaatttaaaatcatgtctagagtaatataatagatgttaacaatcatgataatagtatttcaaagtatattaaacaaaatggattcatttctaacccaaccagtaaaatattctttgaaccaagattttactaggatgccaaatttaaaagttaaaaaaattccagctttttgagtaatgagcaatttcagtcatcaataaaattaatgaaaatgagagagcaaattacactaatccattgggtaaagaaaaacttaaaacattacccaaatagaagctttcttttctattgcttttcatcagtaataggtatcaactacatttaacaaaaacactgttgctgagataactcaccctcttggtttttaaatacactcaagatatgtcatgtttcaataaatgatgtcagcgttacactgtgtgaaaaaaatacaaaaaaaaaatttaagtttcatctataaatattattccattgacatttcataattaaagtttctaaagaatgaattcaaggccggtggctcacggctgtaatcccagcactttgggaggccgaggcaggtggatcacctgaggtcagaagcttgaggccagcctggccaacatgataaaacccagtctctactaaaaatacaaaaactagctgggtgtggtggtgtatgcctgtaatcccagttacttgggaaggcgaggcaggagaatcgcttgaacctgggaggtggaggttgcggtgtgccgaaatggctccagcctgggcaacaagagcgaaactccatctcaaaaaaaaaaaaaaaaaagtgagaaaacattggagaacataacttgattgagtgagaaggaaatggcagcttagagcagaccctgaaagcagggaggcagctagctgggcctgatctcctgctgcagaaacaggcaatacatccgtactgtgtgaagcccctaagtttgtcactatttgtcatgcagaaacaggtaagtaagacatattataactcggaaaaaatctcaaacctgttgcacaagaagttatttaccattgtaagctctctgcgaaatgttttggaaacccaagttgagaacagctttgatcagaggcaactgaaggcgggcagaagaaaccaagcagtaactactcagctggtgtgtgtgtgtgtgtgtgtgtgtgtgtgtgtgtgtgtgtgtgtgtgtgtgtgtgtgtgtgtcagtttggcagacgccttctttttttttcccctctagtgcatcatgttgaaactgtagctaatgccgggcgcagtggttcacacctgtaatcccagcactttgggaggccgaggcggggggatcacgaaatcaggagatcgagatcatcctaaccaacacagtgaaaccccttctctactaaaaatacagaaattagccagatgcagtggcgtgcacctgtagtcccagctactcaggaggctgaggcaggagaatcgcctgaacccgggaagcagaggttgctgtgagccgagattgcaccactgcactccaaccaggtgacagagcgagactccatctcaaaaaaaaaaaaaaaaaagagaaaaggaagctgtagcttagaacaggagaatgcaagtgattattatcaggaattgcatctgtgagggaacctgaggactcaagccagcccagcagagggcaaggcagcacagggcatgagtcattctcctgatgctaccttcacaggatatcagacaaaggaaactgagcacctgccccatttgatgaaataaagcagataaaagataatacatttaaacaattagatgtgtatcttttatatccaagcaatattgtacagaaaggcaccacctctaccttatgacaagtgttactacccatactcaggaaaccccgatgttgccagcacagaagccaggacaacagaaagctgaacaattccttttgcccaatgtgaacatctccaataaggctccagtttggaagacttctgaaggcctttcaaattcataataaatgctatgaactgccacacttaatcccctgtattctggctgggccagctgttataatacaccaccccacagtcattgctgcttggtagtcgaacaaacacgctggagtcagaggccagagtccttcctcatgccaccagcttccctgagcctagtcccaacaccattccccccagggcactttgctgtggcctcactgggtgtgcccacgtggtcttgccctgaaccccaatctgtaatcagcaccagctcttcaggcgttgaccataaaaggcactgaatgatggtggtgtttttttgttttctgttttctgtttgtttgtttttttgagatagagtcttgctctgtctcccaggctggaatgcagtggcatgatctcactacaacctccacttcccaggttcaagtaattcttatgcctcagcctcccgagtagctgggattatcaggcgcccgccatcacacccagctaatttttgtatttttagtagagatgaggtttcaccatgttggcctggctggtctcgaactcctgacctcaagtgatccacctgcctcggcctcccagagtgctgggattacaggcgtgagccactatgctcggcggatggtgctgttaacaacagtatctatccttgacaatatagggcttcttctgaccacctcaaagatgctactgcatcaggctttaccaaattcttctcttgttacatgagtttcagctcaagaatcagatcatgggggaagcttcaagagcagcaaaacttgtaatttttgcccagttgccctacaagaaaataaagttttgactcttaggcataatcaccatggtgagaacctatatattaatatctacacacaagtatctatatctctccttttaaatatactctttagatggctgctccttacgacaaaggttttatttggtgatttgatgataaaaaaaatcacttttctttatggtgactattatgccatcatctttactaacaagtatattatcaggaatctcaaagaaagtggcattcatgttatagccttcattacttcaaactattccggattccccatattattttacatattttcactgacttttaagcaaatgctttaattttccctttttttttttttttttctgagacggagtttcgctcttcttgcccaggctggagtgcaatggcgccatctcggctcactgcaacctccgcctcctgggttcaagcgattctcctgcctcagcctcccaggtagctgggattacaggcatgcgccaccacacctggctaattttgtatttttagtagagatggggtttctccatgttggtcaggctggtcttgaactcccgatttcaggtgatctgcctgcctcagcctcccaaagtgctgggattacaggcatgagccactgtgcccagcaattttctacttttttttttttaatttcttagatggggtctcattctatcactcaggctggagtgcagtggagtgatcttagcccatcacagtctctgcctccaaggctcaagcgattcttctgcctcagcctcctctgtacctgggatgtgccacaggtatgtgccacacacccagctaatttttgtatttgtggtagagatggagttttgccatgttgcccaggctggtctcaagttccggagctcaagtgatctgcccacctcagcctcccgaagtgctaggattacagcatgagccaccgcgcccagccaacttttctactttaaaaaggcaattggtgaaacctcttctctactaaaaaatacaaaaaattagctgggcatggtgccaggtgcctgtagtcccagctacttgggaggctgaggcaggagaatggcgtgaacccaggaggcggagcttgtagtgagccaagatcgtgccactgcactcctgcctgggcgacagagcaagattccgtctcaaaaaaaaaaaaaaaaaggcaattggtaagttgtatgaacattttgaaactcaaacatttttgtgttaccaggaaattcactatagagagaatgaaaactacgactatttgtaaataatactatgacacagactgcgacaggccactaggctgatttgcaggtaaaatttttgttctatcaaaaccttaaaaaccacatggacacacacacagccttccccagcccctgccatcccatcacacacccttccccagcccctaacatcccatttgtggatgtaactgacatataggaagacagcccatagttatcatttaggttcaccttgtccctggaattgtgctacataaagaaactgagaagcatttctacaagaaagctacgggtcacttgtgaaaagccccaattcatcccagctgaggcatttatcttgttggaatcactggtaaaagggaaagccttgtctcttaaagactttcagttatagaggctacataaaaagcaatggccaccacaaagcttaaacagataaactatccattttgtgtcttctcctatacattagtaattacttttaaaaacatctccacctgtaccttagcctcttattcctcaccagtattccttaccaataagcaacacatatcctactgatattttgttgatggagatagaaattaaataggtggctaattcttcttcacatacgagaaaggaaagttatggaatgaaaatgatgtctctaaggtcctaaatttttcaaactagtgccacctaatctgtgaccatggctaaattctcttgtctcagctttcttccatataaaatgagttgtctaacaaacagtaagctcaattaacatctgataccattattattaaactttttctatttatatgtatttcattctcagttaatatgatgacagaaggggataaacataacttatcaacgacattaatatgacttctttcccctactacattcgttaataaagaggttataattaggtttcaaagacagcatttcattaaggtgatttcattcagatacaactatttgcatataagtgcaataaaaaccttagaagtttctatttgactatgttagcttcataagtagaaataatacacatgctttatgcttaggttaaaaatcagcctaacaatatattcatgattagttcaaaagagcagacatcaattacctataagtttataactgtcaacacataacaattacaaattagaaacagagtaatcaaagtcaggtcataatcaatgtccagaaggtcaaagacatgcagaggccaaatgcatcttctaagtgttgcctggatcaatgtcttatattttacaagtgtaaacatggaaaaatcaagttatttttaatacacttaagaaatgaagtgatttttaatacatcccatatagtaaaaacataaatttgaactaatgtcataacacccttctggtgtccttttcattaaaatgcactaccctaatcatgtttacaattgatatttctctgaagtataaattacagattgtgttaacaaatttgcaaaatgtggcaaaaatatccattgccaacatatattcattcaagtcaatcagtgtatacttaatgagtgtcttctttctccagaaactttactaagatggaaagaaggctttcaattaaagcccagagagagagaggcaaaaaaaaaaaaaacccaggtcattataaaacatgaaaatctgtgaagttataaagatgcccactgggtatgagggtgataacagagatcatttccaggtaacagaaaagactttataaaagggtcatgtctgagttgagccgtaactgaggagtatttgaccagatgggactgaggaaggaaagacgatttgcagcctaggcgatcaaaggagcagggcgacggggagaaatccatggagcgtgtccaactacagtcagtctggtgtgagatgctgcagtcccaagcgcatggagtgatgaagataaagctgaggtctccaggttgcggagagccttaagtattaaggggcttgggctttattctttgggcaatgatatttactaaacagtttcaagcacaggaatgccatggtcacatttttcattgtaaaagaacatgcttatagcagtggagtagatattgaagagaaagactgagcgaaagaagaaagccaatgactatctagtttttaaaagataatctagtgagatgcagacaagatggtagaatagaaagctccaccgttcgtcccccgaccccgcaaggacaccaagttaacagctaatctacataggaaaaacaccttcttaagaaccaaaaatcaggtgagcactcatggtacttgatttccacttcatatccctgaaagaggcactgaagtgatttaaaaaaacaaaaacaaaaacaaaaaaaacccgtcctgaatctgctgacaccacgcctcccttactgggggcgaagagcatctctgggcactaggggagggagaacacagcaattgtgaggcattaaattcagtgttgtcctgttacagcagaaaggaaaaccagaccaaactcagctgatgcctgcccatgccagggggaatgcagatccctgtggtcggaacttgagtgcctgcaaaccttgccacagagggctacagcactctgagtctccaggtcaatgtgaaaggcagtctaggccataaggactacaactattaggaaagtcctagtgctgaactaggcccagagacagtgaactgggggtgggagggcacgtgacatactgagacactagctgggacagacaagggagtgctggcatcactgctcccctaatcccaggctgcacagttctcagctccagaaaagaccccttccttccacttgaggagaggagatggaggagtagggaggactttgttttgtatcttggatactagcttagccacagcaggaaagggcaacagactgaattgtgaggcctctgttctaggccccagctaccagacaacatttctagacacactctggcccacaagggaacccactgccttgaaagaaaggagctggtgccagcagcattcatcacctgttaactgatgagcccttgggtcacgaataaccagcagcaatatccaggtaccacgtcgagggccttgggtgaggctctgggacatgctggcttcaggtaccagcacagctactggggtccaaaatgccaagtgtgctcttggggtccccagttccaggacttgacccttggatggcatttctggacctgccctgggccagtgggaagtccactgctctgaagggtgagtcccagaccaggtggcattcactacaagctgacttaagagcctttgggccttaagggaacatcagggctagtctggcagtactcctcatggtctggggtagtggtgattacagggtgaggctcctctgcctttggaaaggggagagaaaactgggaaggactgtattttgtgttttgagtgtcagctcagcagcaataccaggttgatgtctaagacttttgactctagttcctgacccccagatggcacctctggacctacccagagagcctggcagacctcactgccctgaaggggaaaaaacaggcctttatcacctactgattataaaaccccagggccttgagtgaacataggcagtagccagggagtggttacagcaggacttgggtgagactcagccctttgttggcttcatgtctgactcaacaaagtcatagtggtggtggccacaggggtgcttgtgtcactccacctcaagctttaggtggctcagaacagagagagagaaactctttgtttaagagaaagcaagagagccgggcgcagtggctcacgcctgtaatcccagcactctgggaggccgaggcgggcggatcatgaagtcaggagatcaagaccatcttggctaaagcagtgaaaccctgtctttactaaggaatacaaaaaaattagccagacgtagtggtgggcgcctgtagtcccagctactcgggaggctgaggcaggagaatggcgtgaacccaggaggcggagcttgcagtgagctgagatcgcgccactgcactccagcttcggcgacagagcgagactccatcttaaaaaacaaaaaacaaaaaaaaaaaaacaaaaaaagagaaagcaagagaagagaacaagactctctgtctggtaatcaagagaattatcacagatcttgtccaagaccatcaaagcagcacctctatgagtctgcaagaaccacagcattactgggcttggggttccccctaaagtagatacagcttagatcacaatacccaagtcctgttaaatatctagaaagcctttctgagaaagatggctacaaataagcccagacagtgaagactaaaataagtacccaactcttcaatgcccagacaccaaagaacatctgctagcatcaacaccatccaggaaaacatgatctcatcaaatgaactaaataaggcaccagggaccaatcctggataaatagagctatgtgacctttcagacagagaattcaaaatagctgtgctaagaaaacacaaagaaaattcatgataacacagagaagcaactcataatcctatcagatacatttaacaaagagaatgaaataattaaaaagaatcaagcagaaattctggagctgaaaaacacaattggcatactgaagaatgtatcagagtcttttaatagctgaactgatcaaggagaagtaagaattagtaagcttgaatacagactatttgaaaatacagagtctgaggagacaaaaaaaaaaaccacaataaattatgccttgcctacaggatctataaaatagccttaaaagggtaaatctaagagtaattgggctgggtgcggtggctcatgcctgtaatcccagcactttgggaggccgaggtgggtggatcacagagtcaggagatcgagaccatcctggccaacatggtgaaaccccgtctctacaaaaaatacaaaaattagccaggtgtggtggtgggtgcctgtaatcccagctagttgggaggctaaggcagaagaatcgcttgaatcagggaggcagaggttgcagtgagctgagataacaccactgcactccagcctggcaatagagcaagactccatctcaaaaaaaaaagaacaaaaacaaaaaaaacagtaattggcctattggccttaaagagaaaataaaggacaagataggggtagaaaatgtatttaaagggataataacagagaacttcccaaacctagagaaagatatcaatatacaactacaacaaggttacagaacaccaaggagatttaatgcaaagaaaactacatcaaggcatttaataatcaaactcccaaaggtcaaggataaagaaaggatcctaaaggcagcaaaaggaaagaaataaataacatacaatggagctccaaaacatctggcagcagacttttcagtggaaaccttacaggctaggagagaatggcatgacatatttaaagtgctgaaggaaaaatcttttatcttataatagtgtatctggcaaaactatcctttaaacatgaaggagaaataaagactttcccagacaaacaaaagctggagaatttcaccaatagcagacctgtcctacaggaaatgctaaaaggagtacttcaatcagaaaaaaaaaaaaaaaaattaatgagcaataaataatcacctgaaggtacaaaactcactggtaatagtaagtacacaggaaaacctagaatattataacagtgtaactgtggtgtgtaaactactcttaccctaagtaaaaagactaaacaatgaacgaatcaaaaataataactgaaataacttttcaaggcatagtgagtacaataagatataaatagacacaataaaaagttaaaatgccaggggataaagttaaggtatagagtttttattagttttctttttgtctctttgtttatgcaattggtgttaagttgttatgaggttaaaatgataatatcaaaccaaaacaacacacagtggagacacaaaaaagaaaaagcaagaaactaaaacgtatcaccagagaaaatcacctctgctagaggaagataggaagaaaagaaagaaggaagagaagacaacaaaacaacgagaaaacaaataacaaaatggaggagtaagtccttacttataaataataacattggccgggagcggtggctcaatgtgtataatcccggcactttggaaggctgaggtgggcgggtcacctgcctgggaggtcaggagttggagacaagcctggcaaacatggtgaaaccctatctctactaaaaatacaaaaattaaccaggcgtggtggtgtgtgcctgtaatcccagccactccaaaggctgaggcaagataattgcttgaacctgacaggcagaggttgcagtgagctgagatcgtgccattgcactccagcctgggtgacaagagtgaaactcagtctcaaaataaatacatacatacatacatacatacatacatacatacatacatataatgaatgtaaagggactaaactctgcaacaaaaagacacagactgggtgaatggatgaaaaaaacaagactcatttatatgttgcctacaagaaacacacttcactataaagatccacatagattgaaaataaagggatggaagaagatattctatgctaatggaaaacaaaaaatggcaggagttgctatacttatatcagaaaaaatagatttcaagacaaaaactataagaagatataaaaaggtcactatataatgataaaggggtcaattcagcaagacgatataagaactttaaatatatatgcacccaacactggagcacccagatatattaagataaagcacatggtattagagccaaagagagagataagcctcaatacaataataactagagacttcagtaccccactttcagaactggacaggtcttcaaatagaaaatcaacaaagaaacatcagacttaatcttcatgatagcccaaaaatcagcagcatttctatatgccaagaattagtagaagaaaataataataaagatcagagcagaaataaataaattgaaatgaaaaaaatacaaaagatcaataaaacaaaaagttggtttcttgaaaagtcaaacaaaatagacaaatctttagccaggctaacaaagaaaaaaagagagaagatccaaataaaaccataaatgaaaaacgaaacattgcaactgatactgcaaaagttcaaaggatcattagtggctactatgagcaactatatgtcaatatattggaaagtctagaagaagtggacaaattcctagatacatacaacctaccattattgaaccaggcaaaaaaatccaaaacccaaacagaccaataacaagtaacaagattaaagccataataaaaaatcttccagtaaagaaaagcccaggacctgatggcttcactgctgaattctaccaaacatttaaagaagaactaataccaaccctactcaaactattccaaaagacagaggaggagggaatacttccaaacttgttctacaaggccagtattactctgataccaaaaccacagacacatcaaaaaaagaaaactacaggccaatatttctgatgaatattgatgcaaaaatcctcaacaaaatactagcaaactgaattcaacattacatcagaaagtgggatttatccctgggatgcaaggatgattcaaaatattcaagtcaatcaatgtgatacatcatatcaacagaatgaaagataaaaatcatatgatgatttcaattgatgctgaaaaagcatttaataaaattcaacatccttcatgataaaaattctcaaaatactggggataaaaggaacacatctcaacatatggcttttattaaaagccataaatgacagacccacaggtagtatcatactacatggggaaaaactgaaagcctttcttctaagatcgggaacatgacaaggatgcctgatgtcaccactgttattcaacatagtactggaagtcctagctagagcaatcagaaaagagaaagaaataaaaggcatccaaattgtaaaggaagaagtcaaattatccttgtctgcagatgatatgatcttatatttggaaaaaccttaagattccacaagaaaccattagaactgatacccaaattcagtagagttgcaggacacaaaatctacatacaaaaatcagtagcatttctaaatgccaacagagaacaatgtgaaataaataaaagaaatttttaaaaattccatttacaatagccacacataaaattaaattcttaggaattacccaaagaagcaaaagatctctataatgaaaactataaaacactaatgaaataaatcaaagagaatgccaaaaaaggaaaaatattccatgttcatggataaaatccaatattgttaaaatgtccatactacacaaagcaatctacagtttcagtgcaatctctatcaaaatgccaatgacattcttctgggaaatagaaaaaagaatcctaaaagttacatggcaccacaaaagacccagaatagccaaagttatcctaagcaaaaggaacaaaactgaaggaatcacattacttgacttcaaattatactacagagctattgtaagcaaaacagcatggtactggcataaaaacagacacacagagcaatgaaacagaacagagagccaagaaacaaatccacacacctacagcaaactcatttttgacaaaagtgccaagaacatacactgggaaaaagagtttcttcagtaagtggtgctgagaagacaggatatcaataggcagaagaatgaaactagacttctatctctcaccatatataaaaatcaaagcaaaatcgatttaaaaattaaatagaaaacctcaaactatgaaattacttcaagaaaacattggggaaactctccaggacactggtctgtctgggtaaaaatttcttgagcaataccccacaagcacaagcaaccaaagcaaaaatggacaaaggggatcatatcaagtcaaaaagcttctgcacagtgaccaagaagcagcttctctgctccttctggaatctctgcctggttcaatccacttgcctctactcctgcctccaccatgtccatcagggtgacccagaagtcctataaggtgtccacctctatgggcagcagcagcttccgggggtggcctgggtggaggctctggtggggccggcggcatgggaggcatcaccgccgttgtggtcaaccagagactgctgagcctccttaacctggaggtggaccccaacatccaggccgtgcaggagcaggagaaggagaaggagcagatcaggaccctcaacaacaagtttgcctccttcataggcaaggtacggttcctggagcagcagaacaacatgctagagaccaagtggagcctcctgcagcagcagaagatggcttggagcaacatgggcaacatgttcaagagctacatcaacaaccctagggggcagccggacactctggtccaggagaagctgaagctagaggcagagcttggcaacatgcaggggctggtggaggactttaagaacaagtacaaggatgagatcaataagtgtacagagatggagaatgaatttatcctcatcaggaaggacatggatgatgcttacgtgaacaaggtagagctgtagtctcagctggaagggctggctgacgagatcaatttcctcaggcagctgtatgaagaggagaccttggagctgcagtcccagatctcggacacatctatggtgctgtccaggacaacagccacttcctggacatggacagcatcattgctgaggtcaaggcgtagtatgaggagatcacccaacctcagccgggctgaggctaagagcatgtaccagatcaagtataaggagctgcagatgcaaagactgagatctccaagatgaactggaacatcagccagccccaggctgagactgagggcctcaaaagccagagggcttccctggaggccaccatcgcagatgtcaagcagcgtggggagctggccattaaggatgccaacaccaagctgtccaagctggaggctgccctgcaacaggccatgcaggacatggcgtggcagctgcatgagtaccagaagctgaagaacatgaagctggccctggacatcgagattgccacctacaggaagctgctggagagtgaggagagccacctggagtctgggatgcagaacatgagtatccatacaaagaccaccagcgcctatgcagatggtctgagcttggcctatgggggtctcacaagccctggcctcagctatggcctgggctccagctttggctctgacatgggctccagctccttcagctgcaccagctccaccagggccatggttgtgaagaagatcaagacctgcgatgggaagctggtatccgagtcctctgatgtccttcctaagtgaacagctgcgacagcccctcccagcctgcccctctggtggctgccccagagcctgggagggaggctgctgtgcagcggagcacagggaatgggagacccacctgaggctcagccctagccctcagcccacccacgggggagtttactgcctggggaccaccttgcccatgccttcagctacaaaacaactcaactgcttttatttttttccccccaaaataaaacctcagctagccctgaaaaaaaggcttctgcacagtaaaaggatacaatcaacaaagtgaagagacaaccaaaataatgggagaacatatttgcaaaccctgccaggggattaataatcagaatatacaaggagctcaaacaatgctataggaaaaaaatatataataatctgatcattttaaataggcaaaagatttgaacagacatttctcaaaagaagacatacaaatggcaaacaggcatatgaaaaggtggtcaacatcactcatcatcagagaaaggcgaatcaaaactacaatgagctattatctcaccccaggtaaaatggcttgtatcccaaaagacaggcaataacaaatgctgtcaaggttgtggagaaaagggaaccctcatatactgttggtgaaaatgtaaattactacaaccactatggagaagattattttttagttttgaggttcctcaaaaactaaaaattaagctactatttgatcctgcaataccactgctgggtatatatccaaaagaaaggaaatcagtgtatacaagatatatctgcactcctatgtttgctaaagctctgtatataatagttaagatttggaagcaacctaagcatccatcaacagatgaataatgcataaggaaaacgtggtacacatgtacaatggagtactattcagccataaaaaagagtgagagccagtcatttgcaacaacctggatagaattggaaactattaaataagccaggcagagaaagacaaacatcacatgttctcacttatttgtggaatctagtaatcaaaacagttgaacccatggacatagagagtaggagaatagttatcagaggttgggaaggtagagggaggatgggagggaaaaaaatagaatgaataagacctactatttgatagcataacagggtgaccacagtcaataataacttaattgtgtattttaaaataacttaaagagtgtaattggattgtttgtaactcaaaggataaatgcttgaggggatggatactccattttccatgttgtgattatttcacattgcatgcctgtatcaaaatatctcatggctgggcacagtggctcatgcctataatgctagtactttaggaggctgaggcaggtggatcacctgaggtcaggagttcaaggccagcctagccaacatagtgaaacccctgtctctactaaaaatacaaaaattagatgggcgtggtggtggatacctgtaatctcagctacttgggaggctgagacaggagaatcgcttgaactcaggaggcagaggttgcagtgagccgagatcgtgccattgcactccagcctgggcaacagagaaaaactcatttcaaaaaaaaaaaaaaaagcaaaacaaatgaaaaaaagcaccttatgtatcctataaatatacacgcatactatgtacccacaaaaataataattaaaaaagataatctagtgaaaagatgattcaggactgatcagaggcaatagttaggcaaaaaaattaaaactgctttgacaaacttttggcagataaaatttgtgattggttgaatgtaggcactcagtgagaagggataaaacagaaaactctagtatggaggactgggtagatgtgacttccccacacgagaaaacagccattgatttaggggcagcaatgaagattttagctggatgtaaagtacccgtgggatgtccaagttgagggagccaggagcaaggtgcctgagctggcacttcagggagaagcctggcatggagctaggaggcaggcaacatatgctcaacgaggaaagagcccagaggtggcatacaggataaacagcaagagaaatatgaagagaactaggaaaatgcagataagtaactgcactatcaataaaatattaaaccacaaatgtgagactcattgccctgtcatgttatctgagaccaatacattcaaaagcaagtataataaaggtacagatgacctgagagcacagaaatgcttagacaaatttggaaaaaaaaacaaacagacattccagatgcaaacctaggattgaacaattagtgtatctttgactatcccccatctcattacccatccagcctgcatcctggcacctagacttgagctctggccctctattaccccctttaggtactgtctcacctgtcccaaatgtgtctttgaatgtccacgtaggttctgaaggtggccttcagtctgtcatgctgaatgagttaaattttccaggaaaatccatatcccaaattattgcttactatgatctcctgcataatgttaagtaacttgggttttactctacatgcttccatactgctacagaataaacactcagcactcgtgaaaaagaatttatggctacagaaaacatatccaagacttacacaagaagatttacagctaagccctgacattaattggctttgtaatccagcttagctcctcttgctccagctgtcatctgcagaatgaagataatggagcagtgaagttgtcacagcatccgaattactatcctgatgggccaggtgtagacagacatccttaagtctgtcactagagagagcaaaacgtcttcatgggggcaatatcattttacagtatttggggcactgaaatattcctttcagagtgtccttactttactacaaaatgtcctaccagggaaagaaaaatattatcaattctattgaaagaaagcattaaaggaatctcactagctctttcagtaaaatcaatcaggaaatcatgaatgataacacttattatgcagacatacattatccatccactcctttaaaaatatttatagaaaatttaggttcctgtggctgtgaaactattctcaaaaaactctgcgtaacctaaaaacaaacaaaaccccctggggctcttccctttgctccccagtaattctcctctgcatttttaatatctgtgtgtcaccccctgtcattaataaagctatcaacagtcagtaaaaggcaacagaagtgtttcattgaaatcttaattgccagacatacagaatatcttaaaaactgtcctttaaatgcccacatttctcaaaatcatctcttaattttatttacaattacatttttcactttctgggtgctccattttccatttttagaatgtcttatatatttgggtagattccaaacagaaaatgagttccaagccttggactgaatcactcattccaatgggtgatcctaaaactgaaatgcaggcttacctcaaaaactaagacctcccagccctcactctgtgcatgcaagcttccaccttttttcatgcaagctccccaaggaggacactgcctctcgtgcacaggcaggcccaggagctgatttggagatctttctggctctctgtcgtctgcagactttcagtgctcccatgcatagatattggtccccttcctgaggatcataacaccttcgagttcttccatcctttgaaacctcctcgttgtgacaacgttccagctagacccagcttgcttctactaagtctgttctgtttactgtctcttttgttataaaattatttactcattttattttagtgatgtgaattaaatgggtcatatatgcttttgctagtaatccaagtgatattgaggtttctacattttaataatgagtcacatcctctggtctaccaatgccacttccatcacccaccccttcctagttaaaaatttggctagcatctttccgtacttttctcttatttgtacaaacgtgaaatacatttacataagttcatttaaagggaatgtataacttattctgaattatgatttatatattctgaattgtgatcatttatgtaacacaaagctcgctgcttgcagagtagaattaacaagcgtgaggcctgttagaaagaaagtgactttattaaccaaaactagtcgtggggaagtggttggattcccatccaaagcaactacttcaaattttggtggggaaggaaagagtttaaaaagggagaacttgatacgaaaggcatgccagaactgtgctgaggacgatgcctgtgcatcttgttccagtggctatcttgggtcccagtccacctggtacatggtctggcatcatctcaacagtggcggggctgctgattagccctctgaggccatctctggaactctgcagctgggtctccaggcttggtctgtctgtctcaagattagcccccaaatcttcaaagaaggcacataattagatgctagcgtacagttagataaataagaagggagtatatctggagaaaaacggagggacgtggagtctattttaaggctaaaggaaacaggcttctgtagtttgcttcaaggttacatcttgaaacccaagagaaagaggaaaaaaaaaagttttaaaatgcattttgaggttatgctgcccagttacatttacatcatgatattcttaagccaaccatctttttaacgtctctttcatagtatggatattccggtttttattctaccatttcattactgatggatcttcacattgaatatttcgtcactagaagcaatactgctacttatttcaacgtgtatcttggacattcctgtagttttatttctgaaggctaaattctcaaaataggatggccgtttcataggaaatgcatatgtacattttgaagagatcataagattgctatcccccaaaatgttgaagtaatttattcctctatcaataagacatatagcccctatttcttcaacagcagtgaatgatactaagttgttttttttttttgctgatttgatagacaaaaagaggtattttgttgttttaatatgaacttgcttgattccagtgaggtcaaatggattggttgttttattttccattatgtacactagttgttctgagtggacttggcaacagtgtagttgagttttcccctttcacattttatagattagggatgttaatcctttgttttatgcttttcaaatattctctcccagtttatggtccatcttttatttctatttgttatttctttcaccatacataacatttcagtttttatgtaatcaaactcatcagtgttcttggtaatggctactaggtctcctctcctccttcagaaggcctcttctatgccatggagaaaatgaggctcgacgtccctcaaattccaggccatgcacctggatctgcatctatcttcatcttctgtcagtcttggagaaagcgatgtcttctggtagaaacagaactacctactgtgttcttcacctcttcattgcttcagacaaaagactgcaaaatgacctctgcatggtcacacccagtaaaccatttttaaccctgacctttattgctcattctacacaggtgacccctctgatgatttcataggctctcacttgtgaattcctgaagacatcctggctgtcctcctctccctccagcaattgtatctcagcttcctgagagcacatgccgcttttcctccgtattttcccttggtcttttttcatttaatgcagtcttacttgttgaccccctagctcccaggacttacagtttagtctctatgctgatacatgcagacttgacctccatgcttgcctctctagcacattcccagatttctcagctccagacccatttttatacagactacacatccacaactgagcctgtcatcaccatcagatatttggtgtctaaaagaatggccagggctacatcccagtcacacaggctataggtctcactgtctccatggactcctcaacactatttgtattataaataaacaccataggatttgtgccctctagacccatgacaccctatattccagaacaagagaacaatcggcctggaggttttgcttggatctcttgtacactcttgcaacagtcccccagcagcaactctccagtcattctccattcagttttgcattctgtagccataaaacctgggtcttgactgtgcctcttcccttggaaaaatcctatcttggttctattggtttataatgaagttcaatctccctgtaaggtttaggagaccacgcatggcttgaatcttacttctttcttcaaccttggttctcactctgcttccttctgcctcctcactctgaccatgtcctctcttcagaaaccatatcctgatttccagtttcctgtctactatgttctctctcacctatgtaccattgaacatgcagttccctctgctgactcagtcttaaagtatgatgggaaggctagagcatcacaaaaatgcctggacagttagacacaattattaataaaagtcaaatctcaaaaggcatgctgtctattaatacaaacactaaatgtaaacaagaaaatttcatattaggaagatgaaatcaacgctgcattaccactaacttgaacaaggggtgggcaatagacacagaaatgaaattacccagtgttgaacattcagattgactttggaatctcacaggctttcctaaaaaaacacttcttccctttaaaaaggtactactggcttggtgcagtggctcacgcctgtaattccagcactttgggaggccaaggtgggtggagtatttgaggtcaggagttcgagaccagcctgaccaacatggtgaaaccctgtctctactaaaaatacaaaaattagctgggcgtggtggcgcatgcctgtagtcccagctactcaggaggctgaggcaggataattacttgaacccagagaggcggaggttgcagtgagacaagatggtgctactgcactccagcatgggtgacagagtgagactccgtcaaaaaaaaaaaaaaaaaaaaaagggactacttattgtacattttgaataaaagacgaattgagagcgaggatttgatgcccctcacggcatcttagtgactaaagatttaccatcagggtgggctcagtttctttcaggtaaatgaaaaatggcaaaaataatgcctttcatttctaaacacgaccataaagataaaacataaaaaatgatgacagatttgacgaactaaatctttaaaatgtctgtatgccaaaacatacacaaaaacacacatatgcaaattaaaagataagtgagtaggtggagaaataatcataaccaaagagagttatatcttcaatctataaaaagctctgataaatatgaaaaagataaatacccccaataaataagcaaagatataaacagataacttaaaaaaagatgatcaataataggaaaaaaatcaatcaaatcacatggaaaagaataagataacagtttgaattctaaaactggcaaaaatgggccaggcacggtggctcgtgcctgtaatcccagcactttgggaggccgaggcacgtggatcacctaaggtcaggagttcgagaccagcctggccgacatggtgaaaccccgtctctactaaaaatacaaaaattattcaggtctgatggcaggcacctgtaatcccagctactcaggaggctgaggcaggagaattgcttgaacccgggaggcggggggtgcagtaagcggagatcacaccatggcactccagcctaggcaacagagcaagactctgtctcaaaataaataaataaaataaaataaaataaaatataattggcaaaaatgggccaggcacagtggctcacctataatcccagcactttgggaagccaagagagaaggattactcgagaccaggggtttgagatcagcctcagtaacatagtgaggatctgtctccactaaaactaaaaaatttagccaggcaagatggtgcatgcctgtagtcccagctacttgagaagctcaggtgagaggatcactggagcccaggaggtcaaggtttcagtgagctgggatcacaccagtgcagtccagcccaggcaatagagtgagactctgtctcaaaaacctataattaatttaaaaaattttgaaaactaaataaatacaattggcaaaaatgattgaaaggaagctaacttcaatattgatgagggtgtgcaaacatatgcactcgcaaccactgatgacgggaacataaaaacccattcaaaggctgatatatggatattctctcaaccagcaattcaactcataggggtttatcaagaggaaatatttggacaaattaaaataatatttagccactaaaaatagtaatccacaaccaaaatattaatggtactgagtgaaaaacatgtacaaaactatgtgatatatacaaacatatatatagtataagcctctgttttaattaaaaatatgaaaattaaatgtattaaatataatgtattaaaaatatgttataaaaggttatgtgtgtgcatatatgcgcatgcctaaaatggcctcagaggactttgcaacaaaagtttaacagtctggggccgggcatgtgaaattaattatcgtttttaaatgtttctagatctcatacatatttaaacaaacagcataaatatttcttataataaaacagcaatactattttaaatgtctgttttgaggacaatgtatttaggaaaattgtatatagaacaggaaaggagtacaagcatggaaaagagggaagtcagtgttaaattataaaacctgatcacacactctatttgttcatcatttagaatatacttttcaaatggtttcaatacaataaagccttaaatgttttgctctaagcattcttgatttgatttttcacacatagtatattttaagggctgttcatttgactgcatttggttcatttaaattcatctcatcaaaatgcaaaatttctaagagctattttatcttcaaaaaaatcccatttaagtctaacttatgtcatattttttcttagaaaaaggaaaacaaattttactaaaagtaaatgaacttaagttccaaaagttcaaggttgacacaaaagtaacttaaacaccataagacagaaaaacatactggccttcaattcttattcaaaaagtttatttacccacatatgtttctttagtcatcagtctacaaaacaatttgaaccaatttttcctatcttttaaaatcttatgttacatattcttctttgacatagcaaatgaatgttgagccttttcctggaaaaagaaatcaaagcctgtcattgccatgtgcccctctcctccaatcctgcgactcccagtccattgaatctatctgtcacttagtttcaagaatatgacattaaacatgctgattcctctacttagaatgacttttcaaatcttttatcttccatgcccagcaaatactcagacccaatactccttcaagacccaatctaatcaccttatctctagagactcctaatcactgtagtggagggtgcctcaacttccttcagtggacaaaatctacatgcaacaagttcatgcacacacacacacacacattcacacacagaaattgacacacccactttcacacacatatccagactcacacagatttacacacaaagttcacacacacagattcacacagattctcatacacactttcacacacatatccagattcacacacagatttacatacacaagttcacacgtgcacagattcacacacacagatacacacatacacacaaattcacacagatttacacaaattcacacacacagatacacacagattcacacacacatacataaacacacaaatttcacacacacaaaatcacacagattgaaacacacacattcacacacatttacaaacatataaaaattcaacacagatttatacacacgttcacacacacaattattgggcttatattgtaactatctgttgacatgtctttcttctctagcagactcagcttcttatggaatgccctgtttgcatgccgacatatacacagaacctccccagatgggtgataccccacaacacattccccacaagagtttgctgaattgattaaacatgacctatcatgaacgttatcattattttagattattttctcagtataatacaactccttttaagatccagtcccatagatgtgaagtgggctgaagagtttggagttcatatgacacaagacactggactttcggtgacaaggaaccatggtatcagatggtgctttgaaagtaacattggctgcacacagtggctcatgcctgcaatcccagcactttgggaggctgaggcaagcagacggcttgagcccaggagtttgagaccagcctgggtaacattgcggaaccctatctctaccaaaaaatacaaagattagccaggtgtggtggtgcatgcctgcagtcccggctacttggaaggctgaggtaggaggatcacatgagcccaggaaggtggagatttctttgaggagtgattgcaccactgcactccagcctgggctacaaagcaagaccctgtctcagaaaaaaaaaaaaaaaagtaaagaaaataacttcaaggagggactgagaattgggagcaatttaggtgtgaccaatctagcatggggtgacagggacctgtattaggaggataacaatggcaaacagagaaaaaaaaaaaaatctgtacgatgccccccagcaagtgtcaggaacaggcaagaaaatattttatgaaattcatctggatgtgagaaggtccatgaactgtgttggacaatacatcaagggaggcaattaggcaaggcccctttcccacagaaaccttgagctacactgtttatatgtggaagcacacaaacagcaaggagctgggcacaggttctcagcaggctgatcaatctgaggctccatcagtgctccctctgctgtagaatcctgagcgcttgctgagtatataacgcctttgccacttcttcagagattcctcccctcgccccaaagtgtaagacagacatcattcagtggcatgtactaaaaatacaatggaatgtctagcatacttgctgaattgagaaaacattaatatcccaggctcctcgggtaccagaatggagtcaatgctagaaaccactcttctgagaaagagtcaaaagtgccacagcaggttcaatgagggtgtcaccactaagttaagatgctgtcacaaggctaataaaaagattaaacgtattaaaaggagaactgatactaagacaaatttgatttcctttccccaaaagaataccaagcatctgagatataggaggttaagtgaaggtcaaaagagacagttagattcattcataagcaatttacttttcaggagagattttgaaagattatttaacttagaatgaatagtaaaatattcaaggtagttatatggcaattaatgaaaaagtggaaatgaatattaaattcctagctcaccagtgtcatggtctaacaagaaaaggaaaccaatttctaattttcccatggaatgacttacataaagaatttgtagatcttcatatacaaagacaaatatttaacttaggccaggtgcggtggctcacgcctgtaatcccggcactttgggagggaaaggcgggcggatcacctgaggtcaggagttcgggaccagcctggccaacatggcaaaatcccgtctctactaaaaatacaaaaattaaccaggcgtagtgacaggcgactgtaatcccagctacttgaggctgaggcaggagaatcacttgaacccaggaggcagagggtgcagtgagccaagatcacgccactgcactccagcctgggcaacaagagtgaaactctgtctcaaaatatatatatacttaacttagattttaagagtttttctcaactaatagagttaggtaaagtaaattacttaactgaactatctgcacattttcccctaatttatctttggaatatagttatgagaaggctggtcaaaaccaagacacaaaggtagaccccaaaaacccaacagggagagggggaatcatgttttccctcacatgacctctctcacaaagggctataaaagccaaaaatttaaacagacttagataaaaatttgaattatttccaaatgcagagtgctaaccactatagtcaagtcatttaaattccctgtggttaagtctcttatctgcaaaacatgaacatataaatctctttgatgacattattaagcatttcacacattacatatccatctgagaagacagcactgaagcagagaagtccaatattatgtatgcaaaggatgccttgcaggaggaaatcctgtcctccttcagttctcactgatttatagatcctaaaatgtataaaaacaagcattaagtatttttaaaatggaaaacaaaatacactggaatgagaatgtttatccatgtgactttgcacatatgaaagctgaataaatgttctgtatcatccagttatttcagtttcaggagttaaggatactgaggataaaatatcctgattatggtgcctgcatttttgtgttcacggagttatcctgtcatatagatagcctaagggtctctgaaagaaaagatggagttacgaatagaaatttatttctaggaccaaattcaagttcaaatttgcatgataatatctgcagtgctttattcctcttaaaacccaagttaccaagctcttaaactcagctctctttgcattttaatgaacagagtccaagtctgatgcttaaatggtttgtttttattttaagcttttgaatcccgcataagacctaccacagtgctaggtactcagtgggtctctaaaaaacttattggctgtttttaaactgtaccttacatgtctctgaattataacacatgatattaaattcagcagcaaggaaaataagcctttaagttcttactttgctatgcttccttgctatatggaaagacagtgtttatgaaaatgtgattgctatggcttacatgtctgtccccttcaaaactcatcttgaaatttggctgccattgtgacagtgataggaggtaggacttttaggaggagatagggcgataatccccaagcggatgggattaataccattataaaagggtaagttgtgtgcctttttatctcttggcccctttgcccctgccatttgaagcctctttgatcccctcgctcaggaggacaggacggcatacaaggtgccaccttggaagaagagaacgaccttaccagacacaaaacctgctggcaccttgaccttagacttcccagcctccagaagagtgggtcaatacatttctgttctttgcacattacctagtctgtgatattctgttatagcagcataaatgcactaagacaatgaccattctatgtggcaaaggctagaaagaggtatagggtttagagttagcttctgaagtgaccagctaggacagaaacactgcgagaaattctttgtgaatcatggctttttcattcctggagtcacttttccttcgataaacaaacaaaactccacctgtgaatataatagtctcatatccaaaagggctggctggtgctgggagaacaggatatatactcctgaagcctttccttaagtggtagaatcattcttcactgatgaatccaacaattattcctgagattgatgtgttgatttagcaatgctctatcactcagcatctctctgtttatgcttttcctctcccagagggcagccattctaaagagttatccctctctgcaagtagcgagactcataaactctacatgagcatatttaaggacttccaccattcaaatgaaaaaaattaccaaatagcaaatgatcctataaagaaaaaattttcaaatgaaaataaaacaaccctcagaaaagccatacaaaaatataacccaccactatcctctgaaacctttggaaatctctgctgtcttactgaagtacttggagttttaaatgcagtttactggctaagactgaaaatagctgggcgcggtggctcacgcctgtaatcccagcactttgggaggctgaggcgagcggatcacaaggtcaggagatcaagaccatcctggctaacacggtgaaaccccctctctactaaaaatacaaaaaattagccgggcgtggtggcagatgcctgtggtcccagctactggggaggctgaggcaggagaatggtgtgaacccaggaggcggagcttgcagtaagctgagattgcgtcactgcactccagcctgggcgacagagtgagactccgtctcaaaaaaaaaaaacaaaaaacaaaaaacaaaaaacaaaaaaaaaaaaaacactgactatatttacatatgcctggacagagaacatagaacactgtacacaaaacattatctgatatacctttaaagttattcttaaccaacatgagggaaaatctgtcattagtcaataaacaaagtcaattgctgagaggaacactctgtacattcagaaaaattagaattcctgccttgcccctaaaaagaatttaaacatagctgctactgattagagacagggtatttcaaagtccagccaggaaaaaataatcagaataattccccttgctcctagatccaggagtcagaaggtgaatcacaagcaaaaaattcattaatttatgcttgtatatcatgattttccagctctctaaattaagggaaaaaagccagccatacaatgaattgtgggcatatcctataaatggattttcagaaatattgtcaaagttcttcaaattaacttttcaagaccaattcaacaaatacctttctgggtttctttcttttctttctcttttcttttcctctcctctcctctcccctcccctcccctcccctcccctcccctcccctcccctgtcccatcccctcccctcccctgtcccatctcctcccctcccctcccctcccctcccctcccctcccctctcctcttctcttttcttttctttttgagatggagtctcactctgtcgcccaggctggagtgcaatggcttggctcactgcaacctccacctcctgggttcaagtgattctcctgcctcagcctcccgagtagctgagattacaggtgcctgccaccgtgccaagctaatttttgtatttttagtagagactgggtttcaccatcttggccaggctggtcttgaactcctgatctcatgatccacccacctcagcctcccaaagtgctggggttacaggcatgagccactgcacctggcctataaatacctttcttggactatattagaaattaactttcatttttatcgtaagtacttttaactctaaaataaaattaatatcaaatcacagtaaacatttaagcatatctaaaaatgagtggttatgggggccatgtcctccgacagcaaactaacttcccttacacaccacatttgtcccgttacccattggctgcatttagttcttctaactgcacccaattcctatattctggaaaattctctggctccattcatttattccatagatatttactccaattatctcaagggtaatgcagggcattagtgtttacaaacattcttcaaacctgtcataattctattcttctcttatttcctgttagcagttatttacatgcgtacatatgaatgattaaaagatataaaaaatgctcagtaaatgttggtaattatttttgattccacatttcagggcaaatatactgagtatttcatagacttacattattattattattattaatttatttatttgatatggagttttgctcttgtcgcccaagctggagtgcaatggtgtgatctcggctcactgcaacctccacctcctgggtcgaagccatctcctgcctcagcctcctgaatagctgggattacaggcgcgtgccaccatgcccggctaattttttttgtgtttttagtagaaacagggtttcaccatgttagccaggctggtcttgaactcctgacctcaagtgatccacccgcctcggcctcccaaagtgatgggattacaggcatgagccaccacgcccagccaatttacattatttaacacatcaacctgattaataacatctccaatattacaaaagcaaaagctgggtttccataggataagtaactacctcagtgtcaccaaggcacccaatagaggagccaggattcacccccatttagcctgaccctatgtgctgggtaataaggggaaagttgtatataagttcagtagacaaaattaaaaggaggtacctttgggaatgtcataataatgcaacgtacctccttctaactacgtgataaagcattataagtatctagatttgataatatcctgatattggcatctccgaagttattgtgtttcaatagttagcattaattcgaaactaaaatgtactctgctaatgctatctgtgagaaaccactaaaatgttctgctatgattgtcagaaatatgtctttatatgttcatggagagggcaaaggtacactatgaacactactgactgagacacattatcaccccattaccatgttctggttggtgagtaagtgtcctgggaatctcagaagagaaagaggtcctgtgccatcctctccaatatgactatgagttaaggtcatagcaatcaggacttgaaatctaccacgaggggctataagccggttcgtaatttgacagctgctgcatattaaatctaatatcaagagccaaacagtatttctaatcaagtaaatggatgactttttcccttgaaacagaaaaagaagttctgtaaacatgtgtttgaaggacacagaaaaagagagagagagacagaataaattaggccaaaagatatatgaactgttaaagcttgcaattaagacacttgttcttgattatttaaagaaatgagttcagttccatcaacactgaccgagtgccttacatgcccgtgataggcactgtggcaggtcctactaatgcagacacaatgcaggcatcagtgctctattagtccaatggtcatgtgaaaggtaagctatatagttaaaatcaccagatccaagtggaagaaggctgtgacttattcacctcgctattttaataaagaactacattttaacaaacatttaattaaaatgtttttataagaacataacataagcacacagtagcatttattcttatttttgcttttttgagatggagtctcactctgttacccacgctggagtacagtggcgcaatctcggctcattcaacctctgcctcctgggttcaggcaattctcctgcctcagcctcccaagtagctgggattacaggcatgcaccaccacattcagctaatttttgtgtttttagtagagacagggtttcactatgttggccaggctggtctcgaactcccaaccccaggtgatctgcccacctaggcctcccaaagcactgggattacaggtgtgagccaccacgcccagcccacagtagcatttattaaaacctggggttacagttgtcactgacataaagactagtctcacttcttgacctggtagcaactatcaaaaataaaacatagagtctcgggaacaaatggtagtccttcccccttacagaacaatggcaataaatatatttatgataatataatagtcataatgaaaataaacattactgtgttgttatgcaaagaataggttaatctgatgattatacatgcataatatgtgattaaatataagcataatagactatcagttaggttgcagtgatttacctttaagaatatcaaaataaacctccttgatgattacaaaatgactttcctcataaagaagcacagaaagaaagtaatcttgactagcaaaatgaaagctttactcatttgaattatcatgcagaataaagggagagaaaaatgtatctatgttgcaaggagattatacatctttcataacttggctctcaataatacaaataactagaaattttcatattttctttgggaaaaaagttacatatcaacataaccatacttgaactaagtgagtttttgagttttttttttttttttagatggagtctcaatctgtcacccaagctagagtgcagtggcactatcttggctcactgcaacctccgcttcctgggttcaagcaattctcctacctcagcctcccaagtatctgggattataggtgcatgccgccatccctaactaatttttgtatttttagtaaagacagggtttcaccatgttggccaggctggtcttgaactcctgacctcaagtgatctgcctgcctcagcctcccagagtgctgggattagaggtgtgcaccgcggcgcccaccggaacaaagtgagttttgctgtgagaaaggccaaatttcagtaagaaataggatgatcagaatgtaatattcctcacattaacaaaaaaaaaaagcaaacaatattaaactaggatttctaaaaaacaactgagtttcccaggaaatgggaacttcataacactgtccagccaggtgggcactatgtccaggcagtgtccctgtgctttgtgcggtcctgctttgctttattagagcagagctcatttttcttttttttggagacggagtctggctcagtcgcccaggctggagtgcagtggcgccatctcggctcactgcaacctccacctcccaggttcacaccattctcttgcctcagcctcccgagtagctgggactacaggcgcccgccaccacgcccgggtaattttttgtatttttagtagagactgggtttcaccgtgttagccaggatggtctcgatctcctgacctcgtgatccacctgcctcagcctcccaaagtgctgggattacaggcgtgagccaccgcgcccggcccagagctcatttttcatcaccattaacgtacagtgccataaagaaagcttctgggtggcacctggcacacggtgggtgcgcagtaagttgcagctgtcattaccgtcactatgagtgtggaccggatgaaagctgaggtcaccatcctctcactctcttccactcccaccagctctcctccccctgcaaagcaccccacctttgggcaccatggctcatcaatcttgtactgttatgctccagctgaaattctgggatttctgacaaactgtatgactgtgatgttttatcttattacaaattttagtgttctttacatagtcccttatgccataaagcaacacaaacacatacccttgagatagttcacatggggtcatacctacgcagattttaaaaataccaccactagacttttttgcctttttctcctttgtttcattgtaaatatcttcaatctctctctctctctcaaaaatacaaaaatgttacaagaaatttaaaaaaaataacactgatagctcctaccatccataaacagatatattcgtattttgctttctttcttcccagtatttttcttcctcattcacacttctgggaaaagaaaggatagtgactgtatgtttaaacagctgtactcataagtacactttttttttgtcttccctttttaaacatttaactttaaatttaacttttaaaatttaatatgtgttttttctgtgtttcagattatttgcaacgcattcaaaacacatcttttcatggtgtaaccgaataataatgaatgtggctctaagccttcccagatactcataacagcaacatttatattaaaagtagagatacacttaggcttattgttgatatttgcatttgtattctcaatactttcgaccattactagaaatctggtcttgcaactctgtttgttttctcactttaaaacctccctggccattataaacatatattcacatattgctttatgtttttgtttctgtcatggtaatactgtacttgacatttgtatctccaacagcatctggcacagtattgtgcacacagtaggcattaagtaagcactttaaaaactgaactcacttaagggatttcaataaaagggctaactcgttggaaattaaataatttgtgaatgagacaccaagtaaatgtattagtcactttctgacttgatataattttcacgtaagatgtgtgtgtgtgcatgtaaacacatgtgagcttatctccaaaagtgccagatgtctttatctttcttctcctttcctttaaaataaaatttatatgtttttaatagcaaagtaataaatgctcattatggaatttttcatatatatggacaaaaaaggacttttcattgttcatgtctaatagtaatatattttaggaataatactaaccttctgagaccataaaatttccattcagattatttttccaaatgaaaagaaagtatctgagagaaaaattttaaatacctgctgataaacatactaaacgaaaagcaaaagtaatgaccttaattccaactttgtatcaaccttaatctatctgcaaagttagccatctttcttttttttattaagatagtgaaccaataaagcagaaaacaagtggctagtacaacatatttcaaagcatccattgatcttgcggctttcttgccactttccatctgaatcttctgtccaccagtcttgaatgggattgcaacctaaatcagtttcactaaagcccacatcacacatagacagctggctctagtcttaatgaagactaatgaaaacaatgaaagccacaatgaaacccgtaagaaacactgacataacctacagactcatcaagctttcatcagtactctggaatacttttttattatgagtgaattggtgaaaaaacaaaacaaaaacaaaacaccgccatgacccggcacagacgcaacgtgtcacttaggagcacatactctgggcacacaacagcctcatgatgatcattctggcaacgtgggaatggctggccccacagactatcctctccaggcctcgtatcaactagcctctcagcttgggagctactctagttcaaagtcaccaggtctgatgatatcatagacacaggtggtcactgtctcatggggggccctcctctgaaggaacaggagccagattcctgaatggcgcactccttcccatcaggctgtgctcaagatgcatcaggctgagattaggctacaagccccagatggttgttaggaaaccattacaaatggctccaaatttaaggatagaggcaagggacagaggtaggcaaacacagctaggaatacacaggcagaatgatactttcttttttttttgtaagtgtcacatcagaactttgtttttctttataggtacatttttgttagtatcatctaaactggccacatgtcgtgttctgctttgctaagtgctgagtatcctcttcttaatttttttaaattaaatttaaaaaatttttcacggatacataatagttgtacatatttatggtgcccatgtgatatgttgttacgtgcattgaatgtgtaatgatgaagtcagggtatttaggacatctatcacatcaagtattcttaaacgatgcaattgtaagattattcttgtgaagaaaaaaatgactaaaaggaacatttaaatggactcatgttcatctcttctgtgtactctgaaaattttaataccaaatatcacctaatatataagcttttttttccacaatcaatacaatgggtgggagggggttcaccttgaggtattgaatacattaagaatttaggttaaacttcagttaagctaactcagcagtaatttaaaatgtttctacaatgaaggataacaattttgacaattatacagcaagtgtgaaataagtaagtaataataatcctttgtaataataataatcctttgtaataataatcaaaattagtgatattctgacccacattcaaattcctatgtactgaactgctagaaaaaaaaaaaaaggcatgttaggaaaaagaagagattccaataatagcagttagtatacagcttcacagtttacaaagagtcttcaaaaccagaacctcatttttttgtttgtttgtttgttttgagatgttgtctcaccctgtctctcaggctagagtgcaatggcaccatcctggctcactgcaacctccacctcccgggttcaagagattctcctgccttggcctcccgaatagctgggattacagacactcatcaccacgcccgggtaattttgtatttgcagtagagacgaggtttcaccatgttagccagctggtctcgaactcctgacctcaagtgatttgcccgccttggcctcccaaagattacaggtgtgagccactgcagctggcccaggacctcattcttgtaacagctctgtggaataggtaggctatttataatccaattagatgtatttatctttgaactcattaaacacaatttatgaatacttgtttcagggatgcattttctggcaacctcttcagattcagctttatgatgaatatctggttacttgtccccatttgggttctgtggggatttgtacagtccagcattgtgccgatcagtattggaactgctcatcatgtacctactgacttatcacctgcctgcttccaaacaccactgcttcagaatctgcaaagagtaaaacagacacaaccaaaagaggtgtgttcactttttgccctgtacattagataaccacagactggatatatggttatttgatggagaaataaaaccaagtaggtaccctagttctcttcaaccttgacacaacagctttatgtagatgtcaacaaaaattttaaaagattcagaaggatcaaaagagtgggacatagaaaaggatcaacattaattttaaaaatatactttattataagaaaaaaataatgtgtggtgtacaagctgtaaaaggatgaaatgtaatgcgatctcagaatgtatgtcaaagatacttccaaagtcagctaacacatcacgattacaaagcccacaggacataacctttaaatcctctgaacaatcacagacatgcaaggcagggaccatttacagaaggacactacgcgaaatgatgacaaccagaccaaggagagacaagtgctgctggatacgatgtcagctaaagcattaactcttctactgtctgaatgtggaaagcaattatatacgaaacagaattaggggttaattaggaagtataagagcacagcccaggaatatagaagtaaagtcagaaagacccagaggcaagtacaatcagcaaagctatcgagggcaattgggcatctttctagaacaactggttgcatatgaaagaaacagaaaaatttaggttcactaatcaatgacaggtgaaataaactgatcatatgcaactggatggcacgtctattttgtgcttttgaaaagaacctgagaagcccttggtggaatgctacatatctggaaaacaatctatcaatatcaataatgaaagccattccatcaaacttataaactttatttatatattcctcatgtgaaactatggcatcatctctctggactttacacagtacggtttatcactgaaatctcacaatacggttccactgggttcagcaaacaaagggcctattttgtttctggaccagatctcttgccttcaagttgcttgctgggggctagatgtatgaagataatgaggctatgaaagggtgtgtaccaggagccagcgggcccagaggaagggcaactggctcaaactcaagggcagtcacacccaaaggagagtcaggatagggcagggacaggaacagcttttagcagagaaaggaaaattttggtagatattaaaaaaggctaatgtcgcttttgttaagtgtgtttctagataatttattctagaataatctaaccattaaaacactcctttgggccaggcacggtggctcacgcctggcctaacactttgggaggccaaggcagtggatcacttgaggtcaggagttcgagcccagcctggccaacatggcaaaagcccgcctctactaaaaatacgaaaaattagcctagcgtggtggcgtgcgcctgtaatcccagctactaaggaggctgaggcaggagaatcacttgaacctaggaggtggaagttgcggtcagcagagattgtaccactgcactccagcctgggcaacagggcaagactctctcaaaaacaaacaaaaaaaaaactacccctttggaagagtagtcttaaacctttttgctcaaattcttcatgaaacaattctgagaaaatcacatgccctttgcatactttaagtacaattaacagtattttatcttacatataaataattacaaaaatgtagtttagatgtaaagactgcaaattctaaataaacattttagaatctcctaaatatatccaatggatctcaattcatgatatgatatccactattattaattttaaaaatacatgaacaagttccttttaaaagtctggacattttacagccttccccttcctcttttctgtttgaagtctacttctattggattttattgtaatatattttgattcttcaaaatctttcattgttcactccatatacatttctgcaacaaaaaaatatgtatgacttgcatggtaactgaattacataggctagtttattagctagaccacttagaggaatttagtatgaatgaaatgaatatgtcatccaagttcactgttagttacagaatgttcacatgctcaaattgttcctatgatgttaattctaaaaagtacagtggtcaaagcctgaaatacttcctgatgtgactgaacatgatattttttggatattatgtagaaatacttcctttgcttttcctgtgctatagttaagctcttcctttcttagagcttattttctctctgaataatctttcagaaaatcacctgagctgggcgcggtggctcacgcctgtaatcccagcactttgggaggctgaggtgagtagatcacgaggtcaggagatcaagaccatcctggctaacacggtgaaaccccatctctactaaaaatacaaaaaattagctgggcactgtggcgggtgcctgtagtcccagctacttgggaggctgaggcaggagaatggcgtgaacctgagaggcagagcttgcagggagctgagatcgtgccactgcactccagcctgggtaacagagcgagattctgtctcaaaaaagaaaatcacctgaaacataactatgatatccctcatggcaacaaaaaattgttcctgagttttctttttttctttttcttttttctttatttttttttgagactgagtttctatcacccaacctggagtgcagtggtgcaatcttggctcactgcaacctccgcctcccgggttcaagcaatcctcctgcctcagcctcccaagtagctgggactacagatatgtgccaccacacccggctagtttttgtatttttagtagagacgggttttctccatgttggccaagctggtcttgaacccttgacctcaggtgatccacctgccgcagcctcccaaagtgctgggattacaggcgtgagccactgcgcctggcttgttcctgatttttcttgaggtttggctctaacaattacagttattgtttttttttaaatatctttagtgttgctctatttgaataattttagtgttatttttaaatagaaataataatttcactgctaatccaaaagtaaataaaaatcacttttccaaagataaaaagtaaaggagttaaggttgaacatgtgttcctctctgaactagagttctaataacacctatattatcaagtctacttacttttaacaggctccatttgagttactaatgctaatgttaatgaataaataaaaagtttacaaatagattcatacttcatagcaaagaaaataagctcattgaatattaatgtcataatcaagttgtacaatgtatacttttaacttaatccaaaatgccttcacaatttctaacaagtttgctgtagaaactcagatacatctggtgaaaaaaaaaaattccaaatttaattgcctaacactgcttgtaataataagactgtaacaagatacaaagatatcaagaagtcaagactgtagacatctcaaagcaggtcaaataacaacatattaaaacccccttttaaaaatatgtggaattctaaataacttataggcataaaaccacttattatctgcccccttcccgtgaaatttttgaaatcataagacaatggtttatcaatttttctttttcttttttgtatttccacaagtgacaactcagcaacttgtaaatgtttcacaattatgcttcaatactttaaaggtaggctgcaaatacgaaatatttctttattattttctcgctaatcatgtccattgagtgaaaggaataattgttaccatgtgatgtttcttacttcatatttactataatttgataagtagatcaatattatatttcaagtatttccattaagtgtgcaacacagatgctcaaaaggtgaaaggcaataacttcctaggcattgaaataaagcaattgtcttctctgtgactcattctttatagaaactaaagcagaaagcatatgatcaatgttcctgtagtgtgaattttctaccataaaagaaaatgcacacattttatattaatggtggaaatcaggtatctgactatcctagaatagctacccaaatctacccttttcatagaacccaataggcatttaatcttaactacagtcatattgagaggcatggttttaaaattaggacagcagagaaagcttagattctcctggcgctaaagggtgaattatttctaccaggggcccagagaaagggactgacttcccaaggaaaggaagcttcatgcatggggaatccgatccccgccacctcctacatacaagagggtcacagaatattggtgcagaaagacactatactagttccgggtttcagacacacgtgaccttcaagaaatgcagggctcctcccaagtctaaatagttatcaaaaatctaactttaggaaatgttagtgaactagttctagtaactaaaaataaacgaaccattaaagcatgctttcttttatgctactacagtatttgtgttaatttaaacttgattttttctcttaacctctatggaaatggacaaaagatacaatgttaccttatatttatatgaaatgtacgaaagttaggcaatgcttccttatttttttagaatatgtggaaaaaaataaacagggctactaggcattttctcctaggccaaacctggcaagtcgtctattttcctattctccaggataatttaacagactttaaacttttctactattttagatgtattttacgaggtggaattaaaaatgaacattgaaaatggcataactgtttcatatccttaaatatttttcccaactcttctttgaaatggttaattatgcacataaagaatagttttgattcacagatttgactctgctgtgattatatatttgaagacctttcttattatgtgtctatattgtatgaattttgcttgtaatacagtaaatacagttttgtctaattgtttcatgcctaatgtttctgacacgctatttatctgttttgaaatgcaccctccaatcttgattcttactcccaacagacatagattgaacttttatcatatacaattttactctgcacaatcttgatcactattcagtaatatgtggcaatgttaaactccataataacaaaccagggcctggtcccccacagggtgacttccactaagtcctttcaggttacaaaggaactgtcattattcctgtgattataggtaaaaataacctgcaatagaattcattcctagataatgactagtattattttacaactgtctcttttcatccagacataattttcatctagaattataatatattgagcattttcaatggtattttacaaaaaacaagtttttatctgaattaaaattaacgagcctttatctgagttaaaatagaatcacgatggaaatgaattcatttcactgtgaattaaccaacatccactgagatcaaaatcaccatctgtgttgccaaaggaagtgtaatatttgtgcatcagcattttcattttaaattttaactttcttataaatttctgagaaattgttttaatcatatcatggaagtctactatttgaagtaacaaatatatgggccccttcaggaaaaaataggctcctatgcaatcgtttttatttcttaatctactgaaagaaaaaatcttgagtttccagatttttattcatttatatactatttcaaccagccattcaacaatatttgatctgagggtctagtacatgccaggcactcacaactgtgaatacagaagtgaaaaacacagaaaaattgctcctcatggagcttacattttagaggagcttttggaagatgaaaaagataataatagcaagtaaataataattagttctataaataacagaaaatatgaagcctaagaagttcatgaaatagaaagaagttgttgcaaggctgggcacggtggctcaagcctgtaaacccagaactttgggaggtcgaggcgggcggataacctgaggccaggagtttgagaccagcctggccaacatggtgaagccctgtctctactaaaaatacaaaaattagctgggtgtggtagtgcatgcctgtaatcccagttactcgggaggctgaggcatgagaattgcttgacccgtggagacggaagttgcagtgagctgacatcacgccactgcactccaacctgggtgaaagagtgagattctgtcaccaaaaaaaaaaaaaaaaagcaattgcagaataattaaatgattaaatattaaatgattaaatgcaggccaaaggactaatcatgtgcccttccctccagacaaattacagtacgttcaagaatgtaggtatcactccttccctttctactcctatactgaaagagctttgcaagtttcacatattattttatgaggtcccagtatacatcctaaaaatgtaaaaatcttttccagtttccatttctggacatatgatcaattaaactgtaatccttcctgctacaaaacaccagaaaagctggctcggtgataagaagcattttcaaatgttgaagtcatttataaaaagaaatccccaggcagttaagaaacaatgagtggacacaaaataagagctaacccagaagataatgacacttcccctaaattggctagtcccggcaaccagtaggcttgaaagctgtgccctcaaaaggctgtggccttgatggtggaccaggaaagtccacccgacctcacaagcaggacaggttgaatttgcgtgtcttttgtccagaatctgggcaagaaaaatgtctttccagataacagaatggggttcaaattgacatactttcaggtccagacatccttaaacagaaaaaataacaacaacaacaacaacaacaaaaagcagtctcaaccaaataatacgcccggcagaggcaaactcgaaagcatgctggagaaagatcctgtcaaggcaggctgcgtgggttattcagtgacagagcccaggtgaagatgggctcacaagtgaaaacgtcagggtacacgacagcacacgtggccattcttcccgaagatgtcaatcagaatatgggcagaactctgtcagcgtaaatatgaagcagaattcacgctcactgttttatgcttgatgcctaatttcaaccatcaacaacaatagtaacaacaaaacagaaatgatgaaaagtcttctagaatatttacaaagcatatacttcactagtttctaaaggtggaaatcctaagagtcctaaaattattaattcagttaataaattcatccttgaagaaaccatgtatccaaataccaggccaggtaacaaccaatttttaaaatctatttttaattgatgtttcatttatgtacagcaaaatgtacaattcctaagtgttcagcctaataatcttttatacatttatatacccatctcatcccaacacagatcaagatgaatgctttcatcaccccaatagcttccttgtgcctctttccagtaacagcgttccctaactctcagcagtaacccctttcctgacttctatcaccaaaacgtggtgtggcctattccttaacttcatgccatcacgtggtatactcgtgttcagttcctttcaaccagcatagggttttgagttcaaccatattattgtacatatcagtagtttattttttaattacagactaataacccatgatttgattgtgccacaaattgtttattctttcttttgttaatggacatatgagatgtttccaatttggggctattatgaataaagaagatgtgaacatttttgtacaagtctttttgtggacatacacacttacatctcttaagtgtatacgtaagagtactaagtcagatcccataccccaaaacgctgttctgatttattttaatcacagatggtgatgtggtttggatccgtgtgatttggatcacccaaatctcatgttgaaatgtaatccccaattttggaagtggggccagatgggaggtgcatagatcatgggggcagtttctaatggtttagcaccatcctctcagtgttgttctcatgacagtgagtgagttatcgtgagatctcattgtttaaaagtgtgtagcccctcccccttctcactcttcctcctgctatggccatttaagatgcacctgcttccccttcgccttccaccataattgtaagtttcctgaggcctcccaagaaagagaagcctctatgcttcctgtacaacttgcagaaccataagccaattaaacttcttttctttataaattacccagtatcagacatttctttatagtagcgtaagaatggataacatagctagtatcttagtacattttctgttgccataacacaataccgcagactgggtaaattataaattacagaagtttattgggatcccagttctagaagctgagaagtccaagaacaaggcaacggcacctggtgagggcctttttgctgcatcataagatggtgaagggcacacatgtcaagagggcaaaagcatgcgcgtcagcttgggcctctcttcttctaaagccgccagtcccatcatagtggccccaccccgatgaccttatctaatcctaattaccctcccaaaggtcccacctacagtcaatatatgaatttggggatttggtttccaaaacatgaacttttgggggacacattcaaaccacggtaaatgggttttgttttagaaattcatatgtataaaagtataaagtatgtaatatttgtttaaggcttctcttactccgcatgatgatttctgaggttcatccattgttgtgtgtataattagttcgttcctctatcttgctgctgatgggcagtcttgcacaagtacttccgtggacatatgttttcgtttcttttaggttagagaggggccatgtttccctttcctcgaaccctcttcccaactttctctcataagacaatgaatttaaaatgttttctgaagtatagctaggatcttatataaaaaacaattgtacttttcatatatgagcagtacatttttatatatgaggagtacatttttatatatgaggagtacatttttatatatgaggagtatatttaaagggtgaatgctcagaaaatattaataagacacccctagattttactatacatattgcatatttatcagattttcagggaagaattgtgattccatcagtgtcatttatgaatttatcgtatctttaacaaactgcaagttttgacaaggcagtgttccaatctatcatgtgttttctcacctgaagactcatttattcaacaaatatttatcaaacatctattttgtgccaaggattgggagtacaggaacacacaaactattcactccgtagttgaagagcagagggtgtggtacagctaatacagcaggcagtcacatacatccccatgtcataaatgctaggacgggtatccccgcatggtgcccagggagcgtgcaggagagagcacctccgcgtagtcccaaagagtcagaaaagaatccagggagaaacaacctctgggagcaccctgggtcctaaaggctttagccagatgaggtggcgttgagagggagagaagagagaagagaaggcaggtaagggttgtgggatggacaaggcagaatgtttcaggcaaacagagtgtcatgaattaaaagctgggaagcaaggggaggcatcaagtcagtaggagtggagagcagcattgaaggtgagggtaatgaggggaggccacagaggtgggtgaagccagaacactgtgtcttgcatgtggttttggagaattaagagtttgttgtgaaggctccaaagagccactgaggagttggggcagcccaaatgtgtgatttggaatcatcattctcactgcagtggggacacagagcggtgtgggacaaagcaggaacaaaaagacacaaagacacattaagagtccattgtaggtatctgggttagagaagttgttggtcctgagctatcatagaagtgggctagaaagtgaaaacccatgtctattcctttacctgtcttctacaacattttcacatgcaaacaaactaaaatgtatttaatcataagaaaatcaggtaagctcttttcaaaattaaaatataagcctcaaagcaccaatgggtctcaaaagcagagagtggccttttagaaagcaatgggggaacaaagttcgcagctaaattggtgttcttggcttggcgatgcagaaagtaagaggctgcaggacggcaaccatactaagtgtgtcacatcctctccgcctggggttcttggctgacattacccatcacaaggaccgcacagggttggtccaactcccaaaccccagaagctccaggatgcattgctattatgccaacttttagttttcacacaaaacaaaggattttttcttttggttcgtggggtgtttcttatgaatgaattgtgtataactcagggaagagttccctatctgagtatattactgttgagtgacagatttctcagttgtgaattattaaggttgcagagatacctctaaaagtggcaggtaacaactaaaaaacaacagtctgcgaattcctacatattttgctactaaatgacatcagctggagccatagtcctcaggccttaactaccaaaaaagttgaggaaatacatactcgctttctcttcagcttttcccctaagccagaggttggcaaactacagcctacaaaccagatgcagcctgctattggtttctgtagagctgtgctggaacccagtcccacccgttcatttacatgttgtctttgactgcctttgcatgagagcatctgacctgagtagatgggacaaagaaccttacggcccccaaagctgaaaatatttaccacgtatcccttaccaaaacacatgcaggtccctgctctaagcgatgctgaaaaataacatctaaagtatcctgttttctaaatttactgaaacgaataacaatgatcaaacattgaaattgcaaaagaaaagttttaaattccccaaagcaacttcccatatcttctttttactgagatgtataaaattcatgagctgcttgagagagtagagcacgctggaaaccacccgcacgtgccatccacagatgggaagggctgtcacatttctgaaagggatcctgcggaagctgattaaactgttagaaaaccatttaagggagatctgccagaccccaccaacagactcagattttagaggacagatatttcagaggagtttcatgaggcatttaaaagaagttcagatccttaacactgcgaggatggataccaagcagaggctcacgaacacttttcagcagagttattaaccaagtcaacacctccctctgttgcctgacttgaatgcagagacaggtgtgtgagttcgacctgaggaccacactgcaccgcagcaattgcacctgtctgaccacagcaacctttcctctcttaacagtaaagcttcatgtactccttgtacatggcaagtacctgctttcataaatcagggcaagaaatggcaaatctatcttaatttccacctcaaaaagaatcactgagcaccgttttaaagggtctcagcactgatccccttgggtattctctgaggcacctgtggtaatccttatttgtttcgcagcctgtgctgaatgaaaaccatccaagtcaaataccttgctttcccctgtagcttcccccactcagtttgccttccagggctaagacagcatgaagcacagaatattgattggaaaagcactgcagactcttcgtaaagccagccaaattatcatctaccatatatgttcccacatgtaataagaaacctgattgattcataaattttagagcatatttctagaaattaacaaaataaaatcttttctgggtccatgtttttcccccacactcatcccctacatatgaagtctctggtgtgtcagctcgtgtgtgacagacaaacaatagccttttccccacaggccctgtttctttctctctcctttttttttttttttttaacttagaccctgccattcattttcacctctgacagtaaaaccccaggacaagattgtcacaaaaaggattatctttcagatcaatggtgaaattgatttgaaaccccactatttatcagcctccagcaaaagtgcaactggttaggaaatatgtcctttcacactcatgttatgctcagttcacccaggcagcacttcacttcatttcacataaatgcaataacctggccttttacttaaaattaagtcattttccacatagatttctatttttttgttagaatatatgcaaaatgaggattcatactccaaaattacttgcatgtatttctaatcataaagtatatatcacttgccaaaagtgatcttttcattatccttttataggtgatagagaatcctttacttctagcttaatataatagaccaggtatagatgattttttcagttaaattttctaaccctgaatatgaaggctaaaatatagactaaatggaaagctccagtaagaatagagaagattaactaactactttcatcctacttctcaatatatttttggtctcccacattgattcccatattaattcccttaccccaaaacccaagagaaaatttattcaaattaccgacaatgttacttgcctaagagttattttaaccacagagtccaatagcagtgaaattttatcaatatcaactaggtaaaataaacccagaaaacccagggtatcaattccttggtataatttaaataaattaatttaaaactaaaattctagtctgtctattcagtaattcaaaacaccctaagaactcaaaatactaaagacaactgtgtaagtgatttttaataggttgatataattcattaagaaaccaattaccacaggtaaaagttaaagaaacagtgtaagagctcttttagcaagaaatgtttacctgtatacttatatagacatatatgtgaagtactagggtaatgatttattatacccaaacagcaaataaacagctaaaaagaaaacaaatatgtcaaaatgatatattcatatcacgtggccttgtacaaacattttacaatgtctagtgtacaaattttaagttccttaagccagaaataaaagtagacaaaaatttgccaatggcttctattttaagtattcatatttaagccaactatttagactaatatgtattttctcataaaatttgactatattcagtgacaaaaattttatgtaaccaaaatgccactgaattcaaatgcagagattcaaagtttattgttaatcttagattccaaggccatacagcaaaacctttcatccaagattagatttgcatttaaaaagatcaatgtgcctacaatgaacagaatgtttgaagaagaagcaaaatagatgtgaacaaacaaattcgtagattaaccactctatcatcttttgcctctcactgaattacagatgctccttaacctatgatagggttacatcccaataaacccaataaacaaatttaaaataccctaagttgaaagtgaatttaatacacataacttacaaaatattatagcttagcacagcctaccttaaacatgcttagagcgcttagattatagcccacagttggtcaaaattatctcacacaaatcctatcttataataaagtattgaatatcttatgtaatttattgaatacgatattgaaagtgaaaaacaggatggctgtatgggtacttgaagtaacgtttgaactgaaagtgtattgctttcacaccattgagaggtcataaacttgttaagtcaaaccattgtaaaagccagggactgtctgtagttcagtcaagaaaagatgattgattggactagggatagtgatggggaagatggagagtcacagatgggaggaaaaactgacaggacttggtgatagatttgatattgacatgaggaagagagaagttgcaaggcagattcccaggtgaacagttgagcagtatagttatttattattttttgagacagtctcactctgtcaccaaggctggggtgcagtggtgcaaccttgcttcactgcaacctctgcctcctgggttcaagtgattctcctgcctcagcctcccaagtagctgggattgcatatgtcatcacggctggctattttttgtatttttagtagagccaggttttcaccatataggccaggctggtctcaaactcctggcctcaagtgattcacctaccctggcctaccaaagtgctgagattataggtgtgagccatggtgcccagcccggttatttattgaaacaaaaacactggaagaagacccagcttgggagtgggtgggtgggagaagagatcctgattttaattttacacgggtggggtttgaggtgccttttgagacatccaaatgtagaagtcacagacacaaagagatctctgggtctagactagagattgattcatgaatcatttggatactgctagttatgaatgccatggacataaatgacattggtgagagaccatctagtgagcttccaaaaaagacaggaaaacacatggccagaaaagtagaagagcttgtgtcaccaaagcctgaagaaggatgatgctggtgctggatgttgctcaggtggcactggtaaacttggtagaagtgaatactgtggagataagaggttagacaacatactaatattaggtggagacaaagcaagtgagaccagaagcacaactttacccattccagaggtgttactgccaaggtgggaagagagtcagggttgtttccaaagagagagagaaattaaatgagtttttttttttaatgggggaaacctgggtctgtttaaaaacacatggaaaacatcccactgataagatgaggctgaatataaaagaaaagggaggataatcaatagagttaactttcttaataaactagaagtgatgggatacaaagcaaagcaccagtgggagatttgccttaggatgcaaggaagcttggatgggtttaggtaggtttatttgcttggtatcaggaagatgagggagtttccatatgttacttttcatttcccatgtaaagtaggagaagagttcatctgccaagactgagcaggagtctggaaaagagaagggaagaggtatgaaactgttgttgtgaagactgggaagaaaagctgatcagagatgcctagcaagagatgggacaagcagtgctgagagctcatttgaagctggtgttcaaacattaacatagagccaatttgtcctcttgggcgtctttctccaacatcttgtggctgcacaggttgaaaggccaaatagttgggttcttccaagttttgtgtttttacagaagacagcaatgcaaagattgaaaagcaaaggtagattctaggcctactctaacacagagcataaacaatggtgttattgaagttatggaccagggagtcaggtggagaaaagaaaaagggaagactgacgtatcgggagaaaatacaggagtcaatagactggaggtcctaatgtagtcccaaaacagtcccagtgacaggggttgaaagcgtaagctggagtatgttcactggaacaggtgaatataccgacaaagtcaggacgttaatgtaggaccctgtggctcaaggacaggaaaggaagcagtgagaagatgggaggtcaaggtgtcggatgctaaatctcccaggataatgggagaggttcgagtatagacagagattacaaacaaggtgtcaactcttctgtgagcaagaaagaatgtggtgatgacacaggagactaaaacttgaatgacataaacctcaaatgatcatgttttgcaaaaggttaaaggacaaatagtcaagaagcagaaattcagagtaaaaatgtcaccaatcccaattcttggccctgggttagttggatgagaatgtaaacattcatgacttgaagggacacttccaggaaatgggaaacctcagatgtgagccaggatccagctaagaataagagaggaagttaagaacatagggaggcatgctggttatggagtggaagtctcagtagaaaaatcatgcaaaacatgtgtgggtggtcagaagagagtacacagccctttaggactgaagggacaggagggtatctactggggcatgggacaggagggtatctactggggcatgggtcagtagcacaggggagaaagtctccacgtttcctgggagtggatgagcaaaggcctcgcctctctgccagtgaggctctcttcctgagaagagacagtgtgctggcagcaagcactggttctgcaccaccatctcagcttcttcacaaagaggaccaacttccagatagaagagaaaaagaagctagaaagaaacataaaggcaacctcatcaaacccctttcatgtacagaagataaagtgcaggcccagggagcttaactgaccttctcagggtcatgcatttaggaaaggggcaggactaacttgagctcaagtcttttggtacccagaccacaaaggtttctgatattccatctcttcctgacctcgccttagactgattcactgcagacctgaagaagtaacccacgaaagtgggaattaaactggacatttgactcaaaaatatttttataaattagaaattaaacagaaaagaatagcaacttcatatagtttataatcagaagaggagtttgtggcttttaaaaggtaaaaagagtttattttacttacgatgctaaatttactcctatagttatgattcttcattgtcctgaaagtcaaatatcactaacactgatatcaaattgactgtgcattggcctcaaactgcctttttaggtaatctctcattattgtaggatcaaaatcaacattttagccaagcttcaacacaaactttggatatttaaattcttatttttaaatttacattattctttatgaaaattgactactatatttaaaacacataaaatacattaaacaaaataaaactaatgctctacaatgattttattgccacagaaatcttatttatctttgtgtaatctatttcactaggttagtaccagtgattctggcaataccctaagacagaataaatggtaggcagctgtgacatatcacaactaagcgttcttaaacgcataacacagacattaagtaaaaaacaacattagggcgattatacattaattacatggatacgttttggaacaaaagtaatttaaattgcattttccatagtgatactttgaaaattcttaccatttcatgtatgttttgaaatcatttgagatggatgaaatgtaagagaaagaacgctcttacaacaacaacaaagctcatatttacatagcatgtactctgtcaggtactgttataaatgctctgcaaatatgaactcaacccttcttcacaacaaccctgtgtgctaagcactgttgtccccatttagtgacgacaaaactgagacccagagagggtatgtaaatcatccaaggtcacacagttggttagtggtagaggcaggatcagacctcaggaggactgcctccaaaatctaggctcttcaccacatgctatggttctgtcctaagcaggattttatttgtaaaaatagctctagaaatcttactcgctaataagtttataacgaatgtgctgctacgctgttagaggtcactattccaacatggaagcaaccatgtcctgctacgattcctcaccaggctcacatattgtataatattaacaagtaacgttaaactataaaaccatttatacacaaatgaaggatttcttgtggtataatagtaaccatagcaacaaagtaagatgggtttgcaaagtgaaaagtatcctaaggcatttgatgccctcacaaaaagctttctctcaatttacaagaagatgtaaccagtaacagcaaaataatagtaaattttcaaaacagattatattgctatctagattagcaatatttcatgttagcatttttatttctaaaagaacaaggggctatattcaaattgctcccatttacatctctatagcaggaatccttaattcattcgagattttatgataaattttgactaaggtaacattttttaaaaatcatgatatgtacataggttcaatgacaaaaatatgcaattagaataaagttgtaacaatatcacatgcatcctacataagtataatgagtagaaatatatacttagcatacaggagaatcataattatctttagatttatttccctaagaaatagattttattttttgtatatcagaactgattgtgaagaataggcctcactggagaaataatgtgttgaatccttttgtaatatctattggcaaaggaactatacaattgcttaagtaaataaatattaaagactgctagtaccatatatagaattaataaagaaagaaatattaagggagggctctgcttttgctacaggggtttctcgagccttgttctcttcaatgtatatcaatgaatggataaattaaagtagcttattgcttttcaaatatttggatgatagaataagaatacaaaattcagattgctacaatgtgctgatcttattaagctgaagtttaatagaagtaactgtgctagagtttcgaaaaacaacatacaactagcagaactaaggagatttggtattaactgacaacagcttccatacaaatcaacagcttataaccattcacagagtaaatattatcacaggtgtatcaagggtgcattacactcagaaggaaggagccgctaacctaccctacactatcacatcacacctccagtacaagggcattgtatttcaagaaggacacacacactgagggacatttacaagaaaagtgccaggatgatggtggattgttaaaataatttcatgtgaggtgtgtgtcacactgagaaaggtccagttccacttgagaagtttcctgaggtcagggactgaccacatcttagttttgtcatcaataccaagtatgcagtagactcaaggtaaatgtttgttgtacaagtgaagcgattaataaatctaaatgtgcagaaaaagatacttagttatgacaagagtgtgaaaatcttcaaatacttgaaggagtgtatataaagaaatgatacagcggggcgtggtggctcacgcctgtaatcccagcactttgggaggccaaggcgggcgtatcataaggtcaggagatcgagaccatcctggctaacacggtgaaaccccgtctctactaaaaatacgaaaaaaaaaaaaattagctgggcgtggtggcgggcgcctgtagtcccagctactcgggaggctgaggcaggagaatggcgtgaacccgggaggcggagcttgcagtgagctgagatcgcgccactgcactccagcctcggagacagagtgagactccatctcaaaaaaaaaaaaaaaaaaaaaagaaatgatacaaattatttataataatagaacttaaacagaacctccataatagaaccaggaccaaagtgtggaagccacgggaaaacaaatttcaattcaaaagaccatctagtcagggctgtcctaggatggaatgttgaggttcctcatcttggaagggatcaggccggacgaaggtttagacatgttaacactggggaaaatagctttctagcgcagtggaaaccaggggcagagacatcgcggtattgaaccagatttctctcgacaagttaagatgctgacttgctgaggctctgtttggtcctagggaccagatgcagtgagccgagatcgcgccattgcactccagcctgagcaacaagagtgaaactccatctcaaaaaaaaaaaaaaaaaaaaacagcaaaaaacaaaaccaaaccaaaacgttgccttaaactgaagcatacacatcaacagcataagttcttccaggatgatgatgaaaggacaaggcataaaatggttacagtgtccccagagttacgctttccagacgcagccctaagtggtgaaaaatcgtgctcctggagctccctagggagggtgcagcttccaggagagaggctgcacctgcttctggcccacagagggcaccttgctgctcacacatttttatactactggatcattcaattgtaggtttgcaactagtctcttcccaccaacctataaccccttggaagtaaaatgtttaaaatttccactaaccctgaaattttgttactatcaaatattggtttaaaagactaaaattaataccaacaagacataccaattaatcctgacatgttgcctatgagggagatactatcattattatttccactttacagattaataaaatgcaatttagaaatataaaataacttccccatggtctctcagtttgtagcatttggactaaagctgcaggatatccaactccaaaactcaaggttcagccatgatgataagatattccttgcacttagaagcactgacattaaattaagagagagaatgaataacagcagctttaaccaaccaaccaaagtaaacctgttttttagggaatagagaataagtcttgattttttaatttaagggaatttgtgtaatacccaatgagataaatttcaatcctgtattacaatcagtttgactcatattatcttgttgacaaaccatagatttgtaataattctagaaaaatgcctctgttgtgtttcaaactcactacgtcactttacaggcagccacaggtgcagttgtttaacggtgagctgcctgtagagtataaccaagacagctgaactctcattgcagtttactgtaagcttgaagataaataactcattttgcagcaaatgcttctacctcttcaccaacaattacaatcctttagtttttcaatgtacataaagagaactcccctaagaaaaaaatgaaaaaatatacacaaattttgaaagtcatccttcctgagtaggtatccattgtaaacagaatggctgataaaatgccttacagactgaaacgcaagatgaccaagcatgaagatttaagaaataggagtaacaaaaataaaaacaccatataactaatacagtcattatctcagaaataaatgtgtattgcttagcttgaagagtcactaccaaaaaggtcaagatcttaaaagaacaggtactgttgcaatcactgagagggttccaggaaatatacagctaatatgaagaaacaaaaagaagagaaaagtcctgaggttagcaggactagtggaataaatgacaattatttaagaattctgattatgtattctgtaaattatttcttgcatttataaatactgtatttgtaggagtcaaatgattctgacaatattacttttgtcttctcctatagtaatattttaatcataaactaacacctcctaaacatgtaagagatatctgaactttttaattaattaaatcacccagttagttactaggtgagttacctgagtgcctctagggactcaggagatggcggtggcaatggcataaatgagaagggtaagtcatgagggggaagttttgtgccataaacctgtaagtgcaaaatcaggcaaagggccacattgtctgctttacatgccattttagtgtctctctaaaaaatattttcattgcccttgtaaaataatttatatatgttaacttatacatacacttcaatatatttgtgcatcaaatttcaaaagctctagaaccctgaatatatttaatgtgtgcctttaaatttgcattacacctcaaatatataaatgtcaaatatgtacatgaatttttaaaacataaaaatatttttaaggatgccctgtggtctaaatcaaataaatgttcacgaagggaaaggaaggttaggcactagactctactaggccacaacacgtatctgagctttgcctatgaagttttgaatctacaaaaacaacttatctattttccagatttgtgaactctaattgatgaaaactcaagtctgtatttttttaaaaaagaaactgaaagataactagcatagaaagagccatatacacagtttagttggttttgctactgtttatattttgaaaagcaaagattataggcaatgctccacactgtaaataacaattactctatgtctaatccatttctatgcattgagaatagaacacacagtcaagatgtgtccatggtggctttttgctttattctcaccaattaacaggtgattggatatgacagtaattagacacctcagctggaagaagatcattatgtcttaatgagaggattaaaaacaataaaaatgtgcttattgcaaaatatgagcacataccttaagtagcaatagtacaatttattttgtctccaagtttattgtgctttgtcagcccatatcaaaaaaaatttcccaccaacatgtgacttagaaaattacgcaacctaagcatacaattaacaatttttggtgagtcagttctatgttttggcttattttttttgataatgttcactagtgcttctctgacaagttacagttgccacataatattataaatgttatactggtacatttcacattcacccaaaatttcagctatatactcagcagtatacctgctatgtagttcaagataccatctcaaatttaacttcctcaatttccatgagatggattttttttttagacctgcacacagacctatgtacacccttggcaggcactcacagatgcagagtgactggaaggagcacagaaggtctctgatgcaatgcacatgccaccccagcaaggtcaaaagtctcctagcaactcttcttcgggttagagttttgtttccctaaaactgatgtttaattgcatgtgccatctgtaaaggacagtattaatagctaacacctcctcttattccaccattaattaattatcaaatgtgccagcattgagatctgctttacaggaactgaaaaatacagtgtaaaatcaggacaggatagaagagagggacgaagaacgacttgcaaaaccctacttgtcaggggacatgtgggtaaaaagttttgttcattcactcacacactctttcagtcactcattcagaaggacttactgatcacctgttatccacattggcagagtatataaattaatatttaaccaaggtaatcattctttagtcctaaaccaagaagatgctctcataaacattatgtattattgccaatttggaagtaaaacaattctatacccgtatattcaaaaccatgagctgtcacccaggaacctcctaactcatggctcttaaacctataaatattagggtatccaaatgtatccttctctccttcatttaagagacagaatagggtttccctcttttatttaaggcccatttacccatatcctctggacactacccctgaccccactgccttctgaagactttgtgcattatcccatagtagttcatggtagagtatttatttgcttgatagtaagcccgctggggacaagggagcttgcctactttattcttatttctatctctagcatctaacacaccttggcacacaatattaagtcaatcaatccttgctgaataaatagacttagcaatgtgcacaacttctgccccaccccgttgctatcactgtaattaccccattaaatgccataaatattatttataaaaagaataaaacttacactgccttccagtggtaagcatataattgttgcatgacactctatacaatgatacccccccgtaatataactcactacacagtttttacactgaaactgtatccttcttgtattataaaggtgaaatggtatatagccaagcatatctgagcaatggtatggctttttcttgctatcttctatcaatcaatttatttgtacagcacaaaattgctactcctctgaattgaagcaggagaaagccttacataatataacactattctgatacatcttgacatatacattatgtaacagtacttttcctttgctatacttcgcaatataatcgagaaatgctcttttaaagtcagcaacatcagcaggaataagacttttaaatgaagctcctaggaagacagaattctcacacttaaaaacaaagtatttattccacaggaataaatattacatgttttctgaaattgatcaactgcagtgatcaggtaacacttgcattgttaagcagtaagaatgatttcttaaaaattattatttaatgtcatggcattttaagttagatcttaaaatttttaattgataataattgtacataattatgggtacaatgtgatattttgatatatgtatacattgtagaaagattaaatcaagctaattagcatatgcatcacctcaccctacttaccattttttgttgtgagaatatttaaaatctattcttttagcagtttagaaatatataatacattatgattaatattattttttgagacggagtcacactctgtcacccagcctgaagtgcagtggtgtgatctgggctcactgcaacaaacacttcccaggttcaagctattctcccacctcagccgcccaagtagctgggattacaggcacctgccagcacacctggctaatttttgtatttttggtagagacagggtttcaccatgttggccaggctggtcttgaactcccgacctcaagtgatctgcctgctttggcctcccacagtgctgggattacaggcatgagtcaccatgcctggccatataatacattattaactatgatcagcatcccatgcaattattccttctgtctagctagctagaactttgtaccctttgaccaacatctccctatttccttccactccagcctctgcttctatgatttcagcatttttagattccacatacaagtgaaattatgcagttatctgtctttctgtgcctgacttatttcacttagtataatttttatctgaaaaataatttttttttgttatggtcctatgatgaaatataaaaccatagtaataactaacaagtaatagtactaccaggagtactaatactacttaaagtttattgagcacttactatattcaggcactttcctaaggggtttcaatgtattagtgcatttaaaactcagagcagccccagtaacacaagaataatcattatcagtatttattcttccctaggaacctgaggtgcagagatttgaaggaattttcccaggacggcagctgataagtggtagactgagggtttaaacccatgctgttagtgttaaacattattctttctttagtgtctttatactttcatgtgaataaaaataaattactattacatgcctctttctgtctgaaactgaagtcattttttaaaactgtttggagcacatttcagaataggaatgatattcaggatcagccactcaaatttcaatattttaaggaaagggtcttatgaagtgtgtattcaatcttatcaatgcatggataatggtgagctatctggcaactgccaaaatcctactactgtatgacttagaaataaacaactattttaagcgctacttggtaactatgctgccaaccagtttctacactgcctttataggaaataatgtactgtgatcaccaatgactctgtttataataaatcaaatattttataaatttatacaattatatggaaatcccagacacatttctcctttagaaaggcaagcagaaacaaatctatcccgtgttcaggaaagtaaaggttttcttcgtgagtacgctctgaatctaaataagcctcagtccaaaaagagttttactgcagactgataatcccctaggtttataataaaaatgctgacagagctttagctacagcataacaaatgaaaggccataatgttcttctgtcagaaattcctatttatttccagtgtcctaacagatgggctttactgccttgaaactcccccccaaaagttaattgcttgtctatcaaaaagataaacatcttgttttaggctttggggatattacatgtgtagagaaaaaccaatactcgagcaacacattgtgtccgaaatgcattcgcagtaagagagccatactctctcagggcatcagagtaaggaacagctggatgactccaacttcttaaaaagtacaggattctctgcatagtgacactagcatctataatacctagattttagtataccaataaggattgatttactgccacataaatgactataataactttacaaaacaaacttcaaaatgaaggtgaaactcttttagactcttgaaatagtgcctcaagcaaaatgaaccttaaacatatctaatccagtatttttcctttttttttttttttttgagatggagtctctctctgtcgccaggctggagtgcagtggtgagatctctgctcactgcaacctctgcctcccaggttcaagcgattctcctgcctcggcctcccgagtagctgggactacaggcatgcaccaccacacccggctaatttttaatttttttttttagtagagatggggtttcaccatgttggctaggacggtctccatctcttgacctcgcaatccgcccgcctcggcctcccaaagtgctggaaaactatgcgtttactactttagctagtgtacaatagcatggggatctcattctccaaagagctggtttaaatggaaaatatgtagacagcctcttaactaatgattcgcattaaaaaggaaaattatgactttaacacatgcgtattggtgccactaccagattgcacgggaaatgaacctgactgaatctggacatttttgtgttcttagaatattttacttacaaatataacagttgtataaaaagtaataatacagaagtgttggtatctatcctttcactttttccactcacacacacacacacacacacactaccgcagataggcaagcaggccgactgaagcatgttgaataaatcatacttctattcttactgttctgctgcttttttcactaagcaatgtatgatggacatctttgataaaggcctcattcattctgacgaatggacagtttccattttatacatattctacaatgcactttattagttaatgagggtatcttctctctcacaatattttttataaacagaaaggtaatatttgcacatgcattaacatacatgacattgcaatctgatatgcttaaatacatattagacataccaaaatatatcaaatacatattatttcttaactgctttgcacgtgcattctgcttgtcttctatggaagataaagaattgagggatgttatacccattccctccttctttcctattctacctcctgacttctggcatttgtattttacttttatctcctcaacaggttatcatttataacttcaagtaatatatatttaagctgtcttgttgacttatcaaccttaagtcaacatctttttcagtgaaaatgaggaactgctgcgtagacacttgattccactttttccgtgttctgccaccttctggttattgttaattacattattttttttctaacatcaagagaataatttagtctccaatgctttgtgtaaaatttgattctaaaaattaaaactcaacataagcaacatttctagcattatgactactgaatactattcattgcaaaatgtagtagtgtaattagatccttagggaagggattttcatccaacactaatgtgctgctgcataagaaagagttttgaaagtttcaggccttcatgtattatctttttattcccttttagttctccatttagtttcagttttccctttaatttatattcagctatcacttctcctgtatatcatccttttactcattttttttgggttaacacccaacacatttgcatatagatattctttttaatttttaataaagatggggtctttctatgttgttcaggctggcctccaactcctggcattaagcaatcctcctgccttagccttccaaagtgttgggatgacaggcatgagccactgtgcccagatatatattttttaccaatctttgtatttccggtgtgtatgattaaaagttgggaatagaattctatatttaaattaattttctctcaggtctttgaagacactgctttgatagcttctcggatccagtgttgttgatggaaaacataatgttagcctggttttcattcctttgcagacaatctattttagtctcattggaagcttgtggcatcttctttattttgaaatttcatcaagatatctccacatatccagctttgatccagcccgcttgccagacttttacatctgtctattgatgcctatggtaaattgagagcagcaatggccccaatttgtgcctagctttggaagagcccttcccgggttctctgggtttggccacataatttgctttggcccatgggacagtactaaaggaaagtaagtagcgacttgaaaatgcccctgccttggaaattgcactcctgctgctcttaggaatcctgctgccaagagaacaagtcgaggttagcagggtgatgaaagacacatggctcagctcctcccatcaccacaaagatcacagataacggcatgtgagttcaccttctatgagctaatcccagccaatcttccactgaccagagaaacatgagtcagttcaggtggaaacagccacactgcccacatcagaagaatcaaccagccgaatcagacacaagctaaatgaatggtctttgttttaaatcactaagttttgaagtcatgtgttacataacaaatgttaattgacatagactatttcttgagcttataaaatgttgtcatgaaactttattttctgcctttcattgtcttattattttgtattaatcagatgttggacctactgactctattcactattgcccctaactctttaatgttccatttccttatctttctgttttaagtgttcagagttaatcttcaatttatttatttattttttatttactgagacagagtcttgctctgtggcccaggctggagggcagtggcaccatctcggcttactgcagcctccatctccgggttcaattgattctcctgtctcagccttccaaggagctgggactacaggtatatgccaccacgcctagctaattgtattttttagtagagacggggcttcaccatgttggccaggcttgtcttgaactcctaacctcaagtgattcgccctcctcagcctcacaaagtgctgggattacaggcttgagccaccgcacccagcctaatcttcactttaagttgaagaaaaaaacatgtttaggcatcaacagttccctttccattatttggtttaatacatttttactgtgataatcatacttttaatttcctggaaatttcttgttttgattgttcctttttcataacagcctttacagctattatttcctttcaaattctgtttttttttttgttttgtttttttttggtagcagagtctcgctctgctccccaggcgaatttttgcatttttagtagagacggggttttgcaatgttggccaggttggtctccaacacctcgcctcaggtcatctgcccaccttggcctttcaaagtgctaggattataggggtgagccaccgtgcctggccttcctctcaaattctgctgagggtattaattagacacctttttaaaagtttctggtaatccctgaattgtacatgaatcttctggtatcggttgcccttttcattcttctaaatacagtttttccctaaatatctgattgatgattcttggatctgataatcctagttacttttctaagtgaaaaatgacattgatttgtatgggtaattcatattgtttcatctgcactgtgaaatacatgatcccaaaaggcttcttcctggaatgaaagacatgtcaacactcagaacattctgtgggtttcatgagcggaaaagcaggcaggcaggctggtgacacccatgcctgccaagacagacaagttttattttacacgtgaaatgctttatgaacctcccttttttacacgtgaaatgctttatgaaccgccctcctgaacacctttcccacttttccccaatgctcaatgtaggatttcacttcagagaaacaaaacaaaacagaaaacaaaaacaaacaaaaaaaaccttttccattgttttaatgctaccatatgagaaaagagaattaagctagtgtgttgaacctgctgacttaaactggaaacccagtcattaggcttcagcctcaacctcttttttttggatcttgttcgttagcttcttcgggtcataaatgcctcatgctgataacagaattcactcggttttatttttgagagaatacattttgagaatgattcatgtagggaataatttatgtgtgaagaataaagtttccaatatagagatcttattttaaaaattggctttttttcttaatttcagagaattgatgacactttttaaaggatttctgaaatcagtgatcacttagatgaatgttgctattatctgcacacattgctacattaaacgctccagaatttaaagttcgtttgagctttctgacactaaataatatttcgttttatttccaaacttatgaaagcaacataggcccaaaaggacagcagtatattaaaataaaataaggttattttccaatgagaatagagataaatcattttcccaaggagagttcaccaaagctagagactggccgaagaaaagtagccctcagcttcaaagatcaagctaattttaaaacacaacctatctcctgcttcatttgtcttaaatcttaaggctgttgtccaacaggtcatggcagtcaaaagaactgtcatataaaatgtacatctagtaaggccctctctatttttattttaaaacagtgattttaaaaattttggtagaataacctaattatcaaataaaagcttatagaaacccacatacctacacatatataaaaaaactgaagtacagttgttttgcttgagaaggctgaaggtgggggcagagatgcttcacagcctagcttcattcagggtcctgagataccacaaagacaccgtttttctcaaacaaaactgaaatctgccaggcatggtgtctcacacctgtaatcccagcactttgggaggccgaggtgggcggatcacctgaggtcgggaggtcgagatcagcctggctaacatggtgaaaccctgtctctactaaatatacaaaattaactgggcatggtgccgcatccctgtagtcccagctactcgggaggctgaggcaggagaatcgcttgaacccaggaggcggaggttgcagtgagctgggatcatgccactgcactccagcctgggcaacagagtgagactctgtctccacaaaaaaaaaaaaacaaaaaccaaaaactgaaatctactcttctgttacgtgaggagaacaatctgtgtctcatatttaaaatttacaagtatagatacatttttcatgaatatttattaaaaacaattaaataaaaattattccattaactcatttgtttaacatttccatgtaaccacagcaatgcaaagcactttgagagctgcatgggaggtctaagacatggtttctaatatcggagttcaaatagaaatcacatcggaagctgaagccacattgtgtggtgctcacttccacagcagacttgtacagcttgaagtatttaagcagattaactgtaaaggaaaaggaaaaatgttacttagctgcatcttaaaagactcttgggattcaaacaatctataggaggaagacagctaacacaccagcggtagagaaaacacaaacatttttgtttgttcggttttttgtagagacagggtctcctcttgaactcctggcctcaagggctcctcctgccttagcctcccaaagtgctgggattacaggtgtgagacaccatgcccagcaaggacagattttcaagaagagaacacagcagggatgtggtaacaagaggacatctgtgtaactgaagtggaaaataacatatattggagcttgaagggaaataaaattaaatacctaagtgaggaaaatacaattagtgtttcaaccatctgctaccacttcctactatgcccttccttctgggaaggctctatttcccttcttcactcaggtaaggctcttgcataagtgacttgctttggccaatgaaatggaattagatgaaatcactgtgatgtctcttctctctgtcataaggctgaacgtgctccagatagaaccagctccatcagcttctgtcgtggagtgagggcaacttcagccgtgccactgcaaactcacgatgagcgtgtaactgagcgaggaataaatcagtgttgttgaagcccctggatcaattatcactgcagctcagacaatcctcactgatacaatgcttagtaccagatgaaggatgacgttaaagtgaggactgatgtctatctagtgtaggtttataaacagttttcatttccaaacatgccttttcactcagtgactttaacatggggatgggtgatgctgaacttggtcttgtctagccttagtttacatggcggcatggcagccagtgctcatgttcaggaacctaagatgagaaggcaagtgtcttcagggtttactcaatgtcactttctcattaagacttaaccatccatttcaaattgtaaatgagtcccttcctctttttttctactctgtatctccctcccttattgtctttctccacactacttcaccaccatttgcatgtgtgtgtgtatatgtatttatgtatgtgtgtgtatcatgtatatatatgtgtgtgtgtgtgtatatatatataaacttatgtttgcaaaaacatatctaaaacttatataaaatttatctagttgcaaaaacctgaaaattaatacacatctcatagttcctttctgaaaaattatgatctctacatccccatgaagaaagtaagacaaataaacaaagcactaggaaagttactccagttacttcattagcatgaatttgcaagaaagacttcagtctgctttctttaacagataaaatatatcacagttcaggcagaccttgacttacgctaactcgacatatcttgactaatgaatgacttatttacaactgggtagagactaggaaaatccccacatatgctgccaaatacaataggtatcgctggcaaccaaatcagaaccattcccctgcctcacaaaatgatacttaggttaagtgcaatcattgattagtgcaatatttctggtagatttggggttaatctggtttttgcatgctggatggggaatttaccactgttatgttctttcatgacaaaacaaatgtgatgttttaaacaaaaacattttctaatgcatttgtgtaatgtttccatttgaaaggtagagaatgactgtgctatatttgcaaaacacaagacctctcagggacagcataatacttgcacttccaaaaagcttttcccctcaaaggaagacactgtgcccttgagaatgactctcgaattaatcatagaggaagaactttcatttataaattactactcttacatttcacagatgaaagaaacagaatactttataatatttaaaaaaactatctggatatggtggctcaggccgggtatggtggctcaggcctgtaatctagcactttggaaagccgcggagggtggatcacttgaggtcaggagttcaaaatcagcctggccaacgtggtgaagccctctctactaaaaatacaaaaaaatagctgggcctggtagtgggcgcctgtaatcccagctactttggaggctgaggcaggagaattgcttgaaagcgggaggtggaggttgcagtgagccaagatcatgccactgcactccagcctggacaacacagcgagactctgtctccaaaaaaaaaaaaaaaatttaactgagcataagatgattaaaatatagtcccttcacatgtctttaactgcattatattcaataaaatattcattttaaaatgaaaacttgaaagtaactgaccattcaaattttgaacaagctgaagaagcttcaaatagcagataattaccaatgttttaaacgtagtatgtcctggagggaatccaacatcaggataaacaaggcaaagtctctgttctacagaattcaatgcagtgctggagactgagatgcaaccacataatcctatcatctcaaactgaacttcaaggagggagtaactaactatgccctgaaaatgatggacaatttctaagagggcttgatacttgggctctgtcttgaaggatgcaaggtccttccttatgaagaatctaccatacataatagtgcagaggtgaaaagaaagcacattcaggaaacagtctgtgatggcttcacccagaatagagggcattcaatgacctggaagatgttttaagaggttattcaaaaatatttactatcaactcaatgtttgtcataggaaatgattttgtatagaaattatttccccagattgtgaagagctctacgctgcctactttggagtttattttataggtaatgaggagttatcagtggcttgtaaacaggagactggtaggatcaatttctttttctttatttaaggaaggtaactggagttggaggcgagggagactggtgaccaagagattagttaataagcaactataatgactgaggtgagagatgatgaagggtaaaatggggcagttaggcagggtgaacgcaggtgaagaaattatcaccatacacaatggtgtggcgaaacaaataggtggagagacacaagaatctgcaataacttttaagaatttataacttaaggaactgtttgggcatattaaccaataacaatggagcaactagagatgatcagtgggcagttttgaatactaggagagatgtcaagagtcatcacaggacaggttgtagttgaggccaggtcaagagtctaagatgccactgtataggatatagcagtaaaagaaagaacaggaaaacaagagacctaagcagaggaaagggagacatcaaaccactcggtatcactcgagtgatagagccaatgaacatgggctacagggagtaggacacaatgtcatgaggtcgacagaagaaaatacataaggactataacagtctttagaggtagcaataaggaagtcattggaggaaaatttgagagtttgtggggttagaagccagactgtcatgaaatcaggaatgggaaataaggcagagaaaaaaggtcgtttctgaaagttttgatgatgaagacgcagaggaaacaaggacagttggttgagggtaaggtagagttgaaaattaaggtaaagggaacttaaacataactgtatgacctaaagatggatccagttaagaaatcaatgatagaagctataattgtgaggcaaagtaagacagaaataacctcggagatgaagaaaggaggccacccttttttgagcattcaatgtgtaccagatgttttgctgtacactttcagatgcatttcctaaattagctaaatattaccaataagtaggtatcagtatccctaatccatagtcaggaaatgatggagtagaaaggtttattaaaattggaatatctcagaagtgaagatctctatgtgaaataggagacaaatcatatgttccaacagcattaggaatcaagtagtgaaaatggcagagctcccatattgaatgagaaagtgattcttggcagataagacaagaaaaaaaatattcagagtgcatggtaattattgaataataacaaaaagttaacctggaatgattgcattattttcaagcactagctcaaccataagtgtattcttatatataaggtctaatgaatgctttaatgaacaatagcttttcattttgccaaagatacaggaatatggttcaaagtaatgttacctacattaatcctcactagagtttaaccttaacccagtgaaggttaataaggttccctatttctataaggaaactgtactaaaataatgtctcgtactattttacaattattttattatgtgaaaactccatgctgggaatcactaccaaagactaatttaaaactaattatttcagcattaatctggataatgatccataatgaatgaaaaatgaataatctgacatttcaggggttccctactgccccaattcatatacaagaaaatgcttttgctatgcctttcatacatagattaaaccacaatctaaaatatcccaaagtgttgagatacttacaaattatattttagttatttatagactagaatgcataaatctaagtttcaatgctgagttaattaaggaaagtccaattttataacattatttttgcatgtggaaaaataactaatacataatgcttgaccatatggtctgttagtccttttgctaattacctacaaatcactacacaggttttacagctgctatatattattaactgtagcatgttttccccaaagattttattcctctcttcatacatttttgttttaactatgtacaaaacaagttcgtatttttaaaagagtcaattgcagaagactgaatacacaacatatatatatttaaaggaatgatgctttacatttaaattaatgttaattaattgataaaagtttcagcagaccaaaatattgaataattttcttttagtcaacattttaaaattcttcattaaagtctggtagcctacgacacgcaatgctgcagtcaggcattaaaatgttgtaataacagtttctgatatagaaagcaattagctgtttaaaaaaatgatgtatttcatataagccatatctaatttgggacatgtgctttaaacaatgttagaattaaatctgaattttgtcacagaatctagaataattattatgttttaaaagtataatgactgaatagcatgtcagagaaaatggcagaaaattaaaattgaaattgaagtatataattcccaataaaatgcttgcttctatcctcctcagaatactttcattacattctacttctttatccaattggataaactacctagctgcagtgtaaaatcctactgggccaggattatgactgattcatcacatgcgtcaactgtgcacgatggtctgcacaagtaggtgctaaaggtgtttgctgaaataaaagatccatacttttcgaatcaaacaagttcttactcttacggtgcacacattgatttaccaccttagtcatacagtaatagtgtataaaagccaaaaagattactgagtatataaaataattggtatctgaaaggcccttttaactaccaactataaattcttccctaagctttatactgtcctgccaagctaacaggttttcttcgtactaatgctgcacagatcttcagaaaagctgctatcaattactttgatttcccaggctgcccaaactgctaatggaatttagtaattagagttcttttgaaacaatcccaaatctgagcattctgcctgattacaagcagccatcgacattaacatcaatcgttgacaacgtaatatacattggatgtgccagaggtaatcattatctaaaatcctgtttctagaacatgacttctatctagtgaagaacatgtaatggggatttaagattcttctacctccaataactgattctatcatgaatcttgtatacagcattcacaatcagaagcaaagatatctttatctgtaatatttccagtcaatttcatagaaaagagccttgaattctgtcaccattttaagaggccattttgtccacatcttccctttcaccaaaaatgtaatcagatatcaatacattgtaagcatgatactgtcttacacttgtatttggaagcaggttcccaagttgatgatgagcattcagaataataaactttgcaaccagaattgctaacttgtaaagccaaaaatcaacaggaagcaaaatgagtctgaaaagcacaaaaagtaaaaaattttatagaaccatttgcccacagatcaaaaggaattttgatcaaattgactagtataactcaggaaattacagttattagtccttaagcatttccggtagaattctcatcttttccaaagcttcactcaaatacaacaggtcataagacctcacaatcttctcggaacactaatggagctgccacagtatttgaaggacatggtcatctactgtgtacaatgtttctggaggaaaataaaacttttagagcagagtcatctgtattaggtatcaatgagatgtcaggccacctcaggaatgactgttccactacagtccatgtgcactcaaatatattaaatagtctataaattcaatgtcaaaattaaattgcaactgtcaataaacacaaatagaggactggtttattacttctgttatattaaccagcttttccaactaaaaactgcaatactaactctgcgttctgcctggaattccttataagaagggtgctttaagaattgatttttagtgatgctgagcattttttcataggtttgttggtagcttgcatgtattcttttgtgaagtgcctgttcatgtcctttgcccatttttaaattttttttattgtgttttgcttcttgatttgttagattccctataaattctggatattaggcctttgtcaaatgcatagtttgtaaatatcctctgccattctgtaggttgtctctttagtctgttgataatttcttttgctgtgcaagctcagtagtttaattcagtcccacttgtttatttttgttcttgttgcaattgcttttggggacttagccaaaaaatttttcccagagccaatgttgactagagtatttcctaagttgtctttcagaattatgatagtttgaggttttacatttaatctttggtccatttttagtttttttatatagggtgaaaggcatccaggttcagtcttctgcatacagccagttaatcaacagataaatgcaaatcaaaaccacaataagataccatcttataccagtcagaatggctattattaaaaagtaaaaaaaaaaaaaaaagatgtggcaaggctgcaaacaaaaggaaacgcttatacacttacacactgttggtgggaatgtaaattagtccagccactgtggaaagcagtctggagatttctcaaagaacttaaaacagagctatcatttaacccaacaatcccattactgggtatatactcacaggaaaacaaatcattctaccaaaaagacacatgcactcacctgttcatcgctacactattcacaatagcaaagacatggaataaactcaggtgtccatcaatagtagactggataaagaaaatgtggtacatatacaccatggaatactacatagccataagaaagaatgaaatcatgtcctttgcagcaacatggatgaagctagaggccataatcctaaatgaattaatacaggaacaaaaaaaagaaatactgcacgtttcacttataagtgggaactaaacattgaacacacctggacataacaatggacactggggactatgagaaggaggagggagggaggcatgggttgaaaaactacctatcggctactatgctcactacctgggtgataggatccataccctgaactatagcataacacaatattcccatgtaacaaacctacacatgtactcctgtatctaagataaaagctaaaattaaaaatataaattaaaaaaataaataaaaagaactcacttttgtgtaactgtaataagaaacagaagtaggtagaaaagacaaaaataaaacttgaaatgatacagaaaaatatgcccaagacaaaaatccagtttgttacaataatatagcaaatgtccttagatacaaatgtaattggtaattctaatataatacaaaataatcaggctaacttctccattacaagtatattttataatcattttcctgctggaaaacataagcaaagctgaaattcaaaggatttgttcagtacaatcccttgtgaaaatattttttcatttaaaatattaaatagtgttaagtttcaatacttgtcatatttaatttatactttatgcatgtattaattttgaatgtatctttagtacatatcttttaggattcattgctattccttacaacctagatgagctataaaatcaccaggctaaacctttaaaaaaaaaaatgtaggccgggtgcggtggctcatgccttaatcccagcactttgggaggccgaggtgggtggataacttgaggtaaggagttcgagaccagcctggccgacgtggtgaaaccccatctctactaaaaatacaaaaaattagccaggcatggtggtaggtgcctgtaagcccagttatttgggaggctgaggcaggagaatcagttgaatccaggaggcggaggttgcagtgagctgagatcacaccactgcattccagcctaggtgacagagcaagactgtctcaaaaaaaaaaaaaaaaaaaaaaaaaaggatccatttagtcactgggaagggaggacttataactcctaaaactccagtttctagagaaattcaattatgtataaaaccggatttccagaacttcacacatttggctgattttctagttgagaaatcatgtgaattcacacaaacctggaggttgcagattgcctgagttttgtcccacttgctgaatgcagaggcccagtgcaccccatgactggtgtccccagaacagtctctttccgtgggaccctgaatgtgcctgggatgacagaataacatgaggtgggggaggaagggaggagagtttgtgatgtgagggatggcaggatgaagcgagggagggaggaacgtgtgtagctagatgagctaaacaagagactaacgactggaaaactatttttcaacattgccctagacattctaggtgtgagggaatttaaataatgtttaaacattaatcacttctaaataattagaagtggaaaacagtaaaggagaaatgagacagttacagagactgctaagtacatgaaaaatataccacacggtcttgtgtcaacaaaactaaccagcattttacaaaagggctccagtggggatgccatttctttaaaatagtgactcccctgaaacaaaaaagccaaagttcccagaacagcctgtgcattcacctctccatacctgggctttggctgttctccagggttggaatgcatctgcaggtgtggacatctaccctcacaggcctccctgtctaacccaggggccagcaaacattgtctgcaaagggccaggtggtaaatgtttttggctctgtggcctcctgatgctgctggtttctccctcctcctcctcttccttccccacccttaaaaaatggaaaacccaggccaggcatggtagctcacacctgtaatcccagtgctttctccaaggcacaccctgaggactcaaaccacagctgctaggaagctccctgttctgctgtttctaccatagctgtgatcacttcccacagtaaggatacagtcccatacactctcctgcctctctcctccagcatgaatgcacacttcttcaggcagagctttgatgtcttatttagcttgtatcaccagccactagtgcaatggctgacacgagaagagtgatggacatttgctgttgttgctgttattgtttttaagacggagtctcgctctgtcaccaggctgagtgcagaggcgtgatctcagctcactgcaacctccgcctcccaggttcaagagagtctcctgcctcagtctcccaagtagctgggactaaaggcacacgccaccatggccagctaatttttctatttttagtagagacggggtttcaccatgttggccagcatggtctcgatctcttgacctcatgatccatcggccccggcctcccaaagtgctgggagacatatctttatttaattaaacattcttagactccagttttctcacctgtaatattaaacatttatgttccttttaatctctaaaattccctaatttcacttttgagaagttcaaatactgtatcttacctcaagtatttaaataatgagtttaattcttaattctgcctataccaaagaacaaagtatctttttacttgacttgatttcttcctttcatgcaggacagtcctgggtgctcacaagagtcaagtttcacacacaacagctcacggggtaacagccttttatatatttttcacatgtggaaaatgaacatagacatgggtcttgagaagggtaatcaactgcattctgagctaggcattcaatttccaaaataataaatttcctctatctttagtctctgttcccttcccctctttctcattctgggtattttaccagaaaattagaagtctttaaaatcaaatcagtgcaatgaaatgtttggcttttagggtgaaatcaccaatgtgattatatggcaggatcccacatactcaaaaggttcaaatttgactttgcttgattttatatgagactgttagtgtttctgatgccatttttaccctgaaattcaaatattctccaagagtagaccttatgtcgtagctttgttaacattatttcatcttgttattaagttttcttattttattataataatattattaattttcattactctaagaaattatttcttaatttggttgacatttaggtctttcaactgtcattatgatttaagagtttgttgattctcagtggtaatcatataaaaaacagttccaaggaaaacaatttggtgatgattaacagcctctgatgattccaccaataattgtacacaggcagatctgtcacttgacacaagtgagtgcctcagtcacatgattcgcttccggtttgggggcttggtagcctggtctattttgtgtgcactgctctcaaccataatggcacgaggcatgtttggagaaaaagcctcccaaatgaaaaccattatggcatgaggcacgtttggagaaaaaggcttccaaatgaaaataactacttacaaatcatccttgggttaaggaattctgtaaaaattaaaatggttctgttctcctgagtgctgtgactgaaaagtagtggaaattataaaaattaaatattctgaaggcacttgccaaatatcagcaacagctatatattacttacatagtaatataatttgcccacaaaaaagttaatgttaaattgctctaattttcatatactcttaatcttattattggacaatacatttgttttttcttttgcaacaagtcagtagaaaaaaaaaaaatcttagtgacataaatttttgctttaagcccaacatgaaataaatagcaccaaatgtttggctaaaaatagctttgaaatttttgagccatctccacctcctgtggagcaatgtgggggagaaataaaccaaccaataaataagatctagttctgtttctaaccttcccattttacaaatgaagaaacttggcacaaagagggtaaagagatgactgaaggtaacatgccttgttaagggcatcttaatggaatatattagatgaactcaggcaaatctatgttcctgctcaagatcactagagaagttttgtttctgttctccaagttttcacattaacaaccaagagacagtgacttgtgtaaacagtgacacaaaatgcagacatttggtgaatgaaacggaaatgaaataaacacccataaagaagcaaaacaactgggcatggtggctaacagctgtaatcccagaactttgggaggcggaggcagaaggatcccttgagtccaggagttcaagaccagcttgggcaacatacagagactcagtctcatctgggaatggtggcatgcacctgtagtaagtcgggaggccgaagtgggagggctgcttgagcccaggagctcaaggctgcagtgagccatgacagtgccactgcacatcagcctggcaacggagcgagattctgtcccaaaaaaaaaaagatgtggccaggcatggtggctcacgcctgtaatcccagcactttgggaggctgaggcgggcagatcacaatgtcaggagttcaagatgagcctgaccaacatagtgaaaccccatctctactaaaaaataaaaaaaaatagccgggcgtggtggcgggtgcctataatcccagctactcgggaggctgaggcaggagaattgcttgaacccgggaggcagaggttgcagtgggccgagatcacgccgctgcactccagccctggtgacagtgcaagactccgtctgccacctcctcccacccgcccccccccccaaaaaaaagcagcagcaaaataaagttagagacatccaccatcagattgagatttcaggaggtcaaacttgcaaatacacacactggtgcatacacacaactccagctgatgaggagcacaaccaaatattgcttaccattctaaaattctaaacagtagggagagatcaaagtcttacatgagaaacccctgagcacagctgacaggagctggacatacaggtcttcagccagtacggaagcagggctcgactttgaccttcactttgagtcccatggacattccttctatccacacagaatttctagcttgaaatcaggaagaagtaaaaactttgacctcatatttgacttctgtattctcttttccctattaactctgactatcataaaatacaattaaattaaaattatatcttaattaaaacaataattttaccaaatccttgtaaatttggatcattagatgaatgagaaacttgcttttcaccatttagtttcagaacttctttaaaagtcactatttcaaattacttattcctaaatttactttgttgatactgattttcatgcattcatttccaattatggttgaataacaggaaatacaaaaatttttctgcataaaactatggccctaaagcattgaacgccaatgaatgattgaagctccttgaagaaagcatctctaaaagccctcaactgtcaatcctacaatataacgaaggcagatgacattctcagattcctttatatagtttctttcatagtttcattttttaaaaaaataaaagaaatgctgaaatgtgaagttccttttcagcatgcaatttgttctaatgataatgtaattcctctatgtaaggagttccatattatttctttttctccacactgaactgtaagacaataatattatccctatgtttattactaccccttcaactttatgaagcacaaaatgcctcctttcctgttttcttgacgtacagaattttgcttcagtaagcctaagagtttttttccctagcctgtatacgcttgttctgtgccaactcattgtaaaggagccggtttgaaagcttatcaccattaattctgtgactttccaactctgtctccctggtaacagaagcctacaattacgagacaagaacacaaaggatttgccaaattatctaaattctaatactctaacattttatacccttccgcctcccatccatgcatctattgtttttcccaagtctaaagcaatggtcttcatgttagcttctctatcttcagttttcctctggccaagtcatctaaaacacgcattccagttgaatcttttggaaaccttaggactgtcattcttccataaaaaactttcactgcgccccaaaactctcagagcaaagtacaagtacttccgtttggtattctaggatctctatgactgctaactatcccttttttttttttttttttttttttggcagagttttgctcttgttgcccatgctggagtgcaatggcatgatctcggctcactgcaacctctgcctcccgggttcaagcgattctcctgcctcggcctcccaaatagttgggattacaggcacctgccaccacacccagctaattttttatatttttagtagagacggggtttcactatgttagccaggctggtctcaaactcctgacctcaggcgatccacccacccgcctttcatacatatctctatgcttctgtgactttggccactatacgagctaggtcaagtttgccagtcttcctgtgtcttgctacttcacattgctataaacattcttaagtaaacaaagctctgttttgaattaaacatttccaaagcaaagtatttcactagcttcctgattcaccgcatgcttatccctaacaagtatgcttattccttaggattctccacagtcaatggcgccatttccccagttgctcaggcctgttaaagtacgagtttcaacaaagcaaaatcatgattcctatgtaataaaaatcatgtctcttatgtaaataaaaaatgaatgtgtgtcaaagatcttatacacttagtaattaatgaggaagccagtaagatgttaaaaccagttgaaattaaaatttgaagaggtaggtgtttaaaggcaattttacaaagtaattttatggtaagatcacctggttagatatattaataaaatgggataatgtccaacagggcaataaactataatttttaaatcatcttttccaccagatagaaattatctgtatctctactagacaaaaatctgtacattcaccccttctcctacaaggttttacaacacccaaagcaacagaaaatcaaaggtaaaagcctacactgaacggaaaaacactcagtagttgctccatttttgtttcagaaaacttttctgatattctaccccttatgattataaataatcctcaaagattatctttaaagaaaaagtctagcctcattaggtttggtctaattattcacatggatgcaaggcaacaagagtcctaatcaaacacacaggcctcgagtttgatctgaaaatctagagccttatagtattgagcaactatgaaagattaagaattttctgggtagatttttcatcagaggtctcagatttgatttttattatagtcctcatatttttttatgctgagtgtaggagactcagcccaagacgttttctccagcagattttatatatacccataaatctgggtgaattcttctcttcttgatgacttccaaattctctaaggcctctgatctggtaagaaatcataccttctgtgaagctgatgctctgtaagccaagtaccaagtgccaagccagggttcttgggagactctgtaggcactgaatccatacataactagtcttgagaacaggcttccaactaagaacttgctctttaatagggggcttttcacagctgattaaatgagaatcattctcaaatgcgatattgcttgcacaattgatgtttccaattatgctctgataaaaagagagcaagattcttattgaatcttacccaaataactatattgccaagtcaagtcacaaatcttagtaacatagctgtttctgaattctaagggatgagtgagaatgagataccactaaaaatgtttcactgcagtttaccaaagcatagtctattaaactgaggcttagagacagcttgggaaaaaggagaaagggtttcctcatacaaccataaataagagagcattccaacaacagcaacatatctaaacaaataaccacaattaaattagtctcatcagttcatttagtccttagtaattaagttttattctgctggatactgctttcataaagtatgtctgctgctggactgaaagaagtcctggaaatccttagtcactgatacagtctgcaagttgtctaagcaatacctgtttgtaaggctgtgcttgacaattccctgaaggggcaatggttcataatgctggtacaggcctttccacaggttctgaactcccctttgctaaaggtataaactctagcctgaagcttatagcaaagtcaccaggcaaacatcagaagggaaaagagctcttgcttgatggtaagactcatggcgaaggtcatattccaggaacagtattatcacagcaggcaagagtaaatttcttttttgggatagaggacataactatttcataagggtttcccctgagagagaagacatatgatggatagcagaggcactgacaatttccagggtcttctcaaaatgtgtacactctataaaatatttaaaaaaatgaataacattttacttatacaaatttaacctagtgaaggttaagcatctttcctgatttgacaactatcttcatacagttctcacaatagtttgaggtaattaagacatatggaacccatgaaacaaacccaattatttctagtattcttttacttataaagtgaaagaataatctttatgaggccccctcaaaacacaaagatagcattagatgtaaaagacattttacactgaaattttttttttctaaatttgcaatcaaattgtagaaggcaaaaatcaaagtgttgtcagaggaaatttgctcactgaattaggatggaaccatgggggcatgagaaacagtatctggttacctatttaatcaacgtggcaaacagaagaaggcacacaagtaccaggaaacttcagttctttactagtgaggaactttggctcactgaacttcgtgtttgtttacatttatttatcttgttttgtttttgtaaataatcaaggacatgataaggtccacacaaagttgagatgcagaatccttgctacttaggcagattactctgcaggtaaagaatgatcttttgtcactccatccgccctctgttaactctaaggccaatttatcattttaacatagagaagtcattttctagttttgttttaatgtgaagtttggcagtaaagttttcatgagctccttttatttttttatatcttgtgaataattctatcaaaactgaacagaatttaccaaaaaattaacacgtttcattatttctttacagattcagatattataaaaacaaggcaaatacaatttgtttcctcaaacactctatagctagctctccacactcattattctcttcatatgctggaatacactaatacttttctttgggactagtcttgttttttatttgtttttgttttcttacacaaatgcacttacacagttgtgttccttgtcataattcctccttgtgataacagtagtcctaatttttagcagatattacaacttctatttcatagacaaagctgggtgggagataactgagaactgtcatagacagcattttagcagactagcaaagctcaaaaatacacaacacataccttcctaaagccacattcatcctttttgcacattcttaaagtgacaaaaaatgaacacgtttaatgatatgatccataaaataagaaccaaaaatattaaaaaattaacatttgcttaatgttagttcttataatgttctatcttagaaattattcagggatctaaaataatactgattaattagctcaatttaattttaatccaaattttgaagttactctgggccttgaaattatgtttaagctaacattctataaaacataatcactgttataaaatcattggtcaaaactgtaattcaatatatttgaaaacatttcataatctcaaacattatttagaagtaatattatctttttggttagcaaaccaatataagtatagtagtgtcgaaaactcagactaagtagttgcttcatgagaaaaatttaaatcttatgaagaatataatatagtatattatacttaaaattgaaatatcatagaaaagttatataacttttttcttaagaaaaatgattaaaccaatctaatcaaaaattcacctcatgtgaagtcttaaattgtttcttttttagtagtttctgtaagaatattttaagtctagtacaatattaggagatactctgaattttctaaatttcttatattgaacataatttaaatatgaatatttactgaattcattgtaagacatagtatgattgaagaatataggatatggtggattgcgacattttaaattatgggtttaaaagttttgtatatccttatctattttattttctaagacctaaatattaatgcactgacacaataactaatcagaaataaaagttgacatagacataaagacaccacgggtaataagaaagaacaagcagccgggcgcggtggctggcgcctgtaatcccagcactttgggaggctgaggtgggtggatcacctgaggtcaggagtttgagactagcctgggcaacatggtgaaaccccgtctctactaaaaatataaaaattaaccaggcatggtggcgcatgcctgtaatcccagctattcaggaggctgaggcaggagaattgcctgaacccaggaggtggaggttgcagtgagccaagatcatgccactgcattccagcctgggtgacagagcaagactctgcctcaaaaaaaaaaaaaaaaaagaaagaaagaacaacaagcatatttttcactatgtgtaattattttaaatgagctgtcacattttaaatttacctagaaattagaccatttgcaggcccatttcggcggggaggcagaacgacagaaaatcatacacattttccattaatggactcttgctgtgggaaagggtgagctgtcctgaagacctctatccagtgttcataagtttatcactcacctctaataaaaagcaatcactatgtgaatttatagaaaatattaatttcatgtttatttttagcctatgaatatagtggctttcattaatatacaatgtatttttatcatttctgaaaggtttttatccagtgttttgctgaagctttttgtcttctgaagtacactaaattttcaatttaataatttagttcagttaatactcattttacttcgtgtagtaataaattattcaacttattattaccttgtggacttccataatttttcaaattgtagtcagcaacactgtctgcagcagattattaagtaaaaccatatatagaaaacatacatttaatctttcttagatactgtttcatgtcttgctaaacagcagctttggggccaagcacagacggaaattctcccaagcccagctctacctcctctctgactccaagtaggttgaacgctcccactttcagcacattcagtcttttggcaatggagatgcacaagttgcctggaatcataaaaggctcctcggcttgcctatctttctagttcccaggaccctgcctgtgctcctcctcctcctgccacccagatatggctactaagccccaccctcacagtccacaccatcctccaggcagagtgcaccccccatggaaggctctgagctggagaagcacacaccaccagtccagaccacacttggcagtagcaatcagggtcaaaggttaacatgtacttgcaggataaaaatggattctgtcttatactcagtatctaaagatagggctggtgatcaccatcactggagccatcatcactgccagcccgcacagacctaatccctccctgggagaatatgtatctgcagcctaaagtctgaagccttttcccaaagccttaaccttccataaaaaataaccgttgaatattttcagaaaggcaggcactccccacaaaaaagaacaagattcccataaatacggtggtgtatcccctagctggccctaattatagagccccaattttcttagtaaacttgtagctagctaagtaccactaggcaatgctaacctgatgccatttatgaaaaataaatttcagagatttattctgtatgtgtgtatttaaaaatctgaaagcaatacggtatactgcaaagaatatggtttggaaatcctatagatttggttgaagtccctgcactgacactaaatagctgtatgttattggaaaactaccaaaagcttatctaagtaaggcttagaaaaaacagtcaagttattttcatgattaataagatgcatatagagaacttagcatagctcttagaatatagtaatagtcatagtttattgagcaattgctattaatattattgaataccatttcagtgtattcaacttttctttccgtggcttattaatagagtatctacttaactgcatattcaattccatgtctttatttttcatattataacattgtccatattaaaatggctttatttacaattttgttgactactattctattgaatactgacagcctaattttatgaaggtctgtgacctttgctatcttcctaacatgattctttacaggaaattacataaaatatcaaaaaaaaggaaaagaaatattgtaactattgcagcctcattcatggaaaagacagggtacccaaactaaaaatccaagggatgaaatcttcaaggacaccagctgatttttgtgcatcaagaagcaaacagtcactcagttatgcagctgagctatggcaaaccttacctgtcttacagaagacagctaagagctacaataaaagaggtcaattgcagctcttctttcatagagttttctctttcatagcatggaaaaaacaaagtcagggattccttaattatttctctgatcctataaattttttgctggcatagttgtttagctgtatgggccactacatgaaatgctaaggaagaaaaaaaaagtgctttttgaaatactcaaaaattgtcttttgaaaactaaattgtgctttcaaggaaaaagtattcacataaaagtaataatcaacaaatcggatataactgatgagattgtttgatagccaccttgcttctattcacgtactctacgtgtcttctcaaaagactcccaccaaaccccattcttgtcatttccagaatgaaaggagacaaattctgaccctgagccacagtgcataaactttctcttttttttttttttttttttttttgagacagagtcttgctctgtcgcccaggctggagtgcagtggcaagatctcagctcactgcaagctccacctcctgggttcatgccactctcctgcctcagcctccccagtagctgggacttcaggcgcctgccaccacgcctggctaattttttgtatttttagtagagacggtttcaccgtgttagccaggatggtctcgatctcctgacctcgtaaaccgcccgcctcggcctcccaaagtgctgggattacaggtgtgagccaccacacccggcctaaactttctaaagcagattccagttttcccaggtaaaatcacacaaagaaaccaaacatataaaataaataaaaggtttttaaaattaaaatacaaagtttttttttttattttttcatagacagagtctctctcttctgcccaggctagagtgcagtggtgtaatcatagctcactgtggccttgacaccctgggctccagggatcctcccacttcagcatcctgagtagctaggactacagatacatgtcaccatgcttggctaatttttttattataaaaatttttttgtagagatgcaggtctcgatatgttgcccaggctggtctcaaactcctggcctcaagcaattctcccactttggcctcccaaactgcttggattacaggcatgagccaccatgcccagctgaatttattgtttttaaatagaaagtacacttgtgtagcacttaacattgcagatacattctgagaaatgtgtcattaggtgatttcatcattgtgagtacgttatagagtgcacttgcacagacccagctggtatagcctactacacacctaggctgtatggtagagcctcctgctcctgggctacaagctgaacagcatgttactctactgcatactgtaggcaactgtaacacacggtaagtatttgtgtacctaaacatatctagacatggagaaggtacattaaaaacacagtcttataatctcacaggaccactgtcacatatgcagtctgtcattgaccaaaacattattatgtggcacatgattgtattataagaaagaaaacaaaaatggctcataagtccacagccaaggacaaaaaatacagaagtaaaacaaatttaactaggaagctgaaaccatacataaagatacaaaataaagagtaaaagcttcttccccttccctctgagccctctccacaaaggtaaacactgagcaatttctcatcattctctctcttctagagagaaagaataataatataaataataatgtaatataatataaagagagttctctttctagaataatgttgatatattaatccaaatacatgcatcttaaaggtagtattttgctaaataaatttataaattaaatttcaaaatatttatgtgcaataagtaaatcaatgagaacaaacaatctgtttttggagaaaaaacatattaggtcagatgtcatggagggctattttagacttaacaaatcttaacactcattttatttgggtattttaatttggttacttaatattacaaaattgtgattcaaacgcatgagcagatgcactatggaaaggtcttaacagccttaaaaatctaaaatccaggaatctaagtgagaggtagttaagaaagtttggctttaaagctgaattattaataatatatagaagctacctgaatcctttactcatacttatatgtcaaacaagaactattcagggctttctggaagtattaaggtcatgtttcaccttcactttttgtggtacaattaagaaagcatgccagagtttgtagtaattcctgccactcaccaaggaagcagaaagtttgtttctgagctcagtctgatcacaacctcacaattttccctactttatattccttttcttgtctctttcctctgtcaccactttatctatcactcctctattgcaaacaatgaagaagtactttctttctagctatataagatcatgttagagctcccagtgctaggtcctagaaccatctctatatgtccacagtgcaaaaaaaaaaaaaaaaaaaaaaaaaaaagtctacggggcaaaatttgttgagtactagaaaagttcctaaatattcccccacatcacccattcccaactaattacagaaaggtcacaatttattataaatcaacaaatatctgaggaaaggtgtaaaaagacgagcgatgtaaaatggcagtattatataactctactgtattaaatatcacatgtaactacttgacaaaggaaagacagacagccttctccagcaagcttcaaaatgctctgcctaaaaaatagattttataatcacgtttttgtaatatctctctgtactgtgattttacattatactaaatgggattccaatggtcactatgtgtttaaagcatggcagcattctttctatatgcaactcctctgaggtaattaaatccttggtgttctttctttttttatttttttaagatggagtcttgctctgtttcccaagctggagtgcagtggtgccatcttgactcactgcaacctccgcccgccgggttcaagtgattctcctgcctcagcctcccgagtagctgggattacaagcatgtgccaccacacctggctaatgtttgtatttttagtagagacggggtttcaccatgttggccaggttggtctcaaactcctgacctcaagtgatccacccgcctcagcctcccaaagtgctgggattacaggcgtgagccacgacagccggccagtgttctctcttttaaatgtcatcttgacagtttgtgagtaagctccttttaccaacaggcactgatctcatagagtgtgcacaaacatacagccttatatgttatgtgttaacttagctgggctctggtgctcagttaggtcaaacactcacctagatatggctgtggaggtattttgtagacataattaccatctgcaatcagttgactttaagtaaataagtttaccctaaaaaacttgggggtcctcatctaatcagttgaaggtcatatgagcaaaaaccacgtttcttgaagagaaggaattgtgcctcaagactgcaacacaggaaccctgtctgagcttccagtctgccagcctgccgcacaaatttcagccttgccagccgccacaaccatgagccaattccttaacatatatgtatataaacatttctttctctggagaaccttgacggatacacatactaaatctccgtcaatataataatcaacaagtatttattgagtgcatttacatgccaaacactgttctagatgcaggtaatataaccatcaatgaaacagacaaaaatctctattttcatggggcttatagtttagtggtactaagatgactagcaaattgttagttaaggtaaccatataattcatcatacaatccagagcacttttaagataagggtgaaataggatactggtaatgattttgccagggcagcatgtctaacccagagccatctcgacaaaccaggatggtacacatcatctaagtctctagtgaaactgaagcccatctcccccacacgaccatgcatctggctaactgtagaaagtcaaaggtgtatgtcattaatcaaagttgaggaacagacttgtagattcagagagatttgggttccaattctcggttacacattataaaaagtattaaacttttactccagcctgggcaacagtgcaatactctgtctcaaaaaaaaaaaagtattaaacttttatgagtctcaatcatgccatttagaaatccatctaatgtgagaactaatgatacacatatgtacagcatatacagaaagaactggaacctgccagcccttcagtaaagtgcatgtaaagtaagtgattaagccgagcagggctggggattaagtggtgcactgaaaactttggtacatgaatataagtctttctctactactttatttttttaacatatgtgaatgtatgtcattggttttaacatttttgaagaaaagacagaaatctgaacattctgcctgggaattagacagcaaagtgcaccagaaatgatgaaatgatggcaaggctataatttagagcacggacatacgtgactctcaagcggccatttatcactgttaagattgctaaaagtgactttaggtttacctttaaaaagtttcatattcattaaactgaattctacaccaatatataccgaagtagaagctgccttaaaagcaggtccaacaatccttctgccctgctggaaactgttgctaggagacgagagtgaagagaacacttcctctccagtgtgaccacaggagctgcaactgctgcacaccctccacaatgcttttgaagcaggtttgaaaactctctgccggccgggcgcggtggctcacgcctgtaatcccagcactttgggaggccgaggcgggcggatcacgaggtcaggagatcgagaccatcccggctaaaaacggtgaaaccccgtctctactaaaaatacaaaaaattagccgggcgtagtggcgggcgcctgtagtcccagctacttgggaggctgaggcaggagaatggcgtgaccccgggaggcggagcttgcagtgagccgagatcccgccactgcactccagcctgggcgacagagcgagactccgtctcaaaaaaaaaaaaaaaaaagaaaactctctgcctatggctgaaacctcagagagattttaacagtctacaaagtatacagatatccctaggtatgatctcaagagtgagaaaagcttccctttgtctcctaatgtttttctccattggcttatcctagagtccaataatctttgtccattctcttggagtcttcctaacaaagatataaaattaagggaactcacagtgaagatgatctattaattctgtgggaggaaggatgaggttactcacatgtaaggacagcatgggtgtgacaactgtttcagaaagcaaagtcccaaatgccccaaaattgtatttatgttcttttgtttgctggtggagagaatgtgagggaatgagaggtcgagaagatctaaggagaggaaagataagaaacacattgccttttctagataggataggccagagcaggagttcatactgaaatactttattatcctgtgagggttagtcaactgagagcaaccacaatatggctttgtttgtttgtttgtttgtttgtttaaactggaaagaaacactgtgtttccttctgattataaatgtaaggctcattacaaacctccattctcctggtacatttttcagaaaacagagaaagtgaaaatctctcaaatgacactgccactgactacattttgatgtacatcttcatcgatgttccctttgcatgatcacacatacacacgtgcacaccgtaacacacttacgtggaactctgtaagtctgaaaataagacaagttccctccatcactataactaatctatccttctgaaaaggagactccatctattcctgtcttcacttcaccagattaccaaatgctctctcaattattgcattttgaaggagaaagtagtttgaggagacacattaacctgaaacaacctcctccgtaccgaattggtaattatttcatactagttacacctcataaccacaaatattaactcctgtaaataagctttttaaggatcacttttagaaagttatactgtgctcacactgacaagatcctcaatatatgcccatgggaagaaggaaaaaagcaggcttctcaggttacgtaagtggatttagagagtgctctaactcaagcaactttaggcagtgctggtgctgacatatgtgaaaagtgtgaataaaattatttcatgataatgataaaaataatatttctaaattgctatcttttttgtatagttgattttcattcactaataaattaattgttataagtagatagttgacttttgcatctttatccctaaaatttcatatgcataatgtgggccacatacttttaaaaataatactcagatatttagcattaccttatgtcgagatttctcaccctcagtactactgacattttgggtcagacagttctttgtcattgaggtagtcctatgacttgtagaatgctcagcagcttaccagacttctgcccactggatgccagtagcacccctcaatgtaacagccccaaatttcttcagatatcatcaatgtccactggtggcaaaaccgccccagttgatctttatatttagggtcacctcatatttgggcatacgtggtgtctagcttgcctttacaaagctggatcctaaggacacaattttataacctgctcttccagctgactgatatgtcatagcgatcttctcagctcattatgtacatactttcagtgtgttcttaactgctgcactgtgcctcattaacaggttgtgtcacaagtgttgtatcagttaacaattgtttccaatttctcagtaccatagtctctatcatttcatatataaattcctttaaatatgttcaattagttccttatattttaagaccaatagtatccttagaattcattttaaatttagtttaaatatacctgaagtcaaaggattaaaaaaagcaatacaacacaatataaggtcaaaacaaatatattttagattgcttattatttatggtttctacccatgccactcttctattagaattgagaccagccaggtgtggtggctcatgcctataatcccagcactttgggaggctgaggtggaaagactgcttgagctcaggagttcaaaaccagcctgggcaacagctgactgacacttcctctttattaaaaaaaaataagaagaagaagaagaaaaaataaatacaaagaattgagaactaaccccccgataagatttattaaaaattccttctaaatgactaaaagctttgctttttcatcagtattctgagcatctttttcaaatacaaaagatataaaacaggcctttcagagatccatatgtaccaaaactgtatagcttctagcatcttttcctttagaaactctatgtgataattcaaaaccaaaaccaaaaatctagtcaatcaatgatttgaagatattttattactagctgtcataaacaattttaagtgaagtctttgggtttcttgctctagagaattctaactgagtttaaaagatttaaaaatcgatgattgcattgtttttggattcaggaaggatatacaaacagtttaatgagactggaaagaggtccaaagcagtttcaactgtacctatagaacttcttgaaagcatttgctaaagcaaatatgtcaagacatgaagactgattaattcagaatgggagtttgtgtttgtgtgtgtgtgtgtttgtgtgcgtgtctgtgtgtgtgtctctgtgtgtataagcacgttctttgaaatattttaaggatttttcataataattttttaaaaatcaactcataatttaataggatgttgcaaataatcttctcatagaaaatcttagaaaatttctctggaattagcgttaccttttcaatagacaaaatgggtaaataaacattattttggtaaattttgtgtatttggaatcttaggtgatagaatttgtttccagacaacctgggtctgatcctcaattccttacattcacattgaattatttatatggttatttaatttttttctgcctaagttttcccttgcataaaagacaaatcgttataatatctacttcacagtgctactgtgagaatagcagaggaaatgtttataaaaattaccttctaaaatataaagccacagtattctaactggttgccaacagtatctaaatattcttcatagtagttaaaacagattaagaattacagtgtattattcctcagtgttgagcatggccccttttttatcttagtatttataaaacaatttcaatgaataaccatttatacacatacaggcagaaacaaaaactgctttctttgttcaacaagtacctactcactggcactctttttgaaggcagagaggactttaggtacttcacataaagtaagtggttttgtatttcacattatttgagcctatcaaaaaccacatgctataggaaagaatgatcttactaaatctatttcagatataggaaaacagaagtgtcgaaagttaagagacttgtttaaagtagtgataggatcaagtctaacagtcgagcttccacatttgtgacaaactactttgctattattgtagctctccttctggcccactgtgaaaagccatgttcatacacatgtttttaacagttatcaagttatggattaagaaatatcatcctatgagatgcatattaccagtatccccatttcatacaaaggaaaactgagggatagagattaagttatttgcataaaatcacacagctgttaagtaacagtggcaggttttgaacccatgttacctgcctgaggagcccgagttcccaaccacgatttgtgccacacacattcaactggcattagataacaacaatctattttactgtatcagaatatgattaatttatctttcttcataatgataaaagattatccaatagcatcttctaaattgacatttatccttcaaaatttattttcaaatcttctgattcattcaagagaaaacaattttttaatgtttactgtattagtccattctcatgctgccagtggagacatacctgagactgggtaatttattaatgaaagatgtttgattgactcacagttccacatggctggggaggcctcaggaaacttacaatcatggcggaaggggaagcaaacacttctttctaaacaaggcggcacagcaaggagaagtgcagagtgaagtggggggggaaatccccctataaaaccataaggattatgggaactacaattcaagatgagatttggttcgggacacagccaaaccatatcatttacttaaaaaaaaaatcataatctttcaaacaaaaataatgctctagtctttttaattaaaccccaatatgattttctaacaattctgtatgcatagttataccaatgtcaattttaataattagaaaatgctattcatctttttcataaatttcatactttaattccacaaaaaataaaaatatacataatttattattacaatatattaatgattttggcattctgatctacaatatagttgttatgctttaaatatattatcacatttgtattgaataaaaccctgagctttatccgccatgaagtctataaaaaaggaaaatcacaattggattaacccatgagtatttaagaatttccttggtagttttttgattcgtaattgtattccaacactttcacaagtaaaccgtagggatttttgcctccagaaactttatctggcagcctagtataactgtgtggtcttccagaaacaatcgtgtctcctttatttttttaagcgtatatacaaagagagagtatatacaaattaacactaattagcaagtcagaaaagcatgtttttctccctagctcttatgagtgttcatatataatttgctccaaaagaaattttagtaagttacagtactgccagaattactttaatttgatggttttaacagggaaaaaaaggaattatggaaatcccctttggaattcaatcacagaaaggaaagattcaattacttggaaggtctttggcactgtgagatagatatacagaaaatgagagccacacttgggtcatcattaactgtaataccatatggcatttcctcctctgagcttctgctaccatctatttacataaaatatgagctgcaaaccaataattacaaacacacatacacacataaatgagagataactatgctgagtgaaatgtaaactgacttttaattattcattaatagtaatttagaatattaaggggcatgacacaatgttatcctcagggtccctatacaccaggaattcacctcatttcagattaacaacccagtataaaaaggcctattaggcccaaattatataaattattcttgaacagaataggtccaatatcaatctatatgattctaaatgctaatctacattcaaggactaaatggcacaaagtagagcgtacatttacaacagtaccaagcacataggtggcattcgctaacaagagcagttacagaaacattctctctactggcaacttttcagctacatatgtattaatttaagagcaagaactaattcgggatatagagaaacacaacccactctcagtacttttaagtcaaattgttgatcatcaaagattctacaatgagctttaagatccttctcaatctgtggccctacgcagccactaccaactgaatggagctggcaggcaagatggaagttatctgacattttatgatctgtgatctcatcttctcccagaaatcaggatgctagtgaatggcctcaccctccatcccattatttaagctaaaaggtgtatgtcatacttgaacctctctttcacatgtagtccacattcaatccgacaattgaattgcctttctaggcattgaatctatcccattagcactgtctctgccatagcacatgaatgcaagtctgtaattacctcctaccattctttcctgtcccctctaacccttgctcctcactgcaatgagagtattagttttgaagagcacatataatcttatgaccaccaccatcccaacacaatcctgaaacagctttacattcctcttgatcttgaacacagacctttatccttaacaagaccttccaacagctggccttccagatgtattccagcataagacatactccttccctctcccccttgacactccagccatactcctctcaatcccaggcacccaccctccaggtactctcctagcacaaagccttagttaggagctttcctcttctctctgctttgttaaacatctactttcagaactcagctacgctgtcccaggacttctactttacagatgcctgtcgtatcctgccaacttgccataagtttaattttactgacccttgaggacaggggctaaatatgtggtgggcttgttcatattatatgaacaccacctagtacatggcctagcaatggtagatgctaaacaaatcctgcttaaaagctagaatgaatgaatgaaaaaatgaatacattgatgcaattatccatagtagattattatatccttgacagagccagtgttacagaagagttggctcctaattaaacagacatattttgtatattatatatagtattctattcatttgatactattgcatttgttcagtattgcagataaattacaaattaactgcagtaataattacatgtgggtatgatcaaaatccccaaatctatattaacaaacttccttaaaatcaaagttgagtaaatttatatcaactttccatcaatatgtgttttattacattcatttaataattccaacaattactaaatttaaaaaaatacaggaaactaagcaacaaaaagttctcttaagagttttcaggacaaagaatacataatgtttcatctgctaaagtagcaccctggcatccaaaagttgtttttgccatattttcaatgataatttttaaaaattacacttggtaaattcaaatggctgaaagaaaacacctgtaataaatctttctcatggaaatccacactgaaaattagtggaagaccctccatattgtagtcagatgtgaacacccctgtcatgactcatgactgctgccatttcagtatggtctggtgtcagaatatagtagggacatgagggttccaggcctagcacaagcaccaaattactggcaaacactgtcactggaggcttgttggaggcttgtttctgcaactcaaaacctaaaatgacatctctgcctcagaggattataggaagaagatgacataggtattttagaattcttaaaaaatataatactataaaatgtcaccagaacaattctgagattttagagtcatttatgacaaggcatgcaaccagattgccaactcttgtggcaaaatcaaacctctgcatggtacaacatccccaaattccacataatttaaccagatgcacttaaaaatcactgcattgcattggtgccacagttttttgttcctatacatttcttacaatatattctactggtcttaaagaagtttgtactgagcaagcatcatatctattcaactttctttctgtagagtctagctctttatgcaaagacatacttaataaaatgcttgtgaagagtcatacaacgagataatatttactcaaaataagacaaataatattctgcactcatagccatagtaacctatgatataagaaagtgtgttagccgggcatggcggctcacgccagcactttgggagaccgacgcgggcagatcacctgaggtaaggagttcaagatcagcctagccaacatggtgaaaccccgtctctacaaatataaaaaaattagctgggcatgatggcgggtgactgtaatcccagctactagggaggctgaggcagaagaatcgcttgaacccgggaggcggaggttgcagtgagccgagacagtgccattgcactacagcctgggcgacagagtgagactctgtcaaaaaaaaaaaaaaagaaaaaaaaaagaaaaaagaaaaagaaaaagaaaacaaaagaaaaaaaaaagaaatagcctgaagatctgaacttaaatcatctacacatcccattctaagcactaactaggtacttacaatgccaatatcatataagtcatgtgaattgcaagtacaactcaagacaaactatattttaaagatatttaagaaggatttttaaatgggtgcatgtattttaaaatgttatgacatttaaaacaagtccacgtcttaccgattttttagtagtaaaaagaagaaataatacattctatcaatatatacctttggaaagaatcaagctgtaaaacactgaaaactcttcaattttcataggtaatagtggctttagggctttcaaagtataactttttatggattaatcatttgcaatctttcagactttgatcatatattatgaatgttaaatgttataatacctttcttagttacatgaattcaagcggctgttattctataattctaaatacaattcatttctggctatgcctaattttacactttatgccttttttcctttaacttaaatatgttgtttggccaacttccagctttggatttttaaggtttatattggaacaagtttcattccaatttgatttgtgacagataacattgtaagctacttttctatattgcctctgaaaaagagctatttccattcctacacagtatacagattaagaaagttaacataagtaatgtaccactataatttgaaaatattcatcttgttcacgttctctagctcttactaagagatttataatgccactgaaacaagaattgatgaattcatcactgtctgggacattttgatcataatcaataacataattttacccttaaataggatttcaattaatgcatatttttcaaagcaattttcctttaaaataaaatgggtttttgtaccatgagttattaacccattaggtgccaaaaagaaaattattctgtctctgaagttctacatcagaaaaaaaagaaatgaaaccaaactctgttctattatacatttcccacaggtacatttcataaaaaattacattattatattttcatcatggaaaatgaaaagtaatatactttcgtaaaatgatagaaccatgaaagttttattagataaaagtgaggacacccaaatgcattgctactgcttggacagagtatatttatcagcaaagaaaacattttcatctaaacaaaatttatttgtcatatcattatgaaacatcaagaacaatattaaaaaccctgtgaaacttatgccaggcatacaaaatacactctattttatgataatcctcctatcctagccatttcatccattattttcctgttctcactactagaatgttgaaagaacacagatttctctcacacacaatacaaaatagcttccttcaacaaaaataactcaaaattcaaaaattattttaaatgtatagtataatcattttattataaagaagtcaccctcatttttttaagcttcaaagcatgtcctctactttactactttctcagaaataagcctaagtattttaccccttgtttcaatcacaattagctggttcttgctaaatgattcagtccagctccttatgaaagcatgcaagaggctcacttctcacctttccttatgcagtgttctctagttctgcccactaaatctgtttcaccatcacactgtgtctttgtatgcaatttcctctgcatcttctccccttcccatgtagaaaatgtgaactgatccttcaaaataaaaaacacacactattttctcgtagagtcttctatgacccccttggataactgcttccttccctatgattccatagctatttatgcagacctctgagacagtgttcaatttgcattctaattatttatctacttgtttgtccttcctacaagagtaggaggctcctggaggtagaactcattggtccttctatcactagtaaccctcaagattcggtacctaagacattcaacaaagtaaagagatgggatgagtgattgctgtccacatggtctgttcattgatcttaaaaccgtcagccccaaagtagggacttgccaattatttagaaatgcctatctaatctttctactgtattcaacttgtgtaggagagttcaagttcctgggctgggtactcaagatgtttgattttcaaattaaagagatgaaatttatgacactaagaattctgggtgctgagcaacaacattcaactaagaaagaacaagggagggccgggtacggtgcctcacatctgtaatcctagcactttgggaggctgaggtgggcggatcacctgaggtcaggagttcaagataagcctgaccaacatggagaaaccccgtctctactaaaaatacaaaattagccaggagtggtggcgcatgcctgtagtcccagctactcaggaggctgaggcaggagaatggcttgaactcaggaggcaaaggttgcagtgagctgagatcacgccattgcactccagcctgggcaacaagaatgaaactctgtctaaaaaaaaaagaacaaggggtcagggagcaattggccaccactgacttcagtatctcaagttgagttaggaacttaaagaacaagtttctaatgtaatttctgtaaaaattctaatgcctaaaatgcagcaggaagatacagagattaaaatcaggttaaagcaaaactataaagacaagtagtaatgaggatatacaaggtgcaaagacatacagttcccacggacaatgaggttagtaggggttggtttgggagacctggcggtggccttattaggcagggtggggaaccctgagcacagaggtttctttactagaagtaaccaaacagattctaaactctgctctctaacacttgaaggttcctgtgtcctggaaatctttattcaccaaacgcagtttgttgctttgttaaatatgacagggttatggctgaagtaataatctacgcgtatctatgtatttaacatattctttagtccctcacacttttcttgaagcagaaaaaaaggcacagagaaacagttaaatgtgaggcagaaataattttttcttttaaaattaaattgtttattaaaatatatcgaggggatacaagtgcaggtttcttacatgcgtatactgtgtggcgctgaagtctgggcttttgatgtattcatcacttgaacagtgaccactgtacccagtaggtttttcaaccctcatcccctcccaccttttgtattccctaatatctattattccactatgtccatgtgtacatgtttagcccccatctgtgagaacatgcaagcttatatatatctgcaataaacatatgaatgaaggtatctttttttttttaataatttctttccctttgggtacatatccagtaatgggattgctggatcgaatgatagttctatttttagttcttacagaaatctccaaaaaggacaatctgaaacctgaaacggggcaacctgtttggaaaacagcatggagatttttttaatgaggttacttttttttttttttcttgttgagttgtttgagttccttgtagattctggatattagccctttgttggatgcatagcttgcaaattttttttccattctgtaagttgtctgtttacactgttgattgtttcttttgctgagaagaagctttttagtttaattaagttccatttatctatttttgtttatgttgcatttcattttgaagacatggtcataaattatttgcctaaacccatgtccagaagagtttttcccagtttttcttataggattttaatagtttcaggtcttacatttaaatcttcaatcaaccttgagttaatttttgcatatggtgaaaggtgtgagtccagttttcatccttctgcatatagctacccaattttcccagcaccatttattgaatagggtgtcctttctccaatgtatatctttgtcaactaggtcaaagatccattgcttataggtatgtggctttatttctggtttctctatcctgttccattaatctatgtgtgtatttttataccagtatgatgctgttttggttactatagctttgtggtataattgaaagtcaggtaatgtgatatgaggtaggaatgattctgttgcacactgtagagattttctgttccaaaggcttgggttgggggaaagggaggcagaagagcgattgaagctgaagggaaaggtgtgaaggaaccaagagccttgacaagatgaaggcagggggaagcatcttgcactgggagaacaagggagcagagtagaacccgacacccagctgctcccaaatatgcctccaccctacaaaacatcaacccattgcctgtgcacaacccaccagccgatggtcctacattccttatcagctaattcttagcagaaagccttttatatatcagggattgctcaaaaatagttcacatggattaattcttccaatgctcacaataaccctgtgaggcaggcaccattactatctcatttcacagaaaagtgtggcagggaagagttaatatcaaggccacagagactgacactcttctaagcaaggaggtgataacctgaccactgtatgtggggatgagcacgtaaggggagattttgtgctacccaggaagaaactgaacaggaaaaaaaaaaaaaggaaatttccctatgagttgggttagttgcagacatcactgtaaagtttagtaaaagccatcttgaaactgctgcatgtccagaggaaacaatcacaaaacgaagagcattttaaatattgttttaaaatgttttttaagacaggtgttaaaaattactatgattagattagaacttgcactggttccttgtagacagaaaataagtgtgtacttccaggaaaagagacgacaagaggagtaaagcaacaagttagattggggattaagtgggcttcagtttcctcacttataaaaaagagaagatagaattgaaacaaaaccaaaaacaacttctatctgaaacctacccccaactcccaagttacatgaaactaaaaagaaaagcccagactttggatggggagaatgtagctgaattcagttatttgctatactggtgaagccccacaatactttttttttcattttattttttgaatttttgaatattttatttcctctaaaaaaaaaaggtggggggatatgtgtgcagaacatgcaggtatacacgttctggtacataggtatatgtgtgccatggtggtttgctgcacctattgacctgtcctcgaagttccttcccctcaccctccaccctgcaacaggccctggtgtgtgttgttaccctgtgtccaggtgttctcaatgttcaactcccacctatgagtgggaacatgcagtgtttggttttctcttcctgtgttagtttgctgaggatgatggcttccagcttcatccatgtccctgcaaaggacacgatttcattcttttttatggctgcatagtattccatggtgtatacgtaccgcattttctttatccagtctatcactgataggtatttgggttggttccatgtctttgctattgtgaacagtgccgcaataaacatacgtgtacatatgtctttatagcagaatgatttatattcctttgggtatatacccagtaatgggattgctgggttaaatagtatttatggttctaggtccttgaggaatcaccatactgtcttccacaacggtcgaactaatttacattcctaccaccagtgtaaaagtgttcctatttctccatggcctggccagcatctattgtttcctgactttttaataattgccattctgactggcgtggcatggtatctcattgtggttttgatttgcatttctctggtgatcagtgatgttgagatttttttcatatgtttgttggctgtgaaaacttttgagaagtgtctgttcatatcctttgcccactttttgatgctgtttttttttcttgtaaatatgtttaagttccttgtaaattctgtatattagactttgtcagatgggtatactgcaaaaattttctcccattctctaggttgcctgtgcactctgatgatagtttcttttgctgtgcagaagctctttagtttaattagatcccatttgtcaatctggcttttgttgcaattgctaaaaccacatgattatctcaacagatgcagaaaaggcctttgataaaattcaacatcccctcatgttaaaaactctcaataaactagatatcgatggaacatatcttaaaataataagagctatttatgacaaacccacagccagcatcatattgaataggcaaaagctggaagcattccctttgacaaccagtacaagacaaggacgccccctctcaccactcctattcaacatagtattggaagttctggccagggcaatcaggcaagagaaagaaataaagggtattcaaatgggaagacaggaagtcaagttgtctctgtttgcagatgacatgattttatatttagaaaaccccattatctcagcccaaaaacttcttgaactgataagtaacttcagcaaagtctcaggatacaaaatcaatgtgcaaaaatcacaagaattcctttatactgacaacaggcaagcagagagacaaatcatgaatgaactcccattcacaatggctacaaagagaataaaatacctaggaacacagccaacaagggatgtgaaggacctcttcaaggggaactacaaatcactgctcagagaaataagataggacacaaacaaatggaaaaatattctaccctcatggataggaacaatcaatattgtgaaaatggccatacttcccaaagtaatttatagattcaatgctattcccataaaactgccattgacattcttcacagaattagaaaaaaactattttaaattatggaatcaaagaagaccctgtatagcctagacaatcctaagcaaaaggaacaaagttggagacatcatgctacctgacttcaaactatactacaagggtacagtaaccaaaacagcacggtactggtaccaaaatagacatacagactaatggagcagaacagagacctcagaaataacaccacacatctataaccatctgatcttcaacaaacctgacaaaaacaagcaatgggaaaaggatctcctattcagtaaatggtgctggaaaactggctcgacatatgcggaaaactgaaactggatcccttccttacacatcttatacaaaaattaattcgattgattaaagacttacttaaatttaaaacctcaaaccataaaaaccctagaagaaaatctaggcaataccattcaggacataggcatgggcaaagacttttaattattctcagtttattctcaatccagttttaagatgtctataagaaaagaggagggagtagtttttgtttctatcatgtgagatacactgtggttagaatgcggcatgctttataagtctgaggatcattataatggtatataaataacaatgagactagtgaataaatatcctggattttccactgatctggggaaaataagtaaatctgcaaagaagctataattccttggaaaacagatgtgaactaaaatatcattttttaaaaatggcattgtatatacaaatgctctgcaattacttttaagaaacaagttacaggactcaaatttcctatctccacagagcgctaagatattagtcctaggagagcgaaatgtcctggaagccaagaaaagcagagaaaataagaacataaattcaggaggtgaattaaggttgttcacatggagtaacattttataatgcttttatgtcaaaaataaatttgagattaatcattttcccacaaaaaatgttgtacaaactcccatttttaaattatgtcaaggtttaaaaatagaacactcatttttaggctatgttggtaattatgttaaagcactacagtacttcaggaaaataattaatacaatgaggtttcttggtactatgagctaccttggtatctataacctgcatattaaaatttaacaagtaagagcttataacaatcagagtttcaggacaagcaaattgactaattcttgtttccattataaacaaacattgaatttacaaggtggaatacagatgacgtattcaaatgagtttacaaagtacttaggattatgaatataaacctacattaataagaagactgaacacatcaggttactgctaaactctaattacttacaaattaatcaagtacaataaagaaaattatcatttgaaagacattcttgataatactactaagaactgtcaagcttcaattatccatgctaattcagaaagctggctaatcctaaacagtggataatttaacaattctttctattggcacagattatatttctgtgcgtgacaaatttaccttagcaatttgtttttcttagtttaatattaaaaacaagtcttgcttccttgctagatcagaatgcaaagccagccagaagattttttacaattttaaacgggttaattaccaagtatataatccacatatacagtatataaaatctaaatgctgtttaaaatattttagttaagctttcaaccacatttaataaatgcatgttaaggtatgtagattatgacaaaaatgataaaaaggatgcaaatttttttctatcactttgaaagtctgtcaaaatttaagtcatataaagtaccttgtgagttattatttcattttacagataaaactatagaaccttcaagaagtttcatgtggagtgactccattatggtaagtatattggtgtcctatatatatatttaaaatatctatcgcaaacatagatcttttgagttccctctttctcacttttctaacagaaaaatatagcatacacagggcatagtaaagaacatggatactggagcttgaatatctggattggaatctcgattcaccacttagagctgagtaaaaataggcaaattatttaacttcttagagcctcagtttcttcatctataagatggggttaatattagtacttatctcttagggttgttatgaagactaaattaaatgatacatgcaaagcagttggaacagaacctggcacatagtaaatactcaatgaatgttaggatttacatagcattaataagcacaattacttattttcaaatagataactcatagacaagagaggaaaaaaatctatttttctttaagagaagtgtcatatacatttctcaatttagcttataattatgttgattaaaacaataacaaaaatattctttgaaccattagagtaataattttcccctggtgtcaaggttaaagtaaggaagcagatatatcctcagtaaactcatcagagtatttcatcaagattttcacagttatatttagaaaatgaaaagctcataattgtaagattaaaatatgaaactttattataaaaagggcacagattttaaaagataagcagagagatttacatgagaaaagtgcagtatcacatctagtaatagtccaacatctactttaccttgtcattgttactctcccggtggaataaacagaaccatgtcacctcaggagttaatgctggccaagtgccaaaggccagcaatggcaagaaaggctgtggacagaggacctgggctatggctagaagagaatgccagagacggggaaaaactgacagggtaagagatgagacgatgaggacagaggtgctgggccagcagttgaaggagaggggagggagcaccataagtggctgtgtatgggggcgcagcagaaccatccacggtcagaccaacacagtgacaaacagccactcaagaagttcctaaagaactcaagcgttgacacaaaaggatgtgatgaacagcactcattcaggctcccactgtagcatcctgtggcctcgatgagtgggtgtggcacctggtcatgagaagtatctaataggtaggcccagggacataaagtaggaacaggaaggacagacctttcagctgtacttctttcctatatttaatggcacctgctttctaggcatttacttcattctgagagtggatgataatgatgatggtggtggccctggtggtggtggtaacgatgtatcttgacttacaatcatggtttccttcccattttgagatagacacaatgattcccgtttgagaatctgaagtaccaagacctagagaggttaaacaatttgcctaaatggcacaataagtaacaggaaagattgagttttgaaatcagtctctaaacctctaaaatccacagttttttttattataccatctactatttcccagtatacctcaccacagaaaagccaccatatcattgacctaaaagcctgaaacttctacttgtgaaacttaaaaagcatgaggacatcttttttttttaaaggaaacatgttcttatgctcttcacatctgaatagattaatagcaacaaattagaagtaaaatgattatacagacacaacatagttgaagacattaagtgttgtatcttcttgagtcacgattgcccccattaaaaaccactatgttttaaagaggactgtttatttagagatctggatggtaagctaaactttagaattaaggaattcagatttaaccctttgttacttgaatacgtttacatatatatttttaaaagcccttcctaattcaagaacgttaccccatttgcaatctctttgccagtctatgccatgacaagcctcatacacagtttccacttttatgtataccagtgactttctggatgccaataattcatacttccccaaaacagatacttgagaacatgaatcatcctagactattaaattaggagtgcactatcgatttaagaataactgacatgagctaatttgcagctattcctctggtatttggccctcagttggcactacaaagttagaatcctaaatattccaaggactggaattccataatctcttacaaatttccaatcttgtaagagattataggattgagggatggcatatttggcatcaatagaattcaaacgtctcaaatattttccaaattgaaaaagtgtccacttaaatactacacctggacaagaaattaataaatcaccaaggaaagcaaatatatcactttagaagcacatttgcaatttttaagttaaactaacagaaaccaaatttccttcctttgtgctgctaaacatttgacaaacctaaaagtatccttggtaaagtggctaataaactaacagaattaaatatcccttttgagtacaactgattacatgtatgcaagtacacactcagaactctatcaatttcaaactgctgtgaaaagtgctgaattccattctttcagggagatagaaaacatttataacagcaacagccctgcagtcacatctttttgtaactagctctaagaacgaaaaaaatctttatgacaataacaagaaaatgaattttcattttaaaaggcagtccctgtgccatcactggctgtcctgccacccagctcctctgaaggcattcagacccttcactggaatgtctcaaaaatcaatagcaatttattctctctttggaccccaagcaacaaaagtaaataatactgtcacctccagtctgcctgcagaacatggtcacaaaacagccttgccactaaaatacaaccttacgcagctctttatctatgctggcgctactgattgtattggctttcgtaggggacaaatacttcagcaaagccacacaaagaggtcaagctcttgtacctcagccagaaagaatgctgggacctgaattaaaaagaagacttgccaccacctaagcttcctgcttcaacaatgtgggttttatggaagaaaaacaagaatatttattttccaagattattaaaactaaggggaaaaatgtaagattaaatataccatatttacaattttttcctatagaatttaagaaaatcatcagatcactgaagcaattggttgaaccataatattttgcagctaaaatctataggtaggcaatttttatactgtctgataaaagtattaatccataagcaaactacgacttaagaattaaagttctactttgataatgtttaaccaagtaggtgatatcaataccattcgattgttgaagacattatatacactctggaatatataaaatggcattttgaagcaacagaaggaatactaggaataaccaagtataatcttatctatttagagaaaaaaggaaatcaagctctatatgtaacaccagaaaaccagttaatggaagaagcaggactacaatcccgtctaacattcttttcactatactgcttattgatgaaaaattacttataggcatactaaagaagagtcaggccaggcgtggtggctcatgcctgtaatcccagcactttgggaggccgaggcgggtggatcacaaggtcaggagatcgagaccatcctggccaacatggtgaaacctcgtctctactgaaaatacaaaaattagctgggtgtggtggcgcgcgcctgtagtcccagctactcacgaggctgaggcagaagaatggcttgaacccggaaggcggaggatgcagtgagccgagattgcgccactgcactccaggctggcaatagagcgagactctgtctcaaaaaaaaaaaaaaaaaagagtcaaagtcattttgatgacaataagccatcatccctcagggctacaaattactccttaagagaaaaagcaagtactttgaaacatttgtgcagtaatcaaaaattccgaaatcatagaagaatttaccagtcaatcataccagaagtatttactgaatatctgctgtgtacttctcactagtaggaaatacgaaaaatatacatacatgtttaggaaatattaaaatattgaatataaaactattaaataaaataaaatattaaatataaaaacaaaaatattaaaatattaaaaataatcagatgtcaaattgtacagtcaaagaataaatggaaatcaggcaggtgctgagaggaggagagaggggaggtaggttggatgagggacagggaggaagacaggtgacggaggcagacaccagggctgcagactgtgagtgctgggaggtgctgcggggaggatgggcctggcagagcagtggtgcccatgaagtaaagtgaagacagagagtggggccagacactggaagctccagaaatcaggcagaaggacttgaacttaatgtggtagagactccagataatatagaattaaccattttaacttggcaacatcactcctattgttttttggctcactcctagctcaaaaaaacaaaaaatacactaaagatgttgtcttattggtcagaaaaatatgacttaaaaatataacaattttttgaaccaaaaaggtgcttcctggaaatttcatttaaataacaaaaaacataccattgtgaaaaaacttcactcaaaacttacagttttctgataaaattaatatcattaagctaagggagaaaacaaatctctgaatccctcatttttattcggtaacattaaccactttggcaaaaaaaataaatgaacactaggattgggaattttgaaaaatcatgtttaacttttgtactttaaagaagatacaatgaagttgatatactctatcttctataaaactatgaggcatctaaggttaatcattaaaactgattaaatattatatttaaaaacaaatactcatttatgttttttcaaattttagaaagtttgtaaattctgtagtaaaccaaaattcttttctctttattttatgcattcattatagaaagttttgggggaaaagtgtgtgtgtgtgtgtgtgtgtgtgtgtgtgtgtatgcatgtgtatagatatacagacacacatgaataatcatgtgaaaacttatctgccagaggtctactctaatatttgttacaggcctctttctgattttaaaacaatctacagcagagatataaatattttacttatcactgtcaatacatatcaaatgtcttgaaatgactatgtcaaggtaacacagtaactacacttataagaatatatcttacagaaaagattgtggatgtggacagtggtctagcaacaggaatgttcaatgaaatattgctggaaagatgaaaatgggaaacaagtttaatagccaagagcaaagcattcaatatgtaagttataaacatattcatactttttcatttttatacatattaaatatagtcactgcccatccatttatttctcctattttcctaattttgaaaaagagttcccagaatatttgcaaattaatctgtaaacactgaatgatagtgcctgccctgaagcccacatgaggtgcttcgaggcagaaacggtgtgtagctggtgcccagaacaatgcccagaacagcacctgccacagaggacacggtcaacaagtacttaacggagtgaaaataaaaagttaactaaggatttgtaacttacactcactcactttgaaaaaaaacagaagcagtttacaacaaagtatgataaaatgtagttttcttttttaaaacagggtctggcttgcaatggcaggatcttggctcactgcaacctccacttcctgggctcacaccgtgctcccacttcagcctcccaagtagttggaactacaggcgcacaccatcatgcctagctaatttttgtattttttgtagagacagagtttcaccatgttgcccaggctgatctccaactcctgagttcaagcgatccacccacctcggcctcctaaagtgctgggattacaggcgtgagccaacacgcccagcctagattttttttaaatgtaaatcaaagtaagagaaaaaaccaaaacatccaaaccatacagaggaagatggaaaataacagaatcaggaacctgagctcatgccaacactcaatcatacgttcaaactttctgtcaagaaaggctacagcaggactgcaagtgtggcggaaggcggcagtgtttaaaatgtaaaacttcagatcaagccagcaggagtcaaagcctgatttcaccagttgttagcactgtaggactctggagaaatcaatgactttttctgggcctccttttcctcccatacagaatggagctcttatgagagcatcaccatagggttctgagattgacaccagccaatccgtgcacagtgctagttgcatggtgtcagaacacattaagagctcaatgtatgccaaatctgttatattcatcattacagctttgactgtatgcaaaagataccattcagttcttccaagctgcatttatttcatagattcaatatttattgagactaaatatttattttaaaacttggttggatgaagccccaccaatgtcttcaaaagcctaacatggaaatggaagaacagaaataccaacatataacagtgactcaggtgacatgcatagaatagagatgtactcaatgttccctgaagtaagaggaggaaatgatggattactgaggggtacggctgtggggcaatatcacattaaaagtgatgtaggaactaggacatgaaagaggagtcagagtacaaccaagtagggaataatggtattggaaagtcattccaggcagattggacaacataactaaggaaactgaggcatgggaggacacgagaagctgatggtggttgaacactgtgtgataggatgctcgtggaactgtgacagaaaacaaaatggcaacattctgttggggtcaatttttgaaggccctgttgtgcaatttggactttaacaagtaagcaaaggagagccagtttgggctgataatgacatcagtgttttagatactaggattatcatggaagacagattggatttagagagtgggaagaaagaatagaggctaaaacatcaatactccaggcaacaactaatgctaggtaataaataatacagactggaaacaagacaagacagtcgagttggaaagaaggaaacagatgccagcaatattgctgagggacagtcagaagaattagcacacaggaaagtcaaaaacgatttcatggttttgaccttatatggctagggcagtgacaaaattaattaaggatggtaacatagaggaagcacattttggggcggcagagaaagaagactttattttatttatttatttatttatttatttatttatttatgaaacggagtctggctctgttgcccggctggagtgcagtggcgcgatcttggctcactgcaacctctgcctcccaggttcaagcgaattctcctgcctcagcctccagagtagctgggattacaggcacgcaccaccacacgcctggctaatttttgtatttttagtagagatagggtttcacaacgttggccagaatggtctcgatctcttgacctcatgatcccccccgcctcggcctcccaaagtgccgggattacaggcataaaccaccacacccagcccatttttaaatagattgaatttgaggtagctctggaaaacaaggaggtgatgatattcaacagaaagatggaactaagacacagaagctcagaacgtggattgagaggtcatctgtgtaatagatgacaggcaaatttacaacaccagggaaaatttcaaggggacagcatttgaagtcagaaggaaaccaaagtaatgacacttactctatcactaaaaagtatgatatctaaaataaccagtatgcaggacttaaaacaactacaacctacactaaaagatagagagaaacactttaataaatgtagagagatactatgtgtctggatgggaagaataatttgtgtagtcatcaattctctaattaatctgtagatttaataaaattctaataaaaaactgtaatatacttttgggaagcttaatgaaattattctaaagtcatctggaaagagcatctgagaataactatttttaaaagagtaatatgaaaggcaaaactgacctagcagatattaaaacatattgtaaaaattcaataatggaatactgacttatacacaaaaagattactaggttagaaagtccagaaatagacaaaagtatgtgtaattattcaaagcataaaaacctgcaatttcaaatcagcaagaaaaaagataactttaatcttttagagaagcaacatgatgagaaagctttttcttctgagttgtgttaaggatgatggaggtcgtctaagcttttcatacttagagaggaagacactagtaacagaaatacaaaagaaagtgttcagttatcacaaagtcagaagtaaggaagttgtggattctagtgaatgtttactactggagggaatcatggaagaaaccaccaaccataatgaaatgatgccttcagaaaggaaagcgccaagaaggatgacttgacaacaatgctagagacagctcttaagaacagatgttttgatgagtttccatacccaatttattggaaatatcaaaaaaaaaatagcagaggtgaaaaaaataaaactttattgtcagagattgggcttgccaaatttaagatttctgagttgtcagttcagagaaatggcataataaatcagactgcagcagcagaaatgtctggccaggatttgggcaggtcaataacatagatttctgaagttgccaaaagaagtgcccaagaattaaggcagatggggacagggtattgaatgatagcttcctccattactgtggaggcatgacctgtggtaaacagagggagagaaaagaaagaaagagatttagctaaatattttgagcttcaactaaggtaaaaagttactgacaacagaatgtgaggctgagatatgtttttatttttctctccacagtgcctaacacacagtacacatattgtaaaagattatctaagaatggctggacgcggtggctcacgcctgtcatcccagcactttgggaggcaaggcaggtagatcattgaggccaggagtttgtgagcagcctggccaacatggtgaaaccccatctctactaaaaatacaaaagttagctgggcatggtggtgggtgcctgtaatcccagctacttgggaggctgaggcagaagaatcgcttgaacccgggaggcagaggtagcagtgggcagagacggtgcaactgcactccagcctggccaagagaggagacaacatctcaatcaaaaaaaaaaaaaaaaaaaatgacctaagaatcaatgcatgtggtaggaaatgctggaaaaaaaacactggagaacttaaagacaaccccaaattctgatcacagggcataggagataaagcagaatgagtagcagccacatgaaggcatcaaggtaagcagcatcaccaaaagaaagcctggctcagccaatgacgacaggtaaaaaggattaataaaaagacagacgggcaagggcagttcaaggaccataacagctgagctagtgatggaagacttccttttgcacctttcgaataaaattatttcattatctccacaaagattcacttccaggtacttggttattctggcctcccaccctctatatccattagtccccaccgtgaaaagcactgtggagaaaaaaaaaaaaaaaaaaaaaacactctttgcacctgaaattatcatatttaatagggaaaaaaatggaaaatattttccaactgttgtttatttctgaatttcagattttgttctcaattatactggcctggaactctgtcagaggtgaatatactcagacccatatgactgatttacactagaaagctagtctgtcgattgctagtatgtaatgcaattgtcaagctgacccacgtttgtataatacctgcatcaactcaggaggtgttggctagcttgcaaattttctttgaaaaagcgcttacctaggcaaaggacaacgtattttttgaaagctctattgaggtctgacacacaataaatcacatatatttaatgtgtacaatttgacatatttggacatatacatatacccataaaaccattacaacaatcgagataatgagtacatcacccccagtagattcttcctcccactttgtaatctcttccttctgcctctccctgacatcctcccaccctccactcacccatttgaattacagattagtttgcattttctggaatttatacaagtcaaatcacacagtttatattcttttgtctggtttctttccttccacacaatgattttgaaaatcatttcatgctgttgcatgtatcaataattcccttttattgttaaatagtattccattgtatagtatacaccaatttgtataaccattcacctgttgatggttattggagttattttcagtctttgtctattacaaataaagctgctatggatacttgtatgtgagtctttgcatgaacatatgttttcatttctttggggtaaatgtctaaaagtagaatggctatgtcataaggcagctgtatatttcactatataagacactgccatactttttcccaaagtggtttctccattttccattcccatctgtcatgtatgagatttccagttactctgtatcctcacccgtacttggcatctttcaaatttcagaattctaataggtgtataatagcatttcattgtggcttcaacttacatttccccaatgactaataatgttgggggtatctttgcatgtgtttacttgtcatctgtatactatctttggggaagtaactgttcagatctattgtctatgttttattgggttgttttagtatttattgagttttgagagttctttaaatagtctaaatataactccttttatcagatatgtaatttgcaaatatgtttctccaagtcctgacttgtcttttcattcttttatcaatgtggttttttactcgtttgttttttgagatggagtctctctccgtcacccaggctagaatgcagtggtgcgatcttggctcactgcaacctctgcctcctaaattcaagcaattctcctgcctcagcctcctgagtagctgggattagaggtgcccagcaccatgctcagttaaatttttgtatttttagtagagacagggtttcaccacgttggccaggctggtcttgaactcctgacctcaggtgacctgcctgccttggcctcccaaagtgcgggattacagacgtgagccactgtgcctggcctttatttatttatttatttatttatttatttatttatgaatgaatgagacagtttcgccctgttgcccaggctggagtgcaatggtgcaatctcgcctcactgcaacctccacctcccgggttcaagtgattctcctgcctcagcctcccgagcagctgggattacaggcaccctccaatgtgcctggataatttttttctgtacttttagtagagatgggatttcaccatattggccaggctggtcttggactcctgacctcaagtgatccgcccacctcggcctcccaaaatgctagaattacaggtgtgagccaatgcacacagcaaggtgttttgaagagccgaatttcttagtgttgatgaaatccagtttataaattgttttatttatgaatcctgctcttggtattatatctaagaaatctttgactatttcaaggtcatgaagattgtcatttggaagtcttatagttttaacatttaagtctattgtttgaaaaaggacattttttctaaatatgtcttaactgacatattactgacagaagtaagtaaccacacctattaatgaagttgcagcatcagcatctcaactattctgggagacaatgtaggccaaatgttccctgatattatgttgataataaccccttctcaaaagggcgaatactttacttcagtatcaataccaaggaaggaaaaactgtggtgtgagagttctgctccctgggtgccctctctattttgcctctgacccatgaaactttaaaaatgaagattatgaggaagaacaggccagtgaggtcagagtcatgggttaaagccttagggtcagcagtctgaggatcttcattttaaattttcccctactgtaactcccttgctcattgtttgggtatatttcctattcaatgttaatgttaaaatatcactgccatcttgttttttctctttttgtttctgatcctatttcctttcattaaaatgttattttctgttttcccaaaattattaaatacatataacacattttcttttcttcctcaaatattattaagtatagatacatatacacttaatatatacttaattaagcatatatatactaaataatatttgaggaagaaaagaaatatatgtttatatgtactatgtacatgtatgtgtgtatatacagatacatatatacttaatatatacttaattaagcatatatacttaatatttgaggaagaaaatacagatatatttatatgtactgtatgtgtgtgtatatatatatttaatatttgagaaacaaattaaaaaacatatatactatatatatgtacacacatacaggtcatgagatcaagattattgtcatagaatccaaatctagctagaaaacacaaaatttaattcccactgcaattttaaccccacagatgagccttgataaagtaatgagagagcaataagtagcttatcttttagaggtaccagatctgtttctagtcctaaggcatttcagtagaatgcttatttcaataaactcacttaatgcaaaagataagatcataaaggcttgtaaatcaattttttttaaaaactaaaacataaattcactagtggagctcactatttaggtaataactctattgaaaacacttttatagagtaaataatcactccttctcataaattcaggtttacatctgtaggctttctttaaagcaatcttcagtgaatcattttctgaccactgtgtccaaaataattttttaacactgcacaaaaggagatatttaatataaactgttttccgaattgtccttattattgttttcacagcagccacaatgtgattaatattggaaaaggcaccattatattcaagcctcactttcaagtagataatattttaaaacataagacacaaataaaacaaagttattgcaaaaagttggcaaaatatagaaaatctctcgtttggcctctcactttcacacgtgtttttgaaaaagattccaggaagactcctctgtgctcaacagcacagaacagcacatgcactctgtttccttttcttcatgaaaaatcgtaagaatgtggaagaaaaatagtttattagcaaaaaatgcagaaatgtaccaaagaaaaattcttttgtaggacttctaactctataagttattaaaatagatacaactcaggaaaaatttatcatgaaatcaaatatgacagaaattaaagaaaacttaaaggtgtgttggatgcctgaagttggtgttgggtgatgaaattgaggcaggagaatagagtctggaggcagggaacctaaagctgtttcacactgacttcctaaaactaaattgaaaggaaaaccctaactttccacacctaagtaacaaaaggaccagagactactccctttgcaaacccccaccttgtctgcatggtagatgggaaatttaaagttacataggagtgtgacctttgtaacttttcccttcagcccctgattactgtctacagccaatcaaaatgattgtgggccaagccttcatttgcatagaagtgcaactttgaaactttagcctctgattgattgcataaagcataaagcaatcaatcagatgtttgcacaggtgtgtgacctttgtaacttcatttcagcctctgaatggtcgttttccaaggtgaacaccaagtggccaatgggaaacctctagggggtatttggacccaagaatattctctatttgggtccaaatagacccaactcccacccgctcccaccctgtggagtgtaattttgttttcaataaatctctgcttttgttgcttcattctttcctttctttgtttgtgcattttgtccaattctttgctcaaaatgccaagaacctggacactcgccactggtaacaaaatgaatatttttatatgtgacagtattttagaaaataatgtgactatacatattcatatacatatacatagccttaaaatgttcataccctttgactcagtaaattttatttatctgaatctaccagagattttcaaaaacaatcctaaatttggaagaatttcagccatacaagtgcatatagtagtgctgtgttggattgcagcagtgaaaacatcccagctatgcaaccacagagaactggttaagaagatatggtattattatatatcccaaaggaatataaattgtcctaccataaagacacaggcactcataggttcatcgtagcacccttcacaatagcaaagacatggaatcaacctagatgcccatcaatggtagcctggataaagaaaatgtggcacatactatggaatattatgcagccataaaaaagaatgaaatcatgtcctttgaagcaacatgcatgcagctggaggccattatgttaagcaaattagtgcaaaaacagaaaaccaaataccacatgttttcacttataagaggaagctaaacattgaatacacatagacacaaagaggggaacaacaggtactggggcctacttgagggtggagagtgggaggactgtcaggactgaaaaactacttatcaggtactatgtccactacctgggtcatgaaattatttgtatatcagatcaacaggcaatcatgagtgcaccaaaccaacatgcaatttacccatgtaacaaactggcacatgtacaccttgaacctaaaataaaagttttaaaaattaaaaaagaagaaaaaaaagaacatatggtagattctattaatttggtagaccattatgtaggtaataagggtacatttgcaaacagaagaatcccaaaatgaaattttcagatacagaactatacaaataaggtatacagcttatattaaaaatgattcatagaattaaaatgactgtgagaatattcagtatcactaaaaattcaaacagtagttttattggagcaacgacattacaataattgttatttttactttcttgtattttgcaaatgttatttaatgaacacgcattattatgaatgcaaaacagctgctatttttaataagagagccaagaaatacaaatatgttcatgcttcttcaacagtgaagcggggaggactttatcttattctaggcctatgctgtccaaaagagtaatcactaaccacagacggctatttaaagtaattaaaattcaaactttagttcctcagtcatactaactacattttaagaggtcaattgccatagtctactagtatcagacagcagagagaacattttcatcgtcagaaaattctactgtgaacgagctgttctagataattggcatgggatcatagaagataacctacaaggaaaggataattcataagatgcaagactctgtagttagtctacactaaaccagcaaccttagtctattaagaaagcctgttctacaagatggactatgctatataaataagtgactcacagatcattagcaaagtaactataagtcattaggtttttggttagtttcctggggatgttattttggtatctgataaattcatacaaaaatcacgtctgttggaagtttatgaatgtaaaaaaactataattactctaagatggaacaattcctccaacatgcagccttcctacagagtaaacaaatttgtctttgtcttataataatcggttgtcttgaggaggcagaaacaggaaacaaaaagacaactttggaaataatactttttaaaacttttttcttttaaaaatttctgggaaaaaaaggcaagaaagaagaaagaaattcatttgaaaaactagctcttcaaaagcagtaccaaaatcacttaggtggataaatgtttaagagtgaaaaaacgtacacctttctttatttgagaaagtagaatagtatgaagaaataagaatgcaattcaccaagccattattaatgaagggcttatctactagagtattttgtgcagttggtattccattacatataatacatttcccattagaatgtttatttaattttcttgatttaccctcatcattgtacgaagatgttccaatccattttaaattaataggctgtcttcatttcaaacatgcaggctggattttactgacataatgtgaacactacaaaaagctgtttatctttgttgaagtatgccaagatcctctgattttttttttccagtgttttctacccttgagatttaaaactgaactcttcagccaggaaaatcaaggcagcagaaagtgtaactattaagatgtaagttgcacttaaaagtgtttcaatgccccatagctttccatacagttcaaaaattatgtctagtttttaagattattaaatgttacttagaggtgggaattttatcaccacagcaattaatatcagtggaaaaccctaatacagcataagttgaatgacaacctttacaatgtatccatttagagagggtgggaaactcaggaaaacaagctgagtatttggagtcagaagttttaggctgattgtcaatgttgctgattctcgaaacttctgtttccttatctacaaaatagagacactgagaatgcataatacatggggttactgttgtcttcatggtacaagttaggacacaaggagcaggttacttattttaaatctgttcactgttagtgaggtaaattattcaaaacaaaaccagaaaaaatgattatgattaaaaaacaaatcccagcaggccagcctccctttaaatatatttaataatatgaccaaacagatctgtaaaatatacaaataagggaataagtattcatttaactaaaaggtgttgttaaatagaacttcatcggacctttaaaatgtaacttaaaagtataatttaagcctagtgtttttcataaacatgtttacggtgtaaaaaagaaaatttgtaatttatatatattgcatctactgtattaagtctgcagcaggactggacatgttcctaaccatgtacaaaccagtcacactgcttaccagctatagaccttgggcaaattactttacacctctgagtattaatgctctaatctttaagatgttgatgatgaaacctacttcatagtgctgctgtgatgactaaattatgccacgaagcatgttgcacagatgtgtactgcaataaatcaatgtacgtttgcagtcatctttacagcacagctggtcatgaagactctcctgagtacatttttgactagagatatactgtgttttaaaacttctagttttaataaatttaaccattgagtagaactgtgctacttcttcaatattcagaaaagtatatatttttcatacaaaagtaaatatatatatataactattaatttcacattagaaatatgaaaagcactccaattcctggaaaatgtcgtagtacaaaggggaaaaattaagatagatgaaaaccagaagtattcctctacacctttaccaccgacattaaaaagtgaaaaatcaattcccttttcctctggtataagcaggtaacaaatggtaaacagtttagccagaaagaagaaaagccaaggaaatccacttactaaaagttaaattcagtgactaaaattatctttcgtatgctcaccactaccaaaatctatatttctagctatgttctttcctgagatccagatatatggacaacttccaagaatcaaactcaacatttctcaaacagagctgagtatttttggccagcagaccctcccctgccataatttgccttccctgtttttccctctcagtggatgtcaagtgtgaaggtcagtctgcgtgtgtctctcttcgcccatcattaacgtgtgcattcaatattataaacacaggaacctctgctttgcatgcaatagagggtaagcaagcctgtttatagcgaacgtccattctgaagggagagcgcacaaattattaaacagataggactcctttcaagccttttaagcactgtctgggttagggatgtggtggctacagcaacataaaaaaaagttaattttaaaatattaaacataatacaaaatggtgacatgatttttctctaaaatataggaagtgatcaatcaaatgaaaaactatattttaagtaaaacttcaccataaatgtcatgatttagccacagctgaaaacttaaagggtcagattcttccagctgaccctatggtgcccagctggctgaacattctgagaataatccagtgcagtggaaacactggacatttaataaatgataactcctgaggaagaacaaggaagtcatgtccacaccagaggtgggtggtgtaacggctgattttggaggagaagtttttgttttgttttgtttttcttttgtggggtgggggtttgttttgctttggcttgagacaaggtaggaaaacccatttggaaggctggaaatttgatatttgatataagagtctgtctggctagaaaataagttcttccagacatcaaaaaggaactaataaataatcagaataaacaaatattggccatgatatatatttaaaaggtagcctagctaggcatgatggctcgtgcctgtaatcctaccactttgggaagtcaagctgggtaaatcgcttgcacccaggagttcaagaccaacctggaaaacaggtatgtggagaaggactaacatatactcctgagaacatctcagaatacgcagagcatgtttttgttaactttttcaaagatcagctggcactccgtagatatatggctttatttctgggttctctattctgtttcattgatctatgtatctatttttatacaagtaccctgttgttttagttactgtagtcttacagtatagttcgaagtcaggaaatgtgatgcctgcagctttgtttttggttgttgttgttttgttttgcttaggctttgcttttttattttttatttttttggttccatatgaattttaggactgttttttctaattctgtgaaaaatgatgttggtattttgataggaattgcattgaatctgtacactgctttcggcaggatggtcgttttaacaatattaattcttctgatctatgattagagttaaaagagcctctttttctttttttttttttttgagacagagtttcactctgtcgtccaggctagagtgcagaggcacgatctcagctcactgcaagctctgcctcctgggttcacgccattctcctgcctcagcctcccgagtagctgggactacaggtgctcaccaccacacccggctaatttttgtatttttagtggagacggggtttcaccatgttagccaggatggtctcgatctcctgacctcgtgatccacccgccttggcctcccaaagtgctgggattaccgtcgtaagccaccgtgactggccacaaaagagtcttttatggagaaatagagaatggaataaagccagataaattcaatttactgctcataaatggccatgcttcttcttaacatggtccccttactgcagaggctatatatctaaaaatgagagaaaagcaatcacactgttgcttatgagcaatctacatgaaatacaaaaattccccttctgaaaaattataacaatttgttattgaagatgtgtatgtaaattttcccacctgtgttacttttttatacaagccaaacctagcaggaatctctaattatcataccatgaggatggcttaacaagggtgttgccagcccacaaatgcaatttgattctcagcatgaaggcaagactggcaatttacaaactccagcaacaagtaactatgaatattaagatcttaatttacacaatggagaactcattgctcttagaataaaaaaaggaacattttgaggatcctgttgctggatgtggagtaaaaaaaattatggtaatgattctgacaattgttgaagcacatacatacctgaatatcagggtactttttagaattattctgctcacaatggggaaatattttacttaaataagcagcctgaatttgaaatcaagtcataaggtaaatgtctcaattacaaatggtactgctttatatatggataaatctcatagacataacactgactgaaaaaaacagacataaaacataatgcatgattccatctatataacgttcaagaacagacaaaaataatctacagtgatagatgtcagatggtggtgactttcagtgaggatattgatgggagggtgcctgagggagtcttcatgacttagaaatattctacatattcatctagatggtgagaacatgggtgtatacatatggaatattatttaacctctacatgtaagatttgtacagttcaatatttgtgtgatatactgcaataaaaatttaaaaataggtcaattgtattagataactaacaaaattgaaaaacagatcaatagtactagataataaatatacaatagtctttatctttcctaaaacaaaatttaactgttactttagtgagtaccaagagtgcacacattcagaaggttttggaacccatctccttgtgtagcacagcattacatattttacatttcaacgtggctacaactcctaatcctcctgtcaagaatcccacatgagccaggctattgataaaacaattgcttctccagtaaagagttttatttgctctctcattgcctatcagcttaatacataggagaatatacttgaaaaggatcaagttctataaacaggactaaatgattatggagcaggcatctttataattgtgtttttacttttttccccccagttgtttctcaaggaatacagcagaaattgaaccataaagcttagcttgacagaaaggcattagcctaccatgctaaaccaaagataggagagacagttatttatgaagaaacactgttccctattatccttctgagattctaaaaaagggctaaatattgatgcatttcaaagtcaccttttcccccacttcttgtattaacaagcaggagtatgttttagatgctcctaatttgtcaagatcaggtgaacagaactgtcgtacagagcacactgctctcattcctacaagggctctgcaaccctgtgggttattaataattcatcggtctttcttagttcacaacaggggcattactcagagggcatcattcttactgaaagaagttaacagcgatgggcagataaacaatgcacaagtcaaagaagaagaagcctcttatgaatttgtgaacactgaagatctgttaaagagctccaactactataggaaaaaaaaaactgctaggtattctttacctaggcttctattgcctgttaggctaaattcagccatctttagaattatatcagttgtattaacacagaaattccttgaaaatcatttaactcttttgtgtgttaacacaggttatactactgggtacgattatgttgtctttattgaattagtttctccaaactaatctttttggcaggaaaatgatgtctacttttgggttccaacagtatttatttatcaaggaaatacatgaagcatcctaatgtcttaatgattgaaaacaagtctccaggaaaaggaacaccatcctttatggtcctcctcaatacacgtagaccctctgggtgaaatttaacacaggtattccaaaaaatttaaataacaggggcaacaggctcagaagcctaaaggcatgaatcacgcaagagtgtaaaacagtagagcgaggcagagtctgcagcctgtgactgcatgccctgcttaaagaaacttcaaaaacaaaccaaaaaccaaaaccaaatactgctaggccaaacatgcctatgtggggtgaccaatttcagacccatagcataaatcagaagtctttattctgaatatatgaggactcagaataggatgtattatgtcctctaaataaaagatattcatgtgggttaaataagagcattgatttattttcttgaagatatattgttattagaatgtactccattatttagaatgtactccattatttagaatgtactcgaatacaaattaagcctctgatttctgaatatcagtaacgagtaacctcgctttagctaaaaacagtaacataaaatttactgagcacttactaggtgccaagtactattctaagcactctgcatgcataaacagacttgaaattctcacaccgattctatggagaaaccaagcaggcacagaatgagaaagcaatctgcccacaaaaacacagctaatgaggctgctgttcaaactcaagcaacctgctttcagagtctctgtttccttgtttactgctcgcttcctcttagttaagagcacagctcatttactccacatgaatgcatcaagggaaagcggtagctttcactcattagcaagactgatataaaataaatagaaactcaccaccaaaatcactacatatactatacctcctaccttagctacaaagcagaggagtttcagggaccaagaaacaaaaggcttggagacaatgagtacagttcctgataacagtagataataaatatcactaggctgagaaagagttaagaggtcaaaaagaggaaaagatgattctataacaacatgccattttcctctcgtactagaaatggacatcttcagagtctttgcttcctttaagatactaactaggtcagatcagatgttcctctttttttcttttactaatggaatgccctaagacagaataaatatagaaattaaaggatctttgaaaaacccttgggtttttctttactgataatttcaaattttaaatgctacagattctataattacagtgacctcactcttggcactgaatgttatgccttcatgctacagtaaatacctttggttatgaaggatatgctgtcctaaaaaatggaatctttactagtaatgttgcaattttttatctgaggtgtttcccattcatctttttcaaaatagaatttcaccagaattaaagttaacatattatttattcatcatatctgataagcatccgatgatgataaggaatttttttcataaatacataaaaatttctttcaacaaatgcccctactatatctaaatatatagttggaaatgtaaagcaaaagcatttcaattagataattataaaagtaaacacattttttcaatttatgcacacttaaaacataaaatgttttagaacaaaatatttcaactaatttgttttaattagttaaaaatacattacaccatctcatagtagagacagctacataacatgctacataatggattagtgtcagaaaatgccaactttttgcataatttcaagaatatattccaaaaacacccccacttaccatcaagatttcaaaataataatagtcaatatttatatgtacctcccattctgtgtcccaccaattatctcattggatatccaaagaaaaaaaaggttctacatctcaagaagtttgaataacccttaaaggatcaaaatgtagtttattttatgaaaggctctgagaattcttgctttgaaaaaattaactttcggtgaaatatattgttttccagttaatgacatacttctcatactcatgcacgattctaatactttcataaacaaatacttagaaaaaagttccatcaaataaccagtgagaaataaattcaacctacatcactagagtcaacatgattcattggttagaaagggaaaggaagacatctctctcttactgaagcagcagtagcagcctggggtaaatctgtcacgcaaatacgttgggctatttcaatgttactcttgttagatcttgcttttatcaggctttcatgtaaataggtagtaaaattttcaaaaaggccatgtgtccatatgcacagattaaaaaaaaaaatcttttgttgtgcagaagctctttagtttaattagatcccatttgtcaattttgtcttttgttgccattgcttttggtgttttggacatgaagtccttgcccatgcctatgcctgcacaatgtgcacatgtaccctaaaacttaaagtataataaaaaaaaaagattagaaaattaaaaaaaaaaaaaatcatggttgtccagacagttgaactgggatttcatttccctgtgtatcaagagacttgtgcagtaaagggttaacttagcagtcttgaggttttcaaaccacacacattctaaagaaaagaaaagattggctcttgacaagctcctgggatataacctctaagtgcttggagtatcctgcctagtaagagtttgcttttctacctggggccttgggccacactagacagttttatgctaacaatgtgatttatggcaaacacccgttctagttcacccagggccctaggtcacactgtatcagaagtttgactacaggaggggctgcagactgagtaactaaagttacccacgtaggtgttccacacctacaagacagaccccccccaacaaaatccttgaccaccaaggctcagtgaccctccgggttgacaatactccatgtgtgctatcacacatcattgctgggagaattaggaactgtccacacaaatccaccaggacaggacaaccagaaactcattcctggtctctccctgactctgttctatgtcccttttacctttgttgatttgaatctgtatcattttgctatattaagccataactgtgtgtataatagctttttataatagattttatgatttctatgagtcctttcagcaaatcactgaacccgagagacaaactagattcttcccattggtatctaggattcaaccagccttattatctgactccttggtcatgaccagtctctgttcagacacctaatatctatcgaaccccttaagttaaatcagcctccagatttcagcagaaataaatgcacagaaaaaataagcccatataatttgctgtagaatgtaaaaagcaacttttgatatttaggccaattacagtaataaacattaaataaaagagactgaccaactgcaaactggactattttcaaacttgttgccaatgactatcctctaggtaagagatgaaggtgcctcacaaattcaactgtataagatgtatgtgcccagcagggtcgtgcctgaagtagccatcctgcctttctaacctatcttgtcccatctatcacctcacaacattggccactaatgctgcatcctcagtagagatgggatcgtgacctacccaaacattcattataaaggtgtaagaatcaaagaagcatgttgtcagctctgcttttggcaataaaggaaaggtttttctcaggttttcctcttcacatggttttgggctgacagtgagcagtgagcaagctgtacttaagagttgtccctaacagatgtgagggcggggacagcattgaatacaatcaccatctctgatggccccctctctaaatgcattaaaggaactcaaactggaaaaggagaattatccagccattaaatttcattctttatgagacaccaatagctacctttttttgctttcaagaaacttgggttatgggcacaaagatccttcaaaatattcaaattatccatcttgaatctcagacaatttttgtgcataataaaagttcaattgaagcctcttttaaagagtcacttgaagaggtacatagtgactaaaataatcattcaaacaggagataaacaggaataagtgaagctaattcaacctgcacatgcatatttaacatgatacacatatgttacaaagcatactataaatatctctgtgcctattgaccttgtgcagctctaggaataaatgctggaggaatttggtacttaaaatgttgaagaggtcaggcacggtggctcatgcctgtaatcccaacactttgggaggccgaggcgggcagatcatgaggtcaggagatcgagatcatcctggctaacacggtgaaaccccgtatctactaaaaatacaaaaaattagccaggcatggtggcgggcacctgtagtcccagctattcgggaggctgaggcaggagaatggtgtgaatctgggaggcggagcttgcagtgagccgagatcgtgccactgcactccagcctgggcaacagtgagacaaaaaaaaaaaaaaaaaaaaagaagaaatatggagtgctggtagacatttctgtcaatagcagcaatcagtagcttaacctctattgcttctctcattctacatggcagagatagcagtgataactgtggcaatccagcagaatgcgaggccttcagaagcagagctaaatatgaggagtagcacacacagtatgtgtctttatggcagctcttaggaaatctgtccatttgcacaggtgctcctagaggcaaatgagcagacataccttgaaccatagtgactctcttaaggttattcaaaattaaactgtgtcactcccaaagagacatcacaatcctggaagaattcagtcacctgtgactaacctgacaacaattaacatacttgaaaattgtataaaactcaaattaaattttaatctttcatacttaagaaagaatcagtaactgataaagaactgtttaactcaatttgaatgtgatttcatgaaaggatacattttttaaagttattcatctggatcacatattcaacagttagagttttccaaaataattccaaagcaggtttcatgctgacatttttaaatcgtaaaagctttagcacagtaggcattgtccttgcctggatgttctgtgtcggatctacattcgtgtttatactgtgctgctgaacaaaacttagcaccacaataattatgtgaatcaagttctagtcgactttgtcagtatgcttttcatctctaaagctttgaagtcaaatcccagtaaatgtcaatatgctcctatcatgtccacacctgtcatctgcagcacaagtcagtgtgatctgcagatagaaatgaggagaaattgaacatattttatggctgttctgcttgaggcaataagaataaagtaaatcaatacttcatgtcatttcctgaaaatactgtattctccaagacatttagccagcacttgcccatttaacaaggacaaaaacataaaaagaaagtttttaactcagaaaattagcacatcaatatttctgggtcacagaaattcaagatgtatcatgcattacttcaaaatctcagttaaatacactctcaaggttggttgctcacaggaagggtaagtatcattaagaaaatctaaaatttcaggaatgaaggctcatatttaatatcctattattcctactaaaatattactaaatttatagccccattaaaaaatgtcaagacatgactttctctgtaaaatgagacctgcaaaaacattatatatctttacttacatggtatatttttctaatttttctatcaatttctatcattttccatcattcatttttaaaaaactctttatactttactgttcaacactatttctgacctttggaaatggatatttcttgactatctacccatactgtatgtacacttaagtagaagaatgtacaagttcagggagcctctgcaatagtcttttgtaatttaagaaataatttccaaatctgagcaaaaataattgggccttggttggaaaatgtaagttacaagtatataacttaaagaatattgaaatcatatttgggaaaataaaaagtatcaatagtaaaatatggtagaactcttaagtacatagagtttggagtccgagaagctagagtccaaatattggctaacctcctattaactactgatcttggggcagttttcacttctctgagccgaagattcactgcttgtacaatgggaacgcacacaatgtacagctgctctgaaaagtaaacgagctctgactacagaaagtgcctggaacatggtactcagcaaatggtattttcttggaatcctataaacaaattggtaacaggaaacatactaaaaaagagagagaaaaacagtgaatacagggcaaaaatgaaaatcattaaaaaggcaaaaaatgtcccggtagcaatgatttctaagtatcataaaagaaaacaactaggaaaatataattagaatgctatatcactaaaatccgtttttgagaccaggatgttcaattcgaaatcctaagaatgatgtgcttccccctgcctgagaaagtgccacgctcaagaaaggaggaagggaaggaattccagtccttctttgcttgtgggttttctcttaaaacttctgtttagaggaggtaggtgtgttcctgtccccttgacttggcttcaaggactagagacagaaagtctactggaaaagcatgtatttgtttgtgaggaaattagatactggattcgatactggattcactacattgtttgttcaaatgatttgtgtcaggaaaaacttttttttttttttcttttttttgagatagggtcttactctgtcacccaggctggagtgcagtggtgcaatcttggctcactgcactcccaggctcaagccatcctcccaagcagcagggactacaggtgtgtgccaccatgcccagctaatttttttaaatcttttgtagagatggggtcttgccatgttgcataagctggtcttgaactcttgggctcgagggatccatctacctcggcctcccaaggtgttgggactagaggtatgagctaccgcacttagccaggaagaacttttaaaaaacaaattgttaacaaatccctgaggttacattactcatccataaatacatcagcatgtatctccaaaaaagtaaagttatttttaagcatactacaatataattaacatatctataaatattaacaatgcttccttaatagcaaattaatactcaaatatattccactgtctcataattttctttacagtttattcaattcagactccaaatatttgcttccaaataatctagttgctgagggataagagagtgggtaattgaggatatagatgaaaaaggtcacatataagtaaaattgttaaagttggatgactggtataacagagttcattaagttattctccctgcttctgtataaccttcaagttttcagtaagaaaaatgttttaagttttccgtaataaaaaattatacagacatacatcaatgaaaataaaaagatagcaataaatataactcacaggtttgagatttttttaaatgacattttaggtcaaaaaaatgctgaaactcagaccttcctagccctgtagcctcaataaacacaaagtaactgagagtagaaagttaatttactttagtaaaaaaagcaagttttaacagcatcaaaatatgagttgaataattaatttttaaaatcctgtattaatgtgtttatgtcaggttccaccagatataggcataaaacaaaccaggtgctgccttttttggagattataggctaacagactcagtgcctgccttctatatatgctatggcgtcaaaagttgggaagcatctgttcaaacaatagtttaggattttattgaaggtcaattaagacttaactgagaaattttaaaactattaaatacatttatggaaacaatttttgcatatctaaccatttttacattatcaataatttgaaaataccattttttagagcaggagtatttattaaaagtaaatatacctaggtctacttcattagtaaaaaaagtaaatattcctaggtctacttcttaacatattcaattggataagcaatgaataaggagtactgagttgaagaagtgaagtcctatctagacctcaggaggtatggagaatacagaaatgacagaatatacaccacactaagctgccttgcctgtttcccttacaaacagcaattagaggagactccttggggacttaacatatttactcctacatatgttaactaaaagcctatgctaatgtacaaaggatggatctcctcctgcctgaagatctcagcagatgtgacagcaggttctggaagaggatcagcatacaaaggcatacgtgtccactggcagatcctgctggttgcctagtctatcaatattgcttttcctttcctccttgctaacagaaccttggcattactgagggtggcaatgtgcctagattttaaccactacacttcccaacttctttcacagccaggactgaccacatgacacagtccttgttaatgaaatttaggtgggagtcactaggtggattgaaaatcctttataaggggacagtcaggctggtttgctactttttccttttacccttttcttcctctttgtcttcctccctatacctctatgtgctggctagagctcaagcaccatcacatgagcatgaggaccccaaggatggtggcttgcaaagtcaaaaggcttcattttcctctttccctggctggagagactgcaagtttctccccaggtgtgtggaccacaggtgctgcagttggccccaggctaaaagctgcagagataagaactgacttctacagctctccaccttttctcctccatgccagtatgcacacccaaccagcatctctgcttctcttcacaatccagtaccttcaagtagttgtttttgtgatatgtccaggtttttattttggagggacatgcattccagtagagcctaagtcccttagtttttagaaacaaaattatttaaatttcactactgagccccaaagaacttctaacatctagactattaataaatggcttcttgatcagagagtgatactcaaaaagccagacccaacaatagagttcacagaaacaacagtccttcaacattttctgaagagctcttcatttccattaaaagggttttgttaatcatttaaaaaatattgttaaattactgccatgtgtgactcatggattaggtgatagctggtactggctttatatagctacagaaacagaaacaagtctatgggtgtcttacatgtcaatatgctttagatcatttcaggtaaagtaattaagcagatacatattgactatttggtgcctaaccttatggtgatgagcaaagtgtggggaagctattgaagaatatgaaatcactcttgcctttctataatcttattgaaaagaaaaaaagactaacaagaaaaaattaatccaaatcaatatataatcaaatgctgaaatatggggaaaaggcaagccaaaaacatctaccaaattatgacaaaatatacaaggctaagactagattaactgaatccactcctcctagatatgctgaagctctgaatagataacatctggtaagctgtgaaacatgaaaagcatatacagttcactggaaatcaaaagagcttaagcttactatgtgagatataatcaagaatatgggttttaatctatgacccattgtttgccaggttctttttaaatttttcattcaaacatcatatattaaacaaaagctaattttaagaataaaagtgtctccaatattttaagtctcaatgactgaaagaatggtgaagcccttcttgggactctgaagacaataccccaaaatatggtgctttggcatactgaaccaaagcaggagccctagggtctctgtgaccttcctctcccggtctctcaatcatctgtctctcccaaaccagaggatgaggctgttctctgaagttctcttgtctacctagaaaccagacccaccaaagagaagtacgttacctttgatctcttcagtgaatttcattaacaagagaaaattaaaactcatatcctagaggaagagactgaaaattaaacaccacacctagaaccctgatgaacttcatcccaaaatgaatattgaatgaatattcaagcacttcacacaaataatcattgacgagctaacttctatcttccatgttcattaaaatcatttagtacaccccacaaaattgcctcatttccctcctctctcctttccctatgaagaagggtatacaagcatctggacctcgttgggttattgggtaatcattctcctgcaattgccccatgcttaggcatgttaaacaaatttgtaagtcttcttctcccattaatctgcttattgtcagttcattttcagcaaactttcagagggtagaaaagaagctttgtccccataccattaataaatatgagtaggaagaaaatgatctgagaagaaaagagatgaggagctatgttccgagcatgctcaatttgtgtgaacagcaagacaatccctcttgtgcccactgtttatagtatgatacaggtgaagtagcgaaggctttgataacacaaacacttcaacattcacatctcaactccacccacttcttagttggccttcagcaagactatgagatctagctcccaagactgcaaaattgggatcacaatatcaaactacaggaatacattttgagaattcagtgacatgattcagttaaaacacctaaccaataataggtattaagtgttaacatctttctttcttgtttctgcttgttctttttgaatgccaaatctgataagcttatgaatctctacttcaaattgacccatttcctaactatcctcaacatcatatgcttatatctatcgcacatcttttactcctattttctatttctctcaacttaaaaaagcactataaaagcacttttatagtattaaaaatactatacatccttcaagatccaattcaaggcctgtccttttggtacataagcaatcatttcaatctgcattaggttttcctttacctcatgacatactttgctattaattaatttacatacatgtcttgcctccccagataaaacataaacttttataaagcagaatctgtgtctaaaattggttttgtttgtaaaggctcggctctggactccctctgagatcaacaaaaacttgctgaataaaggaatcagtggtgctgaccattaaaatctgaggactaatgtctattcagatataccagtcaaagtcaaatttatgaaatgtgatttttgtctactgccaactgctaagaaaaccaaaattcaatgtgattataattgtaatgaacaacaacaaaaaagcagctgttgcttcggactaaaaagcaatgcttaaaagagataatgtaacgagggacttctgtaaaagaccttaaataactattgcacaagaagataagaattaaaattaaattaattaagataatcaattccactattaaaatggaaatgaacttttatcagaaccgtggtagaatcacaagtaagatgtttcaatagttaaaaagtagtttttaaaatttgagatgcattgcaaaaaaaaaaaattggctcatgggtcagcactggaattaaccctataacaacagtaatttacatgaactattaatcattttaaatgtgattaaaaaaatacaagtccagcacacctgttcaccaatcaaaatacctagggcttgagacaatgtagtaagacaacctgtaaagctaagggtcaacaagcttccaagattggagctttcttcactctcttttttttttgacatcagtgtacaactagactcaacattcaacatgtcaattatgtcatcatcactaatctttcagtattagcaaaagtataacttcaaaaactcatttccaataggaacacacacacacattcacatacatacacacacacacacacactcacatacatacatacacacacacacacacacacacccccccgacaaaatgaaaccaacagaagctcatgaaagcatatagggaatagtttcatttatgaataaaatgtttccctgtatcttctattaaaccaagggttttaaaaatcaaattaaatcaaaatacaaaaaacaatagtatattgtttttgtagaactaaacatctcctttaaattgatatgtctttaaaataggaggtgaaaactatcgtgacaattgttctacaagattaaattaggagaaataacttaaccaacattttatacattaacatttatttaaaatctgcatattaatgaacttcaagtattgcaaacttggcaggatgttgaaatcaatgttttcagatatctatcatgatatattgagtctctggtttacttgacgtttttcctttaaaaataattttaagtagttaagcaatgtaattcctcttattttcaaaaaaattcatattctacttccttcatagatggtcactgtaaagaagtttaaactctaattaacagctaataatatgcagatagcagatacacacaaaagcttccattaaacaaaacggacaaagaaaactaccatttcctgattttctccctcagccctccctacctactatcttgattctgcaaacagcagaataaattaaagttcctttcttctacatcaactcctttgtcctctcaaggttgcctaatcatattcatctcctaaaatgaagtaagaaacatttcaaaagctgtattcacattaaatcaactttctgattcgtgcattgcaggaataaagcaatgtaatcacatcttaaattggtttacagcaggctgtctaccttatcctacttctcaggattgatgaaatgaatagttttaaaatagcactttttgaaatgacaagagaattaatagtgcataattacctcagtgttgacaagtgagagatgtttaactccttaaatgagctctcctaatgaatcagtgtcagagaaaggctccactgcatgtacatggttgattgatatctaaggggattgatttaaccataaaggaataccgaaagccagtttttaaagttatttaggcaaaaaattaaatgaatcaatttttacttaatatttggaatatatttacttaagactttaccataagctttgatagtattctaggtgttgattactaggaaaatcttattttacattgtatgagtccactaaggaacatttaaccttttaatagagtggcaacaaaaaaaacttactttagtattggactccacactacataaaagtgaaaattaagctattggatttaaaaagtagtacagagagttcatttctgacatttatatttaaagactgtaatgaagacaactacaatacaatgacgtaaatctccattttaacgaaaacttttaatacatgtaaaatatgtataaaatattaccataccatgttgaacttttaatatttatatacattctctttctaattcttgtcaattaacatgtgatactgttccattctattttaaatcctgtgggtaaaaccaaaacagattgatatttctaaacacctggaattgagaaaactgaacacggtctcagcagtagagctgtgcagttgaaatgtaacacaagccggctccaacttactcttcatttttccatgtctttcacgtataccagctgcctagcttgagtgtgtgtcaggcacggggctaagaactttctatttaattctggagattcctaagaagtagatcatactatccccattttgtagatgaggaaggctgtgcacagggaggttcctgtcccacagtcacagagggtcgtgagtagagcctgattatgcactaagacaactggaatgcatagtccacacacacactggttggcaaatatatttccatgtagattatctttaccggattaccactgttttagctatcagtgaaggtgttagattgtgttgttattcctttatcagttcaatatatttgggagtcaactaaatgctagtactttcccaggtgctgagactacaagcgcatgacagagatgaggcccttctcacgtggagaccacagacagcatttgcagggagggggatttgctttgtaattaagcgccttagctaagagacacaggtgcaggagatgcacaatttggacacttagacaaacattcttgacctggtacccgctgagcctcagtgaaagagtgagggtaaagtgtgaggacaatggcagcctgagctcccagcactaacacaatagctggagctggccatgccctccacctgggcagcaggggactataccaccaggctcaggtggactgcgggggggttgtaggcagaatgtgcagcctgggagtgtggcactctatgggaacgtctgccttaaccttcctttaggaagccaaagcctctgtgctggcactcctccccaggtactaaccctgtcacctctcccccagactccttagaagattgagcaccagggatgaaaccaggtcatcaccaatcaaattcctggcttcactgttctatcttgggtttctttaaaaaataattagatacatgaatgcctcagtctgttctattaggtgtacttaaactatgtgtcaaagctcattggaatatttcactgatgccttaaaatgtctttagcagaaatgcatttgagttgcaaacatgcaccttaaatgtgacttcccagggacaatcagctaagaaattttagttaatgttacaatttataaatatttgtgaataaaaatgtgttctaaattaaaaaaccaagtcttcattgactcgtctaagaattagggatgatgaaaactacttcttaaggaatactgaatgagttattgtagctagatgggtccggtgggctctaacacacagcaggtgtgcccgaggatggtcacatctgaatcgtgaaacaaatggacttcggattttgtttatattataaaaatctacaagaaaaacagtatttttcttaatcagttttaaactaagtcaaataattttgctgcatttaccaagtgtgtagagatttatattttaaaaatataagaagtgtagcttcaatggtaaacatgtattttatatattacttcgtaggtaatgttcctttgcttttttaaaaaaaattgctatccttagctcagaaataaaaaatgttaaaatagtaagagactttagtaataactactaaaaactggctcttccaactttccaatatctatgatggaaacccttcacacctgcctgatgtgtcagacagacacaaattggttgtttgaggggtcagaccctttcttagactgcctctcccctcctcaccccttaaagtgatacccttgaaaatcccctttactgtttcagaagaacactgttttagaagcagctataccaccacatcatttacactcacaatgccatagatgtaaatgtgagacctcagggccaggccaaatactccgggcctgaaatcctactctttccatcaatatgcccttaatcaagaggaatctggtagagcttctgtgagaatacaagttcttaagtgtaaaatctagatgtcccattaagcaaacgataccagtcaaggaactggcttttttgagctcttcctaaaaataatgagatttggaggacagccatcagtcatggaaagacatcaaacactgcatgaagacctcttgaaacctggttccacaagaaaactagaaattaaaataatgcatttaatagctcataaagtttacaagattcttatctgctctgcaagacagaaagaatcaaatgattttcttggccagggagaattcaggttcaatttttaagcccctattctgtaaccctcagtcagccctgtaggaaggtaattatcagggctagagggatagttcctgctgtttcctataagtaaactcaggagctaaattaaggtacttagaggtaaactctcagggtgtgcagagcttggctgtttgactcccgtggattctggagcaaagcactaaacacttctatttattcagagagcaggtagagaatagggcagcagaaacacggctttctcagacacctccgccagcccctgctaatcaacgggagtcacacagctcacaatctcttgctatggttttaaaatgcaacttttaatgttatttcattgtggtgtccttgtactgaaaagcatttattatgtagtttcaaatttacctgaaggttaaaaaaaaaaaaaaaaaagaccacagcaggaaagctgccattgtgagaaagaaggacataaaattcaagcaatgaattaaagaggcaaatgaaggaactcttttcctctattagaaatagaagaaacagattgtgctcgtcttgcttagggccaacaggcgcactgcatggaactcagccagcttcagtcacaaagctcacttaggagttctggtctgtgaaaagaggaaaccagatgggctatttactttcaacaagataattctggaggaaattgttatatgtcaaagaaactttttagcttcatctgctattttagcctctaaactgattcaggaagcagaggggagggttctgttaggaaagaaataagagaattggggaaataaaagcaagcgcagtgcaaaaggctgggcggccatgtcgtccaagtgcataagcttcctggactcatatcctcactctaaccttggacaagcgatctgacctcttggtgcttcagtttcctcctgggtaacatggggaccacaatagtgtcactagaggttgtaaagattaagtggtataaatatcagtacttaaaatacaacacacacatgagcactcaataaccatcaggcattgtttttatctatttcattttctcttctatttgcaaaacataaagggaatgtatcatagatatagatcaatgactaaacaattcttaagaagacactaacagctaaatgttatattggtctactgattatattgaccatataccactgatggaatttgtttgaaaacaacttctcttttgtttggctaccacaaaaagtaaaataatccagataattttattcttggatcaaaaatttcaaagagattttcttacctcaaaattaagaaagatagcttttaagaaaagtagctgtagagtgaatatagaaaagttaattaaattctaagttaaatttctaatacatataaaggatgctttctaatgagaaaaaagcagagtttccccagcaaattgtaaataacttggaccaaaatcaagataattcttatatgaatatactgtggaaaaggtatctagcaacctcatttttaggatgtacaatatctaaatattagttattaagcaaaaactgaaagtattcaaattaagttatgtgaccattaggcatccaacttaacctacttttattttacacttgtactattgctaaataataactgatgattccaagagaataaacaata

SEQ ID NO: 852 - DNA, 112711 bp, Homo sapiens
atggggcaatttccaatatgagtaattacttcttgtgcatctaaatcttccctgaatgtgcagctgggaatactttcattacatgttattctttccacaccataaattaatccctacacgtgctgtagatcccctgtgaatctcaaaaaggagttgcgaagattaatcatttaatttgtgtgaattgtgtgaaaattgttttcccctggctctttgagaagctcagtatatgctcagctgcacacaacggaagtatttgaacaaattaatttactgagcaactactatgtgtccggtactacgccaggcagtgggagaatgaagaaaattattagacaatctctgacttcaagggatttattagctagtaacaaaactgaaatgacatggttaggccacaacctcaaatgcctatggccaacgaggcagagctaagagcaactgtttcaaaggcccaggcacgctgccaatgctgaggcccagcacatccactccagctgatgctaccgatggacacgatcaccagtgtgtccaggtgtgttgtttaactcaagtgaaaatggaaatcctgctttttatgtgtaattaaccagttctccaatgttggcattaaattcaagatttgtatttttaaaactatctatctgtgggccaatccccacccacctataggtcacattcagctcctgaggacattgtgagaccatggatctgaaacagcaacaacaaaaccagctagcgggatggtgtggtggcttgtgcctgtaatcccctcaatttgggaagccaaggcaagtggatcacttgaggtcaagagttcgagaccagcctggccaacatggtgaaatcccatctccactaaaaatacaaaaattagccagtcatgctggtgggcgcctataatcccagctactcaggaagctgaggcaggagaatcgctttaacccaggaggtggaggttgcagtgaactgagaccatgccactgcgctccagcctgggcggcaaagagacaccgtctcaataaaaaaaaaaaaaaaaaacaccaactagatataactaagcagcaaattaagcaccaaattatgtattatgtacataataaattatgtattacaaacaagatgtgcatatatgggaaaaatgaaactggaagtggaaaatgccacagaaggaagacctgaactgaatttggaaggaaaatactatacctttgactatagaaaatgtaaggggaaaaaaacagtttgatgacatgtcatgattaatgatgctctattgcatgctaatacaatggagattatcctaaatgatggagacatgaccttcacagaaaaatctggaaggcactgcaaacattgaataattttcatataaactcagatgtgaacaacatccatgctcccaaacatttctccgctagtaataagaagatgattatgaaaatgaaaaccttgttcctttcagctattacgatataaaaagtggttattgttaatacattgtgagatcaagagtgttatacagacaagaatgatgaccctaacatttgctttcaagatgttttgaaatatttgtcaagctggtcattgtgtggagatgacatttaaggattaaaggctctttgcaaactcccctctcctggccatgcctggcctatgcaggatcctttctaataagaaaggatgcaaatgcatgggtggtgacaggcacgtggccttcttcaccgtcactgctaccaggaaccgagggatcactacacatgtctcagttgtttgtagcccctcagggtcaggaaacacctttcaaatccacgttttatttcctgatcgatgaaatgcagccactgtggcatattcatgcatctctgctaagaaagaaataatattcatgcatctctgctaagaaagaaaagtcaaaaatagaaggggaaaaaaaactttttgtgggaagagagaaactggaacaaaatgggttggaataaaagattgatgaagaggtattcaatgcttgcagggaaaaaactgggaaaacaattgatgtcaggaagctttagataagacactcaagaatttcattttaatatttattgcttgtagtgaaattgatcggtatctccggcatgatgaggtcatgaaagaagagattgatgcaggcaaattcattatttctgcttctgttctttctgttttgatattagtctattttctcccaataaactatcctattgcatacctcccaacttttgccatttgtggtaatgtaattttcctgtcatcttttatgaaatactagagtacccatctgttgtacgggtagggataaaatagcttccttcagaagaaaacactgactgtaaacagccaagccccatgaaagacaagtgaatcttctagtggtcctttatcagattatattttctggtgccagggcagcccatcttgcttgaccttttttacttatgtacatgagaaaaaccgtgggtcctaatcagtcatatgataatattctgggtttttttttcctagcatagttattcaactaagatattttaatgcaaatactctgatttcaatttattgaaatcaaggaaataaacataaaaaaatggaaacaaacaatgtaatttagtcaggtatcttgaaagatcaagcactacattatgtgtctcagagactggcttcagaagtcagccgctgtcctcagagacatgactgaccttaaaacgcaggtgacaatgataccccttttcctcagagattgtagcaaatcccaactcaaaatctcacaaaaacaaatcacaacaacagagtctcactctgtcacccagcctggagtgcagtggcatgatctcagctggctcactgcaacctacgactcccaggttcaagcgattctcctgcctcagcctcccgagtagctgggatcacaggtgcctgccaccatggccaactaatttttgtatttttagtagagatggggttttaccatgttggtcaggctgttctcgaactcctgacctcaagtgatctgcatgcctcagcctcccaaactgctgggattacaggcgtgagccagaaaatcacaactctatccagaagatgctcctgaatctgacatccagggggataggatcagctgccttcttggatgtggtgaagggatctttatctcagctgtcttgccgaataagcacatggagctgatttcgattgtgcactgcagatcagcaaaaatctttctacttacactgtgcgtaagctgtatggaaaaagttgtactgttgaaattatttttaatattatcacattgtaattgttagattagattttttttaacttttaagctcaaaggtacatgtgcaggatgtgcatgttagttacataagtaaacttgtgtcatggagttttgctgtacagattacttcatcacccaggtattaagccaagtatctattagttatttttcttgataatctccttcctctcatcctctgccttccagaaggccccagtgtgtgttgttccctatatgtattcatgtgttctcatgacttagctcccacttatatgtaagaacatgctgtgtttggttttcccttcctgaattagtttgctaaggataatggcttccagctccatccatgtccctgcaaaggacatgatctcattcttttttatggctgcatagtattcaatggtgtatatgtaccacattttctttatctagtctgtatgagaatatagacgggaagacaaagagagagtaatgaaagataagagctaaagtcccaccaaaccatcttaatttttgccaccaacttaggatacttccctcatgtcacatgtcaaccaaaactgcagctgtctgatccaccgtctcatgtccaggccaggtggcctctcaacatctgtaataccataatagcttcttccttggatgccctgcctctaccaggccagttccccaccatagccagagggccgaagtcctagcaggtgccatggtgacggaagcagaggatgccagaagcagaggatgccagatgcagggtcaggagctgaggaaagcaggcggcctgcagcaagaaaatgggtccctggagcctgcaggagcaacagccctgccgacaccttgttttctgcctggggcattctgacctccagaagtctaaaggaagaaatttctgttgtttaagttcccacgttcatggtaattgtggggtggggggagcggggagggatagcattaggagatatacctaatgtaaatgatgagttaatgggtgcagcacaccaacatggcacatgtatacatatgtaacaaacctgcacattgtgcatatgtaccctagaacttaaattataataaaaatatatatatataaaaaaaagcagcaatgggagactttacagtactggatacatgaaggttttatgtacaatttttaaaaactagtgaattcaaaacaactgacatacctttagggtcaatgaaatttgaaacaaccacagcaaatactttgttagtgtccatattattacataattattaataacattaagtataccatcttttcagtatttaagtgaaaatttacaatcattcagtaaggaaagttttctgatgaccatagcgttctttttacttggtaactgaaatagtgaaaacagaaaatcataaaggctatctttttccaacaaagccctgactggaaagaaataacaaggtcatagtctctgctaacaagggcaactaactttcctgtaacagttgaagttttgttatagtggtttgaaagattgctgatttataactttgagatttaaaacacttgctataagaatagatttgttaaaatatttgttgtagcaaagaaaaatagctgtgaaagatgcttcctgggagatggtttgtacctggcaactcataatcattagctcacaatgacttcactgatctgggtctaatcaaagcatgaggaatctgaaaatcagaaacatagctaagttattctcccctgtaaaatctattatacaggtgaaaataaaagttactctaacgacacataatctcaacttgtttaagtaataataatttttttcctttttttttttttttttttgagacagagtctcgctctgtcgcccaggcaggagtgcagtggcacaatcttggctcactgcaacctccacctcctgggttcaagcgattctcctgcctcagcctcccaaatagctgggactacaggtgcgtaccaccatgcccagctaattttttgtatttttagtagagacagggtttcaccgtgttggccaggctataaataattattatgtcatattcttaagactgctcagtgcttagggtgagaaagccttcccaagggagggtctgttctctcctgcctggtcatagggcatagtacatctctctccatttattttctattctttgagacaattattcctcatgttccaatattctttttcttttcactgtctttctgtcttgaataaatctccaacatcccccacaactatcccttttaagtttcagatacccagacaacaaagcacataaccaagacgcttgatcacacacacgtgcatgcatacacgtacacacttatacaccatgcatatatgtgtgtgtttgcacacaaaaatcttgcttcgcaaacagaaggcggcatgtaaataactgcttggaactcattggcagataaagaaacagaggagatgtcaattatttaagataacaaatgggtcttttctcttagtattgctcccctgccagagcaggttcaatcttaagaattttacctttatcccacccctctgccactgtttcattttatggccttaggactgtcatttggcttttccttgaccagttctttccataagacttgctggcctttgtttcctttctgatttttactgttctcttgtccttgctgccctcactgtaactggcttctgttcatttctccaacctgtcaagagcatttagaatcccattcctacccagctaggttctgttgccccatctgactttacgacatcctcatgcaaggtgaccatgtactctactccatcaccccagtcactgacgaagagccctgggcacagggctgacccaggcgatacaacacctgtgtctgccaagttaatggcattccattattaattactcgttaggagaaatgtgtgggatgacaggggataacacacacctctaacattcccagacatcgaagcaagcatctcatgggcttctgtggaagttcatttacataagtggttcttgatcctgatcttgtagaggtcataaagcctttgtggatcggataaaagctatggattatcttttcgaaaagctgtgcacacacacatgccacagcattttgcataaaatttcagaagattcaaggatttcccttgaagtacatctctagaactcctggagtttagaacattcaggttaagagtatctagtgaaggtaattttaaatattgtagcatctacattatctttaaaagaaatgtacactagatgccagaagaaaatataatttgaaggattttctttaatctagatgatatcacatatataccttaaaaataatcttgattgacctatgctctcaggccaaagaaagaattattcatgcaatcaaatgaaaatgatttttttctgctgtaaaaagtaaaattattttttaaattgtggtaaagtacacatttcatacaatttgccatcttacccatctctaagtgtacagttcagtagtgctaaggaccacagttgtgcagccaatctccagagccatttcatcttaaaaaactgaaactctatactcattaaagcattacacaataactctcaatctcccccttaacccagtccctagcaaccaacattttaccttctagtctctatgaatttggctactctaggtagttcacagagtatttttctttttgtaactggcttatttcacttagcatcatgtctcaaggtctttgttgctgcatgtgtcaggatttcatgcgttttcaagggccgaataatattctattgcatgttgcatgtatatactgtatcaatttttttttatttttttgaaatgtagttttgctcttgttccccaggctggaatccaatggtgcgatcttggctcactgcaacctccacctcccgggttcaagcaattctcctgtctcagcctcccaagtagctgggattacaggcgcgtaccatcatgcccggctaatttttgtatttttagtagagatgggtttcatcatgttggctagactggtctcaaatccctgacctcaggtaatccacccacaccagcctcccaaaatgctgggattacaggcgtgagccaccatgcccagccgctgcatcagatttttgtttatccattcacacatcaatgattacctggattgtttccaccttttggccattataaataatgctgctgtgaacgtgggtatgtaaaatcaaatttttagcaaagaaatcttactgctgtgtaaatactattgtttgttttaaatttttgaaacttttaaaaatcatttcattgttaggcacaactgacaaaaagagaagtacacaaaacaactcaatgagtcatcaggtagcaaacagtcatatcgccaccacccaagtcaagacacaaagaaggtttccatgtagcgcttgctctctgaggtgtgtctactacacaacacagagttcccatgcagaattaatctggtctccccaagaatgctgccagacagagattagtaatcccatgttctgggttgagtaaagggaagcttagagaatgtcttacaaggtcacatagctagtaagtgatagaaataggattctaaacatcagcctttttcaccccacctccacatgggttggactacatagaggccagctggtgcagtaaaacacatcaattatattaaaattatccagaggtataaatgtgactcatacttggttaatgaccacattgtttatccttttgatattcttcattgtgacttctgaccactgttctaattttgccctttagagtaatttaaacagatgccttaacatttccacatgcaagatcctaagtagctaaagaccgtgggcacatccccaggaagactcattcccaggaattctccctaggttctctcagggaacggcatctccaggcaacttactcccctgactgtcctcttgtggtcacattagtgtgttaacacccctagtaagtaaaggtatgtccagaactgacactgaattttagatgttcactatcaacccaacgaacagttcattcactcattcaacaaatatttctttagagctttgcactattccagactatacctcctctgacaatgctttgattaatgcagggaaagtcacaggcacatttttctactcttgccacactgttgtcttatactgaacatgggatcaagtaaaatctgtatgcgtttcacaggaactactgccaaggaaggtccccagcatcctatatttatataattggtttttcgaaatgatctttgtgctgtcttcacagtagatcaccagggtttcatgtggtaatatttcaaaattagtattttggtggttgatcaacagaatccaataatattttttaaatgttttttcagactttaaaagttaaatttttatatctgtttagaaagaatcctttccttccttatatgcctctccttccttaaaaacaaacaaatgaagtgtgtataattgttctctgttgttatggtttgcatcttatagccatgaactctaacgaccgacttcctatgtgctaaaagtggtaattgatctaactgcattacaatttttcaatataagcaactagttattgaagtggcttaatttggcaaggaaacacctaatgagtcaatggctttattcggttaattcagtgaaaagtgctaatgattcagaaagtttaaggagttattgtaaggccgcctgtaggaaagtactaataaccaagctatgaccaactgcctcaaaagcagggttgccagggtaggcaacttaggatacaaagcactcagtgaaatttgcatttcaaatttgttgttcatctgcaattcaaatttaactggttgtcttgtgttttatctagcaactctattttgcagccttcaacatagcaatgattaattaacaggagatgttaataccagatttacttctccatgggcattcactacccacaaaaaaggtagccaacgtattttgatgtttgacttctgcaaaattagaagacataagtcttttttggaaatggcttaaaaatagaaggggcaggataaaactgcagatgccaactgtcattttccactccatccattcatttcataaaattatacagccagaaaaagatcatttagtccaaatctatttacttagaaatgtcacaagaccaagaaagtatcttacttttcaataattcctcagaatctgacttcgcatctactcaacctatttcattttggatgctgtaaggtcttcagagctagaaaggatgctgcagtaaatctggccatcaggcagctaacaaagagggcacaccagacagcagacaatgggctaatgctggagatggccctggaagggcatgggtcaggttctatgatgtcctggtgatagaagtattccaaggctggacagttctgcaaaagggataggagctggggaaatcaagaggagcagtggccaggaaaaatgtgcgtgacttaggcatacaagatgtataggaccatgaaaaatgggaaagcaaaactccataagaatttttggtaggctgctagttttttaagttacattccacagccggatgtgatagagtcccagtcatgatacctcatgtcactggccaacagggttgattgagccacaaccaggcttatgaagttggctttgcccctactcactgcttcagctgaatatctccctaaactgaacattctggtaaaaatgacatcttcctagaaataagaccaatttaagcataggtgagattcacagtctataatagagaaaaccataatttatgactttttataagctaagtttatcattgctaacactgttctttctttcatgcacacattccaccgacaaacagccaaaaattttaaataaaccaaaaggattcaatacatattcacagttctagacttattggctctagaaattggggccttttccttttgttttatgctaattaggcttgaagtcataatttcccttaaacacatgagcactattaagcgccaattctggggtatttaaagagttacaaagagagtgcaaaaggggaaaaaaaacatgaatacgacctcattcctttctttaaaaggatctcagtatagttaatgaaataagacatatttatatgaaaagttggcatatattgcctgtgcttttatgtaaaagctgcattagtataaaaaacagtaaagattatagaaattcaaagaatccatatcacttttgataggggtgctcaaaatttcattgcagtaaaaaaaagagggaattgaacctggacttaaacagttaagattcaagtaaaactgattatttgagcatctactcaacggggagagtaggcttattcacatatattctctaaatttatgtcatttcattcaaacattaaagcatatcatttaccaataaagcctcaaccatttacttcttccatatttcatatataggtaatgatatggtttggctgtgtccccatccaaatctcaccttgaattgtaataatcctctcacatcaagggcagggccagctggacataattgaatcatgggggcactttccccgatactgttcccatggtagtgaataagtctcaagagatacgactgttttataaatgtgagttcccctgcacaagctctcctgcctgtctccatgtaagacctggccttgctcctccttgccttctgccataattgtgaggcctctccaggcatgtggaggtgtgagtcaattaaacctctttgctttataaattacccagtcttgggtaagtctttattagcagcatgaaaacacactaatacaggtaatgaggtatgctagtagaaattaagtttgtactgtgtttgttttccctatgtcttgggaacagatgtatcagaaactcacacactcactcgattggggagaaacgtggggattctctctacaaagagcacaatcactgaaagtagtctgcctgaaggatagtgtcctatttcaactttgacatgtgatggctcctgagggtagagcattgaaaagaaggcaaaggatggtcgagatacatcccattcacctatttccctgtctcaagtaaatgtatatcctgggaaggacagacagacatgtaatagggagaagtgaggtggctggctacattcagttcagtaattgaatatagatacaggtattggttctgaagtttttttaacatggtaaaatatatatataatctacctttttagtcatttgtagttgcacagttcagctacattaagcatattcacattgttgtccaaccaacaccaccatccaactccagaaatttttaattttcccaaactaaaactccatacccattaaacactcacttcctgattcctacccctctccaggccctggtaactgctattctattttctgtctctaggaatttgactacttgagtatctcataaaagtggaatcatacgatatttctgtgtgactgcttatttcacttcgaatattttccgagttcttccatgtcatagcatgtatcaaaattttattcctttttaacggtgaataataatatcagaatatgaaaaatgcctacagcagcaaaaagtaagccaaatagatgtgaagccaacaaagggcctccatgttatatacatacataccacattttatttatccacttattcattgatggacatttagctactatgaattatactgctatgaacagtgatgtacagatatctgttcaagtccctgccttcaggttttgggggtatatacctagaaatgaaattgctgggtgatcatctatatttcagttgtgtggaaccaccatactgatttccacagcggttgcaccagcaaagtacaagaatttctatttctctacatccctgttgaactttttacttccttttttgttgttttgataatagttatcctaatggatgtggtacttcactgtggttttgaccagcatttccctaataattagtgatgttgagtgtcttttactgagcttattggcgtgattatgaagatttgaaagttacattttataaacatagcatcaatccaggcaggccaaagatataacatttgtgaaagcaaaaacgaattgaaaaaacacaaacaggtgacttttcaatgccattgatcagcatgctacatttagtacttaaatactgaaaaagaaacttaaaaatccaaatatagaataaacggttaagtgtattacgaagcacttgtcacaaaagaacactaagttataaaagtaggaagactggtaggtaatacaccaaaatgtttaaggtggttatttttaagtgtgtttcataagtaagctttgttttattctttacacagtcttcatccttggcactcaagaaatatttcctgattaagtcacaaattgatttttttataatagtgtgtaattacgaaataagaaacaaacatatttgttttaaaaggaaaaataaagtaaactagtaaattggttctgctgtacattagaattgtctagggagcttttaaaataatataaatgtgtggtacttctcttcatcaaagatcagaatctttgggggtggaggagcccaagcatctgtaatattaatacacaaagaaagttgagaactactgttgtggaaaataagaatgaattaggccctttggaagtgttctcttcatcgtccgttgctgcagttgattaaagatgaaccactcaaccagcctaaattgttgacccacaaaaccatgtgcaaactataatagctgttttaatgctctaagttctgatgtggttacttacacaacaacaaattattaactcacttaaaattttccccaataagggcttattgtgtgttaggcacaatacaagtgcgtaacattcattatctcattaaattgtcctaacaaaccaataaggaaaatacattatttcaaatgaaaataggcttgggatgcttacacagtttgctctttagcatccaattccaatcactaatatactaacatttgcctaatataaattagaggaaattaagagagacaaattgcaagatattgcattgtaaatacataatacatacacaaatacacaaaaattcattgtaaataattcatcagcatgcttatttttcaactaatgtaaacactcaacattaggtagtcagttaggtatgcctttggcataactgaataatatatataatatacattgtactcattaggtaacttctcatcattcatcctacttccacccacttaccctgccaagtccattgtctatgactgcacactccatgtccatgtgtacacattctttagctcttacttataagtgaaaaaatgagctatttgtctttctctatctgacttgtttcacttaagataatggcctcccgttccattcatgttgctgcaaagtacatgattccatgttttctatggttaaatataattttattgtgtatatctgccagtttctttatccaatcattcattgatggacacttaggttgattccatatctttgctattatgaacagtgctgcaataaacacaaagtgcaggtatcttcttgatgtaatgatttttcctttgggtagatacccagtagtggaattttaaaactgtaatagaaatacaaaaagccaaaaaaaaaaaaaaaaaaaaaaccaagcattttaagatcaaacaagcaaaaaaaaccaaaaaaaaaaaaaaccccacaaaatttcaagatacttcaccaaaaaaaaaaatatatgaaaagcaaataggtaaatgaaaacatgtgcaacatcattaaccattaagaatgtgcaaattaaaaccattaagacaccactacacacctattagaattgttaaaaataaaaagactatttcaagaattggccaggatattgtgctgctaattgggaatttaaaattatataaccactacaaaaacagttttgcattttcatgaaaggctaatcatatacctcatatggtctagccattccactcttaggtattacccaaaagaaatgaaagtttattatgaaatattgaaaaaatgaaaatgcatttctaaacaagccttgggtaaaagaagaaatgaaaatggaaattaataaaattcaaaagtgaatgaaaatgaagacataacataacaaaatttaggggatgcagctaaagcaatatgcaaagaaaattttttgggactaaacagaaaaaagtttccaattgtcttcacattccaccttcacaaacaaaaaatgaagagcaaatgaaaagcaaagcaagaagaaaaaagaaaacaataacgatcaaggtgaaaaatcactggttgagaaaacagaacaataggaaaaagaccatgaaaccacaactttgttctttttgttgatcaataaaaattatactgtcttgtcaggctgatcaggaaataaagagaaaggatacaaattaccaatgtcagaaacaagagaagtgacaacactacacattgtagagataccacaaggataagagaatattctgagcaattttctacctataaatttggcaacttagatgaaattttacaattcctgtaaaggctaaacacaaggacctactaaatttcaagccagagagaaaagaaaacttgaatagacttatgtctattgaagaaactgatactgcattaaaaaacctcaaacgaagaaaacttttaggcccagatgtcttcactaatgaagtctatcaaacatttaagaaagaaaaagaagcaattctacacaaatgcttgagaaaagtgaagacaaggcaatacttccaatttattttttttcagccattattactttgatacaaaaacaagacaaagatattgtgagaaaagaaaaccgaaaatgaatattccttaagaacacagaaatgttaacaaatagaattcaacaatatgtcaaataacgatacattgtgactgaatggggtttcacccaagaatgcaagtttgatttaacctttgaaaatcaaacataatttaccatggtaagagagtgaaaaagagaaatataatactctcataaggtttaaaataaaagcatctgacaaaaatctgaagtctgtcttatacagtcccacagcaaattaggaaaaatagagaactttctcaacctgataaagatcatctatgaaaatctacagttaacattacatttaatgatgaaagattgtctactttccctctgagattgaggccttaatgttaagtcttacaacttccactcaacattatactggagctgatagccagtgcaataagtcaagaaaaataaaatgcataagattagaaaaaaattagaaaattcctattctcaaatgacttgattgcctccatagaaatttctatagaatctaaaaaatgtcattaaaactaataagtaaacttaacaattatctcggttataaagtcaatatacaaaatatctaaaattggaattaagaaacaccatttacaatagatcaacatataaaatacgcaaaaataaatttacaaacagtttgtgtgaattgtacactgaaaagtataaaacattgctgagtgatattaaagaagaaagacctaaataaatggagcagtatttgctctggaattggaagacgtaacattattaaaatgtcattattccccaaagtaatctacagattgtcaatcaaaatcttagaagatggtgatagaaactgacaagctaattctaagattcatgtgacaatgcagagaacctgaaacaggcaaaaacattttgaaaatgtagtacaaaattaaaagactaacaccatctgacttcgggtctcattgtaaagctacagaaatcaagacaatgtggaattgacatcaagataaataaatatatcaatggaacaaaatgagggtaaattcaaaaatatgttgaccattgagcttttgaccaagtatcaaaggcaatttaattgataaaggacggtcttttaaacaaatggttctagaacaattgactatccattataaaaatatgaactatggtctatatcttgcatctcttgcaccatatataaaaatgaacttgattcacaatagcaaagacttggaaccaacccaaatgtccaacaatgatagactggattaagaaaatgtgacacatatataccatggaatactatgcagccataaaaaatgatgagttcatgtcctttgtagggacatggatgaaattggaaatcatcattctcagtaaactatcacaagaatgaaaaaccaaacaccgcatattctcactcataggtgggaattgaacaatgagatcacatggacacaggcaggggaatatcacactctggggactgttgtggggtggggggaggggggagggatagcactgggagatatacctaatgctagatgacgagttagtgggtgcagcacaccagcatggcacatgtatacatatacatatgtaactaacctgcacaatgtgcacatgtaccctaaaacttaaagtataataaaaaaaaaatgaacttgaaatggatctcaccaataaatgtaaaatctaaaactgaaaatttgaaaaaccacttatagaaaaaaacataagagaaaatctttataatctttgcttagacaagaatttcttagataataatacaaaaatctataaaaatctataaaagacttcatttattttgactgtcaaaataaaaaaaattaaagacttcaaatttaaagatttttttaaaaagccaaatattgagagaatatcttgcaaatcacatatttgatatatgatatattcttgtatctaggatatatataaaaattttcaaactcagtaagaaagcaaacaatcatattgaaaatactaagaaaaagatttaaacaaacacttcatcaaagaaaatacttgagtggcaaataagcatgaaaagatgtgcaacatttttagtcattagggaaacgcaaaataaaaccacaatgagatactactacaaacctatcagaatgtctaaaattaaaaaggctaatcataccaaatactggtgaaggttgggaataactgaaactcccatgcaccgcttctgggaacataaaatggtaatcagtttggaaaagattttggtgatttttacaattgagacataagctgatcatatgactaagctattctactcctagaaatgaaagcatatgtctattcaataattagtacacaatattcagagtaactttatttataacagtgcaatagccaaaaatgtgataaaaacaaatgtcaatcaacaggtaaatgggcaaatactgtggtaagtctacacacctgtatacaggtgtgcaactttctagtgtgtagatttaccacagtgtttacccacttacctgatcatttgtttttatcacattaaatataccagcaacatgaaaaaattttaaaataattatgtttaataaaacaggccagagtaaggagtgcattctatattattccatgtaagtacattatagacaatgcaaactaatctagagtggcaggaagcagattagcagcttcttgaggctgggaaagagtggggaaggtgccgcaaagcagcacagagaacttcttggggaatttctgtgtttactgtcgttactgtggtgatggtactgaggtatacaaagacactaaaattcacaaacatttatatgccagatacatgcagtttattgtatgttgattatgcctcaataaatccacatgaaaagaaacccaaattaacccaaaattatttgtaggggtaaagtaaatgcattagaatacaggtagacaaggagatactggaaatcttgaacagtatcagtaatgctttgctaagcactggcacagggggtccacaggtgcgcagggggtccacaggtgctcagttcataattctgcttcacaacttgcacacacactataaactctagtatatataaaatagtaaaaatattgatccttatatacaattaaaatggcctctatttcacaatgacaaatatgtgtgtatatgtgtacgtatctatgtgtaagtgtatatgtgtacatgtatatgtactggaatgtgtatcggcatgaaggggaagaataaaaataaaaataaaatgacaaaaatgtctcacatgaaccaatggcaatattgtgtcctaaactagtgagtatgactaattcaacttttgcatctgatgtaaaacaaaacaaaacaaaacaaaattactactgttgctttaatccactgggtgatttcccagtaatttaatttaaaaaaactggcattaagaactaagcagaacgaggatattttaatttggaaaaaaaaatccataaatacacaagtaataacattattttaaaattaaatgactgatttcagaaggaaatgttttcaacaactttattagtgctagagccctcatgccacagctcctggaagacttcaggctctcaatttaagctctttgaatgtaaagagagccagacaaacagcttttcttctgtaacactccatttggctggttaacacaagttatcgattctgggatttagggttgccaaatgctttcttaagagctctgtgctattgactatcctcgtttcctctgcacttcttttcttagtcttgggtaaaatttaaaactctttgtaccatttttcaactcatctcgacggaaacagcctcaatttactataaaaatgtcaatggctcactagtgacctaacctcaaaggattgggaacgctgcctcagacatctcttttctatgttcccagggtctacagaggctctaccacaacaagatggggaagcccagtctgtaatccagcaggacagtggaatgctactggtgagacctacaaactaagtctgcagcacagtcctgcagcttccccgaaagctcagcccaacaagcttcctgaatttcacattcattttacacaacatacatgttagtagatatttttaacgtacatatgtctatttaggggaaattattagcatcattattgccaacttacaagttattattttgcaagttttatgccctttagaagtgactttgtaacagtttaaaatattattttctttaggtaaagagtcatatttgaaaaagagtaagtcaaacaaattgtatacattttataaatttgttgaaaaccttattcttagagactgtaaagcaatggagatctttgcaaacatccgtggtcatgtctaatggtgacggcacacataatagccaatcagagctcagtaaaacataagccagcaaatcagaggccgctcatagaaggagtccaaattcctttactgcaggatgaataacttgtaaaatcctaacattcacattctaatcctctgaatgaatgctgagtagggaggagacgaagcttagaagcaaaaggaagcttgcatcctttgatgtcctctattgttgaagttacaacaaattaagacaaaaataatagttatgttagaagacaaattaaatacacgaatcataaagtagaaagaatttttgaagaaatgatattcagcgttcccagggattataagtcaggcaaaattaagtcatgcagcattttaatgtaaatattttgcatgatacatttacccacaggcttatcctaaagcagtatgtttgcacttttatcatttgccttaggatgaaaaaaaatcaatgaatttaagagttttaaacctctttaatatttgcacaatattagatgtgctataatctcatataaaactacctcctagagagcttttgagaattgcttttgcctggggtctctggtactaatacttcaagagattagaaacatcttacttaagaagagttttctttttgcccattaaaatcaaacaagctttgttaaacactgaggcagaagagattcataaatcaatgatactcccctgaactgcccaaggtttgcatcatagattaaaaaccaatctcagaattgaaaaagctacagtgccacatatctgtcacaacactaatttactgaacttaggaagaaaataacactagcatagatttaaatagttttctatgcaatatgcaatgaatcaatgtactgacttgcttggggtttatgaaaacaacaactgacaatgaatatcatcctaagtaaagagaggagttatggtttaaaatcatgtgactacacaattcctacatttttttaaagaataatttacatcaaaatttttctctaactctaccctattatcacagattcttttccttgcattcttttcaatactatttatctgctatgaataatatttccatgtttaaagcattctattattttatgacctaacaaactccaggatttaaacaatgctcatctaacaggaaataccgcccttccaatctaaccttcatatgctttcgttttcttccttttcttctctctgaacatggaaaatgagtgccatttctatgctgaatattgatcaggagagaaaaatatatgaggtgtgagttatattgtgactacggtgattttccatccactcagtattacttatcgtgtcaatcacttaatcctgcagcataagttcttttttgcttatgatggaaagttttgttgtgttttattttttatttttgttttttgaaaaaagacatgagcaatctgattttctttggacttcacaaaatccaagaaagaagatttactgaaaattcatttcttaaaaaatgtgaggtccttgacaatggtcttctctacagtttcaatgttaggttttgaaaatgtgaggtccttgacgacggttttctctacagtttcaatgttaggttttgaaaatgttaggtccttgacaatggttttctctacagtttcaatgttaggttttgaaaatgttaggtccttgacaatggtcttctctacagttttcaatgttaggttttgaaaatgttaggtccttgacaatggttttctctacagtttcaatgttaggttttggtcatctctgagcgtgcataacatgaatggaaagtttttttcggagatcagaccgttatgatttttggaagtgtttcctgtcaaggagaagctcatggtctccaaggtcttatctttctactgggtggatgggccaagggaacacgaagaagcataatggagctctgtctgagagaatcaccagagtcttccccagcgtttctcaatggtctacaaacaggtctgcgggcttggatcacagacggagatccaagatgggcatgggcatttacgtgggcagggcaagcgacgctggccacactgcaaggccctcaacgttcccacgtgaaaaaagaaattgttcctcaaacagcaccactaggtcgggtgcggtggctgacgcgtggaatcccagcattttgagaggccaaggcaggcgggtcacaaagtcaagagatcaagaccatcctggccaacatggtgataccccgtctctactaaaaatacaaaaagttaatgggcatggtggtgcacacctgtagtcctagctactcaggaggctgaggcaggagaatcacttgaacccaggagacaggagacagaggctgcagcgagccgagatcgcaccactgcactgcagcctggcaacagagtgagattccgtctcaaaaaaacgaacaaacaaaaaacagcaaaacaagcacacgtgagaagccctgcttgttctgtgaacacagtcatttctgcctttccttcacagtaattcaaaagcatttactgaacaacgaatgtgtattagaacttacaaagatgggtgaataagaaacagctccttccttcaaaggtctccctatctacgggagaaaagagaccggtaaataaagggccgtgcagacgtatcttataagtgctgagctagcagcaggacaaacgaataaaggaagaaatggcagctctgatattaaagccctcagctcctcctggaaagaggaaccaagccttggtgaagcttcagagaagaaggaacaattaaaacaggctccagggatgaggagaatggactggatggaggaggagcgagcggctgccaaggtaggtgtgcctccaagcacagaaggcagccaatggtcatgcccggttcctgggccagagagcaggggggtggtaccaggtggtgctagggcccctgctacatggctggagtttctcttcttctctagttcattccatgttctaaacacaacaaatcacattgcctccaggtgttaggaccaagaatattaaggtcctgaaccaaaatgccaatatttggtaaaatggcattccctcatttatatatataagtgcgtatctgtatgtgttcgggtacttctataaaatctgccagtttttaacttcctaaatataatggctaactcttttattgtagacaaaataactaaataattgcacagacataatccaacatcatgggtttgattttcttaagggtagaacagctccagccatataaatgcagtgtgtgagtgaaaatgaggacggaagagcgggtgcagcacgggggacccagcagtccttgagccaaggtctggaccctcaaaagcagtggacgtggaaggtggtagctccgatagccagtgggcatatacgcacagagagcctcactctccagctccaaagccttccatatcgatggctccttttagcactacagggtcctaaggagagatgtcaaaaatgtttaacaaccgttgcagcagtaccgggttggaagggactccgtaagcaagttcctacctcctgagcatcaggtctggccttggtgatggtttttctctgtcaaggagattttcagcatttgcagtacattaattttatgcatgaaatttatcttcatgtactgttcctttgtttatttttgagaggaatataaaggggaactaagaacaaacttttgctcgaagccctactctagaaagaattctagagtaacaggatctctaaatttcaaaggaagccaaaaaataaaaaaataaaaaaactcaataattttgtacattttatatatgttttggtagaataaaataaatcctgtaaaaccacagaaaggtaatttaagtacttggaaatctatgtcaatatagccaagataatggaggtaaactaacctggatcagagaaaacaaaagttggaaaacactgagggatcatcttgtcggcctatcagaaacggtatccaatctacaacatcacagcaagtcaacatccgatttcttcttaaggctttccaacagcaagaactttgccatcttacaaggcagtccatcctatcaatgaatagctctacgtcttagaaagttcccctcaggaaagaaatctggtcctctatacctttcatctatcaatccaagttctgtcctctggtgtcctaaagagcaagtcaggtcttttgaaaaagatgtctcttctcatatttccagtgcttatcatgtgcctctataattatgctcttttccatggtttataagcacattgctgatgtgatgtggggtctctgcattttttcttggtgctgtcttgggaagcggcatagtatggtggtatcttctgaaactgcagactccaggcccaaatgggctgtggaaaggggaccttctttatacatgtacataagttctgagcaataaaaaattttattctatctggtatttgtgcagtagctttttataaaagaaagcaaacagcttcacctttgtttctgttatatatcctcctgttggttcagcgcataattccaactataaaggctgaaactgaattctagatattgagtctgtcactcagggcatccgttgttcctgcaagctcagaaccaagtctgctatgcattccttctgtgttttgtacaagcagatggaaaatgtctgaaacaaaaagaaactaaacaggtagtgctttcacatgccactagagatttccttctacttcaactgtgccattgtatttaagtgaagttctggaagttacaaatccccctgttactctgctgtcctatgaaaggctatgaagaaggtgcatgtgtgaaagtgccagctgcttcactgacacactcaccttcacagcctaagcaagggtgttgatcccacttgacacatcaggaactcgtgttgtggaggcattcaacagcccacctaaagccactgagtgggtgggaggcaggtgagtgactgcaatacagaccccaggggtccttcacttacaaacacatcaagagaagacacagtgttgatgcccagatatatcgtttcaggttttccatcactctattacgattttagaaataattttaggcagggcacactggctcacacctgtaatcccagcactttgggaggccaaggcaggccgatcacttgaggtctggaattcaaggccagcctggccaacgtggtgaaaccccatctctattaaaaaaaaaaaaaaaatgccaggagaattctatcacaagaagcacaaggatgatctgtgccccgccataattcaatcgctcccaaccaggcccctcctccagcaatgggaattacaatttaacaggagatttgggtggagacacagagccaaaccatatcaaccatcaatcctaaacagtgggtttaactttcctttcaggtctcagaaaagtacacaggacaataaaatatgcccgcttcatcatttcatttatgtatccatcccttcattctttcatgctgtaaacaacataaactgtagctcattcctttcttctgctctatgaaaacatttttacagcttcccatctttcttcctacttatccttggttacttgtcatttcttcagcatttgtacttcccctttcaaaatgtgagcttggtggacaccacctaaattggttttgttagatatcaccccatttttctttctgagtatcatcacatgtcagtaaatagttggaatttattcttccagaaccttaaatcaaattccttcagaggatctagaccctgccttttctagaaatgtggaggccagttttcctaaaagccatagtacgtgtctgattgacctggcattttctttcttgctgactgagacctccgtagcggtggggttattgtctctgacactgcaactcagtatggaatatgtgttccccttgtagcttcctccaccatttttgagaatgcatgttaaccaataaagtcaaaactttaatgacttttagtgggatgtattcagatatttgttcattcaataagtattgatcaatttcttgcaaaatgccagtcttgtgacctatgtagttaaaatgtcacccctactcttccttcccaagaactctgccatctgctctttaaaggttacaaatgctggctcagctcaaccagaattaatccaggcatgtggtttctttggctaacatgttgcattacaaaacgaagtcatttctccaaaatttcacatacaagatttcacatacaattccaaattattaattcctcttgaaaaactggaagacaactctgagactatatatccatagggccaaaaccagtgagagacaagcagcagcttcccctgcagaaaggttttatttctccatgtgaatgaagataagttctccaggagcagtgtcaacacagcacacaacctggcctgcgcccctctctctcctgagccctgtaggcatccaggtttatacctcctgccctaagtaaagcctcaatcctcctctcctttaggacgcacataaattatttctgccattcctgctcccttggattggtaaattatcgtatcagtataaacccatgccatcactagcccatatggcccttcatgaaaaattggaaaaaggcaccctaattctactttatatccatctgttggaaaattgctgtgaattactgattttgtcatatgaagttacatggcttctttatcccagaaatttatcataataaataaccaatagcaaatcttggaatcgcactgtgtgaatggtgtccctccacatgagacactggcaggcagggcccagacagcaccaacatccacgacagcccccaacccacacctgcttgtcacctactacagttccatccaatagcaccaccaccaacacttccactgccccacacacagcttcatgaaggccattatgccaaggggaggttttttccttccaactattatttctatgaaattttttccttctaaaatttgctctccaaatattttaccctgcacagggctctacatgctgctatttgaaagaccagtagcagaatcttcactaaccttccaaacagatattttgagataatattaaggggactttatttccatagtttaaagaaatattttgccctgttactatactttttcctattttgaattttaactagagaaagagacccatatattcttgatgtgaaaagggacaagttactctttctctgctactctctttttataaaaaataaagcaaataaaatgccacattaaaatctttttttttttttttttgaaacagggtctcactgtccctcaggctagagtgcacatgcaggcacacctcttgtcattgtgcttcaagttgttgtgctttgaagatactgcattttttaacaaattgaaggtttatggcgaccgtgcatcaagcaagtccacaggagacattttgccaacagccatgtgctcacttcatgtctctgcatcacattttggtaattcatataatatttcaaacttttccactatcattatatctgttattgtgatgtatgatccacgatcactgacataaatatcgtctagttttggggcaccaccaaccatgcctatataaaacagcaaacttataaatgttacatgtgttccgactgatacgccaactgcctgttagacactgtctctgtctttctcctcaggtgtgcctcccgatagcctgagacgcaactatactgtattagaccaattaataatgctacgacggcatctaaatgttcaagcgaaaggcagagttgcatgtctctcactttaaatcaaagctagaaatgataaagctcagtgaggaaggcacgttgaaagccaagacaggctttgcaccaggttggctgtaccaacaagttagtcaagttgtgaatgctaagaaaacttcatgaaggcaatgaaaagtgctactccagtgaacacacaaacgaaacgaaagcaaacagccatattgctgatatggagaaagtctgagttatctggatacaagatcgaaacagccacaacattccctaaagccaaagcctaatctaaagcaaggccccaactcccttcaattctacgaaggctgagagaggtcaggaagctgtaaaagacaaggttgaagctagcagaggttggttcatgaggattaaggaaagaaactgtctccatcatgtaaaaatgcgaggtgaagcaacaaatgctgctgtagaagctgcagcaagttatccagagcatctagctaagattggatacaccaaacaacagatattcagtgtagagaaaacagccttttattgcaagatgccatctgggactttcatagctagagaggaaaagtcaatgcatggcttcaaaacttccaaggacaggctgattatcttgttaggggcaaatgcagctggtttaaagccaatgctcatttccattaaaatcctagggcccatcatgctgaaatttctgtggccatgctctataaatggaaaaacagcctatatgccagcacatctgtttacagtgtgttttaccgaatattttaagtgcactgttgagaactccagctcagaatattactgcttattgacaatacaactggtcacccgaaagatacacaaggagattaattttgtttttatgcctactgactcaacatccattctgcatcccatggattaaggagcaattttaacttgcaagtcttattatttaagaagtatatttcataaggctatagctgtcccagatattgagtcttcttatggagcttggcaaagatctttgaaaaccttctggaaaggattcctcatcctaggtgctctaacaacattcatgattcatgggaagaggtcaaaatatcaatatgaacaggaattagaagatttggattccatctttcaatgacttactcctcagtggaggaagtcactgcagatgtggtaaaaataacaagagaacaagaactagaagtggagcctgaagatgtgaccaaattgctgcaatctcattacttgaatggatgaagagttgtttcttatggatgattttgtttttgtttttgagacaagagtcttgctctgtcctccaggctggagtgcagtggcctgatcttagctcactgtaacctccgcctcctgggttcaagcgattttcctgcctcagcctcccgagtacctgtgattataggtacacggcaccacgtttggctactttttttctttttcttttttttttttaattgttgtatttttagtagagatggggtttcgctaggttaggcagggtggtcttgaactcctgacctcaggtgatctgcctgcctcggcctcccaaagtgctgggactacaggcatgggccactgcacctgacctgtaggttggttttgagacataatgctatcgcataattaatagactacattacagtgtaaacataacttttaaatgcagcgggaaaccaaaacactcatgggttgcactttcttgctatatttgttttaccgtggtcttctggaatctaacctgtagtatctctgagggtgtgcctgtaacaataccagagttcattttttctaaatataccttttgttaaatcaccaccattttcttaaaaagcaatatgtttatgccaacaacatactcagagtgagattaaattctttaaaagaagttgactttttgaatgtaataaacttaatatataataattacatcaaactgctcttatttctcctattttatcgctcaccagtgattttgataatgccttcttctcctcacccttctacacagttcaaggccaggcctgccattccttcagaggtagagggctacacaactggtaagtccatgccgagtgaagcgagggtggccaactcttccagcaaagagaggggccctgggacttgagactttaagtgctgaaacaggaaacgtcctgggtaaactggggaggattggtctcacttaagggcaactagattcaagtaattacagtgattctgccacacaccttggctttctctgagcagtgcggcccatctcacactggaatgcgtgatgctaaagaacctctacagggtaagcaagggcagcaaggacaatggaatagttgggctccatctgtgaaataccagagcagcaaacaggagtatgagaggtttccataacactttctgaagactgtttgtcatttttccacttatctaatcaggtgttttcataaaactcaacagaatatgtatacaagtataaaatgtatacaatgtatacaagtataaaatgttcatattactctatcttcacctcttcttctttttcactagaaagatgtcacactctcaatgccaatttcagtctatgttacagctacaacgatacctcctctctctggaagcctcaggggaatgtctgggtaatggagagcaccgtatccacactttacaattttaaaacttaaagccacacatctgcggcacatgacagtgccaactgccaagtactgaactgacagagattcacaccataatgctaattctctgcacaaggaaggaataaaagtatgtgtcaaaaatctgaaaatgattgatgcctgccatctcatcaagactgtctgtcacacgatttcgattgatgatttgagattgcatgtgagcgggacgcaggtgctgcaggttgcctaactagctcaacacttattctcaacaacacaaagacaaattaatctccacatcagaatactttccataaagttcattagactttactacatctacaaaaggcttgaggtggttggcctaatctcagggatactaaattcctaaccatagaggacagctcaacaaatcagccactttcaaaggtactggtgagtccaagagacccaaaaatgtgagaagcagtgctctggccattgtgaaggcactgaattgttttcatcactgggggagaacatatctactctcagataaggatatccctggattttctggctgtccagttgagactgctaaggactcggtcagaggtgtaattagaagaacaacttgtgatttcagtgattatttctaaagcacacagtactgtttaaacatgactcttatgtatcttgtgactacaaatattgaattagtaaactctcatctctaaaaaggaaccccaaatattgacttgaaaataaccacttttagccacaagattatagatgcaacctgttgaaccatttagtatgaatctgcctaattaagcaagaggatttcaaataaccaaatatttctattataaaacacaacccaaaataacagttaagaaaagttatctcacctcccccatcctcacataaccaaggtatttgaaattgttttaatatttgcataaatatttaaaaagtttcacctttaacagaataggtaactagacgatgcctcatcttttctcagagttcaacacatttggacccattctttagatgaatgcacttgtttataaaaatgtgtgatgaatgtcactacattagcacgtaatagataatccaagttattttcagacttaatcagttgtaagtaaagtgtgagggatttgagaacacagagagagggctggtggctctgcagctcctggtcaacatggaaaatatgcagcatttcccgtggagcctctcagtctcgctggcagctgcaggatcagcaggtctcgatccatcatcattcctccttggccccatacgggctgtgaggacacctgggtctaataacagaagctaatcactcggcagtcatttatgaaagagacataggaatggaaagaaaaccaggaaaaatgaaacagatgaatacaaaagtacgctgaagagactgatgttaaatggaatgggattataggatattttaagaaaatgtgagagtattacaagtaacaaactacttctaatagcaaaatattgccataaaaatacattattaatgttacataatacacaatatttcattataacatattataaatgcatctttaaatatctttaaagttttaagaggataaatctaaaaattaactttccgataagtttggaacatgcatagaatgtagagatttaactttgataaataactctgtactaggacagtggcccgggagacagaaggagaagaagcatttgctcctgacttcaaggttcttaccatctccaggagagacaaatgtacaattataaccacagcaggagatgataaggctaataggtaaatctaaaagaagtagtctctgaaaaagagtgttctctccctctccctctccctctccctacggtctccctctctttccacggtctccctctcatgcggagccgaagctggactgtactgctgccatctcggctcactgcaacctccctgcctgattctcctgcctcagcctgccgagtgcctgctactgcaggcacgcgccgccatgcctgactggttttggtggagacggggttttgctgtgttggccgggccggtctccagcccctaaccgcgagtgatccgccagcctcggcctcccgaggtgccgggattgcagacggagtctccttcactcagtgctcaatggtgcccaggctggagtgcagtggcgtgatctcggctcactacaacctacacctcccagccgcctgccttggcctcccaaagtgccgagattgcagcctctgcccggccgccaccctgtctgggaagtgaggagtgtctctgcctggccgcccattgtctgggatgtgaggagcccctctgcccggctgcccagtctggaaagtgaggagcgtctccgcccggccgccatcccatctaggaagtgaggagcgcctcttcccggccaccatcacatctaggaagtgaggagcgtctctgcccggccgcccatcgtctgagatgtggggagcgcctctgccccgccgccccatctgggatgtgaggagcgcctctgcccggccgcgaccccgtctgggaggtgaggagcgtctctgcccggccaccctgtctgagaagtgaggagaccctctgcccggcaaccaccccgtctgagaagtgaggagcccctccgcccggcagccgccccgtctgagaagtgaggagcccctccgaccggcagccgccccgtctgagaagtgaggagcccctccgcccggcagccgccccgtctgagaagtgaggagcctctccgcccggcagccaccccatctgggaagtgaggagcgtctccgcccggcagccaccccgtccgggagggaggtggtgggggtcagccccccgcccggccagccgccccgtccgggagggaggtgggggggtcagccccccgcccggccagccgcgccgtctgggagggaggtgggggggtcagcccccgcccggccagccgccccgtccgggagggaggtgggggggtcagccccccgcccggccagccgccccgtccgggaggtgaggggcgcctctgcccggcggcccctactgggaagtgaggagcccctctgcccggccagccgccccgtccgggagggaggtgggggggtcagccccccgcccggccagccgccccgtccgggaggtgaggggcgcctctgcccggccgcccctactgggaagtgaggagcccctctgcctggccaccaccccgtctgggaggtgtacccaacagctcattgagaatgggccatgatgacaatggtggctttgtggaatagaaaggggggaagggtgggaaaagattgagaaatcggatggttgccgtgtctgtgtagaaagaagtagacatgggagacttttcattttgttctgcactaagaaaaattcttctgccttgggatcctgttgatctgtgaccttacccccaaccctgtgctctctgaaacatgtgctgtgtccactcagggttgaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaaaaaaaaaagtagtctctgatttttgcaattttatttcgtgagaaccaagaaaatcagaaaagctctctaattctatgcattttgtcccaattactcagtttctctatttcaagtaaattggatataacacttgaataggattctgccttgataagtatttatccaaccttattctaaagtttaattcattgttctgaaaattggatgaaaaaagtgaacttcttaaaggtttgtgaataaaaaatatatagtcaaaccataatgaaattcttcctgaataccaatgtctagacatttccctgtagaaaactggcagatatctaatagagtattgcttctgaaaattaactgtgtagttctgtggtacaaaatcacttgtaaaaaatctcctggtgtcaaaacagcatggaactggtaccaaaacagatatatagaccaatggaacagaacagaggactcagaaataacaccacgcatctacaaacatctgatccttgacaaacctgacaaaaacaagaaatggggaaaggattccctatttaataaacggtgttgggaaaactggctagccatatgcagaaaactgaaactggaccctttccttacatcttatacaaaaattaactcaagacctaaacgttaagacctaaaatcataaaaaccccagaagaaaacctaggcaatacctttcaggacataagcatcggcaaagacgtcatgactaaaacaccaaaagaaatggcaacaaaagccaaacttgacaaatgggatctaattaaactaaagagctttgctcagcaaaagaaactatcctcagagtcaacaggcaacctaaagaatgggagaaaatttttgcaatctatctatctgacaagggctaatattcagaatctacagggaacttaaacaaatttacaagggaaaaaaaaacatcaaaaagtgggcaaaggatatgaacagacacttctcaagacatttatgcggccaagaaacatatgaaaaaaagctcatcatcactggtcattagagaaatgcaaatcaaaaccacagtgagataccatctcatgccagttagaatggggatcattaaaaagtcaggaaacaacagatgctgcagaggatgtggagaaatagaaacacttttacactattggtgggagtgtaaattagttcaaccattgtggaagacagtttggtgattcctcaaggatccagaatcagaaataccatttgacccagcaatcccattactgggtatatacccaaaggattataaatcattctactataaagacacatgcacatgtatgtttattgtggcactgttcacaatagcaaagacttggaacaaacccaaatggccatcaatgatagactggattaagaaaatgtggcacatatacactgtggaatactatgcagctataaaaaaggatgagttcatgtcctttgcagggacatggatgaaggtggaaaccatcattctcagcaaactaacacaggcacagaaaaccaaacactgcatgttcccactcataagtgggagttgaaaaatgagaacacatggatacagggaggggaccaacacacactggggcctgtcagggggtggggggatgggagtggatagcattaggagaaatacctaatgtagatgatggattgatgggtgcaggaaaccaccatggcatgtgtatacctatgtaacaaacctgcctgttctgtacatgtataccacaacctaatgtattaaaaaaaaaaaaactcctggtgtcacttcggccattcaaagtcaaatgttcttctaaatctaggtattcattaaattaacattgtagagggtttgctttttaatgaaatagttttttttgaaacctcactaattggtatagtgactcttgcatggctcttccatcggtatacatatttaagtttgaattattgctaaatcctctttgtgaataactaacttggccttgttctttagttctgtgtcaacctatttggtagaaagtggcaaaagtagaggcaagaatatttcaaatcatgcaagtgatgctgaactcagtttctgtcatatatttaagcacatctgattatggccaacgtttcccttcaactttcactctacatgattgcaatatagtttttccacgagtaagtgagaagtgcagataatactttcaaaacaaaacaaaacaacgttggtgtttaataagaccctgaataagctattgatctgtgaattagcaccaggcacgatgtgaagtagtttacatatattatctcatatcaccttcttaataacttaatgaggtgctattatgataaatattatagggtgaaaaggactaatcattaagaagtcaggtcacttgccaaagtttacatagtaagtaagtggtggacctgggattttgactcattgattaattgacacgacaaataattaagtgtctactatgcaccatgcagtgtgctagggagggaagaatcatttacttactcctcagtgactctaaggcagatttaaggcacggcttctctaagctcttgtgttgtcatttgccgcatgacacagacatagaaactagagtgattttcctccttgtcaagcccaatcatggtgatgattttaaaaaatattattaatgattacctttggcttctaatccctaacgtgatatacttatctactgattacagaaatctttgcttagttttattttccaagcaaacacaaaatatgatggtaggaaaaaagagtccaggttgctcctttcataaaatcttattcctaggtttctctcttgtggcactttaaaaaaaagtatccatgaaagccaaggattgatgtaaataaccattaggaagagcttaatgttgacaagtagaagtcgagtttgttttagaaaaacaataggaaaacctgttatatactgtctgcaatgctaaataaatatttctcatcagaagaaatatctgcttattacatttttgtcttcctgattagtatgctttattcctgacatcaacttgaaaaaagatgcaataaatgagaagtttaaataacacaggtataagactgttaaccttgggatcaagggattatttgttaatatttttaaaatgataatacctttatattaaggctaggttctagacgcacctcacattctccacccctttctggctttgcagaagccatgactgggtctgtggaataaagccttagccatcccgtgtggttgttgtttgctactacagcagtagccatagctcttaccctcccctaggaacagcaagttgcattgctatcctggtttcccagaaacagtaataagaaaagagtaggaagtataatggtagactacatggtggcactagtggtggatcaggtgaagtatattggatatctgagactagatggggtttttttaagtgtacttacataggatcaaacaacatttaactttctgaatatgcatttagtaagtataaggcacaagttgtttctgtacattcattttcatggaaggggtgtgtgtgtgtatgtgtatgtgtgcaagcatgctcacaagtgtagaagacagggattatagaagtaaaataataatgcaagatatgcaaaatttaaacagttaaaattttaggaaacctacatgatttctaatgttgcaagataagaaagcttctgctaaaaccaacatatacaaaaacgttacttatgaaatacttttgtagagatttcacccatgagcaatagaaaaaaaggaaagttatttaatatattagaaaaccctaagaaacgtggtctgtggtcactccctctctggcacctttaccacagtgatgacagagctatgcggaaaagaatttctgtgccagttcagccatctgctgttggctcacaaatggagttaacagtctaaaaggaaagtttgttttgaggtgccattcccatgtgcatacaatccacaaactgcagtgtataaacgtggctcagtctaataccaagttaagacttggtttttttgaagagcatattgcacagcattttctggaaatgctcccaatattagatacatgtcacattcgcatagaaacatatggtcttcaatgtgcaatctcaaatcgtctacagagactctgcaatcagagattccctgttttaccttccttttataagtcaattttcacttagcaaactatcacactgtggtgatttggaggcattattttaattcctaatgtaaatttacttttaacagatgtgattctatgaatcatatagcagcatatgatattagttattagctgaaatgatgccaaggggtgttacgtgctggaaactagagcaactgagccaaaccaaggtcacccccatcactgccctcacagctgggtcagggaggtctggcctggcccttgtccattctgaaggttgagagaaaaatggcgtctttatgatgccccctgcccaccgagatactcagatatatttcgccctgtccttgaagcagccccactactactaacagtggctctgaaaatgtggacttgacagatagtacctgtcactggctttctatccaggctccattcctttctgggctgcaggtttgaaaatggatgtgccccagggaacctgaatacagtgagttcacacacaagcaggaaagaagtgagtttcttttggtttgggttgaagcagttgctcaaacgtgataggcagaagaggtaaggatttcactgtgctttaacaaaatgcttccatggtaatcagtcctgtatactgtataatcactatacagaaacaaagtgtgcaccaaaaggtaaagaattttcctaggacaagaccgcagctccacaaacaaccaaggaagctgttcagaaacctctttctgtgctctcttactcccctgagttcatccccaggccccagggcctcccattccagatgtgaagaggtgaagaccacgcctggaataactccgaatacaacacaattgctcctcacatatcagctgttcttttccctgttcactactgagaaaacatagataaatcacggcactttctgtctagcattgaaaatggtcattttaagaatcagggcagatgttggctacacacagaaagctgcccaagggtaggcttgaagcaaaataaattaagaaacccatcatgtactcttgagtgcagggaaacaaactgataatagcaacaagtatgcatccttttcaagtaaagataatgagtcaacctgctgattgcatattgtggtgactgaatacattgtgcaatgattaacaaaagaactgattgttcgtaattcaaggaatatctttccatttactgaggctttacttaacctctagcaatagttttgtcaagttattcacaaaggccgtataaatcttttgttagattattccaaggttcagcatatttttgatgcacgcaattttaaatggtagcttagaaaaatcacatcttctgcctgttgttagcatacagaaatgcaattgatttcagtatgctgaatttttattcagcaaagttatacattctcttatgaatttatatgacttatcgttatattcttttgagctttgtagtcacattagctatgaataatgataggttcttactttccaaccttgaaacttgctatgttttgaatgtgtccctcaaatttcatatgttggaaacttaatccccaaattcgtatgttgatggtatttggaggtggggcctttgggaggtaattaagattagataaggccatcagagtggggccctcataatgagactggtggctttataagaagagaaaggagatcttagctggcatgctcttgccctctgccatgttatgacacaggagaaaggtcctgaccagataccattgccacgttctaggacattccagccttcagaactatgagccaaatgaactcttttctttgtaaattacccaggctgtggtattctgttgtaacaacataaaacaaagacaataacttttgttcttttactagccatattcctttcagtggactggtcataatgaatataatcgtgttttttcccaatcttaaaaataacctttgagcatttttgccgtattttccacagtttttaaatagatctttttctattagattaatgaaaatttggctgggttcagtggctcacacctgtaatctcagcactttgggaggcaaaggtggatgaattgcttgtgcccaggagttcgagaccagcctgggcaacatagtgaaaaatctgtctctacaaaaaaaaaaaaaaaaagctagccaggtgtgatggtgcatgcctgtagtcccagctccctgggaggctatggtgggaagatcacaggagcccaggaggccgaggctgcagtgtgctgcaattgtgccactgtactctagcctgggtgacagagtgagaccttgcccccatacccccacccccaaaaacaagaaaaaaaaagtcctctatttctagtttgatacgtttttaaccatgactgcatgagaaattttttaaaatactttttcagcatctactgagatcatgtaattgttttaatctgtcaatatggtaaattacattattgattatttatgtttacataacatgactatttcatgttactccagacaggtatatctggaataaatcctagagggttgtgagatatatatctatggatatatacatatatctatatatgtgtctatatctatttctaaatttgctttcctagtatttgtagtcatatcatcctttaacaacattttaatttcagatttatatttgttaagtgtacttttttattcctaatattatttgtgtctttagtatttttttcttgatcagtcttgtgagatgtgtatctattttctttgctttttaaagagcaaactattatatttattatatttattttatttttttctttgttgatgtctggaattatttttattattttatttatccattttctttaggttctttctgttgtcttttttctgacatcttatgttggatgcttagttcactaattttcagcctctgttcctttctgatgaaaaaaaaataaagctcaccaattttccttgaagagccattatagccacacatgtaaaaggatcaatttttagtatatagaattttttttttattttgtatttttctacattaataataccatctaatttcctttatgatttcttctttgatccattagttacttaagaggttttcttaattttcaatatgggttgacctagttaagttttctaacttcatttcattgtattcaaagaatactgggtataagaaattaatctttggctttgatgattcttgctttatgacttaaatatgtgtgtttgaataaagagaatgtattatttgtgatgaatatcacatttataaatttgtgtcagatatagtacttatgtatatatatatttttatatagcatttgttaattttattgcttaaattttatctatggctccctcttatttcactgagacaaatagatttagaaatctcccattacattgctgaaatgatctatttcttcttttaaaaagagcttcaagctcattcatatttttttggtaattattttacttgaaacaatggttttgaagatactggctatcaagcattgaaaactaacaatccctaagagacagaaacaaataaggtgagtcttaacattactccaacttactgccttgagagcgtttccaggctggggcctaaggctaaagtgaggagataaagctgagagttgagggagacgatggcctccaaatttcacaggacaaaatattggtgagaggtgctcagagacagagtgtcagagatctgcaaagacttgttcaagtttatgcatgtgagaaaactaaaaagaacctacccaaaaggattagagataacagtgtcagggacccacgagggtaaggaacagtgcctcttatacccaccagtgaaactgaaaaccttgctggttcacagagcattgagtagaatacacagagtggccggcctctggtgggcaacagtaagtcctagactgacccttattccagttctgcctaacaaccaacaacgtgacctggaaggataaaactatttccaagtaacttaactcggtcccagaacaacgaccaaaaatatctgtagaagagaaaaaaacatatctaataatccacaaagcataagtcacaatatctgatatccagatattgtggtcaacagaaactgacgaggaatgcaataaatacctatattagaaaagaagatctcaaatcaatgacattttctataatataaaactaaataaagaagaacaaattaaatccaaagaaagtaaatcagagtcaaaatcaattatataaaacagggatggacaaattttttctgtaaagtgtcagacaataaatattgtcatctttgtaagtctcctatggttttgttgcatattcttattatttctttttacaaccctttaaaaaagtaaaaatcattcttagatgcaaggccttacaaaaacagagctaaatttggtctacagactgtaatttacccaatactgaagtaaaaagcaaaaaagaaaaagagagagagaaagagagacagaaattctaaaaatcaacagcaaattagttgagatagtacaatagataaacatgtaggcagagagagaagacataaattataacatcagcaaaggcaaaggttacatcactacagattgtgcagatattaaaaatataaagacagattatggacaattttataccagtaaatttgactacttggatgaaatggacaaattctttgaaagacatagtcagtcaataaaaaagagataataacctgaatagaatttgttgaagagactgattttgtaaaaacctttcagtgaattctagcaaatatttagggtaaaaattacatgaatctacacaaactttagcagaaaattaaaaaggaatgactggcctggcacggtggctcacgcctgtaatcctagcactttgtgaggctgaggtgggtggatcacttgaggtcaggagttcaagaccagcctggccaatatggtgaaaccatctctactaaaaatacaaaaattagccaggcgtgttggcatgcgcctgaaatcccagctacatgagggggcagaggcaggagaatcgctggaacccaggaagcagaggttgcagtgagctgagatcgcgccactgcactccaacctgggcaagagagtgaaattctgtctcaaacaaacaaataaacaaacaaaaaatgaatgactactttccaactcaatgaagccaccactgccataataccaaaaccagataaaatattacattcctcagaaacagataaaaaattaacatttttcacaaatgaaattcaacactgtattttaaaaagtacattatgatcaagtagagtacattccaataatgagaggtgatgcaaaacgggaagagaagtaaacttccttgccctgataaagagaatctatggaggacctacagctaactttatagttgacggtaaaagactgaaggctttccccttaaaaggaggaacacagtgaggatgtctgctcttatcagttctattcaacattgtactggaggttttagtcaatgcaataattccaaattaagaactccagataaacaaaagacatcgaggctgggaaagaagaagaaaaactgtattccttcaaagatggcatagtttctatgtgaaaatcctatgggaactcctaccagaagtactaagtgagtttagccaagttggaagagaataagctcaatatacaaaattaattgtatttctacatactagcaacaaactgttggaaattaaaacgttaacactaccatttaccacatcatttaaaaaaatataaaacaggaaaacatctgaccaaacaacagaaagaaacagaagagacattgaaaacccaaaacaaaacaccactgagaggaaataaagtagcctcaagtaaatgaagtatgttatgttacaggttagaagactcagtgttgtcaaaatatcaatactctccaaattcatctatagattcattgcaatcctaatcaaaatcacaacaggctttatttatttattttagaaactgacaaagtgattctaaattttatagagtaacacaaatgacctggaatatctaaaacaaagttagagaacactactaaatttttagaactaatcaagctaccgtaaaaaagagtacgttattggtacagatacagacaaatagatcaatagaacagaagactccagaaacagacacaaacatgttgacaactgatcttgataaaggagcagaggctattcagtgcagaatgaatagtcttttcaaaataccatactgtagcaattagagattgatatgcaaaaaatgaactttgatttctgctttacatcatatacaaaattaacacacaattgatcatagtcttaaatttaaaacctaaaactatataacttctagaagaaaacaaaataattcctttatgaccttgggttaagaaaacactttttagctaagatccccaaagcatgaccaaaaaaaagagcaaagttacaaattaaatgtgttaaatttaagactttctgcttgtgaaatatactattaaaatatagaaaagacaagtcacgaacttggataaagcatttgcaagttatatatctgataaagaggacttatgtctgtaatgtagcacatgcagaactcaatggtaagaaaacaactcaccatcctgggcaacagagcgagaccctgactctataaaaaataaaaaaataataaaaatccaagcaaggtggcatgtgcctgtagtcccatctcttcaggaggctgagatgggaggatcacttgagcctaaggaggttgagtctgcagtgatccatgatcctgccactgtactccggcctgggccacagagcgagtctacgtttccaaaaataaaaataaaaaataaaacaacccaataaaaagtggaaaatgaagaaaacaacccaataaaaaaatgggcaaaagatttgaatggacactgcagcaaagaagacatatagatggcaaataagtacctgagaagatgcccagcattactttctattaggaaaatgcaaattaagaccacaatgagatactactacacacctgtcaaattgaataccttttaattaaaaggtagaccaaaccaagtgttgtcaagaatataaaacaactagaattcatctatgtttctggtctaaatggaaaatggtacaactactttggagaagagattgccattttctttgggaccaggacatttcgcagggaagtatttgcacaagaggcaaaaaaaagcacatgactacacaaagaactgtatacaaatgtccagctttacatgtactcgtcaaaacctatttaaacccaaatgtcagaacagataaacaaactgtagtatatatttatgcaatgaaataatattcagcaataaaaaggaaggcacttgcaaaatacactgtaacatagatgaatctcaaaatgattgtaatggatgaaagaatccagtcaaaatgtatataccctgaggtttttgtgtgtgtttgtgtgtgtgtgtgtatgggtgtgtgtttattaaaatatatgtaacttttctgctagagtttttttcctgtggtataaaaacaaggtagttttcctaccacctttgagtagataagtgtacttaacattaaatgccaaaggtagacaccagcaagcttttgagccaccccctccggacaccagagtgctacttattctaacataccctaccgggtcagatacaaatgaaagacagactgagcaggggacacagagctcagtaatattgacagcggggttcaaaaggatttgagacatggacttcacaaacagcagcaccgtaggtctccctgaagcactcccagtgaattcctatggttggcaatatctggaagatctctgcacccaggtcatcccaccagggggccctgagaaccagaactactttttatcactgtgcttcacgtagtctatgaagcagaaaaggcagattacggcaggttgtcacaaagaacaaggtgagtcaaaccgcaggactgcctttacttaagcatacaacagaaaaggctgtgtgtcaaactttctgaaccatttatcttttatagactgctgaagactgttgagttcagcgtctcttaatccaaagcgctgttttagaaaagataatctacgtggcaaaaaatctggtcaggtcagtgtgactgcgcatcctggggccatcttgattatgaaaaactctaatatgggaggagagagactttcagtaacaatcactcaggggaaagcaatggcatcaccctgaagggcatggattaacagataaatagtgaagcaggttaaaatctaacagtcacattcctgtaaaagatatcttcatctcacgtctaattattttcttttccattgctcttctctaattagtacttgcttagtaatggaagcatcgagaaaggacagagagagtattataattctagcaatagaaagctagacacctcattttctagatttgattacacatcttaaaagtatccatttttccccaaatttacatggcacctataatggcataatttaaactttaagtagataagatgaatagatggggactgaatgcagcgtgcttactttaaaacaaaaatgtgggttccttatttcctaatgagtaaacagaaatagaactttcctataattttcaatgctgtattttattttgattatctttactagtatgttgaatgagaagtttttcacacaccaatgtccactgcaaatgtttttagaagttctcactaagtggtggtagcaggccaatgccaccatgctctcaacctcatcgtgtggcaggttgatttagtcagcttcccatattttccaagttctgcttttatttccatccccttaagcaatgaaagtcacaccattagagttggctctaagctacctagggtaagagtggacggttagcagaaaatacataagcaataaccaaatctaatttttatctttctctcgaataggcagcacaaaaattactggaactgctaaaaaaaaaaaatgaaattgagtgctaagcatttcagcagctattctttcacatatattaaatgctatttagctattatatattatgtacataaaataaatgttaaatgctaaaatgttaaattttaaaaactaagtatacgtatatgaataaatttttaaaaaaattcatattcacatatgtatacttaattttttgaagaatattaaaggtaagacaatatagagacatgaataatacacaatctgcaaaaattaactattggattaatcaactatgtagtttaccttgtacatagttcctggaatttttggaaagtggcatgatataatagaaagagtccagacattagaattaggtagactgatattgaaaccccacagcctacttgattttgagcatgtattacttaagttgtagtgtcctcatctgtgaaattccatataaatctaatgtggggattgaccaattttatgtgtctgtagtgtcagtatttgctagcacatattggctagcaaagaatgtacagtttttaatatgcaaatctgctagaagtagggacaaactgcacacttacaacttaagcatgcaattctccatagcttttatgatgattgcagttatattattattttatcgttataagttccacaagtttctttgactatccgaatataaccaaactagtttcctttatctcttcatatgaaatgggtgtatttgtctagaatttaattctgcagcatatggaaatttgcctctgcaatgttatgtattcctgtgacattctctggaccattctcaaccgaagaggaaggtatacacaccattccttgatttttaaaaacttaacaataaaagaaaactaagagagtggttgttatcatacctcggtatttaaaatagcaaggcaaaagcataaatcctctgaccatttactcacaattgctcatgaggcagatagtggcaacttttaagaagacaagatgagaataaaattgcgtcacaaagcagtctcttgattaccaatattaaaatcatttgtacttatcaggaacaatggggagatcagaccttctaactctaaatgagtaatataacagattatagtctctattttggccagaatcacaaaatgtactttttaaagtatactttaaaaatatggatcatatgaagtatgcataaaaataagatggcatttccacctctaattagcagctggaaaagctagagtaagtgtatggcaaatctctactatggccaattatatttccaatgaagcaataaagcatacatttattacataatttaacagatatatatattttcagttccttcctcccttcgttatactgaggaatcttcctctggacagtgctatcctcagatgttttactctttgtattatttgtctttactgtgtctatcaaccatcagcaaaccattaattgaataagttgacgtattagcttttatatttttgaactaagcaaataaattactagtttatttatgcagttatccttatttggagactcttaaaatatcatatgaaaggtttttttttaaatgcaaacacaatttacttttcctcagtcaattaaaaaaataatattgttactctcacttaaaagaatatacatcaacaacagaaatactcattaaatggaactatgtcaggctctgtgggagattagaaatacaaagcctataagacagtctacaggtttgaatttctctttaaaaatatttattatatttttctgttttcatagaattagagaataatatatagtttcatgttatattgataatagagaaattggactttatttacaatttaattataggtgtttgaaattatgttctaggctagagatctaaaacataattatgttttagatctagaacataattatgttctaggctagagatctaaaacatagatctcacattatctatttaattaagagactttttaaaaggcaagatatgagaactggaacttaaattttaacaccatctgtaatctatctatctatctatctatatatatataacaatttagtttttcattttgtgtagatatatatacacacacacatatatgatttctgggaggagtcaggaaatacctctaaacaatacatactgtctctctaaagtccttcaccaattacttcccatattaagtactgaaacaaaaaccatttacctaactgcagctgtagtagcaagaagaaaagcccatttcttcagcatgaataaaaggcaaaagtaagcaggaaagtgggttggagatgaaaaaagaaattactcaggacaaactgggtatttccttttgaaccaaattaaaaaaaaaaaacatggtcaattttgatggattctaacattcatctcagggaccctgagtgacataaaggaaaccaagtcaggaacaatgtctctgtcttcggaagtctcctgtgaagcagaatttgtttacaaggtaaaggattaattaggtttaccttaactgatctatttgacaaaaactcaaatgtaaattattaagagcaaagatcaactcatcaaaagaaatgaagattctgcatacaagtgcccagcagatccatctataggttgatacagggagtacttatacaggagtcttgttggtcctccagtatacagggctatctcagacattctgtgtgagggcactgtgggcactttacacctgccacattcagagacaaggccaaaaccaccaacgtgacctttattatctcccttaaatgtagatttctgtaattaaatatcttctacccttggtcactactacttagcaggattacgctattcaataaattgactacgtaatgtagaaagcagaaaatgttcttgcagctttaatcttctctaactgaaagatgctaatctttctactctgtggtcctaaattgtgccccttgctgctttcatagccgtccccccacccccatcccatttcttccagggccatcatttcctctttcaggacaagaaatgactacagtgttccatgaatataataccatggtttacaccacgataagagactgtgtttcactatgattgctgtaaggtggccacatgggccccagactaccatagtagactacaatatttaagaaataatctaatatataatacatttttttttgcttggtcaaaacaaagtttaaattaaatattaaaatcacataaagttattttgaggatatcaacaaactgattctaaagcttatatagagaagaagaagacccagaaaagcctacacaacactgaaggagaacaaatatcattggtaccacccgactttaatgcttactataatgtcacagtaataaagtgtgattattagtaaaaaaaaaaaaaaaaaaaaaaagataagatagacaataaacaaatcaatggagatcccagaaatagatccacacaaatacagtcaactgatctttgacaaagaggcaaaggcaatagaatggagaaataatcatcttttcaaaaaatgatgctggaacaaatagccatccacatgcaaaaaatagaataaatcattacagtttacatccttaacaaaaatcaactaaaaatgcgccataaacttcaatataaaatgcaaaactataaaacatggagaagataacaaataagatcatctagatgaccttgggtttgctggtgattttttacatgtaacaccaaaggcacaatccatgaaagaaataattgataggcagggcttcattaaaattaaagacttctgctctgcaaaagacactctccagagaatgaaaagccgagtcacaatcagagagaaaatattcacaaaatatatatctgataaaggagtagtatccaagatatacaaagaagtcttgcaactcagaaacacataagtaagggacccatttttaaatggtcaaaagagttaagcagacatcctaccaaaggaaaaataaagaaataaataaatacagctggcaagtaagcatattaaaagatgctcaccatcatatgtcattatggaattcagaaataaaacaaaattagatagtactgcccacctagttgatggctaaaattcagaacactgaaaacagccaatgtcagtgagaatgtggagcaaaaagaactctcattccttcctggtgggaatgcaaaacgttatgaccagtttggaagatagtttggcagtttcttacaaaactaagcagatttaccatgcaatccagcaatcacactttattcatatctggacaatacctggaaacaagatgtccattaatgcatcagcaggtgaatgaacaaactctggtttatccttacaatagaatattatgcagcaataaaaagaattattgagtcaccaatagatatgaaggaaatttaaatacatattgctaagtgaaagtctgtctgtaaaggctatatactttctggctctaactaaaagatatttggaaaaagcaaaactatatatagaagcagtgaaagatcagtgattgccacaggttcaggggaaggagggagagatgagtacgtggagtacagggtatgtttagggtagtggtgctcttctgcatgacgttataacggtggatacatgccattagatatttgtcaaaacctacagaatgtacaacacaaagaatgaagcttaatggaagctatggactgtagttaataataacgtatcaatattgcttcaccaatttaacaaatgtaacacacaaatgcaagatgtgttaataacagaggaaagtgtatgtgtgtgttgggggagaaatagggaaaatctttgtgcaacttttctgtatgtacaatttgtctgtaatcctaaaattacagacaaaagttagtttatgaattttaataaacagtttggaatatttttcgaaatctttatttttcacttgccatactgaaagttacctggcatggttcttttcagccttgtaagcaatcaaaatatttccacaatctaattcaatcaagcttggtattttactgtttgaaaatcttagcattatttacagatttaaggtatttctattccttctttttaaaataataattaaattgtttaatgaaagcatttctgactgtaaacgtttaaatgctacaaatttacatttctctgttcataaaagaacttatttttggtttcttatctttaagacaatgccacattcatgataaaaatatacttcaccaattttgaaatagttctagtagataactattaaagatcattaaaaactcttgagtggatgcattcagttctctaaatctagagtgcagcatatcataaagtgtctcctatccctatcttatcattttagatttttttctccaaagtagtgctcactatcagaaatcaccttgtttaggccaggcagagcagctcacgcctgtaatcccagcactttgggaggccaaggcgggtggatcacttgaagtcaggagttggagataagcctggccaacatggtgaaacctcctatctactaaaaataaaaaaattagctgggtgtggtggcggctgcctgcaatcccagatactgaggagactgagtcaggagaatcatttgaacctgggaggtggaggttgcagtgagccgagattgtgctactgcacaccatcctgggtgacacagtgacacactgtggcaaaaaaaaaaaaaaaaaaaaatatatatatatatatatgaaatcactttcttcacatatctgtttacttgtttcctaaatcatctctcccaattccccagcccatcagccccataggaacagatgtacttggaagtgccacagcagaggaaaaccaccaggtaaataaatatttgggaggtgactgattgaataaattaacttatctagatttggtttgtcaaggacattcggaaaattaggtagaatttagctccatgaatgttgagaaagttgagttttgagagccctaacatggccaattcattttacagaggtggaaaatggggctgacagatgttaactcaccttgtccaaagtcttagtaatggaatcaggaaaaaattcaatcacttgacttttaaccaataatcttttttactacaagagttaatttgctaatgaaatctcctcagtattttctcaaaacagaacaaaaccatgagttaagtattcctttttctttgctataactaaatataccttttaaaattaaaaaaaaaaaaacataaacatggttataagtgatcttatttcctgcatttgaggcagctaaaccagtatttcccaaaatgtcttaatacccacttcttgatctgctgcaaggaaaaatattgttcagtggtcaaatacgttcaagaatcatgattattatatagagaatagacgtttgcctcttaatggaattggaaaattcctacagtaaagatacatgtttagttaagggttggctaaactacttcactgtggcatcctctcttcaaagaacccatcaatattctacagaacaaatatgccatacaacacatttttatccgaaaatcttttataattggcttatattattgttttattcttcaaaatgttttctaaactgtctcagttctcgtcccatgtcatacaatattttataatttttcaaattctcacttttatgttctcacttactaaaatacggcaaaatataatttatatatacatatgtgtgtgtgtgtgggtgggtgtgggtgtgggtgcgggtgtgggtgtgtggtacctggaacacaataagtggaaaaatttgtttcctctgtcttatcgcacccctttaaaaataacacaaacagaaagtgttctttctaatagtgcaacttacggtccatttattttttaatatttgttatttaatccatggcactcacttttttgaactgcagtaaggtgttcttcaacaattcctaatttttctgtgaatcgtttacttggacaatgccacattcacatatacatcccctaacatttgcatttattcagtttccttttaaaataagtgctaaacaaattaatggattttgaaggagaaaggctttcctttcaaaagaatggtaacctttatgtagttgtttttagatatttcctataaaacctgtctactctcgatacagtcagacatcttttcttcttttttaaatattaaaaataagcacataaaataagtcatttgttctttaaaaaacaaacaaaaaaaccaaaaaacaaaaaacctacaaacacaaaatcatgtaaaccagaaatctttcacagaggtcaagaagtcaaaagtaaacaccgacaatgaaacaccgacaatggtaagatccttgtgaggctctcgctccacctttctcattacttctatgtttccgtggcacaccacgggccagtgcttactaagacctctgcttagcgatggagttagtgggtctgcacctctgattgtgctgggcatgagacatactgattaaaaatggtaaaaggataaaggaactggcctttgagagacaacatggatgaatgatgagtttttgaattaaatttttgacagctttgatctttactgaaaatttaaatgaaaaacaaaacaaagcaaaacagagttccaggattttagaagtgccttttatcttaagtgaaatgttctcatcagaaactttggcatcccatccagtgcctttgatgctggctgtgaaacaagacaatccatcttcttagctgggaagacaggcccttcaccacccaggaaaccataacttgtaaacatcagtcaagttcagatggctacatttttacttcagaagttcgctttgcatttggagtggctcattaggggaaaagagagagagagagaaagggttatggaccaaagtgtgtttctcaaaaaattcatatgttgaacccctaacccccaatgtgatcgtatttggaggtagggcctttcgaaggtgattagggttagatgaggtcacgaggatgaggtcacaagccaggattggaaagcttgataagatgaaaaaaaaagagtgagctttctactctgtgtgagaacacagcaagaaggcatctctctgcaggccaggaagagaggcctcaccagcaatcaccttgatcttgaacgttccagcctccagaactcagagaactaaacatgtgcgtttaagtgcccagtctatgagactttcttttatagtagctggagcagactaataccgacagaccaagagagagaaaatggagagaaattttctggcttgtcttttaattattctttatttataaaaaaagccacattgatttttgcagcagtgatgcaagtgtgctgtgcataggtttgatgttctgctcaaattaagtctaagtttttccactaaaggaattatagtgttaatatgccaagagtcctatctgctcacgtacttccagtctctgtaaatacgtgcagcctgatatcaaagcaaaccttgaggccattaactataacattcttggagaaacagctgaagacctactaagaaaaaagtaccaaataaccaaagctggcaattacaattccaccccgaaaagaaggaaggcatgcatatgaattatgaaaaatagggactgtgcagctctcagattttcaacaatgaattgctcacattctacaccgtgtgtgttaaatgtttaaaagtaaaagatcccaaacattttgccaaatatgcagtgttccaaagggaagtatcaaaaggatactcatttataaaattatggttcagtagataaattataaggcctcaaagaacatgctgttacttctacttgccaatttataaattgactcaagtcttcatttaatttatgaaaaatcaaatcatctcaagaatgttttcgttatttttctctaccatgtaaaatatatgttttgtatgtttgataagttgtatcctgtcaattttagaatttagctatttggaacatataaaccacatttctacaactcaaaatagtataatgcttagttacctatctttaaaaaagtaatagtaatgcactgagatatttgggggtgggaggtggcggacacaagtttaactttcaaaaataagggccgtgtaaaataactgaaaaataatcctatttgaattaaaattgaataatattaaaaataaatttctactgaaaattacacctgtttctctattttatttttcttccttttaggatagcagaaaattctgttagataaatcagactaacatgggagacattgtaaatattaagaaacaatagtaggaagaggcggactcacattcatcttgctctttctgctattcccttccaaaaccaactgtgaacaagcactcagggtggccagggtacgtgaggaagcctcctctagcccagaaaaaaactttatttcacaaaaagttatccttcacaataaaaaacactattctataaaaattgtttcccctggccaggcgcagtggctcacgcctgtaatctcaacgctttgggaggctgaggcgggtggatcacgaggtcaggagatcgagaccatcctgactaacacggtgaaatcctgtctctaataaaaatacaaaaaattagccaggcgtcgtggtgggcgcctgtagtcacagctactcgggaggctgaggcaggagaatggcatgaacccaggaggcaaagcttgcagtgagccaagatcacaccactgcactccagcctgggtgacagagcgagactccttctcaaacaaaaaaaaaaaaaaaaaaaaaaaaaattgtctcccctgacttgagttatgggaaagagggttagcttcacttggccctccatgcccctgcccaggcacgtgtctgtattagtgttctgcagaggcaattcaaagtacattgtccaaagcccctctttgaaaatcttttgatgctgctgtaattcaatttggtttctatgttgaatctgaagttctgtgttactactaaccccctttctgtaggaaaaaaatgtatttttctatacaaacccatatgccatcgaggtacctgtatttaatatacctccatttagtagctaataaatatgtctatttgaaaactatttattcttccatacttaatcatagtgaactataaatccaaacttgacagcacaagaaaagtgacatttttcttctttcatttctatgctactttttccaaattatttcttgttctttttaaaaatgaagcaaagacatcatcattgttactattatgccttcagttaacaaaaaccttttaaaaagattatttgaaatgcatatgtaatatgcatgactacgttaacaggattatatgctattagatattgtgatataaaattacaactcactgggagatacagtcctctttgggcctctctcccttctatacatcttgctggacttgccaagatcaaaaggtcctgcccgcttttaacagactattactcagggttgcttatgcaactggtaacctaaagagataaggcaaggtcttcccctagacaaaaggcttgcatgcggcttgctataacagtagtcccagctcagtattcaccggctgtgatgcaaatccacccatgagtaagttccctctgagccaattgcttcattccctgcacacaagctgctgcactgctgagcactgtgtaataaagccctttgcctttggccccaagactcacgtcttccaccagcagcctgatacagtagcaggctcactgatttgtaagaggggtaaaatcaaaccccagacttgataataccatctacacagacattcactggtatgattcaagaatataaataactggtattcaatgtatccaaaaacaatcatgatgaatatttcaccaatgcattgctctttaaaataatacccaaataattatctgtactgtttccataccttgacctttcaactggacttttccttaatttgagcttttttgagttgtcatcagtgtcgtggagacttgcgccttccaattacacagtggtgttcaaacagaagaaattccaaacttttcttccttttgactataactaccctgggagtaaaatgtcccccaaataaaaacataaaataaataaaataaaagaaagaaagaaagtatctacttggcaagtgggaggtcagaagaaaaggggcttcaaacatcaaagaaggttctcaaaatactctttcaaatgaagaaagccccacgctcggtgccttatcttgcaagctcacatggccagacagcaacctttaaaggattatcttaacatgcggcgagctgggccctctcatgtgttctgaaatttaaaccagaaaatggctgcacaactgacatggttgtggggtgtgaaggggaatcaggaagagggaggagaggcttacatttccagaatgagccagagttcagataaagatatttgtgtaaaaaacaaagcaaccaggaatatgatcctgggctgtcaatttgtagaatacaatctaatacttatacgccataggtagtcacagaagttataagaaactacaagccctaaggcattttttagaatagaaatctctcttctccctctctctctctctctcttttttttttttttttgccaatatgtagtgtgggattttctttggctaaaaactgttccaatttccctgttttctaaatatactttactaagcatttttttttacaatcaggagtattgtaacctttgtatattttatcaataataaaataaatccataatttaaaaaaatcacacaaaagtgtataaagtaaaaagtcaaagtcccacatccccacctctgaatttcacctttatctgtgtgtatatgtatattttgatattgtattttgtaagtgtattgttctgtaatgtgctttttcatttaatagcatgattcacattcttccatgtcagtaaatacagagctttctatttttttcatgtctagacagtactttacaagatgattatattcagtaatgtatttaaccattcccctactgatgaatgttgaaatattttcccctaattttttactgtttcaaaatcaaaaatatgtacatcaacttcaagctttttactatagcccgtggactcttacgtgatttactacctgtctttgtcttcctctggaacttcttataccaaatctttgtgcccctggcctttcttccatgcctgggctaagccaaccttgtctctgcatctctgtggaatgtcctgtcccaaggtattggcgtggtggttcctgctgtctcatcactcgctccaaggttacttccttggtgaggtctttctagagctcctgttctacacaatctaatttatccttagtcaatatcttttataccttctcggtttattttctgtacagcacccatcaccctctggaataatcttgttcatgtatttcttactgtttactgttttcatgtaagatttttctctggtatgctctaatgtgtcctttattagaacaatgtctgccacatcataggctctcaataaacgtccactgagaagatgcataatggaagtatacttcaacttggattgtagcacatttacacaaatatttccattagagagatgcctcgaagtaaaattactgcccaaagatttgtacacacaaaatattgatgggtacttgccatgggtactgcaaaaaagctttaatggcaatttatattgtcaccaatattatggcaacggcccttttcccacaaatgcagttttataatgccaatttgacaggttataataatttttttgtaaattaaaaatcaccttgttctaaagaatctttttacatttatcacatttgtgttttatctccaaattaatcattgttgaaaatcttttttattcttttatcttttgggattacagaatgtcattctagttttcttccattattatacaagattgaaaggattttggttggctttcttagatcttatatccaaatgggatttattattatatgtggcataataagaactattattcttttaaaatgtattaattgtcttttgcttattaaaaaatagtcatggtggacatttctttaaattttcaaaaataaacacagaaaagaaaataaaaatcaccccaatagaaacttgcctgatttctttccactgcattccctgtaaaggtgtgttaatagaaatgtttctttgatcatacctataaagtggtgtttataaaaatgtttattcccggccaggcacgatgggtcatgcctgtaatcccagcactttgggaggccgaggtgggtggatcacctgaggtcgggagttcgagaccagcctgaccaacatggagaaaccccgcctctataaaaaatacaaaattagctgggtgtggtggtacataatcccagctacttgggaggctgagacaggagaatagcttgaacccgggaggtggaggttgcggtgactagagattgcaccattccatgccagcctgggcaacaagagtgaaactccatctcaaaataaaataaattttaaaaaattaaaatgtttattcccttatacaacattccctcatactcttttgtatacagtttgatatggtttggctgtgtccctacccaaatctcatctcgaattgtagttcccataatccccatgtgttacgggagggacccggtgggaggtagttgaatcctgaggccagttacccccatgcctgctgttctcatgatgtgaatgagttctcaggggagctgatggttttatcagggactttttccccttttgctcggcagttctccttgctgccatcatgtgatgaaggacatgtttgcttccccttccaccatgattgtaagttcactgaggcctctccagccatgcagaactgtgagtcaattaaacctctttcctttattaattacacagttttgggcagtcctttagagcagtgtgaggacaggctaatacactgttttttcgcttatgctatgaacattttcttttgaaaatgtgatttttaataatggtacagtatcttaatgtgtatgtgtattgtaatttgtatgagtgtattttaatggttcctattgttctacaagtaattcctttttctgttattaaaaattaacccaccaatgaaaacccatgctcataaaatctccaggaccatctctgatttcattcacaggatagattcctaaatgtggactcaataagaaaaggagtataaattatttcacagctcttttcaggccttttacaggcaggttgtgtgtactatttaaagtactattaatcccaccacatacaagatgtattaggtacttcttaagagtgcactgaatataagaaatctgttacaaaatgttagcagagcagaaagagaaaaaaagaaagaaaaaagggatagaatgagattagatcacctggtaaactgtaggaaacagctactgcccccaggactcaggaaactcaagaaagtactttatcagaacttctgagtgctgagtgcatgccaggacccctgaggatgggccgactgagtgggtagaaaccaccaaggcactgcctcccagtcacggaggagtggcatggagaagggatcacagacacttccagaagcaggagagagggaagggtagaaaagagaaaatgacagcgcctttcccctgacctgcctttggatccactgagcagatgtcacaggaactcgctggcaagggcatctgggaaatacagtttcctcccgagccaagcattgcggagcagcacaaagggcgtggctggggaagggttgggagaacagggaatcactctcacacccaagagtgcatggagcatatctgggtgtctacacaggtaagagagtgaggggtcaaaaccgggcttcttatgactctaaaatgtatttttagagcagttaccaggagagctgacattgttgaatctacctgagaagccagaagccagactctttgtattactacagaatgtgattccatgctgttgccaaatgccaggaatttctacatcgactgccatcaggacatggaagtctcattgtttcttaaaacgcaactattcttgaagacatggaaggtcatccttcttacatccttacatccttctttctgtggccctcctaggcttgtcacgagtcagcacgaatcccaaaggtaccagcagcacagaagctcacactctgtcatcagagctgggttggcagtgacagaaatgcttatgcaaacacaggctgacttctcactgaatgtatagaacatctaggaaagaaaggcaaaggatttaggccaaagcaatacctcaatgcagacaactaactagtggcagctagctagtcacctgctctcaactcttcaacgtccttcaaatattttctctaattgatatagcataatttgtgatgccaacaaccaagtgttttttcacaattacagagagccaaacctgtgtctctgctgctcccttaggctacttataatattggcctagttctcttagctgtcagcacaattaccttgtgattaaaaagataacatcaataggaatttcttttttatcagctaagccatggttacatgttgcatggacactagcactcattaccccatccatattttggtgagatttttgcccatttccttcgttttcacagaaaatgaaataaagcataagcttgttggttgcaaaggtgacatatagtaagtcaaataaacccataatgaagttcccttatacttcaggttagcttcaaaatcccactcaaatatgtatccaaaaagaaataaaacaggaaactttctggaataagttcttttgttgctatttttatattgaattggcaaatgtcatttcactgtctgaggtcaagggaacacaagggaacaggcagttctcgaaacagaaaagttggaggtgctgtgccgtctctagctaagaaaactctagttctatgaaatatcattccacctgagaaaattttcacatgattaaaagataacagtgccataaatctacccttgaacatcaggtgtgactcttactatactacccaatgtcttttaaaaaatatttagatcattagccaatttgtgtgggtgatacaattgtacacattccacaaaaatatcagccatttgtctagttcagcatctggtaatgtcaattaagggttttatttactcacaaagagaaaaaagtaaagatattagtttcaaattaagtccaacagtctattgagtacgtagtttaaatgtatttcagctcttcatcctccccagggcagagatcactggcagaaattagcatccacggataggaaccaacaacagggtagctgatgatgtttaggtgaactcccctctttataataacagaaataaccccttttcccctacaaagcccgtctacattttgcatagcactaaggatggcagacctaggagctgagttagccaaccctgaaggtatcctgcctcaagacttgtggctatttggaaaaataagcatcctcgtcatggggtcagtggaatcggggcagtttgctggagtgaaagcccccaattaggtcaccctgtacttgtcatcaagaatgagtacacatggcctctctatcatcaagtggccacctacgctttttgagtggtaattcttgaaatatggttttctctatgaagaaagcttttctctccatagaaaaagcttaacagcaaatttcactgtagtcgaaatgtttcacctttctttcctttttgatgtgatcgtcagctcttgactgcatctcgttttctcatgcctgctttctttctgctgtcagtcacaatcctttgtgacaaggtgggatcacctggcagatgatttggatgttgcctctcatggagatatatctcattgaccctttcgaattcagagatttttttttaatatagaaaaaaaggcatagcattttaacatcactaactaaggcaaaagataaggacactggactgaaaaaccaaggatgttgtataaatattcgtccttgtgtcactattttattggcttgaggtatccaggaaacaacttcatttccccaaattacattttattaccaaacaaaagatgaaaaaagtactacttatcccattaaactagcataatggttactttaattggaggggtgggagagaaagaaaggtgaatctacttagatttcttggagaaatgaacttacaaaaatggaagctggtggcaaagccaaagtgaaattcacgtttacttattccatgcaatatttctctgtccaacctatgtaaagcactacaaatgaatacagtcatagcaactaattgagttatcagcatctccagagtagatgttactagtatgtcctggcatatgaatggtagtattatgtgggatattagtagttcactaagagtcctataggacttcttgtgtctggaaaaagagtttagtgagtgatactgaaaaaccaacagcttggctcacgggcatcattgaacaaatggtactgagcatggaacgcagctactcagaacttatgagccaaatgggtgttttccgtacatggcttcttgtccagaatgctactgctattagcccaatggccatcactggttatcaaacatcctgacccaagtcaaagccagacgaagacagaaggccatcgtgggaaggtgaagcgattcatgcttagggcaagataattatttggtatcctttcaatccatttgttcaacatttgctcccaggagaggcgggatgcttcctggggacagattagagaagaagggacactgctaagtgctcatgtattatttcaagcagttcactctgggccccgacccaaatcctcaggcaacaaagcagcaccctgcaggtaataggaactgtcttctttagaaagcagtgtggtgaccaggtgttgctaatcatcagagtctcttggtgactcacagccgccctcatgcagctttgcgagttctgactgccaacacacacaggactcttcctaagtattatttcagctgaattctgggatgtgaacatcagactttcaaacccggctttctcactttctactggggtgaccctaaatacaagttatttcatttctctggactcagtttcctcatttataaacatgagaataacattatctactccactggttgctgtgaggaccaaataaaataacacaattaaggtgttatctggtatataataaccattcgataaaacttagcgattattatttatggcatccattccacaatggtactcaatggtactgtgtacactgcctaagaatcctaacctttatttttgctccactcatcacttctatttccagttctgtgatgccaacaaattgggtaattgtacagcagcatgttattatgtttcttcacctccccttcttactatgggtcccttctccgccttcctcaaacatggcagccctgtgggatgttgaggctcttgaggctcctcagtttgaaatgaatgagcttgctgaagtggaaacattagaagggcatgattggcagattattttgctccagcaccttcttgacagaagtgcacaaagctcttcaagaagatggagctgctgccagatgccctctgtccagcctcctggaagcccaggagaaagctggagtggacgccatccttctggcctcctcctgaaggacatactggtttccttaatttcttttctactttttgtccttcagtctgttgtccctgcacagctatagagaaaacaaggattacagattccatgtcgttttgcagccagggaacatctttggctagagatttgacggaagtcagtgccaagtggctgtgtccctgtaagcagtccattatttctaatggtctatttgcatgcaaacctccaggccagaggcagaagtaaacatcccagaaacttgtccctggagactctgggacactctcatttacacgctgtgctccattcacggcgctgagtttactcacacgtgctacacatgcgatcctcacgacagccctgtaagatggtattagcatctccattttatcagaagaaaaataacttccgagagggttaagcaatgggtaaacacggacataaatatggcaacaagagacactggggactactagagaggggagtgagggaggagggagggttgaaaaactaactattcggtgctatgctcactacttgcgttgcagaatgatttgaaccccaaagctcagcatcacgcaatatacccatccagcaaacctacacaggtaccacctgaatgtaaaataaaagttgaaattataaaaaattgtaaattacaaataaatgaataaataaaattttttaaaatacagttaagaaggggactttgcagtctggtgtacctgacactaaagcccgtgtatctttaccatatcatgtttaaaaaatcattttcaagagaggcaagaaatttcagtggagaaaaagactgagtatgtagaatggaagattctctagatgtgttgattttgtttatcacggtgtcaactaccggaggagtaggcaattttatgtggatgtagaccatgcacctttatcaggagtactttttcaggtcaattcccttccctagcactaaaaataattaatagatctctttgagagactaagacagtgaggagaaagtacatttacctaccacaactaatgagacctgaataactggaacagaatatttggaaaaaaataatggtttaaatggttaacgatgtgtaactagtaatataatagctacttcaacggagctttcatgtaaaacagaatttcattgcaagtttaagttttcttttgagaaaaatttggctatgtaaaggtgagtttggcaattttaagtttacaacttattggtcaataagtagtagtaagcctcttttgtgtttgttgagttaataaactatggttcttggacaatttctttgttggatgttaatctataactcttatttgacctgttatttgacatttctaacctcttccttaaacattaaccagaaccctgagtactttcttttccaacacgggtaagggattgattttttttcttaatttcataacttatgaagctaaaatgtgcaatattttgactgagtgaattaggaattcttgttgggatttgggaaaaagaaagttatgagaaactgatgactgcctatgtaatacttcctttataggaaattcttaatacccttatataggaaattttaatacccttcttacatatcttttgttcctggtgacatagaagaacaagtttaacaacatcttaagaaagaaaattattaaatatttacagtcacaaacctttgttcaaaaaagcacttaaaaattatatttaatagagtttaattgagtaaagtgaatcacatagccctcaaactagaataggtttagagagactagtgtttttgtgtggtcaaagaagacttatggaaaaaaaaggaaaatgatgtacagaaaatggaagtcaggtacacaaacagttgtattggttacaccttggtgtctatttgaactgctttgaagaatttgtcacctttcagaggccaaaacttggtgatcttcgtgattggaacaagaggaggttatagcctgattacacagtttactctgtacagggaaaactttaggccagacttaaaatacgcaaggaggcagcttaggctaaatttgctttaacaattctctctttatggtcaacctccaaaaatcatgaggggttaaccaaaactctaggcactgatgacattttgtcactattataaacatattcacacagttttaaattttattgggaagtagttggatagtgggttttgtaaagtgaaaagaaggactttaggttacttttctgtaaggattagagtagaaggaacctctgtgtgttgaaattttttgattttaggagataaaacctggtctgctatagtttttttttttttttaagttttagtttgtttatgtgatatttagtatgagtgactttagtttggtttggtctggtcggttggagcctagtacatgagtttagtcaaaagcaatagcctcttataattttatgttttatttatttatttgtttgtttgtttatttatttatttattcatttattggataggtgagagggtgacccaaactttactgttggcttcgtggtacttttagctattattattttcagttttcggtctcagtgtgtcttatatgttacagtgacttgttgatcactttttggagtttttgttgtttgggttgaagagggaccagttgacagtttatagatgtctgtatgtaaacatttgagaaaatatagtattttggggaggctactattatgactattaggaagataatattaagagtttgaaatatggtttctggtcagagtctctatgaatcaattaaaattgaagagttttaaacgtgagttagataaatagtatttgttttagccaagtagtctgttaatctctcacaattgaatctttataatttttatgtataacaaaaagtgttcataacaaaacagattctttttgtgtagtcaatggataatctagtgtgattttattattaggaacaattttagtaacagaatttagtcttttgtgtaacaatagtctttgtagtagaatttcttatggagtctattatgagggatgcatttataatgactgtcccatttattttaaactatggaaaaagagacctaataagtcatgtatcctgagaagagtgaaggacaaaatctttaggccaaacgttataaatagaatgaaacagctttagactaaacttcatgtaacaccttcaagtgtgagccacagtgatgagtaaccagggtctcaagctggtattttttcaagcaaaaaatacttcaaaaaagccactggagtaggggtggggagcgggtaagaagatccatatctgcttatcaactcctgtttttttttttttccatttctttttgtatttggtgtctacaaaagagccttaacatggtttaataaacatgtgtcatagactgcatggagttgcttatgttgtttcaggatacttaaaggaaatgctcactggaacgttctagattttggatttggaatgttcacccagttaagtatactgtaaatattcaaaactccagaaaaatagtctgaaatacagaacacttatggtcctatgaattttggatagggatactagacatgtacttacaaaatggttttgaaaattccttagtacaagaaagactctgccaatctgatacaaatatggctttgtacacacacacacacacacacacaaacacacaccccactctctctctctagatatatatacatatatatacatattaacatataacacatatacacaagtaaatatacttttcactgaattttgggtggacatggacccacggttcttgtctgggacatcagctactaggtctgagtcccctgtctgtgccctgtgcatctgggaatgtgtacacactcttcaaaactccagttaatcaccatcctccctgggaagcttccatgctagaggattgaggaatccaactcttgagaaacaagaacatcctcttcagctcttcattctaatacttagcagatatcatagtgttttcttagttgggagactagattctgtctccctcatttgccccaacttcatgcccactggagctccagacacccactggaggaggcagtgacaacaggatttgcctccaaagaacacagaccgcacccttgtgtgaataagggaattttgttactcctgattactttacccatcctagaatacgctgaatttagccataaaagaagttgaaaaagatactcagaagaagaaaaaagaacactagagtggcaaattgtattatattaccagttttacacatatccacatggatccttatgtttgtggggtccacagcctgaccactgtaatccctcacattcatgtttccccgccgtgtagaaaagctatacagggtattcctgctgtacacgcagccactgtgcaaagatgaccctactctccttggcactgaggagccgaagtcatcccctgagagagaggcagcctacaaatgaatacctggggccaggggcctccagagaggggagttactacaccaggcaatgcttctctcccagacagcttgaatattaaatgtgtaaacatactagacagcaaagtagtgccgaaaccaagaaatggacacacggagagagagggggaaagggaaggggagagggagggagtgggagagggagacggagagtgagagggaaagggagggggagggggaggggaggaggagagagagaggcagaaggagaagaacagggagagggagagggagggaggggggagggggaggggaaagggggaggaagagggggagagggagagggaaagagagaggtaggaagagaccacgaggagagaggaggaggaagacaaagtaaaggcaggaggagaagcccagtctgggaggtagagacagcaacaacttgagtcatgcgctggacacagtgcccacttagcaggaaccgctgcagctacagatgggtcccaaatcatgaacgaggacgttctggttgcacttccatcctaagaggatggtggagggtgatgctttttgtttcttactcatttccctgtgcatccatacagttagccaataccctctaaagtaataaaagtgtatttctgctccgagtaacttggttgaactaatattcaaatccaaatctgcagactggtaggctgactaggctatgtgaatgtgtaaggaacacagaatgtgcatacaaattccatacagacagagaggactgggctggcattaaggaagaccagtcacttcagaggactggccaagaggccagtgacaccacgctcggtgacaccacagctcttctcatggtttcaaccccagaggcagatattcttggctgccttcttgagtgccctgacgggggccactccttttgtctctttctttgatttctctgggtgcagactaaaattctccttgaatctagttcaaactgtccaaaagaggggatctattcagttcgattcatcacactggatggagttcttagaccaacacacgccacaggcccatggccagcctacagatcggctccctgatgtcatgccatggccatggaaagactgaaccatcacagaaggggctgccagcactgggacaggcatgtaagtcatatgagaccatctaccttggtcaaccaggcagtgctaatcgggagagtaagaggacagcacggagattagcaacccaaagcaataccccagcaggtattagagttgaccattggagcttggcatgttttggttattaatactccaaactattcatgcttaaggcaatgtggaatttcaagtgaaagccagatggttcttgggcaagaggaggaaagaaaaacaaagcatcatgtgcttgggagaacgcctagtaaaacaagaggatcccagtctctcccagcagagtgtgggcatcgttcactccctttggtacaatccattccctttctcgtcgggattcacacagcatggtcaaaggcaatactttaacatcacgaaatcaagctaggtttacaaatgtaaggtaagagataaagaaagaccatctatctggagttcttttctcccctttctttctatgtgtagaataaaaggacagagaagagacagaaatttaaagggaaacaaggcaagtgctgaaataaacctgccatctattttaagtgaaacaatttatttgggtttcaagaatacttttttctgtctctcgttcttcctaaatcccagattatcagtctaatcgaagatcataaaggagatgacaaaacaattatcagagagaaaactggattccacttagcagcggctaccaaaagtacagtttaatgtgttttcaatgaggtgggcccctgggggcctgaacacccacaggccaacggatgtttctatgtaagaagagcaacgtcatcagcaaaagcaatttcccacttttattaatccagtttattttaaggcatgattattcaagctttcgtctgctatagttagtcttgtattttcaggataataagactggtgaggctagttatcaagtgcctatgcacagaattcaaatggcctttgttctacctggcagtctcaagaactgttaaatgagcttaaactttattacaagaagaaacagaacatgctgagtgaaaggtctgcttagttgcttaccataaaaccacaactacttaggaaacttatgctctgcatattctaaacctgaaggagcctctaatggggcatttggggtcagttttaagatgattcctcaaaaatgcccccaaataagacctggaaggggattccacacttggctgtctctgcagagccacaggcaacaacacagaggtgccatgatttatttaatggaagcttggtagtgactcaatatcaagaactcaccttgagaagccacatttcaagtatctgaaaacaactggcaggcctttattcaaatactttaaatagatcaaagctgtttattctctaaactcctctccccttcttacacattttaaccaagtcaatgttttccttctatttctctcagaggtctaaacatctctaaactatatttggcctaaagttttgcttgaccacatgattttaagaactgttgaatttgagtgccattgccagggaagctgggaagatggctggataccagcatttacaaaggtctcatcactccatgagtgataaattcccatttctcacatggttcctatgggctgggagtaggagtcctcaattcattgtccttctgaaaggcccagatctatgaattgggagattacttgtattcagcagttacattttctactttttgtgggctttgaggagattagaaggggtaagagaaagatatttgacatacttctttctctacccctcaagactaaataaatactaactcaactatcttactacttcaagtttctaaataaatctcccattcagggtcaggctaatccccttaactctcctctccagtatcattctgatcccatccgacacctcccaaactgagcctcaatgcctttcccgcatggacccgcctctggctggtgaagccaaaggtcctgagagcatgcatgtggacagagctaggcaggtttccttggcgtctcctggggacgtcacatattatcctccattatgattgtcacagtacatggtatgagcagacaatagattttaaggcactttaaaaaaatgcttgtgtaaatgaaatggagcatttggattcaatttagtagccttatacaatatctgctttttatttcagagaagacttctgaggtagctgatgaacatgccggcagagaggttgaattccgaggtgaaccagtcattccaatccaagggagacagcgtttggaagctttaatgtaaacagaaaccctgcgggactcacttgtgcatacagctgtcaaaacaattcaatatccagagataaacagggtataagacacccactagtatattatactggaatgcaacatctttttaaaattatgttgccatattctgtactttatcgagtaccttccattttaatatttcatctaatagactgtaatttggcactttgggtagtaaatagtgaattaaatgctgatgtggcttattagggcaagtaaatttgaaatcaagtatagtgatagcattataatgtgacatgtcatcagtttacagaagagatttctcaaaggaacacagagttctgaatacatgggtgttggtatcatcatagagaacagcaagtattcattattcatttaggaaaggaaatgtgtacctggataatagtttaaagctatatatatatatatacacacatatatatatgtgtgtatatatatatatgtatatatacacacatatatatgtgtgtatatatatgtatatatacacacatatatatgtgtgtatatatatatatatgtatatatacatatatatatgtatcattaacatcaaggctgcatgaaccaatttgctttgcacaaagacacaggagaggtggtatcaagtagtggaaggagttgtggctttggagttaaagatactcattcagattctatcatttgctagatataagccttgagaaatatacttctgtgggcttcaatgctctctactgtttaaaaaaaaaccttgaaaaattccaccttgcagcattgttttcaaattgtcaatttcaactggcgctcagtgaatgggaggtgttggaaatgaagacattcagcacataaataaggaagtaaggtgtttaagagtctgtatcactggacctatgggcagtctttctgggccactgtcaagcctccctttttgagaagctacaacagccacatgggagagtccagcgaccagagtggccgccgtggtccagataaggaaaaccgccatggattcagccagacttagagcaggatccgcaggcgaaccgttcttcctcttccagctatttctggataagcccactgtgtcccttcctctgcagagcacacctgcatctttgattccccaccttgaagtccttgtcctttcctagcctgagtcattccactcagctcaaaagacagtgtctgggcatcgtctccattggaagacagttcctgatgtttcctaaagttctctttactcccccgtcacatcctcatagcatgcagcaataaatagaaattaccctgtttttcaattatatttctataactattgttgccctcctccctttcagtaatgtaaaaaattttcacagtatcttctgtatcctaattttccccactcaattcgatttttgagatgaactggcagctgcctattaccttttactttttcctctctaagtgatacttttagtaagcaatttacagctacctccaaggtgaatttgtgtgtaacttaattacattcacttataccctcattataattacagtagcttaaaatccccatctgtggaacaaaagatgtttccatttatcatgtttctattgtgtataagctgtccttaatattaaacaccacaatactctcaaaagatgagactatctctggtaaatgctatacctgtcccccccactatctctttataaatgcctcagttaaaaatgatatgtttttaccattacgcacttttttctgatttttttttattagtccaaagaaataaagtgctaacaaatagctgggtggatgaagtgagtgaggccattaatattctatactgatagttaatatacattctcttttccacattacgtccttagacttcaggcataactccaagtaaaaattcaacagaataaggaaaactgcattcattagtagaattgtttttctttttcccttataacacagcacaattgcagatcaggagacacacaagcagacctcccagactcgtgggtcacacttagggggttattggtcaaaaatttctggatatctgctttctgagaaagtagcaagattttgctggcatttactttttgataattaaaactagatttttattttatcctataatcggtagtattctcccccactcagagtcataaataaggttaaatagtacaagacgtatttagtcacctaatgatgctgatgatccatctcagccaaaacaaatccttaaaaccaggcaaataatattaatctcacaaaagaagcaactgttaactagaaatggaaatccaattaaatacatttcctgaataattaaataataatgaaaacttgaggaacatgtacaggcatacctcagagatactaagggttcagtttctgaccactgtgtaaagtgaatatagcaatacagggaggcatacaagttttgtggtttcctagtgaatagaaatgttacatttatacaatgctgtagtctattaagcgtataatagcattatgtatataaaaacagcatacaaactttaatttaaaaatacgttattgctaaaaaatgctaacaattacccgagccttcaacaactgtaatctttttgctcatggaaggtcttgctttgatattgatgactgctgactgactaggatggtggttgctagaagttgggatgactgtggcaatttcttataaaaagacaacagtgaagtttgctgcactgattggctctttctttcatgaaagatttctccatagcatatgatgctgatagcattttacccagagtagaatgtattttcaaatttggagttaatcctctcaaaccctctcaaagccactgctttatcagctaagttatgcagtatctaaatccttggatgtcatttcaacaacgttcacagcatcttcaccaggagcacattccatctcaataaactgctttctttgttcatccgtaagaagcaactcctcacctgttcatgttttattatgagattgcagcaatttggtcacatcttcaggctccaatttaattctagatctcttgctattttcaccacatctgcgatgacttcctgtgctgaagtcttgaagacctcaaagtcatccatgaggactggaatccacttcttccaaactcatgttaatgttaatattttgacctcttcccatgaatcacaaattttcttaatgacatctagaatggtgaattatttccaattaacttttcccagttccattagaggcatccctacctatggcagttatagcctaatgaaatgtatttcttgaataataagacttgaaaattagaattactccttgattcatgggctacagaatgaccgttatgttagcaagcatgaaaacaacattcacctccttgaacatctccatcagagctcttgggtaaccagctgcatcatgaatgagtggtaatgttctgaagagtcatttttttctgagcattagggcacagtaaggctcaacagtggacttaaaatattcactcgagtatgccctaaacacaggtaccatcatccaggctgtgttgttgcatttacaaagcaaggtcagagtagattcagcataatccttaagggccctaggactatcagaatggtaaatgagcattagcttcaacttaaagtcaccaggtacatttgcccttcacaaaagggcaggctgttcttggaagctttgaagccatgcattgattttttctctttagctatgaaagtcctggatagcatcttccaatagaaggctgtttcatctacactgaagatctgttgtttactgttgtcaccttcatcgatgatcataaccagaacttctgggtgacttgctgcagcttctacatcagcacttgctgcttcaccttacatgtctatgcagtggagatggcttctctccttcaacttcatcaaccaacctctactaccttcaaatgtttcttgtgcatcttcctcacctctctcagccttcatgatattaaaaagagttagacccttgtctgaatcaggtcttggctcaatggaatgttgtaactggcttgaacttctattcagaccactaaaatgttctccacatcagcaatgagactgtctcacattcatattatttatgtgttcactggagtagcacttccctcaagaatttttcctttgcattcacaaattggctatttggcacaagaggcctagttttcaacctgtctcagttttggacatggcttcctcattgagctaaattattcctagcttttgatttaaagtgagagatttgcaactcctcctttcacttgaatgctcagaggccactgtaggattattagctggcctgatttcaatattattttgtctccgagaatagggaagcccaaggagaggaagagaggtgggggaactgctggtcagtggagcagtcagaagacacacattaagtttgccaccttgtaagggagcagttcatcgcactccaaaacaataagatcaaagatcaccgctcacagatcaccaaagcagataaagtgataaactttaaaatattgcaagaattaccaaatgatagagatagagtgagcacatgttgttggaaagatggtgctgctaatagacttgcttgatacagggttgccacaaagcttcaatttgtaaaaaaaaaaaaaaacaaaaaaaaaaaacactcattatctgcaaagcatgctaaagggaagcatggtaaaatgagctgtgcctgtgataccagcaaatatttattacacgctgcatttctttaaattgtcttatatggcgggtattactttttcctatttcacaggtcagaaagctgcaatgcagagaggagaaatgatttgtttaaggaagtagagtaagtaggcatcagaggcagcattacattagcttcgaagtctttattttcactaaaataccctgccttcccctcccttttgttgctctgtgtcccactttagtatgaaggggcctatgtttatatcacagtaaagtcatgacttaagtagttttagacatagtatttcccccctcatgaaatttaactcctgcagcctattctatttctttaacaaagacatacagaatcatattaattatctttttaaaaaacctgaaaataccatcaagatacttatggaactcacatgaaagtgaaatagggagtatgtccccattccctcaaggaattgagtaataaactaagttttaaccaccaatggtagcaggtttgcatgccacttcacccagataacataaacacaccagttatctgcaacccctgtacgcccaacatggtataaagcaaaaagagaaccatttaacagcttttatattagctagtcattccagtaataaaacaggaagacaatcatacataaatgtcaccacacaaaaactttctctattacttattaataaccaacctgataatatcattaacggcttgtagagctaattgcggtggctttttactgctccctttgatatgtgcactatcctgaggaggataacatctgttagatctaactcatcccaaacatcaaatgtgacaccgtggtgtttaaataacttgactgcgcgctatttcagcaggtcctttcccgctctcctttctcatcttcacaaggctgaccacaggcagaggccttcctgtgctcattactgagtttcatgcagacacgatggagtgggagggaaagtttattaccttcattctgcttgaatccatccctgactttttggtccttcacagatttctttgggaaaataaaaatgatatattgttttctgaacaaaaggaaattaatttcaatcttttaaaaaccaacttgaatgttattcagttcggttttttccctaaaaaaaaaagtttcagattccaaagtttttcaaaaagtaacttcaaatttcatctatgtcaaaataagtaaaataggtcctcttgtcctattgagaatgacaagctcagtataatcttggaaaaatcaatttctataaatgactaacccgccaattgtattttgattttttttaaaaaaagaggtgcctatgcagatgcaggatacatataaatatagagtcaaccatctcctagtgactcaatcattaaatatttagctgacttaaattacactgcatgcatggggactacagttaatgacgatgtattgtggaaaatgctgagagactggatggtgtgttctcccagcaaaatgctaactaagtgaggtaatacatttgataatttgctaaatttaaccgtgccacagtgtctgtctacttcaaaacagcacgtggtatataataaaaacatataattttatgtcaagtttaaaagtatatttatactaaaaattaaactcatttttaaccctatagtttatgtgaaactatatgttatgtaactgaaatattttcacctaatgtgaaatcttgtctctgctcctgccacaaaacagaaacatgagaaagtccactcgtacttgtcagaggtgggttctcttcatcttgctgattcctctggtgggtctggtaaggctgagcttggtgttccctggactcccagaatggtttgggtccagcactgggctggccctcaggaggctgccctgcacatccccgtgcctgtgctgggttccgccccagcctgtctgtgaaatatgcgtgtacgtacgtgtgcacatatgtgcgtgtatgcatgtgtgtgcgcaggtataagggacagagacagacagatgaacacagatggagaaagaaaaattggtaggttgtattgagattccaatcaaaatctaaaatatgattttatagtttcaaactcaatctaaaccttttttgcagggtaatgttttatgactaagcagacgcagaagtcactctcaaataaatatagactacgtcaataaggtaacattgcattcaattatctccccaaggcagaatccctgtcttttctaaatgatgtaaataccttgttctctgtgtccacaatttaaaatggaagttaattaaaaagtcgacttgagcagggaccccaaatatagattcatttatttatttatttttaagttacacaaaagtattactatactagggtgcacactacaaaatatgctaatagaatttttgaagcaatgatgtgaataaaatgaatgaaacattttagaaggttcataaaggcaacaagaattgaaaatccagtaattacacactaagaaaaaataagcaaaaaaaaaaaaaaaaaaaaatttctccaaccaaatgtttactggaaggctgtgataatttttatactaaaggttattattctcaacaaaagcttatttttttccttagtaatagttcttaagctcaatttacaagcacaaattctctaatcttattgtgagaaggctgttacgaataatttttgttgttcatacagagaaattgagaaacaacgataataattgctcaaattattgaagttaagaagaaaataaaaattaatggtctagtgtttattcttataaaccctcctcacaacacacacacacacacacacacacagagagagagagagagagagagagagagagagagagagagagagagagagagaaattttccacttgtctgcaaatagtccctaaggttcttagccaaggtgtgtacctcaaagtctaaagtatgaagacttaaaagtggaatcaacagagcattttatcatgaaagccacacaagtgtggtatctgaaatggtgttctaaacatccttcgaatgctgccttttcttcaccttattgccaggaaaagcacagaagaatgcgtcaggtggaaatctgcatgggaggacaagcaatgaaacaaggtggcctctggctgagtagatgcactcactcattcctccaaccagcgctgtctgtgctaactccatggcggaattcctctgagtgctggggaacacaacagtgaacgtgacagacaaggtccttgtaaaacacacggtctcgtggggaaggcagagccaacaacacaaaaatattctctgcaaagcagagaactgaggtaaactcgtgtggttgtcagtgactggggtgttattttaggagaaggctgaattcatgcaattcttgagttaattatgttcttcgggctggccctggggactgcagtggcaatggaccaggtttcattgcaggaggagggtgttggcagcgactctgggcagtgtggggctaggccgaggaaggcgcctgaggagacagacacccttcctctctgacctctagggcccaggtccagcttcccaagacacccagcacaaggaaagctccaatcgtcatctttcatttctatcaagagtgacacttacggatctctaacaacgtttctatccaattttgggtctctaactatgtttctatcctgatgaaaaaagccagagggtttaataagaaaatgaaaattaaatgcactacttcctcacttagcacacagcaaggttgaggggcagcttttctgagcctgaccctaggaatttcctaactcaggtcaaaaggtgactgactcccaagccaaaggtctctaaggacaggtgtgttaataacaccactgccatgggtggagctttcagaggtctccaaggacagatgtcttaacaacactgctgccatgggtggagcctctctgtgccacgtactgtgctcggggagggacatgaaccacctcaccctggacccctctctcttctccagtatctgcattacatgtgcccagggggcccttctctactctgctgggatgccagcatctggcccagcatctggcacagaacagactcagcccaaatgtagaatataaagtcgggtatgggggtctgatgccctggcaaaggaactgaaagacttacccactgtccagtccaaagtccctaaaagaaagtcacagaggccaagaccccagacactttttgtccccaacacccaaagcttcattttaaaatcctttcagttcctccagaaaaaaaaaaaaaaaaacaaaaaaacctgaccctcaattcttagacattttatgtaaatgaggagaaagtaaggtgctagcccttcccgatcacttcttgttttgaatggatgtgtgagtcctgccaaagtgcaggctagtttgtgttctccaaatgcctcctagctcagtgagggtggtgtgcgcagggctgggatgggccacacaacatataggagcccaaatagcaagaaggcagttggagcacagcttaatcctgttgaaagaagccaccaagaagagctggggcaccggtgggtgcaggtgatgagcaaagctaccttcttccctaggtaatgattgcccatggggaaataatcagtaattcttcatctaggaaaatactagttgctgttcagagcctctgactggaagtgaggcatttccaagtatcaaacaatgattaaaagaaataaaaaacctttgcatcttggcatgctcatttaagaaagaaaacaaaatagacgtacacacagcccatttgcattccctctacccagtctaaaaggtgtccgatgattcattttaatcatttaccaatttcttggtaaccagtgtgtattgcagcagatacttggcaaaagcatgttaatttgctactaatatctgtataaaccagacattaatattctcaatttacaaataagcaaccagaacttcagcgaagataagtaacttagccaagattatccttctaataagtggtaaagctggaattcaaacacaggcctagtggagtccaaagctttccccactcctcagtaaaaagctaaacaaacttcctaattttctgagcttcctacatactctttgcactagggtaacaaccccatggctggctttattgcagagtttctctgcactggcatttggcctttgcctgtctaattttggctagttgcataagattctcacttagtgcaggctcaaggtgagacagtatttttgttttttcttaggtttatctctggagattgccaatgcttgcaagaatagcaatgctatcattaacctaataatgttggattaacttcaagagctgggtaatagcgccaatgttcatttcccgtaaatgttggaaactcctttaacctcatgagatcctacataacgtgggaaagagtccagttctgactccaaaatcttaataattcactctttcgttaactgctttttaaaaattaaatgtataacaccaaatagtgaaaaataataataatcagtttgtacctaaatttctttaaagaaatttttagttttttaaagaaatctttccaatgattctgactttttggaggggaatgccacatggtgattatactgctaaggtatatatatatatatatatatacacacacacacacacacacacacacacacaccttatatatatatatatatttggatttttttgagacagagtctcgttctgtcacccagtctggagtgcactggcacaatctcagctcactgcaaccttcgcctcccgggttcaagtgattctcctgcctcagcctcctgagtagctaggactatagatgcccccaccacgcctggctaatatttgtatttttttagtacagtcggggttttgccatgttggccaggctgatctcgaactcctgacctcaactgatccacccacctcggccttccaaagtgctgggattacaggcatgaaccacaatgcccagccctgctaaggtatattaacggtcagtttagtattatttgactatttgttaacataataggagtaaaacttaacactttttagggtagagatggtacaaaaaattaaagtgtaataaatataaatctataaaaacagaagttaaataagaagaaatcttctggggaagaagaaataatagagtatagattattcttaacgtaagtcaaatatttgataaggaccacaggcaccttcttttaattcagatgctgaattttctttagtcctagaaagaagtgttgttagaattccaaggatatttggatgaaacttcgctgtaaactcacgtggaaactattttagctggccacagatgtgaaactaaaaatgttgaaatacttatttcaagtgcatctcgaaaatctgcaatgacttcctcctggaagataattttcttactacgcatgcttgacatggatttcgaacatctgcaatgacttcatccaggaagataattttcttactgcgcatgcttgacgtggatttcgaaaatctgcaatgacttcctcctggaagataatcttcttactgcgcatgcttgacgtggatttcgaaaatctgcaatgacttcctcctggaagataattttcttactgcgcatgcttgacgtggatttcgaacatctgcaatgacttcctcctggaagataattttcttactgcgcatgcttgacgtggatttcgaaaatctgcaatgacttcctcctggaagataattttcttactgcgcatgcttgacgtggatttcgaaaatctgcaatgacttccttctggaagataattttcttactgcgcatgcttgacgtggatttcgaacatctgcaatgacttcatcctggaagataattttcttactgcacatgcttgacgtggatttcgaacatctgcaatgacttcatcttggaagataattttcttactgctcatgcttgacagctgggtctccacactgcatcacttccaggctcctttcacacagccctcctggcattctgcctggaaatatgtcatatagcaagtttcacacttttttaacatacttgcaaaaaatcttaggttagtgctaacctaagattagtgcattgtttctaaaaggccaacgcattacatttttcctgagaataaatattgacaactccaggatttaaatagtgcacttggctaagattatggattttaggtagtctgtatatctttatgatattgtcctatgtattttaacattcttcacttttcttagtactgccatttcatgatttttttttccttttggatgctattgattagtacataaattccttggttgtacaccctgttttcattgctaatccagtagaagaaaagcaatatgcccaaaatcttttacaaaaaaaaaagctttcttgcatctgctgcttgcattctttgtgtgatacagtattttctctcattattgttggtcttcaaaggcaacaacagcataaggtctgctcaggccagagggcctcctgatatagtcctcatggagaccacacagagcctttccaagaggtcaaaggaggccagaagtttttggttctttttctcctaacttttatgttcatcccaggtaagcctccatctccaatctctgtctactagaatctatacacaagctggtgcaccagcttgcctgctctcacttgccttcctttgatgataccataatgtctctgattctacaacttaatttttctttcactcaagtctagtccagtagatacacattcctgttatggcaaaagatcatgtactgctatttatggaactgtaatttattctgtacttataggtgaattaggcaaaccaataatgccagcaaagcatatagattgaggccaacatttgcagtcattagacaaagtggactcagccactatttctaagtctttagtttggcctaatacctaatgttacattgatgccatactgtaagctccttgaagtaattttctacatttttaaaactcagcctatcattgctaaaataataaaaattctaatgcaagttgctctttatttctattacctgtaaggacacttgtatttgagaatacacacttgaaatgagttaaatataccaacatggatgtttggcttcaaagaccaggagcatgtcggatccgggctcactgctaagctttctctgactaggcatataaatcaacatcttcagtgcttttagggccaccatgcagcaattccatgatgcttggctcaagctctgcgcatctcacattagtcctcctttcacccaagctggctccagtaattgggtgactgttctggcagaatcatgtgctaccatttaaagtgaactagacaaccagttgatactgggtgaggataggagattcttttttttttttttttttttttgagacagagtctcgctctgttgcccaggctggagtgcaatggtgcactctcagctcactgcaacctccacctccagggttcaaacgattctcctttctcagtcccctgagtggctgggattacaagtgcctgccaccacgcccagctaatttttgtatttttagtagagacggggtttcaccatgctggctaggagttggtctcaaactcctgacctcgtgatccacctgtcttggcctcccaaagtgctgggattacaggcctgagccaccatacccggccgaggctaggagattcatagaggacagagaagacattctaggcttcatattgaaattgtaaatgtgaacccataaacaagtcaatagagatcaacttttgcatgcacgatcttatttactcttacataataccaccaactaccacttaactggaatgtcataatgtagaatctagacaatctttattaaattattaaattagctagaatcactcaacatggtattgtggtaagagtaaataataaattttatctagcaaatttatttttggatatacattacttcaaatagttgtgtgaccacaggagcatcataactctcaccggttttttcttctgggagacagctaataaacaactttactacaatttagaaaataatcctttagatttagttaaaattaaaaacatttcatatactggtagctcaaataaaattttggttgctcactaaaccatattatttctcagacatgattatatggtcattttgattacaaaagaaatacaaagcaaagtttatttggaaaccttttcaaatgtttctacattgttagcaaagcattatatattttcaaaagtatccaaaattttttttgttacactgtagtaacttataatctagcttgtatttcctattttcccataatattaacaaacatttacgtatttgagaaagaattccttgaagcataatgagaatatacttgttcaaaaatctcgctttcatgttttcattttaggactataaacattaggtagttcagaagaggaggtgcaatgcaaaaggtcctctgcaatgctagggagctctgggcaaagtgagagcgttctgctttcccttagagaggtcctggcctaaaatgaacacgtacttccacgagcttcgggtgtgatacagaaatatgtatgactctatgtaatccttatcatggcgttcctaccaactcaaacatttttaaggttaactgagtactcgatgtaattgtaatacatccacctagtcactactacaagatagtctgtgtggctgcaggctatgaaggatagctttttattttttccttatcaaggtaatatttggaacacttcaaaaaagccatcacagtgccattatagatgaaaggcttcccggtagaaatttcatttcctatacctgtaacaggctttcctgcagaaatgatagcatatgtgatacatccaaaaggcttatctcatgaagtcccagtgaaatgtattaattttgcttttggaaaataaaaacatcactaatttactgagaactctgcaatgcagtgtaaattctgtacccaagaagtagagctcatcacttaagtgaatagaaaagtagcctatagatgttactgtggttatgataaaacacttttaaatcctgtatatgtttaaagtttaaagaaaagcatttgcatctcgttttcctagtgtaattaattggaccttgaatgttgtatgtttccctgtgatatttgaatgaaagccaggggttgtcttattatttgccttaatatctatttgcagtaaaaagctaacaaagaagtgtccaaatttgcaggtagtgaacccccatttaaaagatatactatctcaatcaactcacctatgtaactttattaatataaaaagagatatcctggctgagggcagccagaagttactctgggataactagccttcaagacgtacctcttggtagtcatactctagcataataccttcccacaatgaattatggctgccctgtgtgatcaatacaatataacagcagtaacaatatgtgctagattatataaaggaatgcagctgccacttgaacatttggattgctcatccaggggaagccagctgtcctgccatgggaacacagacactgtcctgcagaaaggtccaaacagagaagaactgaaggcccttggccaacagccagcatcaatttgccacatgcacttcagtttgccacagtgccaaccacattggaagtgaatcttctatcatcagttaagtcttcagatgaatgtagctcactgacatctaactgccattgcatgagatacccaaatcaagaatcgcccagcagtctctccacaattccagacctacgcaaaccatgaaagataatgcatgactattgtcctaggccatacgttttgaagtaactcattatgcagccatagacactgatacaaacgccaaagttacaagaaattctcctttgtttgcaaaaaaaaaaagaaagttcttactccagatgcccactgtcacctggggttgttgtgtggtttagcagtttgaatttcaaggtgcatatgctttaaaataaagggctggctctcaggcctagtctgtctagctgagcatacatataggactattattatctgagttattaacatttcttcaaacacagcattatccagtttaaattctgtcttcctcagtagacactaagttgtagaactcaggcactgtgctgtacccaatgcaccaggcaccttttctggtatacagtaaaagctcagtaaatgttggagacaggaatatgtcattcatatgtgaataattaaatgtagacaaagcgaatcgaatcatttcttgaagcctaatgagttctgggcaaggccttaagctgagttaagagttactattgcagagcttttgttttcacttccaggcagtccttggaatgctgctgggccattttgtttgtatatgtactaaaccagctgggattgtaggagttttagaatgttttgaaagaataaatttctctgaaatgagaagtggattgtcattttaggattcggagtagttgaggatgtgttcctcgtgtttgaacaggagtgcagtcagcattagtgttgtccagccctccttgctgccccaccacatagaatatcgagccagctagtccctttgtttttaggtgggacgtgtcactagttctggctaacaaggtggaacgatgggtatcacttcccagccagagcataagacgccaactcttccctgcctttgtgactgtggcaacttgtcatggtggagcctcgtgacaaggaccttgtctgtcgcgttcactgttgtcactcagtcagcctggagcccgaggtcccacatcgagcagacccactctggacccgtcgcttgtgttagaaaacattttttgttgttgtgtaaagccactggaactattggcacatttgttacagaaacataattttctgtgctgataaaggccagtgtaagatcgatataaattaatcaccctcccatatgcacatgcacacacacacacatttatacaaaagaagcaatcatatttactgtgtttttacctgcccagaattcttctccttttttggtaagaacaacttcactgacttctgagaaaccacaagtctgatgcatttaggttcaaggtgggctaacttatcccctaaacacacaggcatgaacacacacacacaatatacacacaggcatagggtttgactagggtgggcctatccacctgtttagttcccatggccatagtggtgttggagatagtatgcaaccgaggacagcgcaataagggtcactcctatgacttttgctggaactattaagaaagaggccttctcttcccactaggcttgctaactgatagaatgtaagcctgaagcttatggtgcctttctgtcaccaagaggacacagctgacttaatgaagtaaattccagaaaatttgcttaattattgttaaatgattctgtgaactctcttcatttagcaactgttcaggaaggtaagaaaaagaagcaaactcgggaatatcaacagatttgagatgtctgaattaacttcgagcacctggattaagtcatgtctaggccaacattaatgccaggaactcaaatatttaatccaacaatctctctttttttcttacgccagtctggctggatttctgcttcttgtaattgaaagagtcctagctaatacatcttctatatgcacacggctgtactagatatttggaggtagatggaaatgcagaagccgaagacaagcaaatataacatggtccttgcttcagaaatttaaaatttgtttacagggacaactataataaatgaaaagctaaacgctccaatccatgagctcttccagcagcgttaaggaggtctagaaaagctacttatttcctgcactgtcaccgctgacattgagtgttagggaactccttacccatttttattgaggcagaagagcacactcggcagtagaaatgtaagattttggccggtcacagtggctcatgcctgtaatcctagcactttgggaggccaaggtgggtggatcacttgaggtcaggagttcaagaacagcctggccaatgtagtgaaaccccatctctagtaaaaatacaaaaattatctgggcatggtgactcccacctgtaagccaagctacttgggaggctgaggcctgagaaccacttgagcctagtacctggacgttgcagtgagctgggatctcaccactgcactccaccctgggtgacagagcaggattctgactcaaaaaaaaaaaaaaaaaagaaagattttctcaaatttgtggaaaagaaactaaacaaaaattcactatgaatcaatttactataaaagttctatttaacacttgcaacataaagcaaatactttaaaattaaaaatcccagagtgctatgtaatacaaacatgaaaaacatataaaaggcttctagtatcatttcctaactaacatctggcttactgaataaagctttataacatcaacttcatttttccacagttattatcataggtagttataatgtttttcttaaaaaaatgaatatcaacacaaatttgctgttataaagagtaagacaacttcagccagatctttctctttttgttttttttttttgagacagagttttgctcttatcacccaggctggagtgcaatggcacaatctcggctcactgaaacctctgcctcctgggtgcaagcgattctcctgcctcagcctcccaagtagctgggattacaggcacccagcaccacacccagctaatttttgtatttttagtaaagactgggtttcaccagttggccaggctggttttgaattcctgacctcaggtgatccacccgcctcagcctcccaaagtgctgggattacaggcgtgaggcactccacctgggccagccagatcttttaacttcatcaggatcttcactttattttcagggaaacaaatatgcaaatctccttttctctacagtaatctgtgtgtatattacatgatgtggcaaatgatacattcctgcttgccacaactaattttcactaatttctccagatattctatttaagagggctattttctaatgggcaatctttaatattgatccagtaatttaccatacagactcaagaaaaagaaactgaagatgtaaatttttacttcagcaaaataccttcttcacatgacttaaaacataaacatgattatcaggaagtattatgaaaaatgggactatgaaaaatgggacaataaaaattctcctagggaaacttccatcaacaagaggggacggaaaaacagcattttctctcaccaaggaacaatcccctccccattttttttcatcttgttggtgaaactctaaaatgaatgtgaaagccacataagcaacagcaattgggtaggaactgtggaaggaagccagagatattgtcatggagagacatcttcctgaaagtgaggggaacactgaggggtcaaaatcagaatggggtaaaccaatgggtggatagctccactagaccaaatttggtttagagtaacagaggaggcaggtgaaaattaataatcacacagcaaggccacggttggaagaagcagtctgtatccatgaggcagagagtaagaaagtgagcaatactagaatagcaggtggactactgctctacgccccaccacatacaggacacccctccacaatacatgtccatgaaacccaagtattcaatgttgaataacacatacacacacacacatgcatgtatgcatgcatgcacacaatctatacaaacatactacaagaaaaagtctatttatagactaagaaatctcatcagaaaaatgttgttactcaacagaactctctggcaacctattctagtaagaaatgaaaaccaaacaatgaatcaaccaagcagttgtgtccatgaaacaagacaacagagcagaaatacaagagctggagacataacagagaaacttaaggaacaactgaaaaaaaaataaaaataagatgtgaagtgacacaaaggtacaaactcactgcaaaaagcactacaaggaaaaagatagaaaaaagaacaatgagctaaacggcctgtatgatttggaaaaaaaagaaatcaaagaagaggctgggcacagtggctcacgcttgtaattgcggcactttgggaggccaaagtgggcggatcaccttaggtgaggagtttgagaccagcctggtccaccatggtgaaaccccatctgtactgaaaatacaaaaattagctgggcatggtggcaggtgcctgtaatcccagctacttgggaggctgaggcaggagaattgcttgaacctgggaggtggaagttgcagtgacctgagattgtgccactgcactccagcctgggtgacagagcaagactctgtctcaagaaaaaaacaaacaaacaacaacaaaaaaaaaaaacaaagaagatttgaatctacatatggaaataacactttgtaataaaaggaaaatgacctgtagacaacaccagattataacttattaaaatgatcagtttgtggtttgtggagcaaaagaatcttctggacagccaagcagaaagatcaattcacttatgtggagaaataaatcagacttgcctctgactttcccacagcaacatgtaaatatcaaaaaaaaaaaaaaaaaaaaaagctaaaatgacaccagtaaaaaacacaaggaaagagtgttccaagaaaagtaatacagcatgttgaatattgttctcaaaattttttggaaaaaaccgaactatcattagcttaataatagaactaagactgaaatcattgtggattttagggtaatggaaaacagtttagtgcactttgtcctgactgtaaaacaacagcatttctttaaaatgggaggtgaaccagaaaaggtagatgggtgggaagcagaggaagtacatttcttaaaacagaggatacatcttttctcaaatgcttatggaacagtcatttccttgaagagactgcatatcaggccccaataaaatatgaattaatttgaatgagggaactactatatacatcatactctgagtacaatgtaatatacacttagaaattaataaagcaaaaataacgtgttattaatttaaaataattattttaagcaattcttgaataaaataggaaatccaaatgagaatcacagaatatagtaaaaacattgatgataatggaaacgcaacacaaggcaacccacgctgtgcatctgaactgatgctcagagaaaaattcatagttgcaaaagcaagtgtttttaaaaacaaggaataaaaagtatgttttcatgccaaaatgtggcaaatggagacagaactacgattaaatatatataaacaacataaccataaaagtcagaaaaaaagaatattaagaaaaaaatagaaattgctgaatcagaaaatgggcaaaaagagcagaaacatcaaataaactaaaaagctagttcttcactgggaaaaaaaaaaacctatgcagatactccttgacttacaataggtttatatcaccataaattcattgtaagttgaaaataccataatctgaaaatgcatttaatacatttaactatggcatatcatagcttactgtagcctactttaaatgtgttcagaacacttacattagcctacagctgggcaaaatcatctaagaaaaagcctatttttataataaagtgttaaatatctcatgtaatttattgaatactgaaagtgaaaagcagaatggctgtgtgggtagttcaattacggttcctactgaatgcctatcacttttccactattgaaaactcaaaaaatcatgtcaaaccatcataagttgagcatcatctttaagcaataaacttcaaactaatataaggaaagagaaagaaaatatacaaaattaaaataaggagaatggtaaatatgagggaaagaactttgcacaattctttgtaaatttattaacttgaagtaaatgaacaactttataagaaaatagaatttatcaaaattgagtcaagacaggaaatctcatcagaccaatttccacagaagcaaacagttattttggactcgataactttttaaccagctttaagcaacttctagagattattctgagtatttcaaaccacagtgttgccgggtgaagtggctcatcccagtaatcccagcactttgagaggccaaggcaggaggatcacctaaggccaggaattcaagaccagcctggccgacatggcaaaacccagtctctaccaaaaaacaaaaattacccaggtgtggtggcacacacctgtaattccagctactcgagaggctaaggcactagaatcgcttgaacccagaaagcagaggttgcagtgagctgagattgcaccactgcactccagcctgggtgacagagtgagactctgtctcaaaaaaaaaaaaaaaaagtttcaaaccatagtgtcattccgataagcagtattattccagcgtttgccaaccatgctcaggcatggagagttaaggaaattaatagccatatgtacttttctccaaaaggaatctatcggaacacaaggccgttcccacactttccacttcccactcacagttgcccccctactccctcacggtaaaacaaatgcagaagtctcactcttgagggctcttagcttaattcattgtctcggggtataagactttaggctgacccccaaaaaaggaaaagttaaaatatgtgtgtccactcagcctcctttaactaaagcactatacaataaatcataaatagtaggggtttgtgtctttccttgtcatatatatatatatttcttttatttcctttttttttttttaagacaaggtctttctctgttgcacaagctggagtacagtggtgtgatcacagctcaccgaagcctgaagcctcaaactcttggcctcaagtgatcttcctgcctcagcctccttagtagctagaatgccatcatatctgagtgattgttttttagctttcttagagacaaggtcctgctgtattgcccgggctggtttcacactcctaggctcaagtctcgggctcccaaagtgctggggttacaggcatgagccactctgcctggccctgtcatgcatatatttctgttaagggtatagggatatctggccagtgttgggatggtctggactcagatacccatgaagatctcatctagtctcaaggctttaaacaccgtctggattctcactcccagatttatatcttttccgccttgctttgttctcaacataactggccaacttcttctcaacattggtttacagcatgtccatgaacgtgaaattctttcaactcacaaggcccaacaccatctggcgcctttcgtcacttgtagctcgcctccagctctcctcactcactctggcctccagcctctcctgccagcgaatgcttgcccccttggagctttgggcttgctgctcctttaatctcattcttccccatgcagccctgtgcctcactccctcacccgggctgcgtctttactcaaatgccttcttgtcaaagaggtcgaccactccgccttatttagaactgcactctctgcttcctatccccagcgagttttatttttatctacagcatatatcaccatctgaaataccactgtgcatatctgatggatttatcttgtctgtcgtcagccttttctctttaaaaggaggctccaagagggcaccggtgattcctttccattgtgtgaagctgtaacccccacacctaaaacacagcctgacacaggtgtcagaaatagttactgaatccctggaatcatcaccgtattcctggattcaggaatggggaaaaaagtgttccatctgaggacagaactggatcaagttccaaagcagcctcaaagtttggatgggattggagtggggagtgacacaagtcgttgtaattacatgggcggggaaatcatggagttttgtgggaggaaggccaatgtcagaagaacgtttcagggaaatgggtccaggtggctcacttatcatcattaaaaagctatgcaagtttttacttctctttctcctctatccataaagtcctggtggtgaaggcttacctgtttttttcatggcattaaaccgaaccattcacttcatgattttgcctggtatcccagtaggtcttccctatcctaatacataaaatagaggttggttggcaatttgctgcttcatctgtcagtttagaaataatcctttttggccgggtgcagtggctcatgcctgtaatcccagcactttgggaggctgaggcaggcggatcacgaggtcaggagttcgagaccagcctgaccaacctggtgaaacccccatctctactaaaaatacaaaaattagccgatgtggtggcatgtgcctgtaatcccagctactcaggaggctgaggcaggagaatcatttaaacacaggaggtggaggttgcagtgagccgagatcgcacgattgcactccagcctgggcgacagagtgagactctgtcagaaaaaaaaaaaaagaaagaaagaaagaaagaaaatccttttttcttttcctcattagcaaagagctcagtgcttcctccaaaaggatattgggtctagaaatttgccaaatacctgtgagcatgtcctttaggattccaaatagtacactcatattttgaaatttggcaaaggcttgaaaccaacacttatgggtttttggtttgtttgtttcactcttgttgcccaggctagagtgcagtggtacaatcttggctcactgcaacctccacctcccaggttcaagcgattctcctacctcagcctcccgagtagctcggactacaggcgtgcaccaccacacccagctaattttgtattttgagtagagacggggttttgccatgttgggcaggctggtctcgaactcctgacctcaggtgatctgcccgcctcggcctcccaaagtgctgggattacaggcgtgagctactgcgaccggccacttctgattttttaaaaagtgaacatagagccacacaccaagtaaggaaatacttttagcagcatagaatccaacgcttgccttccttcatagatctctatatacacaaaatagaaatgaaaccaagcactaggcctatattattaatgcaagaagtgtttgcttgggattggatgagcaaaaatgtcataaaaacaaaacaccatgaatgtttcacaatatgccccgctcagaggtcagcccctccatgtgtcctgcagagctcctgaagcctttaagagacaactcaaaaaaggagtgaggcagcctgttctgacacttggacgtcttccaacgcagactttcagtattatttttctaaacatcctaaatctctagtgagaacatggaatagactatttctgtaatggcagatcttacaaaagagaaacaacttcccgaaaacatgcctatgtccagtcacagagaccaagcatcaaaatcacctgcaggggtttctctaagtcgccctcacacatgcttggacatctgtatgaattcaatgcacagtaaatactcctttgagggtctcttatggacaagacttcgagagaagaataagatacattctgcctccaaggaactcatcatctagtccacggtgtgtggtgatgggaatgcagatgccaggtgctatgaagtgaaccgtgtcacccccaacatttacatgctaaagctctaaactcagatacctcagaatgttttgggggacacggcctttaaagaggtgatcaagttaaaatgaacccattagggtggacccgaatctaatctgaatggtgtccttataggaaggcaagattaggacaggagagatactggcgttgcaggagcccagaagaaacgctacgcgggggtgtagtgagaatgtgccatccgcaagccaaggagacaggcctcaggaaaaaccacctgctggcactgtgcactcagagtaaaccccgagtgatctcagagttctagactccagacctgggagaacatataaaccacgcagtctgtggtatggcggccctagcaaactaactcacctgaatgtaaatatacaactacaaagcaacaaataaaaagatggcaacaacaagcaagcaatggaatggaccctcctgctgggctgaacatcaagacagggatttagaaccagctttacacaaggagcatcatttttccctaggtatgatttttatccaattcactttgattaatgacagctaccatttagcaagggctttttatgtgccaggcaccaaactcaacacttttcatgcattcacttactcaaccttcactgcaaccatgtaagatcgttgccattgttattccaaatggacagatgtggacactaaaacagagaggtaaattttgacctttgctgaagtcagatggctgcaagagttggaactagagttcaagtccaaagagtccaactctagaatccttagaaccactgtgcatactgcatgaacagtactcttaccttctctagtcaagagttcaatgtgaactttattccagaaaaacacaccattcaacatcttcatcaaatattataaagaatgcagtacttagatatagactctctatgcagcatttcctagctacatttgacctctctgtttcaatgtatctgtgtagcaaatattctatgaaacacaatttcttaattattgacctcgttgtgtctttaccagcactgtgactataccatgtggtgtgagagtcactccagtgaataaacacagactgaggtcaagagtctaatcattaccaaggccctgggaaccctccttgaagagaagagataggagcgcactatccaccatgaaaagttgaggtaggtagcaaagtcagtgtctacaccacccgccagcttctcctcccctcttccacacgggtgcatggctgccaccacttcctgatgggaagcttttcagaatacagataacatcctcactctcctgcctccctccccaccccagtatttttatttagtagatctggtatggctctaggaagctattcttgaaagtttaataatgattccaactttctgccaggtttaagagccataataatgttgaccaaaattgtagattttccaggatactctaagctttgataattttgtgcggacagttactagatcatgtgatctaaacgagggttggaaatacccccatttatattcccaggcagactttcccttgcccacttccaaagcaacctagactttgggactactctattccctcactgctcttgccctcactcacttaaaatacttttatctaatacaaaggtgctagatgttgacctgattgaagtagagctgttaagaggtaactgaagcttcagctaaataatgccagggggtaacattgtccagggaaactgttcaccagcagacctctgttgctcctgatgtactccaagttattttcagtttagcctttcataacgttgtacaaagaggctttattcataaaacagtagctttggttggcctcccacatcgtgaaaacaaatgtaatatagtaattaagtgtgctgatatgttatcattgcaaatgtcaagttcattgtagcagatgtgtcaactgaagatcactacccattaaaatcaaacaaccagtaggccccaaactcaccatctgatttcatgcgtcaacttcaatgcttaagacagtcaatcacaactgtcttccatgtaattgtcttaaaattattacataacaaagaatcagatctcaattcttatcacctgctagtcataattaaaatgtgaatgaagggctaatgactgacacagttacagggtataaaatactttcacaattttacttccccaaatagatggcattattattaagaaaaattactcaaaatgtgaaataaggaaaaaaacgactgatgtgttaatgtcttgctagagcaaagctcactaaatctccttgaactctctagagaaatgtaacttggttaaacttactacattttctattcatttgggcccaggtattttacacattttaaagtttgggttcctaatttaaaaaaaaaaagtgataaaatcagatgactaatatttttatcaagttaaaaagttttattatccagtaggataataaattagccactatgatatctacatcttttcaattttatttcagcatttctttttcatctgactatataaaattcctactctcatatcttcttttgaaccagttttgtcatcctgctgattccctcattagtagtcacatggatcttatgaaaataaatataatatcccattagaaacatatctgctactagtcggggtacttacataaagttgcagcaattatcagaaaaaggtaatatgcaagtctcctctaaaatttcccaactatattcagaaaaaaaaaacaaaacaaaagcttaagtgactgcttaggtgaaaataagacttccagaagaatgtctgtcaaagttgtaccaagaacattttgaaaatacaggttaattcaaagaagcactcacaaaatgccctcaatatgattttgagaggaattattacaagtggtatgtattcttgaaagccaggtttagggtacatctctaaagcagaataggttgttttcaaattgctaggtcattcaaggcctttaaaccactatattctatccataatttgcaaacgtaccactaacttacactaaagagatagtgagaaataagttcttgtggaagcaatttacacatacagagttgactataaagtcctaggcactttggcaaacatgcttaggggtggaaagtttcttttttggtaaagatcccatagattactatttacattttagcatcatctaaacaatctggaagctcctgaagctcatgtctcatcttcaccatggacacaatcacatattcttactctaagcatctctcatttttattctagttgattctcattcttcattcttcgtaaatgattataatgaatcctctgcctcttccttcccctcttcttcacctcactttcccctcccctcccagctttccctctgccttctcctcccctccccgctccttgtcttccatccctgcctctcccactccccctgtctctctgacactgttgtctccaaccacacacaggctccctgggtttctttcacaaataaaggaacgatttgcatagatggggtaatgtgcatctgcttttgtggtgtaccttccattcttcctttcttctgggaatagtaactccctcccttttcttttcttttgtattttttttttatagacagtgtctcactctattgcccaggctggagtgcagtggcacaatcataactcatgacagcctcaaactcctgggcttctgcgatcctcctgcctcaacctcctgagtagttggaactacaggtgtgctctaccatgcctgccatatttttttttgagagggggtctcactatgttgcccaggctggtctcaagcttctggcttaaagtgatcatccagccttggcctccccaaatgctggcattacaggtgtgcaccaccacgcccagacccctctcccttttctgtagcacaccccaccctcaccccatgcacttttgcatgattatcaatatgggttgaaccacatgaaattgccaattttgtagatcaaacatgatagaatattagcaaatagaatcatgagattgaacatatccttttaataacactaacgtattcagtattttatcaagcatataatttaaagttgtattactagttataaatttaatatttacctctttcaagcccaagcacaaaatatttggtttgtttaaactacatcatgtaggatgaaattaatacctcaagtgggattctcaacacactaactagaaacagctctcagagaagataattcaaagacgaatttaaaatcaatcccacagcaagtaaaaccaacttttttaccaagtagttcagtcacatgggagcagcggaatcagtgtgacattttcttttcacgggatatgtgcaaccatgctgtttaaaagggaagaaataagataagctgattttatttccaccagtgaaaaaagttttcaatacagcagctttcatcgactcagcatggctaacaaaataacattatcaatgaaaataaaataatagatcagctgcacaatctaggcatttttgtttttagaggccttctctaacatttctctgtagagatctgtgaatgcctggttcctgtgaatgaaaaccaccctgctgttttttctgctcctgctgagagacttgcaaagaataaaatctttttttttttccagctggagatcaattggtttgaggactgctctggcccccaggaagtattctttgcccccatggggggaagagatcctcagttccccaccctgaccagagtttgcccccattggatagttttcaaagctgaatccagaaacagacctaaaagcatatccaaaaaatgtgccactgaaaaacagctaacgattcacatggaaagtccacaccctccatctagccgggtctcctcctgcctcccttggggaagaagggggagaatgccctttccaatttcgctcgactgaaagcaagggctgtgtctgtcccccttgctgaaaagcctccttttgtttttcttttctactgtcaggaagcctgcctcagaggagtggacaatgcataccaatgaggaaaggagagcagaggtgattgaaagtgaagataatttttccctgtcatttacaggctgcttctcaaaccatgccccttttgtgattccacttcaaaacacattcttgccaactctcatccaggaggcttttccttagtgatctgctccactatcttggagtttggcttctgttatcacctgaggagctgaaaagcgttcagattcaaggaagcctctcctctgcccaaatcagcagaatttaaggctcatgaggatgaggactgtgacagggaagaaggaggtgacagggaaaggaaatgatactttagcttatttcattgttgaatggagcaaagttgaaaatgattcttctggtgtctctccttaaatcttggggtattgatacagactcatacaaaaatgaaaaggagagaaatgaacatattcatatagtcctttggggtttcacagtgatctacctacagcgacatgttattttaaattacaataatctatttaaagagaaatatggtggaatttacttttaaaaaggttacgttgcagggatgttttaaaagataaaaattaaatggcaactcaaaaaatatctgtcaggcatttaaaaatggatttcaagacaagcatttgaatcctactttacaagaagtgactaggttaattaggaaaataaggtatcttctgataacagtaaaccttgagatacatgtgtagctcttataccggaatgaccatgaatcactaacaaatttactttctagacaaaagatggaccacttagacagcacagtataagaaacaaggaatgttaaatgaagcttaacatcatgtaacagatgttaggttttctcctctcccccaaggaggactgtaatactgttggagatgacacttgtcaactgtgcaatgtgtgtgataaattacagaagcaaaaacataatattattatttaataatccattttaaatatcactgtcatttaaataccacctgtaagaaaagttgtataaatttggcaatgaaaaatacacaatccagaaaaaattacaattaaggatcaggtttttctttgaatatagttataatttttaaaaatcccttatcacttttattaactataattattaggagactggagacaaatataaccattgaagcaaactgagtacctttcaagggccaccgtctttttcctctaacctcctcaggctcacatccccacctcaccccaccacatttaaattactttaaaaacactaaaaaatgtttcctatattagaaatttgaatctatcaaccctgatacttctttagatcctggaactccctttgctttaaacacaatgtccaactattgagaaagaaatttcccataaagaaaaccatagtatttctttggtcacagctgagaggcatttttttttttctgatctggaaaacaacaatcacagaaagcaggttgtttgcaaaatgagatcttaatttacttaaaaacagaatagtaagatgaacctactaaaagtaacaccatagcactgctacaaatgatttacagttgttcacattactgccataatattggaacgataaatgacatgccaaggggctcaaagtaaatttctggagttgaactgcacaaagcaaattgctgagtttgtgtcatatcctaccgtgaggatggcatatctagagcaaggctcaatctagaaggtgtctggactgaggattctagggtacgatgaataacaaatggaacaaagatgtcacccacaggaagtggggactacgggactcactgtggacacctaagccaccgcctccctatgcgatgaaaatctgttcttcatagcaatccagtatacattcaaacaagcagaagaacaacacggggtaagggctacttaactaacttatattatcctattttccatggaattccagcaatcataagaaaaagttccatcttcttggttttgaatgttttaaattaaaagaatttcccttcccaacactacaaatatgtacaatgacacattaaatacaactgtgctttctaaaacctgatacttgacagagagctcttcttcaaagctcaactgcaagttaaattttactgcttatcttttgtttatcaccaacaagaaaaaaattgagcttgagaactgtaagcttataactgggtaaattatgttttgtataagaaatacaagtatccatatttggattacttttgtatagatgggatatacaaaggtgccgacattacaggactgaaaaaaagagccaacttgttttgcattaaaacatttttttaaactttcaaaacaataagagactagtggtctcttaaacacagtttaatgaatttatctctggcaatgtattgtgatatgtttgtgtgataaacctgataccatgaaaacatgaaaataatttctggaatgtttcatttcttaagcaaaaatttcttaaatatgaaaattgggggcttcttctgtgcagtaataggtaagaccagtctggtctgaagcccatatcaaatatttcaacatttcatgcctatataattggctttaaaagactaaaaactctctgtacagtctgttttttttattgttgtttttctcagtccttaatatcctggagtcagaacaaatgaagaagccccatcagcttcagaccacgacacacagcttgcaagagtaaatgatttatggagctacaagcatgagttatgagggagcggtctacatatttgcgttgtgtagctatgcagggggaaagagacaaatgagattcttgaaacatttgtgaaatatagaaaggaagaaaatagaaaaaagttaataagctgcctcagatagtaactaattagatagcaaggtattactgacaaaatgaaacaagaacaaaaggcaacaaaagttggtttagggccaaacattatctgtattttcacttttggatctctactcatttcctttttttccatttcattcaaaaaactattgtgcaaatcaccattctattgtcttctaacattgccgctattttcactggattttattcaatttaggaattaaattaaaagtttcaacatttccagtcatgttattctttcatgttttttgccttaaggagtagaccatagacatcacctattttaatagtttcatctagtccagaatcggcacttggagcttcaagctgggggttagggagaaagcacagacacaggcaggctgctatgctgggccctaagggcaatgtcaaactcaagattgcagatacaggctgggcgcggtggctcacgcctgtagtcccagcactttgggaggctgaggcaggtggatcacttgaggtcaagaattcaagaccagcctggccaacatggggaaatcctgtctctactaaaaatacaaaaaatcagccaggtgtagtggcaggcacctataatgccagctactcgggaggctgaagcaggagaattgcccgaacctgggaggtggagactgcagtgagctgaaatcatgccactgcactccagcctgggccacagggtgagactctgtctcaacaataacaacaaaaaagatttcagatacagagctgttggctttaggaaatgcacagaacttactgctccataatacaaacaaaactttaaaagggtgatgactgattccagattactcttgcttttatcttaagctaatctctgtgttaggtaaggacaagcaggtttgaacggctgttaggacaaggcatcattgtctacaggtgttatgatgaccatgaagattagaaagtagtgaatctgccgggcgtggtggctcacacctgtaatcccagcactttgggaggccaaggcggctggatcacgaggtcaggagatcaagaccatcctggctaacatggtgaaacccctatctctactaaaatacaaaaaaaaaattagccgcgcatggttggtggtgcctgtagtcccagctactcgggaggctgaagcaggagaatggcataagcccaggaggcggaggttgcagtgaaccaagatcgcaccactgcactccagcctggtcaactgagcaagactccgtctcaaaaaaaaaaaaaaaaagtgaatctttgaagttttaaaataatgctatctatggatagaataaaataatcagaatggaaagtgtaaagatgacatatatatagtgagcattcttaaaactgattatcattgatgtccatctattaattaggctgccttacaaaggaacggattttctatcactggaggcactgtatatttttataacttgttcccaaacttatgattttacagaccagtaaaatttctgttcttttatttaagaaaattaagatatctgatgctaaggaacagttaaaattttcactgatttctgagagatggcaaaatgctagtaaacaacacctcttcaaaaacaataggattctacttccttcacttctgaatgtttctgaaatcgaagatgcggcagaaccatcaattccaggttcaccttgccggcaaccctgcgtaatagacttagcgtagctacaattggttgtgcctacgcaaaaatagccaactggggaaagttatttggactggtaacactagaaactatttaaattttaacacgagtgtcacaccactttgtttaaatgtgttcaaacagaagacacaatgtggcaccgaaatgcagcaattgtgtggaggcaatcaagtatcacagggcagataatgaattcaataaaggcagctgaaattgccaaatcttcaaaaggtagaaacagatcgtgtgaagagtatcactcatgtatctaaatatctttatggtgaaagcttcctactttaagagtagctgttcaacacttagtgatatgtgattaagaggtaattaagaagttaagaaggccaggctcatggctcacacctgtaatcccagcactttgggagggtgaagcgggtaggtcacaaggtcaacagatcatgaccatcctggccaacatgatgaaacccgtctgtactaaaaatacaaaaattagctggacctggtgacacccatctgtagtcccagctacttgggaggctgaggcaagggaatcgcttgaacccgggaggcagaggatgcagtgagcccaaattgcgccactgcactccagcctggtgacagagtgagactgtctcaaaaaaagttaagacaacctcaaatttaaataaagaaatgtatttttagaatatattattcagactattctgactaatgggagatcttcataggtaatactcagcaacactcgttaataggcatctctccatttgaaagactgcaaaacgctgaattctgttgtttagtgcactgaattttaatcatttaaaaattgtgatgtctttaaatcaggcatgccatctccagttctcagtggctccactactttccaatatttgacctccagtatcatgctttaaaataccggcctggcacttgtggacatttgtgctaatggcccttggtttccatttataccactgccataacaatgacaaaattgtcgagggtgagtatttgtttgcacattctgtcctattttcctaaataatatattttttaaatcctcatttaagtgctttccatattttcccaccatttgaatcccccagaccccacctctacctggtgacattcaagataatcgtagcagagcagctttagctgtcaagaagtctgtcctttgctaagaggtggtaaggatggttaattattctgatcaagtctattcggtctgtgccaagaagaaaactatgtttctggaggtaggatggaagcaaagtcactagatttccttccttctccttttcatattccttacaagttgctgagtaagtatattttatttggaagcattttgataaattcaattaaacctgctgccaggctgtaagaatttttctgtgtgtagtttgtgggcagaacatcatcaatcagttttctccaccatttttggtttctagactattcctgtagttaaataaaaagtatatttactatattctcaaattattttctttctgctctttttcttaataacttacctacttactgacacgtgattggggacagacaatattttacatttctacaaagcattttatctcatttttctatttctaaaatgaaaatttgagtaaagatgtacatccttaaattctgtacacagaaaatatactaaaatgaatcaacttaataatcaattaaagaaattttttatttaaaaatggataagaatgtgtttgaaatatatggttcagtcttaaactaaacacaaagcagttctcctaactaaacagctgttttaaatctatagctcttctgctccagcatcctaacagctggaggaaattagagtccagagagacatgtgcataatttgaattaaacagatgcgggctgtgaagacaatcaaacaacacagggtaagagatgcaaacaatattactgaaactccaaggagtttttattttttattttcataatgatggcaaatgtggccatagttgtgatacaaactacctacccatcctagtaaaaagtcgtgactttttttcaaaagtgcaaaaggaaacatgccaaattctaaatcaaagccaggacagggccatctctgtatttttccatttatagcactcttgatgccacgcgttgactgtgagctaggggtcgctgcctttcctgcccccggcagccgggcatcccctgaggggatctgcatcctgcaaaacatgccaggccactcacaccatcacatgctggcagctgtgggggcagaagactgaggaagagtgagagatgaccagaagctgaagggagacatatgtaaagtagaaaaggagtaacttaaatgtcattttctgattcaaaatatgagtgacctgctttaatgagcaaaaccctgcatttaaagccacaagtagttcaagcactgagggccagatggtaccctttgaaattaaagcgctctcaaatggaacatagcagggaacctccctgtgcccgactgtgtaacaacacttctcccagataatgtccgttaacgtttatggctttcggtttctagctcagttcatgaacgtgtttacgggtcttctgttgagaaatcaagagttagtgtccacgtggcaggttttccaagacctaagtgtgaacgtgatcatcacatttcttccacctcttcaccttcatagtagacttttcaatactccatgaactcttgattactgatatgaagcacaataaatatagacaagcatttggaaaacagcctgagggttctgtaaatagctaaacattttaccacatgacccggcaattctactctaggtatacgcccaagagcagtaaaaacataggcctatacaaaagcctgcacacaaatattcatggtagcatcattcacgatactcaacaagtagaaacaacccaaatgtccatcaactcattagtggataaataaaatatggtacatacatacaatggaatattatttggcaataaaaatgaagtgcagattcatgctatgacatagatgaaacttgaaaacattgtactaagtgaaagaaggcaatcacaaaaagatatatattgtgtaattccatttatatgaaatgtccacaatagacaaatccacagaaagtaaattaatggttgccaggaactgagaaaagggaatgactgctactgagtatgaggttttcttttggggttgatgaaagtgttctgaaattgattgtggtggtggagtgaaaacgctcccaagatactaaaaaccatagaatggtatgcttaaatgggtgaagtgcatagcatgtggactgcatatcaacaaagttgaggccagcactcaaagagattgcagaacaagaattggagtgttcctggagcttcagatgtaggctccacgaaaaagtgatgaagagagagggacagacagtgtgtgtgtgtgtgtgtgtgtgtgtgtgtgtgtgtatgcgtgtgtgttgaggggggggatggctggaacctgtggaaaacacccattaggagggcagatggacccagtggctgatggtgtgcacggttcctgcacactcatgaaggaatccaagcacacccagggcactcctgcctgcaccaggggagctgcagggagggctcctgtcagcagaccactgcagcccccaaaagccccttctcaggaggaggggagggagaagccagctagaatcatctgcgagggtgtggggcaccaggacaaggacccaccctgtacccagtcccaccccccaaccctggaggtgtcacaaactgggaagcaggcacaagggaacatacaggtaggcaaggcaaagaaccagagacaaagcccattccttccttaggctccaggaaaagcaggtgcaagcaggggcggcaggggtgggagggg

SEQ ID NO: 853 - DNA, 242847 bp, Homo sapiens
aactagcacagaagagaccagtatgacatctattaattattccaataagaggtggtgaccacctgaagtggaaatggggaggcagggtctggtgtcaggggtaaaggacagttcaaagttgaaggcaacagggccaggactccagggcatctctatctctgaaatctactctgataagtgctgtggacaaaaatcaagcagagcggtgggatggcgggttataagagggtgggcagagaaaccatcttagaggagacggcttagagctgagatttaaaggaatgaacgccttccaggcagaaagaacagaatgtacaaaggtcctgatgcaggagctcagtaacgatactgagtgaacagtctagaagctcatttggccacagcaccgtggccattgtcggggcagcagaacatgtgcttggagagatggccacaatcacatcaggacagtcccatgggcacagtggacttagggttttactgtgaatgtgatgggcaggcagatggtttgtgtctgaaaaatgttagaaggatcactctggctgctgtgtgagaatcagctgagaacattctagacattgaagactgataggaataggactgggcaggaggctgctgcctggaggcaccatgagggatgatggtgtttgaacaagagaatagaagtgagggatctgtgaagtgatcggattcaaggtctagctggaggtagcgtcagcaacgctgctgatggattagatgggggcctgtataagaaagacaggagtcagataggacttgaagatatttgtccttagcaactgagagagcagtggtgctgtgctctggggtaatggtctcttcagggaagggcaggtttggcaggaagtatttagagttctatttgggacatgtaatatttgagatgctagttccccatcctactatccaatgggtagctgaatatacaaggatggagaaagggagagaaatagggctggaaatatcaattttgtagtcatccatgtataatatcacagaaagccatgggcacgaatgacaataatttaaaaggtataataatagagaagagttttaaaatgagatatgggtgctcagttcttgggttgctgggaagatgaggaagagtcgtcagggcagccaaagagaagtggcccatgtggccggtgtgcattcggcggactctgatgtcccagaagtcatgaaagaaaatgaccatgtcatttggggatgtgaggattcttggagtcgttttgaagagtggtaggaggaaatgacaggctagagtgggaggtgagcatggagagatgctgagcctagatattttttgaggcatttttagtagaaaaagaaagagagaatttgggtagtagatggtaagtgtgaagaaatatggaaggttatttacgaaataatgtaacttgggagatgctacaacaagattctgtctgatacgaatgaattacccagtatacgtcctcttattaaatatttacaaaactctatatggtaggtgttatcactattttagggatgagaaaatggatttgcaagggagacacatggtccaagacagcatgggaactggtggagctgagaaggaattccagctcaactgaacactacagtggaagcttgagtacatatacaatgtcaccaccagagtacatttacaatgtcaataaaatcattttttaactcacatctgggaagcaagatagcaccagactttgggttaaaggaaaaatctccaaatctcttattagttgaaaaaccttgctttcctttgttttgtttgtttatttggttgtttgcttgttttataagttactgatggaagagaacatcaaatattcgccagatacatgtgcagaacatttcagagctagggaggtggccaggagaagtttcagaagggagagtgaagtgaatgggcccagacacttcaaggacatggaatttatttaactagaatgtctgagtaggaataaatgaaggcagaagaaagttgaaaaattttggatgatctagttaaaggctttgaagcaaagagtgaggatttggacctgcttctctttagagtgaaagctactctgagatcaaagccataggtgaaaagaaaggttgacagcagcatggagaattgattggaaaaaggttttgatggaggcagagagtgccaaaaagaaagagtggatgtcagctcattcttctggtaagtaattacaataatgaccctatgctagcactgttgaaaactaaagattagagtccattattacaatagagctatttttacacgagaaaaaatcccaaggtttaatcgaaactgttcatactgaaactatgacaagccaattgttcctagtacttttaataagaaatatacatgttataacaaaacctatcactacaactgggaataacacagagcatcccaccttactgatggcatatcagtagcatcaccttttacataaagaaattctgtctaattcacaaaatatactatttttagggaataataaaatattagttttgttgttgttgtttggcttttacagactgggtcttcccctgtctcccaggctggagtgcagtggcctgatcatagctcactgtagtctctaacccctaggctcaagagatcttcctgtctcagcctcccaaagtgctgagattacaggtttgagccaccaggactagctaaaacaccgcgattaaaggcacagaaaacatttttacttttattcccgattagttgtcctaactgaaattttaaaagaagtcattgaatatggaatctgagaaattagaacaacagtaaattagatcctagctcttcagtgggttggaaggtgcatacttcattcacctattaagctgacatttatttatacctacagactgactgaggcaacagaaagagaaaaagtgctttttgataatacactgaggctcaaaattttaaatcagagttgaaatcatcacttcacaaagtctgctggagtgctgaggccatctgtctccttgccctgactcttgtctccacgtcagtgacagtgtgtgtagctgactgtggatctgcagatgagagggtctttgcaatgggctggtcagagaaggtagaaggtgaaaggtgaaaggtgaaaggctgaaggaatgggggaggggaggggccattttcagtctccttttctgacattactgatcatttctgatcacaaaagtaagggactccttgggattgcaaaccactttatttaaagaacaaaataaaagtcatattaggatgaactaagtaatatatttacattctacaaaagcgctcaaaatacagtctttattcaaaagcccaagtcagatggattttctcactgaagccttgctgagtccctcaactggagttcaccctcagccctgagtcccccagaatacattgtacatatattttaggaaagaaacatgttctactttctaaatttctgttaaaacataatgtatttatgtatatataaatatatataaataaatatatttttataaattgtagataatctacagaatttctataatatagaaattgtataggtataattttatatatattgtgtgttcatatatacatgcatatctcacacaggaacaggaaaaggaacatccaggaaaaacttcttcccctttagtaggattcacttaaggagaactcaacgatttgatgcatttcagctgtttgaatataacttagctactcagtaatacatatgcaagtattttaattctttttgaatcagcccaagtaagccttaggttctgaattctgccttgtgtaaatgtcacctcatttatttactaggtgcaaataatacactgctaagcgatatgtgttggcttccaagccatcagttatgggtttaaatttggaatctagaatttaccaggtatgtaatttggagtaagttaatttaatttcctaggcataagttgcctcatttcttaaaatggggtctatgcctccttggattgttgagaaaatgacatgggatgatatttggcaagtgttcattaaatggtagcctttgttttcagcatcatcactgtgatcagctgaattgctgattttcactttaactacaggaaacttgagtggaaaagtctgagtcatttatgtactcattacttcagcggatcaattccaagtaacaaagctagggcctctgcttattgtttattgtcagttgcctgaaagggaaatgtagaggaggccacttcatgtaacaacacagataactccaaaataaaggaattttatttatttatccacatttattaaaatatttactttgtaagtataaaaatatttaaaaataattaaatataattttatttatgaagtgggcagatgtataaagaggaatgtgtgaaaatgtatagaaaaaggatttatcttataagtacctcatttttaatgagactctaaaagaaacactcaatctattctaagaaaaatatagtaacatgactatcaaagaatcatttattaaaagccttcagcttcaagtgggttactttttaaaataaatgattttatttccaattaatttggaggtctggctgggaatataaaagaatattattgtgttgcacaggcttagaaatcaaacaagtctggactgaaatcatgacttgctatttaccagctactcaaactttcttggggtcagtgtccttatttataaaatggaggcaatattagtatatatttaagcaaatgtctgtagagattacaggaagcaggtgaggtacctaaaactacctgagacacctagttcttcactttaagggttatctgctttgctaatttctctcacactataagcagctagaaaaatagagaaacaactgttttctgactgtctcagtctgttttgtgctgctataacagaactcctgacactgggtaaattaggaacagaaatgtattggctcacagctctggggactgggaggtccagtatcaaggtgctggcatctggcaaggtctttgtgttgtgtcatgacatagtgaaatgcatcacatggcagaatggcaagagagagcaaagggggctgaacttgccctttcataatgggtccactcctgagataacaaacttactctaggacatgaatccactcatgagggcagagccccgatggcttatcgcctcttaaaggtcccatctcttcacactgttacaatggcaattaaatttcaacatgagttttggaagggacaaacattcaaaccatagtggatatatagaagttatatatataaaatacatatgattggactgaggtaatgcgggactgtgatcccgacgtgaaggaaacctacaaagatttggccttgttagctatagcagaggaagggagacaccaaacaaagcctagaagtctcggtgaactggggaaccacaaatcgaagtttagggaggttaaggaaactagaattttcaggacacaatacctaaaagaagtgacttgcacagagagagttctggaaatttgcggatagactaccttgaatctctggctgaatattatttttccgtacatgcatggggttaacaattctcaaagctcacacggaggtgggatattttgcattcccaccagacagagtggagagaccttatggtacttgaggcatctggtagagttgccagaagactactgtcatcatggtggggctaaattacccatagcattatggctcttctggatgccccagcaaagcataaaagcaagtctcaaaaggaattgatgtcgactagctcaactgttgcctgcataaagacaaactttttttaaacagaatgctacaaaatccaccacctaatgtacaatgtctggaatctagtaaatcactatgaatcgtgcaaagaaacataaaaataggaaccacaaccaggagaaaaatcaatcaattaaaaaagatccagaaatgacagagataatgaaattcatagtcaagaatatttagctactattacaaacatgctccatatgtccaaggaagtagagggaaagaggatcatgatgaggagaaaagtgagtgttgaaagtctcaaatgtaatatatggagagaaaaaaataccatattttcaataaagatacactagagagattaacaattgattagataatgcagaagggaaaaaggcagtgaatgtgaagaaatagcaagagaacccattcataactcatctcaccaagaaaatagggccagagtatcagtgacctatgaagcaataccaagtggtccaacacaggagaaattggtgctgcccatccaagcaaggaaataacaaggggagataaagcaaagcttgagaatttttagaagttggaaggtaactaagagaaagcaagagtgggggctaagaatgatggaagacatgatcgatgccttcagtccttccttgatacccagagatgggccattacctccttaaaaagaagtttaaagtaatgaaactcaatttgacacaatactgaaaaatggagttgtattcatgcatatattgtacattttgctgtcactattttaggggatggtggcagaaaccaaaggaggctcttaatgcctttggcatcaacaatggtgtttccttggcatctacactaacacgccttaattaacctatcaccatcttaagtccttgtagattaaaattgggtgaaaatttttagaataagtatctacaaaaatataaagccttcccttgaagagcggacaactgtggaaatatacaaagaatggaaaaatccactaacaagtgacgtgacacagaaagacgaatacaggcacagggaagagacaatttgaacagaggcttatgaggacgtcgggtgtgggaagggcccactgcagggtaaagagaatcagcatggcagtatgatggaaacacacccatagcactctccacagcatcacagtcatctccatgtatgggccatggtggtcagtttgcctaaaactagcactgggaatgacagcttgttctcagcttagctgtggactcacactgagagattaggtttcataaagcagaaacgtacatcagcctcagaggacatgagtaaaaagtataaaaacagacccgcacctatacataggaataaaatgaagtatctgtaggtaccagttgatctgaaatggcccactccaacgaacagaaggtgcctgcctgcaagcctactttgagttgttttaaacattatgaacctgacagagcgagactccatctcaaaaaaaaaaaaaaattatgaacctgccaggatactgaataaatgctacttagtacaaatgtccaaatataggaaagtccattatatttttggaaacttaatgtcaccaatgacttcatttattaaaaaggcactctgcatgtgagataaagttgggtatttgaatgattttaagtcactaaatagttctgtgaaaacagttcagcagaattagctattagaataaaagcattgtccttgataatatgattctgaacattcaattggggattgcattatgattcagttttcgcactctaaaatccaacttcccttttagtttcctgtttaaaattataatttctaagactaagagccacaattgcccttctagccttttgcttttcatgataatttagaaaaaaaagaaattgagaaacatatggcaggtaatcatttgcaaacacacgactctttcaatgcctgccatgttcaacttcattttatagcatctatcttggcaatataaattgtgtttggctgcagaggtatgcagtgcagtacaatgaagaaaagcaatcgtgacaactgaaaaataaacaacaaatgtgtgtttgtgagggagagaatgtgtgtgtgtatatgtgtgtgtggtttagacggcaccagctctctgcttttccggctttcttccaaaggggaatggtgttattttcgttggtttccttgttcccttttacagcaaagcaatgccactggaggaaagacaattgccacatctcagagggttgccaaatgacctcaaaccagttcaaaaggagcgccctcaccagttccacaaatgaaagcaatttaatgcaggtggattgggtcaggaatatttactattataaaggccatgttttttgaaacaagagcctacattatattaatttttaaaagtggtagcacaggaagactgtaagattatttatgatggccgggtgcagtggctcacgcctgtaatcccagctctttgggaggccgaggcgggcagatcacaacatcaggagatcgagaccatcctggctaacacggtgaaaccccgtctctactaaaaaacacacaaaaagtagccaggcgttgtggcgggcgcttatagtcccagctacttcggaggctgaggcaggagaatggcgtgaacccgggaggcggagcttgcagtgagccgagatcgcgccactgcactccagcctgggcgacagagtgagaccctgtcaccaaaataaataaataaataaataaaaataaaaataaaaaagattatttatgatatagtgactattcagaatgaaacatgctagcatactcacgtttttgtaaactttgactttcatgcaacttccccaaaattctctcaaaagtaagttttctgggtttttaataaaaattatcaaaagtatctaagattcaaaactttgaaagtatataactaagccttcaaaatcaaatcaaatttacctaatgctttatttttcaatgggttttgataaaccaagttaaatatatttggaatacttcaactgtgcaatctacagtttaatgtattcagagacattctagctcaaataagtgcagtcacttgtcttactgttcaattaacattcaaattaaccatttaaatttcaacatattttgctttattgattatgtattttaagacaacataaaaatgaaagaaaacatgcttgatttggaggcaatacatgcaaattacccatggcagtcaatattggtaatagagaaacttaaaaagcatccagttgatttcaaataaatgtagaatactgctatatagtatactttgcataagtggtatatactgttgggaagtagggggagcaaaagaagcttatgtacatggagttaacacacacgaagagcaggtataaagaaatagctgcccattgtcccatttgatggaagtagcctttttccctagagaagaagcattaaaggagagtcagtctaaccaggattatttgtgtgttatctgttctgaaaatagcgcactcaggcaagatgatcaccaaaacctttccataaatatagtctgcaatgcaccattgtaagctgtcccgtttactattttgactcatattaaatgccaagagtatgtaaacacatgatcacttatattaatatccatgcataagctgcttaaaagattttagttcacaaaactcagatacgaaactgcaataagtctgaaaagcagtaaggcaggagagaaggagagtagccaattaagaaatggatagaaaaaaaatgaaaatgcatagtgagaaggggtattatactggctaaatgtacaaccccaggtcatggggttacctgcaccagagaattccagatgctagccctggctcatgcagcacagatggcagcccagtggtgaagagcctgcatccggcagtcagacttcctggctccacatcctgtctctgccaggtacttgatgtatggctttggtcaagtaagttaaactctctctgcctcagtttcctcatttgaataatggagatgagcatcgttcctccattataggcttgttatggagactaaagcagttaatgatcataaaggtcttagaactgtggtgggaacatagtaagcgctatgtgtctcctagccgaatgaccatcctgaccccctggattttttatttatgcaataaagataacaacacagacctcaaaaggcacttataatcaaattatttgagttaatatttgtacagcattgcccacagtgaccaaaatagagtaaacaaacagtaaacagtaacagaatcagtattgctttagtgaagaaacagctaagatttaataaacacctaccatgctgagcactttacattattaattcattttatccgctaacaaccatgtttgaggtagattttatcatcatctctactacaaagatgggaaattggaaacaggtaaataataatgataaatactactagtctgaggaaagctactagaattgaataaaaaattacttataaaccaaggcaatcaacctaattaattagcctttggactttttctcagttaattcccaattttgtgactgaattggtcaagatgatttgcagtgttggcacgtaatacatggccaattgttctaggagatgttctttatttatttatacatgtgagaattactgaacaccttggcagaggccactagctagttgtcttggtgatacatatttttctccttcttccttgttgagtaatgagatatttaaggtggtaaaatggccacccacaacactagatttccaagtctcccttgcagctagaagtatcattgactaatttctggctaatgaaatgttggcagaaggttaaaattattccttaaatgcaaagaatgaagctggctggtacgagtctttatcagcaattctcctttcttcttcttgcttgcactatggacttgatggctgatgtgccatagaatgtcttggaccaagaggtgaccttgggaaaatagccatgcactataagggcaatgaggcagagatcctggttctcagtggtgatacatggcggctttagactacctatgaccagacttctactacagagaaaaatgtacacttctgtcagctttaaaatcactggaatttttggactttgttcctagcaggtgaatacaattcatgctgatatgagcagccatatgaactgaacatcaagggcaaacaagatacatttgaagaaaataagaatgcaaataattaaatgcaataaagcattgcacatattaggtaataaatagcacagggtataatgagattgcccaggagaaaagtgtttattctgtctgcatgggtttcttagaggtgatgaagcttgaattgagtcttgaaaaatgagaaggcatttgattcaagaagacaggagtgaagcgacgggctgcagccattccaggcacagagaactcatggggaaaaagtcacagagagatatgagtaattagatatttctgaatcaaactgttattagtcattagggtcaaaaatatataatttcatacagaacggatggcatatttgattgaataagacattataaaaattatctggctcatttaaagaaatctacatattcttctccatgtaatatgcttaaaagtggttgacacttaagaaggcaaagaaaggggctggtgatgcggcttgctatcacaggctctctctcaaaatgtaggtgctcactaccccagcttgaccctgttaccgcgcacacttggttgaggttaacaaagcgcacttggagagaactttaaaggcaacctttagaaaagcacaaatctccaataaattaatattctcccatcatgataaaaacacataaaatatgcaagatggattttaatattcatgactcacatctttcaaaagattggtgagatatcaaatgtgatacgataacaaaaaagcactttgtagaggtgctcaaagtactttcagcattaatgaattcttataatacccttgtaagaaagaatggaggcagagattattcaccataacttacagatgagatcgaggtggaaggatgctgtcagaagatcagctggtgtaggtttatggtgctccgagccttcctgggagctggcttccctacaatgtctgcagtaggtgcacacgaactgtaggacctatggtcacaggcccacccccaggtcaacctttggttgtagcttcaccactgcagagggggcataatgacagcttacatagttgatttcaggaacttttggtagttctaattgactgctgagaattgcaccaatttttagcttggcatgagcaaaaagcaaacagcttgcttgggttgctaaccctgactgtaaagcttcggcacagtggaaagtctcacactgacaggccttggtgagagaaccacatttgctccttatctagtaacatttaaggctacggtggagtgaaacgacgaggatgaacgtaaaaggcctagtacattaagggatgaggagcatagcaccaactcatcatttttagttcccagaacttaatcaaggattcaggctttcacacagaactcccattggtcatttctttttaatcactaattataagagagatcacagattaaatttccaaagaggaaaaatccctgatgacttcctgtagtcaaggtattcacttcaacgcaatttattacggaaattgaactcttctgatgatgatgggtaaaaataaccttcaatttcccttttaggtgtgtagacatacaagcaatccccacttttctcagctttgaattttgttgctctcagggtttagctgtttaataaagacctggatgtcaacagttcgtaccagtgttcaaacagataaagacaatacattcagaataaggatatgtagaataaaacacagggatttccccaaatggtgatttgggtggtctggggaaattgttcttttcctgtaagtaaggaccatctcattattttgtgctaagcataatgtcaggcccactgtgcctgggaatatttacacattggggggaattattgttgctagtggagagtcttgcctgcaagttgtccaggttcttggtattttgaacaaagaattagacaaatgcacagcaaagcaaggaacaaatgaagcaaagaaagcagagatttattgaaagcaaaagtacactccacagtgtgggagtgggtgaagcagcagctcaagggccccagataacagaatctttttgggtccaaatacccccagaggtttcccattggccacttggtggacatctcatgtaaatacagtgttggcccgcaatcagcatccaggtcagcttggctgcagaaagcaaccaatcaggctgaagtgaagttacaaaggtcatactcctaaacaaacatctgatgggcggcgaaaagcaaccaatcagaggctaaagttacaaagttgcacttctatgcaaatgaagacttggcctgtaatcagtctgactggttgcagacagcaccaatcagaggctgaagtgaagatacaaagtgacactactatgcaaacgtactttcaatttcccatctgccacacagaaaaggttggggtttgcaaagggagtagcctatggtccttttgttactcaggtgtggaatgttggggtttttgtttcaatttagttctaggaagtcagtgtgaaacggccttaggatccctgcctccagaccctattctcccaactgattatctctttttctatatagcacccacgtagccatccagcaaacatatgctaaagatagtagactagagatggacagtctggcccatgacgatgtcattgaacaatttagttatccaactccaaagcctctctacctctgaactcagtttataatcttttgcatttttgggggtaatatccaggtttgttcaagtgtgctgtaaattttatgttaacaaaacctaccttccctttggaaatcatgtaagaaaactaaaaataaatgtttagtaaatatatatatatatcgatagatagatagatatactaaacatatatatatacgtatgtatatatacacattatatatatataaattttttttttctgagaccgtcttgctcagtcacgcaagcaggaatgcagttgcaccatctcagctcactgcaagttccacctcccaggttcaagtgattctcccatctcagcctcccaagtagctgggactacaggcatgcaccatcatgcctggctaatttttgtgtttttagtagatacgaggtttcaccatgttggccaggttggtctcgaactcctgacctcaggtgatccgcccaccttggcctcccaaagtgctggggttacaggtgtgccaccacacctggcctacattctttttattcctcctgggctcaagtgattctcttgactcagcctcccgagtagctgagattacaggcatgggccaccacttctggctaatttctgtatttttagtagagacagggtttcacagtattggtcaggctggtttcaaactcctgacctcaggtgatccaccggcctcggcctcccaaagtgctgggattacaggcctgagctaccgtgcccggcctttttttattttgtctaaaaagatgcagggctgggtccggtagctcaggcctgtaatcccagcactttgggaggctgaggtgggaggatcacttgaggccaggagttcaagacaaggctggccaatatggtgaaacctcatctctactaaaaacacaaaaattacccactggcgtggtggcatatgcctgtagtcccaactactagggaggctaaggtgggagaatcatttgaacctgggaggtggaggctgcagtgagccaagattgtgccactgtattcaaccctgggtgacagaggaagactctgtctcagaaaaaaaaaaaaaaaaaaaaaaaagatacaggatcataccacgtctatgttggctacttccaatctctttctttagttgattttgtattgatgttgcaacctcaagggaacaaacacaggacattctcatgacatctgacacaggaaagggattagcaatgaatgtgacaatgtgaatatcatcttaaagcagatccagcctagtgagttcttctcagcattctggacaccctactaaatatgatttcatgataccttacagatttatattttttctttataaaatagaaagtaaactttttaagactgaatggacttttcattttaaggtgcagttagtatataaaggtaagggaagggtacttccaaacacaattttaaagtcatactcttaaaaacgatattagcaataaccaaagagatcatttgtgaacatctcgtatacagctatgataaattgacactcacagaggcattacagggttataattttaaccacaaaacattcaatcaaggtaattatattctacttgtccacagaaataacttatcaataaagaagtaatgtagacagtcatgaacagcataaaagagaattccaaggagacaaaaattacgcaatatttctatgcgaaaaaattacccagagatgtcctcagccccaagtcgacaaccagcatggaggaccctataatgacctgtctcagtcagctacatcagggcaccatagttctggtaacatcactgcttaacataatccagttgactagccttgtagattctgtgcctataaaacaaccattggataacaattgagctatccaaaaaaatttatctataagtagagaatgtgctgatgagtaaacattagtatcttctccctttgttagttttggttcttattctactttaaccaaccagtattccaccttttaaacagagttatctgatgagtttgaccctcgtgattcagctctgcaaaggctgatgacttctgaattcaccagcgtttgggtttccacgcctaagagcttgaaaaaaaaagactttagaacatggggaccattctgtcaccagtgagaaaactaaactatcaagattaagtcatggagattttgaggtccctgtcacagcagcataacttgtagcctaattcacatatactacctcattcaatccttaaaaggtcctatgcaggtagcacaaaaacaaaaaaatagtaaagtccaaggtgatataagccagattgaaacaaacaaacaaacaaacaaacagtgaccacatatttaaaatgtggaaaaaagcctaaaataaaggaataacatctaagcaaaggcctgaaagaaaaccataatatgaaatatatttttagtcttccctgcaaagagccaaagagctttgggcagtagaattctgagatgggccagcagtcaggaaattaggaagttctcagatacaagacaaaaagttcaaggatgggtagaaattgaaagggaaagaaaagttataataaagcctccttttatactttctgacaagacaaaaattgacattcttttttagacaattgcaggttcaagtgtgtttacaagtatggttgctcatatgtgtggccagggtgggggtacttacgggacaaacagattcttctcattcattcatacttaagatatggatttcttggcacaaatagggtagtgagaagtgaaatattactacaaccctgtgtctgcgtctgaccatttctgcggctgtcaccatctcccagtaggacaattcattgttactttgcaccttcaaggtcgtattagagaagaggcaatagccaggaaggctagctaggccttaaaatattgatttattttatttataaaataaaatataagactttactttcttttttcttcataatttttttaagacagggtctcactctgtcacccaggctggagtgcagtggcacaatctctgctcattgcaatctctgcctccctggttcaagtgattctcatgcctcgccctccctagtagctgggactacaggtgtgcactaccacacccagttaagttttgcatttttagtagagacagattgcactgtgttcgccaggctggtctcaaattcctgacctcaaatgatccgcctcttccagcctcccaaagtgcagggattataggcacgaaccaccatgcccagccaagactgtacatttttcaaagtaaaatcaagtcaagatggaaaccaggaaggttgccatcctgtactgttaagagcaaaatgaaggtcttgaggccaaaaagtgagtgcagacactctaagactccaaagtctccagggtctggtagtttcactatcaggggccagaaatgcagaaataacccgatccttgggctaggaatgcgcaactgtctagtgccatggtgagggactgcagccgtcagtgtcactaacgtggaagggcgaaggcagtcaagagacggaaagagggtcttcaggaaatgatactgatgaagcaagaacagggggccaggattctagaggtgcagcaggatccaagtttcctgataaataaacccccatgaatgaatgttttgtcttggaaagcactgtatggtataaagactctacattcctgcattttgtcacaggcctctaaatccccaacctagagcacctggacagatctcacttcttcacatgcagattcctgaattcagtaaaaaagccaataggaatttaatgacctcatttcgtagtaatattcccaataccaaacacatccactaccatcgccgtgtctttttaagaaaataaatatgtgagtaaatacagaaacagatggatattttaaaaatacctgacggacaacaacagtgaaaaggatcggtcacagcaataacttaagtgtgggctaatctgtaatggacatatgtatcctaagaagacagtggcaaaatgtttctgatgtgaatttaaagtgtctgagtttgggggccttctctgtttctgctcctgatttatatgctgtctccagagcatgagggtacaaatgatttcttgagggcagaatcttcctctgctcccgcacacaaggctttgttaccgcagggctgctctagagcacagagcccctggcaggattcgtctcaggtgaaaagaacatcaaagctgttactttgaaaaagacgcactccagaaaacgcagcacagtatggattttgcaacagatctcacaccggggaaaaataaatccagctcaattatatttgggtcctgcctttacaaaggctcattaacctctaaatcattcaaaagatgtaaaggaagagcaaaacgaactacagctttccctgccagcttttttcaaggtgaaatattcttggtgtttgggtacctggaaaggaagaaatgtttaaggaactctggttctctgatattgacacagacaggaaattggatgtatttatctattttaaggaaactgtccagtgttatttattctcccccaccaccccacatcctatgaggtgagtcaagcaattattgaacctcaattcatggtcgttgaatactatgaaaaaatgctcaaatgtcacctgagactgtgggctatataatacaattgagtttctaataaaagtaaaagagaaattggcaaagcataggaaagccactagtgaagatctatatgaggcaataaagacagcagggacgatcctaaattaagaagagaaaaaagggaagaaaatcagaggccgtccacaatactgaagaatgtaagaactgaagatgattcagcagatgacctgaaatttcctctgtcttgaattttcaagaaacagaatgtgctctccacactcgtaagtgggtcagagggtgttcccactgcatggatgggcaagctggctggccgagagtttgtctcaaggtttggctccatcagacaaacaggtgcaccagcatttccctccaccattcccaagggcaccttcttagaaaatgaaatttcatgctcagtcaaactttagaaacatatgatttaaacatatgccagtctctttctacatatttgcagcttcgcaattcttcacctcccagtccctttcttaaaatagcttgtggttgaagctaaaatgtttagttgaatagtcatcttttcctcttcttatctagcctatagaaatctctcatgaggaaactgagcagccacaagaaaactgagttagtgacgatttataatgtgatattttgatgcctgagactattttcagaattacaagaaaattttccttttccaaacacacagtcttccagaaaaaaatctaccatggaccataaccaatgaacactggctgattcacgtcttgccagtcccactttaagaaaaagaaagagagacagggtatgtgaaaaagttataaagataaaaatatcttcggaggacataaggtaataatcaatttttttattcacatagggtaagaaatcttttctataaggtgaaaagtgtaagagacataaactgcccagagttacaggataattaatttacactgattattttactaaaacacaaacatagaaagtgcttgtgaaaaacattatttagcaaaaaaaatcaaataattataatgctttatgtacccttaaattagcagcaatccattacaaacaacagattttatattaagggtcccacatgagcttctaataacaaaggtcactttttactaagacataacttgtggctgctcaacagtagaattggaaagaaaggctcttctctgattttaccttcccaaactgatgcatgccaatgaaataaaacgttatcctgccaaatgcaagcaaccctgggggagcttttcattgattaagtaaggtcttattgtgattggctcacatcgtttcctagtatttcacaatgtgtgtctcccaaattttccaaatccttcctaattttcatccaaagtcacctcaagcttctagaaccagtggaactactgttctccatgacacccttcctgaatagcctacctcaagctcaccaggcccactcagccacatcataacttccatctaactggcccgctatcatttctctataggtaagccctatctcctcaatcaaggtcattgaaattaagtgaaaatgattgaaatgaccaaggcatcaggaacagtagtttacagttcttccacatgcatactgcaggaacacaatataaatttcatgataacaagtgatcctcttgggaggaaggaagacttggtatctgccaggaatatgagtggtatcagccccagaagaataacaaggtgacggtgaggacacacaagaccaatttcccaatattgtcaaggagagtgtggtctacaaatgaatagaaagcagcattttaaaaatgatatagactcaactaggaaatatcagattgtatctcatagaaagagtaaattgtttgctgaaatctttgtttcagctacatatatgtgtgtgctggatcatgatgtgaaatctatttcttactctgggacaaggtcagagaggtttaaaatgcactgctttaatttgtctcaaaatgtgttccacaaaaaagcagttccaccaatgtgacctgcagaaaagggctccaaagtcgatgatgttcaaaaatagtagattaaaccaaattaaacagatattttaaatgcctgaattaccagggcttttaaaacgttaatatgatcacaagtgttcaaggctagaaaatagtattgatgcaggatattttcttgaccccttcacaggacctgtgacagagctgtcccgtttactcagcccaccatgctaaacccctcacaggagggagcgtgcaagtgagtgcaggaacaagcctgctccttcggcaccagcaggaacaaactccaattactcacttgggcctgctgtggcgcaccccttgcgggaaggaacgtgtagggaagtgagtgcaagaaatggtcagctgctttagccccagcaggagcaaatcatgtgtaggccctgtggcagcatccaggtggggctgactgtgacccaaaggcctcagagggcatgttacaatgctctcttaggtctgctgtcagcagacaacagtgtgttatcagttcagcgggccctttgcctcatggagtgcagtggcttccctctgccagtgagggcaaaggggcattataacagccttttggggtacccgcacttgttgggtcctgaattcttgtctggtacactggaagaataaggttacctagacaaatggaaggatgattaatgcggacaattttattgagtgatgaaagaggccctcagcagagggggagctggaaaggggatgggaggggaaggtcactgtcccccgaagtcaggttgtctctcttcctttctcctccgaggccaggttgcctctctatgacattcagcagtggctcagaagccaattcacctctccccaatgtccagccatttcccctctctaccagctgagcctggggtctttataggcacaggatgggggtgaggcgagccataagtagtttggaaagggcagcattcaattggtaaaaagacattattcagaaagaagtactcgggagagagcgggtaagcaggggtagaagctctcactttgggccatgggttcaggctttttggcttaaaggtggggctttgccagggacctgccttgtctgccaagagtttctctgcctcctgtctccatcagcataaagctcattctaactatatggccatgaaacctagggcaggtcgaggaactagcctctctcccaccacactctgaaaaacagtggtcaaagccagtgctgctgaagacacccgcatcgcctctgcatttcctgtctgatttcccctctgacatatgaccgccctgcacagcaaagcccattctagattacaggggagtgctcagtaagcaagaaaaacactgagaacatctgggagaaaaaaataataagaaaatgcctgaaaatttggtttcatgttataaggaatggaaaattcatttcaattcagtccccaaatctaatataggtttctcaggggaccatttgtgaagtagatgtgttacaataaaaaatgttagtagatcaagaaaatactgaatggcctacactctagtgacactagtacaaaaggagaaaaaaaaaaaaaaggaaaagaaatgagatgaagtgtgtttaaatggcacttgcccaggtctggttattatcctcagcatctgttagttctgctgaactgcatttgccttggtactagtcactaccattaaatttagacagtctaaaataattgttatatgaaatacaaggtagataatttgttatttaagcatcagaaagtaaaagagcatcaggtagtaaaaataatcaaaacaattcataatattttctttatgaactcatgtactctttcttaataggaagccatgatttttattttttatatgaatgaaaacttgatacacatatattttctttctttgatagatattctctctcaccagtataaaaggaaatagcttaattgaaaaatcaggttaccaaaatgaaggacattaattcaactctggatttcaggtgatgcaaaaaaaaaaacaaaaaaattcaaaaaaagcacaaaaaggactctgaagataatttatgtacttttcagcaaaacacccacaacatgacttctagactctatggtaaatcaaagatggaaaaaaaataaaacctaaaaaaaaaaacaacaaaatgacttactcagctgtttccattgaaaaattacttcccattaggagatgaacaaaatgcagcatttggttaatccctggcagtggcttaccattctcttaatactttcttctgcatctacacagttcttagtcagcacatatctgatattttgccatattgctattttaattacaaaaagctaatcaagtgaaaactaatttaaataatcaagtaagtcaagggcaaattaatcctgattcgtctaatacaagtttattacatcaaaatccctatctactctcatcagagaatttgggattgtagttgaattttctttttaagcagcactatgagactaccaggaatacagacagaactactactgaatttcaacatcagagacagcaagcagaatatcatagatacagacagaactaacactgaatttcagcgtcagagacagcaagcataatatcatagttttataaaagtgatctcagaacattcatagtaaagtccatcaagcggaaaagaacagaacagaatggtctcaaagaattaaaatgttgactattaatctcaatgcccagaaaaacttgccttcatccaattctaaggagccacttttgaagtccatcataaaagccacattctgtaaatcttgacactggctcagtgctcagaaactttcagttaagaaaaaaaaaaaaaagagtcaagggaaacacaaatttggctaaagaaggaactaaaaccaaaacgtgataagtgattataaaaccattttcaataagatgcatagaataaggtacaatgtctaaagaatgcaaaaggatggaggagcccagggcaacttgcttctttaaaaccatttgatttcttccaaacagacaaaattcagggaaggaatagtggaaatgaggaaaatgagtcataaatatatgccttcacccacatctcatgtttccttggttagactaaaatattttaatatttacatccctatgtactgtatatatatttttgctatgccatcataatcaaaacaactaacacagcaatattggataccaatgacagtcaaaggccactgaataggccactgaataatggaattgtatccaatcgtccaaaagtaacattacttgatgtgttagtcagggttccctgaagggacagaactaataggattgatgtatatatgaaggggagcttatcaggagaactgactcacacgatcacaaggtgaaatcccacaataggccatctgcaagctgaggagcaaggaagtcagtctgactcctaaaacctcaaaagtagggaagctgacagtgcagccttcagtctgtagctgaaggcccaagagcccctggcaaatcacagatgtaagagtccaaaagttgaagaacttggagtctgatgttcaagggcaggaagcatccagcacgggagaaagatggaggccggaagactcagccagcctgctctttcattttctgctgctgctttattatggccacattggcagctgattagattgtgcccacccagattgagggtgagtctacctctcctagtccactgacttaaaagttaatctcttttggcaaccccctcacagacacacccaggaacaatactttgcatccttcaatccagttaagtcgacactcaatattaaccatcacccttgattagcagacaatgttctccccctttgcacacaggtggaacagagatggacatcacccatttggggtttgtaaagactccagaccatgtggccctatctgggagcctgatttgtctaagcatccccttgacgttaggcactcaggtcatctcaagcatttccccattgcaaatcacattttatgaatacctgtatacatcaatctttccatttctagttatttcttcatggaagaagtggaataaagaactgagttaacaggaatatttttaatcctcttgatacattttaatctggttaattaaaaaaaaactactggcaagccacattttgccagtattttgtttttcctaatctcggattaccttcctactctttttagtctattctcttctcctctgcctcttccccaccacacccctgtaccctgtgctccagctccaagaacccttcctgcacagaaaagacaggatggcactttgcccttccatgctagctcctggctttgtttcattttcacatgtagtgccttcatgcccttctcctcttgctctctaactctcctgattacccccaccgagaatggctcacttcctcatcaaggttactaagtgttctgttcatgcctcatttgtagcaagcacaatttacattttctagaaatataaatttgccaaaaagctgctccagctgaaagatggtctctaaaagtactgacaaaaatgcaactggtactgcaagaccagagcttagaaaatgcttctgcacataaaaggcactctaaaggaaatgcaattaatacaggggaaattcaaaagacatcttaaatggcctcaattatactctttcaggataatttataatctgctaatgataaaatgcagatggcggactatattaatttcaaaatgctctaccgcagttttactagatatttctgggactataatgcaaaaccaacccaagacacattcagaaagacttctcattccctccaactacagccaagttgaattccttactcttgttaggcatgcatactgtggatctcaggttttaatgttctctgtattttatcaacagcttgtcttccataataataatactttcagtcctctggtctcaacattttgttgcaactttgttgaaacttcttaatttaatatctgaattcatattaaagccttctatgtttctttgagattatttttttgctgggagtctgctgttttcagccacctatcagaaggtaactcatgaaatagagtataattgtcagggtgcgataagtttttggcatattttctatgtaactgataggaaatataatacaaggctgttaaataatgaaaattttaaaaaggaataccattaggaaggttttctgtttgggtgatggatgtgatctatcatatagttctaaataataaattcagttttctgtctcaacggttgttctcttctttctcctcaggaaatgttacacgctgagcctctgtctcccagaacagtgctcctgaatattgaaaacatgctgcccagatctttctttcttctttgacaaaggctacttatcttgtagagtgtaaaagaccaaagctttttgtttgtttgtttgcgtttttttttttttttttcttttggtttgtttttgagatggaatcccactctgtcgcccaggctggagagcagcggcacaaacttggctcactgcaatctccgcctcccgggtttaagcaattctcctgcctcatcctccagagtagctgggactacacttgtgcaccagcacgcctggctaattttttatttttagtagagacggggtttcaccatgttggccagtctggtcttgaactcctggcctgaaatgatccgcccgccttggccttccaaagggctgggattacaggtgtaagccaccgcgtccagctgcttgttcctcttctgccttcttcctattcctttctttcctcctcccgccttcatccaacacggtttgtggtccatgttacttgggactattataggcttcaaacgagtctcgtatgagcagtctctagtccatattccacccctgtagctagtgcgcccatgttaaagctctatagtgttcacattactcccctgttcatgaatgctcattagccttccactaactaccatattaaatcccatctccaccttggcattcagggccatccacataacgctaaccctaagcctagtcagagcccatttacttgtgtttgtacctcctattgtcctcccacactcacccttagagcccctctggaccaggctctgtgtcaaaaacaccaggtgatttgcttacctttaggcctttgccttgcctatctctatctattaaattctgccgatcttcttatcgtaaatactgttttctattgactaattatctatgagaatcacacagatactcatacgtgagcattgcttttctaggatgcaacagaacttaatgtttcttatagacctggccatatttttcttttttagtaagcttttctatatattagcaacacacacttggcaatttaattttaaaaataacatttgcaatacaatcaaaatctgatctacttagggacaagacctatagactgaaaactagaaagcactgctgagagaaattttcagaaagtcctaaataaaatggtaagcatgtcttttacaagtatctgaaaattcaatattgttcagatctccccaaacagatctatagttttaatgtaatttaaatgaacatctcaaaaggcagatttctttgtagaaattgacaagaaagttctaaatttcataagggaataaaaaggacctaaactagccaatataactttgaaaaagaaaacaaagttggagaacttctgctacttttctttgagttttattataagttacagtcatcaagaaagtgtggtattagcatcaggacagaggaagagatcaatggaacaggacaaacagtgcagaaacagacaaatactaatctgctaatttttggcaaaatgtaagtgtaattcagtggagaatggacaatattttcaacaagtggctctggatcaattaaattgatctgatctatggcttgtaccttgtaacatttttcatagtcctaaatatgaaggtctagaaggaaaccaagaagatttttgtgaccttgaactaggcaaatatttcttgaatgtaacaccaaaagaatgatccacaaaagaaacattgtataaattggactttatcaaaatttaaaacttctgctctttgaaagacatgtttagggaatgcaaagacaagcatgcacagactaagagaacatatttgaaaattataaatctgatgaagaacttgcatctagactctataaatacttttcaaaactcaataataagaaattaagctacccaataaaaaacaggcaaaagattcaagcagactaaattttaacaaataaaatatatggatggcaaataacaacaatcactgatggtcaatagtattagtcattcagaaaatgcttattaaaattctagcaaagcaaattatagtgacataaaaccaagctgtgtttgcctacaaatgatgggactagaggagtgaaaggaagggatggctgaatggcagtcggagactttcctggttctggacatgttcattatgatagcagtgatagtttcacaggtatttacagatatcaaaatatataaaagcatatacacttatagcactgtgtcaaactatacctcagtaaagctataaaaataatcatgctagcaatgatctccatttttcaagttagtaaaataattttcagaaaaggaaacgtctgcatgtgtgagagagaaaaaaagaccacattagcctaaaaacaaacaaacaaacaaaaaccctgcctaaatcagatggctgtcctgggactcaaggaactgtgctttaagaggggactttctcctgtagtcccagctactcgggaggctgaggcaggagaatggcgtgaacccgggaggtggagcttgcagtgagcctagatcgcgccactgtactccagcctgggcaacacagagagactccgtctcaaaaaaaaaaaaaaaaaaaaaaaaaaagaaaaagaggggactttctatcaggcagagataataaaaagcactagtcaaaggaagaggcaccttatgcagaaatcactgtcataatccttcctgtctataggcaaggatggctctggaccaccaccaccccctgcattctaatttgagagtagatacactactccaacccttagggtctttcttgggttctaagaacactggatgagaaaatctagctaggatcaggcacatctatagcaaagctcacaggtttatccacaaaggccagccatgggctgaccacgtgagcattctagggatgcgatccccagaaatctaggtcacagacaatcctctggaaggtacaaagaggacactggagcaggagatgtggtgtccagcccagtaccccctaggaaggccatgtatgtcactaaaggatgctcacttaatacaggcagaatctcatcttctcagaggtatagcagccctcccttatctgcggttttactttccacagtttcagttacctgcagtaaattgcggactgaaaatataaaatgaaaaatttacagaaataagcaatacataagtttggaagtgtgcagcactctgagtagcatgatgaaatctcacgccaccttgctctgtcctgcctatgatgggaatcatctttgtccggcgtatccaccctgtttctgcagcctgccattgttcattgacattgtctgctcctgacattgaaacttgaacatgctcacggctggatgatccagaatcacctgacgcagataatcctccttctgacctaacactacgtcacaatgcctgggccgttcaccttgctcaatccaatcaggtaggcattttatcaacgcaacataacaagaagtgcaggtatggtaaaataagatactttgctagagagaccacattaacataacttttattatccaacatattgttataattattctattttatgattattgttgttaatctcttaccgtgcctaattcataaattaagctttgtcataggtatgcatgtataggaaaaaacagtacagtttgtgctctgtatccacagattcaaccaaaagaaacaaaatgataaaaaagtaataaaacaattgaaaactacaagttgaagaaccaacacagtataaaaactatttgcattttatttatttattcattttgagacagagtctcactctgtcgcccaagctggagtgcagtggtgcaatgttagctcacagcaacctccacctcccaggttcaagcaattctccctgcctcagcctcctgactagctgggattacaggcacatgccaccatacctggctaatttcaccgcacctgaccttacatagcatttaaattgtattaggtaatccagagatgatgtaaaatatacggaaggatatgcgtaggttatgtaaaaatactgtaccaatttacatcaggaacttgagcatcagcagattttggtatcggtgaggagtcctggaaccagccacccgacagacactgaggcacgactgtttgtattgggtttggtactgcccaaagtttcaggcatccactggggatcttggaacctatctcccattgacaagagggaactactgtaaccaagaaactttgattaacaagagaaaactgtatggaaaaattcactaattaaatgataaacataatttacaatataataccttcataagacttttctaactcatatgcaaatagtaaaaatacacaaaacaagcaagaatgcaaaaaattttccctaaatcttaccaatttgcattaaagaaaaatttctggccgggtgcggtggctcatgcctgtaatcccagcactttgggaggccgaggcaggcggatcacaaggtaaggagttcgagaccagcctggccaatatggtgaaaccccatctctactaaaaatacaaaaatcagtggggcgtgatggtgggcacctgtagtcccagctactcgggaggctgaggcagaagaatcacttgaacccgggaggcagaggttgcagtgagccgagatcgtgccactgtactccagcctgggcgacagagcgagattctgtctcaaaaaaataaataaataaaaagaaaaatttctcataggactacagttcccctgggatattactattcatttataatctatcattttgcaagctgaataccttcttaacaatttcttaaagtgctatgaatgcctagacttctaagacagtgatgccagtgtctctaacttcctgtatatgccacgctagtttctgtatagaataggttatcaattttacgtctgtgttaaggacaggaatcacaggacatctcacttattaaacggcatctatggaattatgccaaacacatttatctataaagaatgctggtcctcactatttttcattaatcaaatgcaatgtgtaaccagttacaaagcctgtagtattaatagaagcttctaatctgtatagcatgctgctttcttttagctgaaataacatttaaaattcataaatattggaggtaaaaagaagaaaaaagattataatgtgtgctctggcttgtagcccgaggagaacagaaacaggggaaaaacaggtaatgctttccagcgatgagtgatgaaaaagaagcacaacaattccagtgactgtatgagaacagccagaaatcattcttctaaaaaatagttttaagcagaacaatgatctagaaaaggatcacaacacattgcaccgccctgagcagtcccataaagcagtgtgatgcctctataaagcaaagttccgtccaacagggctgtcagaggggaacatgagtgaaagggagggagcgccttgcacatttatatccatgctgcaatgatccccacatctctcatggtgcccagcgcacgtctcctcctgcacccacaaccaggaattaggctccacgttcacctgctctgcagctacaggccttatcctctaattaaaccaaccccactgctctagaagaatagccctgctcggtgactcactaacatttaagaatacacacatgtgaaactaagatgaaaatgagggcggagatgatttatgtgaaaggacatttaaagatgaataggttttgtgaggttgaggaagcctgcccctctagagacagaggaggcatttgctcaagtgtggaataccagctgttgaaatgttaagtcaaatgaagtagaaatgtaatgttatttaacaatggccgaaaaggaactcgctaattagtatttagcaaaaaaaggttttgagtggtcaacctgtgtatttgtttatttgtttgcttttgtttggagacggtcttgctctgtcctctggagggcagtggcactatctcggctctgcaacccccatctccatctcctgcctcagcctcctgagtagctgggactacaggtctgcgctaccatgcccggctaatttttttgtattttagtagtgacggtgtgtttcaccatgttgcccaggttggtctcgaactgccgacctcaggcaaacctcccaccttggcctcccaaagtgctaagattacaggtgtgagccaccatgcctggcctaatctgtggactttttgtgtgtagagtgtgactgttacaaatgggaatgccctaatctatatgttactgtggaattttcctatataacaaaagaaacttctaagaactgctaccatttggaatccagtaattgtatttatattgaaatatttattataatgaagtatagcagaaaggctagtgagttacagaacaatatcagaagcctatgtgccatctaaaattttcttttattttttaaattaaaatgatctcaccaagcttaatcatctctaaatctaaaattttctaccaagtttactaggacactagaggcctatttctccagaaaaaatggtaatactaatttttacatatattagaaactaaacattttccaggaatgtacaattactctggaaattccaaatctttatgtcaaaaaacctagaaaatctgccaaatgtaccatgtctaaacctaagtgggtattgctactaatggtatctttactctgtctttatatagaaacaggcttatttggaatttagggctcagaaatagacctacacatacatgacatggtcatttgattttcaacaaatgtatcatagtcatccaaataaaaaagtaacaactgcatatccatatagatatccatacctcacactatcataaaatttacatatgttggatcctaaacctaaatgtgaatgccaaaactatggagcttctggaaaaaaaaataggagaatatttcatgagttgggattaggcaaaggtttctttgacaggttagagaccacaatatcattaaaaagtaataaacttagaaattaaaacatctgttcataaaaaatatgaagaaaatgaattaccaaactccagactataagaaaatagttccaaaacatacacctgataaagtactgatatgtaataaatagatcaaagcttccagaacaatatatacatttcctaatgaacctaatttgaaagtgaacaaaatacaagaagagacatcacgaaaagaaaaatatgaatcactaaccagcacgtaagaaagcacataacattgtcagtgagtctgaatggaatgccagtgcacaggcaccagaatgaaagcctgacagcatccgaggcggcggagccaccgtaatgctcatgaagagtcagaggtttgaccttttgctatcaatgttgttataaatgttaatgcacaactatctgtcagcccagcaattccactgcaggacatttactcaagagaagtgaggccgagtgtggtggctcatgcctgtaatctcagcactttgggaggccgaggcaggcggatccccttaggtcaggggttcaagaccagcctggccaacatggtgaaaccccttctctactaaaatacaaaaattagccgggtgtggtggtgggcacctgtagtctcagctactcaggaggctgaaacaggagaactgcttgaacccaggtggcaagggttgcagtgagccagggtcatgccactgcactccagcctgggcaacagagcgagactctatctcaaaaaaaaaaaaaaaaaaaaaaaagagaaataaaagcatctgtttaaaagtggtttacacaacaaatgtttaccttgttgtataaatgctctattcaagagagtcaaaacctggagacggcccaggtgtccctctacagtagacaaaaatacttctcagccataaaaggcatgaacggttgctccacacaacagcatggaaaaatcgccaacatattttgctgaatggaagaagccttacaccagagtagagaccacatgactctttatatgaccctttagaaggcagaaattgtggtggaaaaaaaatcagaagtgtttctgcccctgctgggtggagggcttggaactgaccaggaaggagcatgacatcattctctggggggtgataatgctctgcagcctgacaggggctgaggctgtaccactatatctttgccacaactcataacattccaccggatataaaatctatctgaaaaactgaactatgaacatgtattgaacttgtttgtcatggtgttcatgttgaagtatttcgaggtgaagtatactcatgtctccaactcactttaaaactcattttaaaattcttcaaaaatgagacgaattggtaagtggatggagaaggatagatagatatttagccaacaaaggaaatagagtaaaaagttaattgcagagctctatcaaaaagcaatccttacccaacagcatgaagagattagtagacagatgctctagcttcccattctctggaagcacaattctatgagacattctccatagctcctcagatgcccaatgagactgtgccctaattgtcccctgcactataaactcaactacccactctttgtcagctttgctttattttccatctgactttcccaactcctcaatgtacttcccaagattactcccaaatgaaccacctgcacctaaaacagagtctttggttctgcttttacaggaacccaacaaagatgataatatagggaatagcatgcatatgtccaactgtgtcagaaatgaggagccaagctgatgagtggatctacagtgatgttctaggaaatttaaaatgtagaattccattttcgcattgtcaaatgcaaggtgtacaattttgagaattttaaataattgaatatataaaatgaaggctctgaaatatctgttgcgatagaggtaagagatctgacagcttgtatgttggcatcacaaaactattgtcagttgttacataaatggatggtaaagctggaatgcctggattggagtctcggccctgacgtgtgcttgttaatccctcctgcctgggtttccttgatctcttaagcaaaatgttgaaagagcagctggatcatggtaaatgctattgaagtgtgctattgtttttattattgcctggcaaacactaaggaagtctatccaaggaattgtaacagaaggaaaatgagggatctgactattatagagaaaagtaattaatttccacgaaacagtcagtaacttggctaaagcgagctttggattatttgtcaattctgaaataacagggatttttttttttttttcaaaacaagtaaatttaggacaaataagatgacgtacttcacaaagtaatgaaaaatgtatgggagccattgttcctcagggatgggaaaaatttgaccagtgtttgtgcaaatttggggaaaaaaagtcatggactagcactaaaggaatgagatctacctagactttgaggtttgtaaagggtcttaatgaggcaaacaccaactgtgttctttcttgattctgttcattacctcatttaattttcaatggtcttgccgtgaatatttgcatgagatatagaatatttttaaagcaagaatattaataacagtttttcattttaggctcattaaataaaaacgtcattttttcactaattcacatgacatttattgagatgtattaaaaaataaaagaaagactttgaagacaaaattgctcaaaggttaggggcaatctgctcttcttggagtaaaattcaagggccattataagaagtataagtcaaattatagtaccaatcaaagaataaaatatttttgatggaactgatataaaaaagttgcgtatccttgtaagacgaatttctttctctccctatctctgagtagctgcataaaccactaagtttttctagaagcaagtgataatgctttatcataggtacaggcttaaagaatgattaggtacacttaaagttgggtactcctatcaaaatccaagacagtgcattgcttctttcctttccaaattttttttttcagtcttgtggcccctaactagtaattaagagaactaaattaaagttcatactggctacttgaaatcttacttttaatattctttgcattatgcatggaacttgtctatggttttaaaatccaaggggaattatgacatttgtaaggcaaacccaggctttcatccatcattctaatctgttttacaaaaaaaaaaaaaaaaaaaaaaaaaatcaaagcagcatttgggggacaaaatgagtgacagaaaaatggcaaaaatgtgtcaacaatagtgagatttcagagatccaggagactagctactaacctcagcatctcccgagatactccattatcgctatttatgttattacagatgatataaatcttacgtacaatcattgtacactgaaaagtagcagaaggaacagaggtttgtgaccagaatctatgacgcagggaaaattaaaaatgcatgaaccattccatataggagggaattgaaaattatatgcaaaagagtatatgtacacccacagacatgctatataaaaatgaacaaaatttaaaagcttattgttacccattgttctgatacgtatttctgttttcttggaaggttctttgctggccggccagattcctaaattttatatcctgctgcactagtgagatatgtaagaggattccaaacactcaagtgtccaaactgagctgtgctgaagacttcaggctctccttcccgtaagatgagaggtcatcaggaagatgatgctctgtgataacaggattgaggcagaaaagctatttgtcacattcccttgtttggattttggttttggactagaaagaacactggcttcaaagtcagaaatcaagaaccaaagcccagttctaacgtgttttattagctgagggacttcaggtaaatcatttagcatttctttccttcagtttcttcagatatttaatgaaagaattagaccaattgatttcaaggttctcattttgtttcaagattctacagttataaatcataaataaatcaccagtaagtttgcgtttgtcaaacaattcaagttactaccactttacaagggcacatattaattttcttaaaaatttatcacatgttatgtaaaaaaataagacttctgaaatacttagacaaaccataaatgtgcaaatattctatttcactacctcatagacaagttttagctgattagcatgccctgatgaaaatacacacgatatgcaggtgtaggagttggatgaatatttttaattgtgtatctcctctgtaggccaaaactgttcatctactaatacattagccttaaggcatgtgccacttttagtgactcagttgttaaaactgcgttacagctgcatttgctcccaaaaaatattaaagtcctgtaagatttctattaatgaatccttttgatcttctattttacatcaggtaaaaggtttcaggagcttctccattgttacaacatctccttgtatctaggaggatatgggggaaaatagcaataaaataggtggggatgacattctgatactagagagcagttaaacgtgatgggggaagaaagcgacgatccaacagaatatcctcgagtaggaaaatgattttatcgcatgactgcctacctcattacaaagtgaaattcaccactatacattttcgtgtgagctttcatctgctgtacaggagagtggctccctgggtttcctataacagctgttcccatgaatctaccagatattttgtttccacttttacctttcttactctctgtctccatacccttctgagggatgagggtctgttgcctaactctttcattagttatttatttatatctgctctgggaaagaagattgtggaaaatgtgagagcaattcacacatcaacgttttaagatcccgtgtacaaatgggattgctccggaaaagcttcttcccacaggcactaattaaaaagcaggaagttcacttgagcagcatttttcttccgtttattttcctttgtaatagacatgctactttttactttaatttgaacattatccctctctgtccaaaaaaatacaaaaacaaaaaccaaacaaaatacagtaaaggaaggcagagtataacattaacaatttagaaaagatattattttcccctaataaattctactgcattcttggaaagcattaaaagtataacaggtcacacatccttgaaatattagatgaaggaatttgtgaagacagactattggaacctctgagaaattagctgggcctctacttccgtggtcattctgaagcatttttagatgctggtcacgattaatgctggaaacaacgttagtgacagttcttctgtgcttatcacatgcctttagttcaggaccgaaagaaggaaggaaggaccacaaatggtacacgaatgggctgcacagggtggtttaaaaggtaagaaaccaaagtgattgcttgtgtctcatttaagttaaatttaccacaaagttcatattcaataaatttaataagaaaggtaaataaaaacaatcacagtaagaattacatatgaaaataactatccattcattctattaacaaactaataaattattgaacatacactatgagtgattctgtcctagatactggagattttcatgatatactaagtatgtttcctgcaagagttgaggatgtcagaaccactgggatactgcggttgaatagacaccattgcctcttggtggtctgaggctggtaaatacacaggcaggaactacgcattgcaacagaaatacctccaaaggtccttatgaggatggtgcacacagaaaaaaacgtagggtcatggagaaactggaaggaggaggatagaagaaataggtgaaacaggctaagatttatccaccccaagttgggagatggtattccagtgggaaaaatttcactgctaaaactaaactagactagcaattctgtaagatgtaagagtgtgagtgatgagctgagggacagcctgagtggttgaaacgctgcttttctgatgatttggctgatggagtggccctaagcaagtttcttcaccgctccgtttcagattcctcctctgtcaaaccgggaaaatactcgtatctacagtaagagttgaaggattcaatgaaggatttaatatatgcaatgctgagaaaggtctgtggtgttcagtaaaaaatcagggtcttttagtttctttcgtagggctgcacacgcctgacacaggggatgtgaaacacagacctctcatcctacaagtcccagctgcacctgaccccagcagcctaactgcccctggcccatgactctaccccagcccattatcttcttcataatcacaatttataacttggctattgctacattacatggtgcatttgcctatgtgtatacttgcttattttgcatttattttcctcatatatgagccctaggaggatacggacttgcctgtatttggggactggaacatataaggtgttcaatgagttttgttaaatcattactgatgatgctgatgatagcctgccactacatagctcttcctttgtgctactcttctaagcattttaaatacactaatattcttaattctcacagcaactccaagaggcctgcctcattaagtgggtcctgttactgttttatagctgaggatattgaagtgcacaggataaaaaagaaaaccacctaaggacacagagtaagtgatagaactgagtgctgagctagcagtaggctctcaaaacatattcttagccattaagctgcctggttctaagtaactaaatgacagatcggagcggggtgctgcctggggccctggctagccagtaggcagaaatggaccccaagctacccagggatgggagatggggcagatattaagagaaatgaggcacatcctgtactagacaattttcctagaagcccagtggctgagctgtttcatctgcagccaagagtgatgttccattgtttcgcatgcactctgtgagccgcctgctgcctgttgcctgagccttactccttcatccagcagagccaggccggcccacaccccacactcttaccacagatggactgggtttgaatcatggctgttaaatgcccttcaacactagtcaagtgattactttctttatttcttcacctgcaaaatggggattataaggtacctacctcataggtttgtggtgagaactaaatgagttaatacagagaccaatgcctgggacaaatgtagctcctctaattaacaatttgaattccctggtcccttggtttagtccctgtttgtcatgtactttacaaaagtgacaggttcctattcttggaaatgaatctgtctatactcagaatcagaaaaaccaaaggaacaaaataaaaatggaggcataccagccaatgggtgcctcggtggtatctccatgaaatctaacccatcagaggcagataagcacagagtccaaggccttcctctccagaagaaagaggaagaaggggggcgtgtgggagtgtagagtgcaaccccctgaggggctgaacccacagaaacagcctaggggtgagataaggggtcctggcccctgaagacaccctggggaattgaatggcttggggatggggaaggagaaactggggggcagaggtgaatacctccccatttctcaatgcctggcacctgccattctgctgttcctttctttccaagatcaaaacaggacattggccatcctcctgggttgtgcttccaaggctctctttgatcactctcagccctccagcttccagctgaaactgacctctagtggcctgtacactggtcttactacagtcattgcccccagattcagaactcccgtctcatgtcctgattgctgtgcagtcagcatctccacggaccagcactctagattatagcaccgagtacaagatggaaaaccaaggaatttcaccaccagttagtgttagacaattcattgttctttagtggcttgagatttaaagtggcaactccataaaaactgacgaagccttccttggtgttgacctttgacacttgtgagcagccacatgtggagtgcgtcctggacattttcaggtatctattttgatgcagcttttttttttttttttaaattaaacagactttctcactaaattgctttgtcatggcctcagggagaatctggcctacaacactgtttactatttcaagtcatgtgtgaatttgatgccctcatttcctcttcttcatgcttgtcttacaccaatcaataaaggaaggaactgggtcatagtctcctggggatgactcccagagttcaaattctggctctgcctagctgtgtctttggaccagttagtttcttcatctctataatggaattgcaatattactttatagggttattgtgaggaataaataagataatgggtataaagtgcttggctggagcaaatgttcattgggtgtcagctattctcatcgtcacgatcagtctatgagatggagtccactgtacttggtacttggaaataagacgtgtttatagatctgtgctgacatgtcagttttcaagagccaccatatatcctgctctatgcgtaatctttgtaatttagagtaaatgttaaggaagagagggcaggaaggaataaaatgtaatgagcaatcattggacaaataaattgcatccactttttaagtgcattttgtatacagtttaaaggtagaattcctgaagttatacgattttaaaatacacttgagaaaggtgatgggctgtccaaagcaatgattttcttctaagaaatacttacacatatagaaaatttgtatctttatatttgctgatgtgaggctgctctacactttgttcccttccatcagcacgcaggaaataaataaaatttgcccacacgctaaataaaagtcagctgaatcccaagtccttgccgtcccctcaaccacacaaactcatgcacccataaatatcttctttttggttctgagtgcacacagaaccaaaggaatttgtattgaaacgtttgatttcacttaacctgcatatttctatttctatatatcttaactctgaagttaaaatacaattcttccaatgatatgaaacacagtattttaaaggtatcacacatcttgggttgttagcaagaatttatataatcatttatccaaatcactatctattttggcttcacaccagacttctaatcaattctatatccttgttcaaggcatgtttcttatttttcaccactagtcaggtattcattcccttgtgctttgttcttgttcatttaacacacaactagtcccattcataggaaacacatcctaatccaattggtgttttacaaattgaatcttcccaacagaaagtcattgtgtccctcctagttcagaaatactaactgcatgcacttgaagttaaatcaaaggataattactggtctaatattttggatcatcttaaatatagaaccatattgtgctacagctggagaaattctgagagtttttagataacttggaaattacacagcctaccgaggtgtctttccccaccctgtgaggctctactaaagagacaagggggacttcacagaaagtttaattcaaacttaattacacttgagcctgaaagttgattaatcggttacatttgcaagcagcagaaaccaactctggctgtcttatacatcttgtacaccttgttgtcttatacaccttggtaggatgttagcctccaagtctccctccaggcaagctgtcccagaggtcatagagcaggaagacttggaccaaattaaaatgcttgaatcacgtaactttttaaaacatagtttgagaaacaaaagggaacagaaaagaaaagtgagccaggggagaaggtgatttttgtttattgccttttatatctattatattcccagcaccacctacaacactggtccggtacatagcaggtactttatgaagatgtcctgaatagctataggatataagtatgcaacccttttgtaattattataagacaatgtcttggaaatcatagctaaaaacaaatcaaacgaaagaaacttagtctcatattctattgtcaaaaattcttccatgatggtatatgcaatagaagctgtactggtggatttctcccatgtacaggttagcacacaggtaacatatgacctacagagctgcagaggatctgtctgcttagtgctgaaggccaccacttgatatagaaagtagaagtggggtgtcagggtggtagggccactggtccacgggacatactgctggaatagcaagacttggacccctgcttctgtttatcctaaggaagtgactggtgctcctctgatgatgcaatgcaaatgtcctgcagtctaagggctgttgtctgacatccagtctcagtaaatatctgtgctgccccatctccatgaattctccatataaaggctatttgagaagccaggctgtgagtgctctccaccatgtagccttcactgacagaaaatctgctcaatgttttaattttaaaggtagattatggattcttttataattagttgtagaaaagatcctctggcaatatggtagttagaacacatctttgccacccttcgctctcaattaaatattcaactcttacctgctaagcagggggagcttggggcacatgactaagccttaaagtcctataaaagtatcagcagaggggcctattaagatttggagaggggtggaattagatgaataatctaataaagaataaacatccctgaagagccaagaaaattatgtagaatttaagttggttgaggctaggctagtgttttaagttggttgaggctaatttaatttaagttggttgaggctaggctagtgaaagaactgtgcagtcactagactcaaataagtataaagagccacaccgtctcgtggataataccaaataatagaggacccataagtaaatctaggactatatggtacttcattttggccaggtgatatattgatatgttgggagaaaggattatttaataaatggtaatgtcacagaaggccatctattcaaagaaatgaatttgggccccttcatcacaccacatatgaaaggaaatttcaggccaattaaaagttttaaatgtagtaaactaaaaaaatagcagatacatctgacatctagaggctcggagaccttgataatcgacaggtgactacatgaaaatatttgtatatgatgataccataaataaaaaacagcagacagtggaaactgatagactagaacaatatacatgcgactcccacagtagagaaaaggttactatctgccataaatacggcttacactgtgatttgaaaaccctacctaatgtatgggagcagagagaaatgctcaataaacagatgaaacaaaatttaagttacaagaatattttgttttggctaatcagactctgaacacaatgaaattccttttttttttttttgggaaaaggagtcctttcataaaatgaaagcaaaagtgtgaattattacagcctgaaattaaggaaataagtataaggacatatattttactcacacacaaaaaaataaataaatgcatataaatatgtatacccctattcactggattgctgtatatagtcacacacacacatgcacaggcactcacaccaaaatctagaaatatcagtaacaaatcaataggcaaatgtttaaatcaaagccattgcagcagagcatagaatattatgcagtcataaaaaatttttaaaaatagaactataaaaattacctttgagagaatggctataaatgattaagagaaacaaattcagaagaaaaaagaaaaaacttatttctatgtgtgagtgtgaatgcatgccagagatatcagaaaggattttcactaaaatggttagcaatgcttgtatcagcggtttctacctcaccttttttatattggttaagtgttatataatgagagtgcattgcattatttgtcacataaaatttaatttgaaagctatttcattgctaaaaggcactggtataactataacttatttttctcatttaaaaatattctatcaaaataacatagtgcttccaccaggtgtgtgtcaaaaaaagaaaaacaacaattactaatgcctatcatttaaaaggactttgatataattaagcgaaaaaaaaaataaaagcaaagcacgttctctttgtgccttccaactacaccaagaatacaacaaagacggcagaagtttgtctgtacatttaataaagaaaacaaattaaagagagtgctttgcactgggacatttgaatccagtggcagctgccagattaaaaaaataaataaagagccatagatcaagctgcagctgcgtgcctccaactcactccgcagcacaggcccaaagccattgtcagtgcccccggatgtgtgggtgtccttcatttctctttgaatgtggccaggcctcttgaaggagaacactaggtggcatgcctaccaagctctgaaacaccattaaccaccaggaaaaaatgcgattaggattctatttggagatcatattttcccctgtaggctaaggaggcattctctaacactgacaggctctgagtctctttagccagaaaatcaaaaagtttctgtgaagccactaggtaggacttttagaaatagagtcgctacatcctctaggctcctgggaaagaacctgtagctgaattatttttgtgggtcatccgtaaaatgttaattgtggattgtcaaacccttactgcagagaggactttcacagaaacagttctatttctgataaatcaattttagcagaagagtctcttttgacatgcttaattcaatgagcaaattgtaatgggcctatcccttaagacactggtgtttgtgtgtttgggagtgttcgctcagcaatcttggccctgatgctgggggaatttgaacctgacaggcccagaggatggggccagcccctttccctggcctatggctccggtgctccagacacacacacctgagctacctcccttaaaggttggaggtcaattaaatccctcaagtacctactaccaagctatttgtttaaagactattttggccatttttttgatcagtaggatattgtcacgtgctgccaaagtgctgcaggtggacatgtttgtgtgttctgaaggacttacatcatcctgcaatggtcagctttatgacacaaagaatgagtgataactcagtcttctcagttttgtgtcgtttgtggttttgtttgtgtttatttctttccctatctggggtaaaagcctcagtccctgattcagcagctttctatctaggtgtctgatttactgaattgcatcatctcttcctcatcagtgttttcgcttgtttgcttgtttgttttgagtcaagggctctccgtctgtcactgaggctgagtgcaagtggtgcgatcacagctcgcagcagcctcaaactcctggcctcgagcgatcctcccacctttgcctcttgggtagcagggactacaggtgtgtgccaccacacctgatgcctggctaatttttaaaatttttttcgtagagacggagtctcactatttcccaggctggtctcaaacttctggcttcaagcaacgctcctgcctcggcctctcgaagtgctgggattacaggtatcagccactgtgcctggcctcccttcagtcgtaattgcattttgaaaactgggcctgcagctctgtggataccacacatgttctatttgagcctatatttctctgctggccgaatttcttaggaacctgtgccaattgtttttcatctttgatcatcagcccgaaccatgctgtgtccacctgaggggacggtccagcatctctgtgccatggcagatggactgccggggctccacctggttttggaacctgcagtttgcaccatggctctcctgactgcagagccaccggcagctgctgtgtttcctcatttcctctaaccccagtctgtggggccttccccttcagcctgctgcagaacccatccctctggtcagttgaaaaatgtgggtaactgagttggaggtggcatgaggggactttctggaaaaggtctaaaagtctgtctagaggagcgtatacatgtgtgtaggtaagaatggcatcaagttgcacactgaaggtttatgccccttactatatgtcaacaacaaccaagaaaagaatcacctgccaaagtcagtcaccacctacttagttccctagagttgccactggctcaattcatgagcttatgtatgtgccaaggggaaaggcttcctcctccactcaggttttgaacattgtaaacactaccaagcagcaaacagatagagcctgaacgtgtgaaacttaaatatctatttagtgtttgcctcctcttcccatttttttttcctttgacagaaaaattgtagtaaggggacagtgctttttgttatcttattactgtgtgtgtgtgtgtgtgtgtgtgtgtgtgtgtgtgtgtatgtgtgtagcaaagtctacatcctagaaatgtatgctgcatgccacagctgggggcctttgtgatacatgtgataggtgaaattcattgtaaaggcatatttgaggtgatttttccttattgtaattctctgtgaattgggagctgcactgaggaagtgacaaggatgaaatgatggttactatgatcagcctgttttccccaactaaacattttcacttggttgaaagctaccagagactacagtcaataataacttaatcgtacatttaaacttaaagagcgtaattgcattgtgtgtaactcaaagaaaaaatgcttgaggggatggatacctcattctgcatcctgtgcttatttcacattgcatgcctgaatcaaaacacatcatgtaccacagaaatatgaacacctcctatgtacccacaaaaattacaaatgaaaaaagaaagtcatcaggtctcgaatatactataaacatatgtgtttacagtctcttcaaacatataccaagaaccttatttaaatctcaccaaaaagaattgtcggctcacaggacaagcttaagagctgtccactgtgataatgtgacaatcccaaacgaatcttttctcctcctttttcatatttctcccttccccacattgactgaatgatatgttgtcggttccttttgttccaatcaggtagttttcaaaatttcatggcaggggaactgagttaaccaatatatacatagcctaattagctttcaagttggctttatggggcaaacaagcaagtgcgttatacaacagggaacagtgggctcccctccctcctgtatctcaatgactgggcacacaaatgcatccccatatattaactggacaacacaacagccccagctagaccagagatggtagacaccaaagaggacatcagggaacaggcaaaatccaaataacatgattctagtttaaactggattggcctcattctcaggtgaaaatgggtttacacaatgcatccctgcaacatttgtaagcttatttgttcctttacaccacgtttcattcagaaagaacgtgaaacagcccataacaatacaagcaagtgaagatatctgtggaggggagtgggctgaccgaggaacagaagggtaggaaatgttgacccagtcgggggtgacgttccagtcccaggtcagttcccgaagtttcatgtgcttgctagaggcaggacacctatttgtttctaagctttccagcaagcataggaaagggaagtgggattaattacataaatcacacaaaccatttgcatatttctttgctatttctggtactgaaaccaaagaatacaagtggatgcttggtgttaccaacatctgcacatgagctgaataaggatgatggtcatattggctctggaaccacttacagcttctacttcagatcatggatttccacacatagtaggtattaaatgctttttgaatttaacgggacaagggaaggtaatcagaaaatgaagaaagaaaaagagaaataaatgcataaagagggtcaggcttggacaaatattgatacagtgttgtacaagaaccatagaatccaacatggtacacctgagatacaaaataacaacagcaaccacaaagagaaacatggggagaatcagggaaagaaactaagaatcataagtaggaatcactaagtgggaatcaggtcctaagcaaattgctttatgtgcatttgattatttattccatcattgcttgtcagcttccaactatccctgcccaagagaaaagtgcacagacacactcagatttaggggtaggaaagaagttgagaataagaaaagaggttctgaaaggttaaggatcttgccaaaggtcacacatctaggaagaggaacttggttaccttatcaaaaacaggaaatccattctcagtttgataatgagtcagatattgtactgactcattatcccagaatacgtacaaacattctcagtgatctgagttcctggcgtattttcttttgtattgcaatctcacaaataatgtgtagagaaagaaaggaactgcatgcaaagtgtgttctttttacacacttactttgcatccaccagtttctaccctggacaaagacaggggttggagctgttatttgctgtattactgctgtactagtcccttcttgatggttccaaatacactacactctagtcattaaacacagatgttgcctggagatcaaacgctacacttaaaatcatgattcaatctgcgtttacatttagaatgggtgtaaacttgaggagaaatgctgtattcagagatattgaagacagacttataaaatataatagaattttatattacacgtagaagcgtctcagcctgaggacaagtggcactagctgtagttgccgtcaggctgaagcctgtctatggaactgggcggggtggatctaccgggagtctactgacatgggacagtgaagaaccacctgggaaaacatcactgtgtgtcaggagggtgtgcaggcacccaagcatcatgcaaatctaacacttcagtctgaaacatgggatggcaagttactaccactcagccagctcccatgggctcatcccaggatcctcgcaggagtacacgggaatttttctcttattaaaacatgtgtgggcatacctcattttattgcacttttactttattgtaatttgcagatattgccctttttacaaattgatgttctgtggcaagcctgcttagagcaagtctattggcaccatttttccaacagcatatgctcattttgtatctctttgtcacactgtcttaaatttaaccttcaactaaataactattgtattatttgaaacgttcaagtaaactaaagttttgtgaaaactgcttttcacctacttctaaaatgcattattattgggtcatttctgacacctttttttcttttttttggtgcttttctgccgatttgaagaaataatgataaaaaagaatttctataaatgtaaggatacttggttaatgtatatttgcatttcattgacaaaataacattttccataaccatgtggtctcaagcagataaattcctgtccagaagcacggtgctaccttcagcatttaaatgtcgggaggcccaatgtgttctcacattgagaaccacatgcattggaaggtggctgctattcagatagggaagatgtaagaggatggagaacaaatgaggtcctaaggagacatgtaaggcattgggagttcttctgctgcagaacccaggctgcagcccaaagggatctgagagacagctgctactgacagggaactcacacaggccacatggagctgtttccctgccatcatcatcttctggtgggtctccttgctgacccactctgaggataagaaggtgaaggagatgtccttgacagatggcagcctatgaagtaggtttctctgtgtaagaaagtcacctcccctcctgtcttggtatggggagggaaagactgtaagcctctctgtcttataaaaatcaaagatttgtggttccaaaattatatgccaaagtatacatcttggaaggaattcaatatggtgataaaactataagttgggaaactaacaaccttggtcctagtcccagatctgatctgtcactgctgactgcatgaccaaggcaaggcctgtctgatttctaagctttgggctcaatagccataaaactttactaacacttgaattgccgcagtatgccgcccctcgatccctaccatacaccccatttatgcaatagccaagtaacttttttccagctctttcttcctagttttagaaaaatacacttactagttctaaaaatccaaacaggtgcacctgactgccccagggagaatcccctgaactagtgctatctaagagaattttctgttgacaggaatgctctaaactacaatgaatgcagcagcctctagttgcaactgcccagtgagtccttgaaatgtggccactgtggctgataatctgactatttaattttctttaattttaattcatgaaaatttaaaaagtcatatgtgcctagtggctgacatattggacagtacagctctgtatcaacttttgctaattaatgtacatatccaggatcttgtactttatttgtccttttaatcaatcaaatccaatattcaataagcaaaaattactgattgcataataggaggcttcacaaaagggcagagtctagtgaagtaaaaaacatccactgtcctctctttctcttgattacttccaacatttacaaatttgggcttgccccgctgatatggtttggctgtgtccccacccaattattagttcccataatccccatgtttcacaggagggacctggtgggaggtaactgaatcatgtgggcgatttcacccatgctagtctcatgatagggattaagttctcatgagatctgatggttttataaggggcttctcccttcgtgcggttctcatttcttctctctcttgctgccctgtgtagaaggacatgttgcttccccttccaccatgatcgtaagtttcctgagacctccctagccatgcggaactgtgagtcagtcaaacctgttttctttattatgacccggtctccggtatttcttcatagcagcgtgagaacggactaatacatccagcctcctttgacttcccttttgctgatccccactgaagttaaagatgcacatttcacacgtgctttaaagattctgaaatctgcatgtttggagtaggccaggcaatattgagaagttttggtatataaacctttgagaaacttaaagtaaaccaattttctccactttttaacaatacgagtttctgtctcctaaatgaagcatttatttcaaaactcttatacacaaaactgtaatcttaaaataagggtgggggggtgctcctgactgccttggtcttctgttctgactaatcttaacaaagaaagcctcatctaataaagacaaaagtggcatcgttatgaaacttgtattgggctctgcttctgaacatatatactggcattttcctagatttgtgatattatttagtacatatttcacctaaactatgtattccacagcacattttccaatgttatggatattttttctaaactcatcttaattttccaagttcaatacaatgcatagccatttgaaaataaatgcccactaaatttcaagctgtacaaggtaaacttactttttccccccactaaatgataaacttgagtaatatatagaacctaacatttgtgccaattcactctcctgccaccccttcttcaaaatcataggtttccaaataaaggaaacaaaaacttacggctgaataccctgctccaaattaaacataaagtaatcaaagtcattattaaatgtttttcatgttgtcgaaggaaacaaaacaacaggaaggacaagagtttaggtcaagaggttccggtgttatctgcgtccttcattataagtgatttcaaaatctttttccctccaggaaaaactagtgagtaacagcttagtctaaatgacagcagctctgtggtacgaagggtccacatttcagctaattttcagctcttcttatcctgataccatgagatggaatttaatagatggctggaacatctataacatgacatttaccaaaggatgtgtcagcggcatccatggcctcaacaaagatggagccttcaaaacataaatcaaagaaaaatataagaacatcttagaagaaaaggatgacagtgatcctgcacatttaaaatattttaaatgccttagggactctacggagcaagtagtgttaaaaataatgatgtaccaactaaagatatttagctccctgttaagagaagaggctatgtagcagaaggagaaaatctttagattttttttttcaaaacatgtggtttgagagcccacctcacactgttcctttggtaattctcttattctctgtgaaccttgtatagttttcttgggtgtaaaatagtcacaggattcccaaccttacccaattcacatggttattaaatcaataaagacaatgtgtgtgaaaatactttttgagctgtaaaaggctctacatgaaaagcttatgtaatagaatattaaattggaggtttcaattaaagccagatacaagagatactataaaccaaaagaggtgctgattgcctatgtgaatttacaaatctaaacatcactgacataatttttttaacagactttttttttttttagcagttttaggctcaaagccaaatcaagcagaaagtacatccttttcttccaaacatgggctattttgaaacatctcatgaacatcatatttatagattggtttgttggagtgagtggagataatgtttgaaggtgagataatgtttgaaggtgatttctttgtggaagaaaagggcttctatggaaagactccactcagagagcttgatatggctcttctagagttaaggagaaacagtgatatgatttggatctgtgtccccacccaaatctcatgttcaattgtaatctccagtgttggaggtggggcatggtgggaggtggttggatcctgggagcagtttctcatgagtggcttagcgccatccctctggtgctgttcttgggatggtgagtgagctttcacaagatccgtttgtttaaaagtgcgtagcacctcctcctcactctggacaggtaaaacatctcacatctcctttgccttctgcggtgactggaagcttcctgaggtctctgtagaagcataagccactatgcttcctgtacaggctggagaaccatcagccaattaaactccttttctttgaaaattacccagtgtcaggtacttctttacagtaaggcaagaaaggactaatacagagagtgagttcaggtctgacccgagtcccacttgataatgttaaaggctagctactttgttggtatagttatattgggtttagtctgtgatcccagagtttgttaaaacaaaatatgtatgagaatgcccaatggaaaatgaaaaagagctgcactgaaaccactttagtttctacccaagatgtcctggaagaccaaggagactccaacagagaaaatcggggtggataacagtgaaaaaccagcagctgagaaagaagtgatcaccggaggaggaacatcagtatatgcttggaggtgaagcagacatttcctctggtgacctctaaacaacttgtacaggagccaatgagataaagtttgcttttcacacttcctacacttgacagcttaaacatatcccatgacagtgtcagctgagtgagaactttcctgtgccctcttgctaagctcctaaattgtgcttcaacactgaggtatcagaaacagaagagagcaaaatggcagtgcaggggagcaagttcaaggtggggaaggacggaggatgccccccaccccaatatacaccacccctccagcaagtgcccagcctaatgcaggcccagcaggagtacatggcaagctttttatttgtttagttggttgttttcaagagactggacactactatgtactgaaataaagctgtaattgaaacttaaagttatccatttggccctgggagaaaatctattaatataacatgacatttaccaaagaatgtgtcagcagcatccatggcctcaacaaaaatgctatctgccaggaggacatggaaactcctttagaggagacaaaagaatcctcagtaaaaggaaccaccaccagatacagcgtgatgggttgtgcagttgaagctacaaaaggtttgtcttggacattaatatggtttggctgtgtccccacccaaatctcatcttaaattgtaactcccacaattcccacgtcataagaggaacccagtgagaggtgcttgaactatgggggtgggtttttcctgcactgttctcatgatagtgaatgagtctcatgagatctgatcattttaaaaagaggagttccctgcaaactctctttttgcctgccaccatccatgtaagacatgacttgctccttcgtgcctctcaccttccaccagaagtgtgaggcctccccagccgtgtggaactgtaaatccaataaacctctttcttttgtaaattgctcagtctcgggtatgtctttatcagcagacatacagatataccgggagctgctttacaaaaatcaccagtaggcatgaaatttccagtggctcaacacgtcccactatgaccaaccctggtgataagctcagtgtctgacacagtggctgccacacctgctcgctctgaattgtcatttccaaccctgcctcttcattctccaacctgaacaccaacatcattccacaaagaaggccctgtgtacactctgccttttccttctctacagtcagtactggatcaatgtccacataggccctatccacaacccaacagcaatctcctggtcctacttaagagcacattcaccttctaatttcaggatcttctttcatagtcttgccatacctttcgtggctccaacgctgttctttgaaaagaaaacttctttgaggcaggagaatactctgtccctttttaatgcttgaatcgtaagtttaatacagaaggaaagccctaggaagtaaatcattgtagctgctttaaacatttgaagagcctacaggtggaacattccttagatttcgtttttttttttttttttaaataacaaaactagaagaatgggtggaaacatttaggtcagataactttctctcaagctctttaacaatgaaaacagttttgtgaaaagcaatgattattcctttactcaaagtgctctagcaaagtcagatgactacaaagcaagcatgtaagagtaattatcttctataggagggaattgagattagacgactgcaaagttgattcctattctaattatcttctataggagggaattgagattagacgactgcagagttgattcctactctaattaccttctataggagggaattgagattagacgactgcaaagttgattcctattctaattatcttctataggagggaattgagattagatgactgcaaagttgattcctattctaattatattctataggagggaattgagattagacaactgcaaagttgattcctattctaattatcttctataggagggaattgagattagacaactgcaaagttgattcctattctaagtatcttatatcggagggaattgagactagacaactgcaaagttgattcctattctaattatcttctataggagggaattgagattagatgactgcaaagttgattcctattctaagattatggataggccaaggtatacaatgactattatatcattcattatcatagtcattgtataccttggcctaccattaatttacttcatgaaacatcttaaacatcaaataataataatagtaataagaataaaaatatctactatgtggcaggcactatgctaagcaccaaagtatggtccctgccccaaggaaatgaatctaataagggagcccagaacagggggacccaaataatcaagacttaattttttggtcatactccatttatttcatgaactctgtttatgcaaagtttatatttttatgataacattgaacaatagacatattatgtcatattggtttatactgacctttacctaaagtactttaaataaaaatatcctattcagagacaaagacaaagagcatggttctcatttgtttgtagcacattatgggaggagtagagttcatttctccatgagatactactgctagctttaaattatggccatctctgagtgtacgcttattagcatggcattctaaattaatatgaaattctgtatgcacaactgaagattcataacacattaaaaaaaatagggtcattctgacactagacagaaatataattctttgaaactagccgtgggagaacccgtagttcaatcataccaacaaatgactgaagggttttaatcatactcagagattcaagtggaccatgcccagtgcatgccatagactctggcatcagtgagtatcgtgccctacaacaaacccacttggctaactagtcactttacaaatcatattctatgagcatttcccttttaattttcataatttcctttttcccagtacgcaatactcttccattttcttttcagcaagggaaaactccatgtttcacttctaatccagttctagaatcttaatccccactttagaaaacagagtccagtgaattttactcttttcagggaaagcctgcagagtaagtgtcaactctccctcaaccttataagaaaactaatgtgactcaatgtgagtgctttcagcaagaatctgagctcaagttccccagattaaactctcagtttggtttctttctcgccgggtgacccaagtaaagtcaattaacctctccgtttcccacccggctttactgatgcatttacgcaggtagctggatattcccagatggaagagcatgcacgcatacattcataatgcaaactcatatcacagtactggtctgtactggcttgcctcattctgaagcagtattttcagggagactcccctgccccgcacattttatcactgtaagataagatatttgtttcttataaagcatcaacaaaggatctactatgtaggaagaaaaggctactaaattctatttatgtttccccagtgagatttttgagccattcgcttcttaagcacataaattaacccactgccctacagatgtagtttttacttccacaagtcttgataaagctcctcagtgctcaaacggataatatgtcagtttcactctgcagagactcaggaaggtacatctatgtgtagaaacaggcactggagaaaagtagcatttcacacacaaaaacagtttcaaggctagccaagtctagtacaggcaaagtgatacaaatagggcatagaacagcagggtttccacgcaggaaagaaactgatgagttcaggaaagtgggctaaaacggtgatgcatttacaaatgtgatagtcgctgatcattgccaacccaacgtgcttctcaccctctgtccttgctcataggaatccgattttttttggagatggaatgggcccagactaggggataaaataggactggtctaagccaatcatggcaattctgtttccatgtggcaaacacttgcttttcaacatgcttcgttactatcactggccatatggcccagttataaatgatgagctgtaaggagaggcctattaggaggcttctaagaattatctttttccattttgtttatttttatgtatttatttatttttgagacggagcctcactctgtcacccaagctggagtgcaatagtgccatcttggctcactgaaacctctgcctcctgggttcaagtgattctcctgcctcagcctcctgagtagctgggattataggcacatgccaccacagccagctaatttttgtatttttagtagagacaggttttcaccatgttggtgaggctcgtctcgaactcctgacttcaagtgatccaccgacctcggcctcccaaagtgctgggattacaggtgtgagccaccgtgcccggccagaattatctgttttatatagaagagacaggcactgctgtgtccgttgttatcctgccttgcacacagaattgatgccttgatgctctgttctatgccatgaaggacagtggctagtaaagctagaaacagccccgtcagtgtgtgagtcaacaagaatgtcctgatgggtttatctgctgtgtgagtgcctgatccctgccaggagacagcatcacgaaccaataaacaaaccaaccaagtttttaaacatgatacatacatgtaactacaacgtaaaatgaaacaataagacatatgaaaaacgttctttagagaaccttattttttcttttatgctttgtaggtactttaggttgagttttctcaaacccttctatgtagtatcaagaaatatttctcttataaatattttaaaaatgtatcatcctgcacaatgaataagattgtagatcacttaaccaatttccaattatctaaattaatgactgcatgtcactactaactgacagactttgtaaaacttttaatatcttttacataaaaagtaagtaatactggcttggtgtacctcattgccataatgatatgcatatgtgaaattagaaaaagcactatacaaatatcataacaattaaatatttaggtaaagtctgagcttagctcatgatttatggtaagcattcaataaattatagggatttttttttttttttttttttttttttttagataaggtctcgctctgtcactcaggctggaatgtggtggcatgatcatggctcactgcacccttgactttccaggctcaatggatccacctgcctcggtctcccaagttgttgggcctacaggcacatgctaccacgcccagctaatttttttttttctattttttgtagaagcaggttctcactataatagtagtcactccttatagtatacatacaacaaaaccatgtactttggaagtaatgcaataagtaacatgttttaaaatatatacacatactttttcagagtaatatgcttttaacttcctgcccacaattttgagaatttcaaactagcagcatgggtcaagcgcatggctgggtatcaaaacaaaaacactgagacactctacacaacaaaatgcaaagcgacatctggtatgttcccatctctccagggtcctcatgatgctgagcttttgagcattctaaaggtacacttggggaacttgcgtctgcaagaccgacttctttttctgtctccctttttcttaaagagtagtgagtaaaatcattaccaaacaaacaaaaaacagttatcattacagagggatctctattaaagaagcaatgaaaggctagcactactgtgggctggatgaaaataaatagctggattgaaaagtcaatgaattaccaacattgacccacatttctctagactttaattaactgacatcatcccaatgaataacatatgataaataaaatcttaattctaaaatactaggcaaaggacaaaggctctcaacgtacgcatttctgtgatacagaagagtaacaacgaattggctaaaattgccggcagctcagctagataccattttacttatttcagatcaatgctgggtttctccctcttcgccaaagctgaatgtgcatcactctggcttttgcccaggtccccacatagactttgataaaatacttactcagtccaccttcggctatcactcctccctgaactcgtctatcccctccatcctcttcttctcttaactatgcctctgctccatgagaccctcagctaaacattggaggagtctttgagagccattcaaatgatctgatgttttcctaaaaattagtgtctttgaacaaatgaagcttttgtgacctatacatgtgtgtcctatggccatttgtaggagttggttctaggaaggctgctgaaaatccattcaccaaaggctgattcactggctggccaacttacctaatcgtttactcaaaagttctaaaatttgattatttatgaactgcacagtgtggtctttggtgtcctgagctcttcaggtcccctcctggcccctcagtgtacaactgcctggagctgttgcagaagggagcaggggcataaacaatgaacatccctaaaatgctcctaggaagagaagaggtgttcacctataacctgaaaagtcctggaaattcaatataaaatacagaagatcctaaaagctgattaaaagaaacatatttttggtaaaccaacaaacaaagaaaatgatttggaaaatgttttttaaatctggagtaacagaaaaacaactaaaatagagattagaaagaaatcggtataagccaagagttcccatatggaattttgaagtttaggttatatttataacaatagacgtacaagtatattaaagaagaaaacgttcttaagaagatgaattcacctgtatttcataactttcaacaaattgatcattcattaaaatctgctaagaaattattgaccattttgagaataatcaaatacagaatacaataaaaatacttgaataaattccaaaagaatgtttcaaaacaatattattccttatattagtaaatgtggtaaaaatcagcaaaatagtaagtgagaaaattcaatggtatccatatgaggtgtgtgttggtggaaaagaacatttacgggtttgaaacccaggcatgaattatcaaaatgagtctcaagaaaatggcagtagcagcatttacttacaattttaaattccttctactggctgatactgatgccctgaaatggtttcgatcaaccgtctttaaggagacccctttacatatatattgtatacagtatgcaaattctaaatgtaaactatcaagaataatacatgtataaaaaataaatcatcaaaattttaagttctttatggtaatccttttttatatgtttatttttatatgtttactatgttttttatatgtttatttttaccttaacctggctcttttggaagtattagctttggtaaaagggaaaaagaggaaaatattttaacctttctcacttctctatcgactggctctttgcgaggtgagtgtgcatcatttgtgtgtggatgagagcccgtgataaggaccaaggagaacacaagcaaagagagtgggcgtgaaaaggagatgaagtaagaagcgtccacaaggccaagagaaatctcgtggcagaacagatggtggcgtgaagggcgacagtgaacacgggggccaccctggctttggtagatgccagacatgcattgtgttctgcacactttccaccctggagcttatgaatccacacagaaaccagcttcgctgtagatttaacactgtaacgcgatgcaaaacagaatgcatggtggccggttccactctcactgtcgggacatccaaaacatgccctacaaatactgtcaataacataaaataatgcgtaatgcctcctccactgtgctttcaaagcactgaaacgcctgataaccaaatctacaataagcaaagaggggatatcacacacttaggcaaaaacaccccatgtgaaaactagaaagtaagcttaggtctattctaagacttgaatttcttacataaatgtgagagtaattttgataacaagagaggtaagaagactcctggccaacaattaatctgtaacaaatattaagcttaggaatgattttacatttagactgtatttcttaataaatttcctcacataaattgtgcctaatctataaactaattttaaacaaaatccatcatgccaggcactttacatcttactctatttattgcaccatttctcatcagaaaccttttagctttaatgctattccatggcagagtatctcattagagtggcaaagataaagttctttttgagataaagtaattacggtgattgtagcggggagggggtcacccaaagttcttggctacagtaatctcctggcttctgattcattttaagaccaataaactgagtacaaacaaaaagatgttaatggtggataactctggttacctagagtttgtcctggagggattagcaattcataaccttaatcagaactagagtcctggagaattttgctcccaggaaaatatttcaagaccagatgctgtatgtgctctcagctcacttctatgtcaattctatcttctaattattattaaagtcaatcaagtatttcactctataaaaagccttactatattttaagccaattttctgttccaaagactagtcagttacttcctatcccaggggctttgctttcttgaggaggcacaagtcagttgaaatatgggctatggccaagacaatgatagtagcaagggacaggactcctcagccatgatcagaaagagtactgttaggatttagtgagaagccttcaggggaaggaggaggcttggttttcaaatcatgccaagggacagacttaccattgccatggagtcaaattaaccttaccagcccagtcaaaataattaaaaattaatacagtctctgataaagtttgttgatataaattggtgctagggaaatatttcaaggaaacaatgacatgagttattttaaattattaatttcattggtcaggaacccaatcagaattaaatatgcacatataaaacaacctcccttgtgtgttcaactctgtctcatttctgcatggacctcagtggatgacttttgaagaagcagatgaaaagtgaatgcttgccaattagctattgttcaccgttttccagtaagcattcatatttctaaaggattatagtctagtccaaactctgatcaaggtcaccatgcaagaaagaggatattctgatatggagatgaagaaaatttgagtccgggttggttctcaacttacctatgaggtcaggtgaaaacttcagacatcagttccccatgcctaacatcaggacaaaattaactatccatttcctttacaatttgttagagtatcatattaaatgtgaaacatgattaaactggagcatcacatttgaaaagcaactcattattattacatgtaaattttaaatagcattcaggaaatgttagaattaagaacaaatcaccaataaaaactttagaagattaccatttagactcatgatatgagtggatctcgttgcaaactgatttttccaaatgagaaaaaatacaattatactttcaaaaataacccaggtggctaaccaggttccagttttcctccttaggtataaaaatcttgctgaagttcacataaaccacatgctgctcacctataactagtcagccacacaagatcctatattgtatttttgttcttgatcagagacaattatgtaagttatcgatccttataaagttctagaaaatgaaacctcagaattgcctattattcacacagcaatctttacacttggcaaagtttagcacctactccattattgcaaagcctaaatttgctggtgaatcagtagtgtgactggtcggctgatccacagaaatattatttgtaggtgttactgaatgtgtatttttgttattgaaaaattgaaacatctgatcttctcctatggactagctacactagatctagttactgtactaaaatatggattatataagttatctttgatttaattgtccctaaatccataagcatatttttttcaagagtatgtttcagttatattttaagtacaagggaagtagttagaaaatagaacactgattactagatttgtatagtgaggactatatcctagtaaaggccagggctatggaaaaatacaaagcagatttttcactcctggcttcgatatttatgaactgtgtaactttgggctcattacttaacctcatggagtctctttgtaaaaacactggatgagaattggagaaaaatagaaatacaagaatataaggataaggaaggaaatcagtacactgtagtgaagccatcataattgctatgcttcatttcattatatgatgccagacagaatttctaaagggtatgaattcatggagtcaacatagaaaatttcgaatacaaatgctatttattcagcattacttgattcgtgtctttctatggacaaggcactttgtgaggtgttaaacataaactagagacccaagctgaaagttatctgatcttataacaaggcttacaggctcttcgaacatagacaagtaaggacactttggtagaatgaagggcaggaagtgaatgatacctgcaatactggagttgacattttggcccctcaggtaggaaatgaagagaggagaggccaacagctctagaaaaacttcagagaagggtcaatgatatgcagagcagaaaacagtgcttggggaagaaacagcatgaatttaaatatcaaaggtggagcatctctgggaactgagaaaaatcccaggtggtcacatgactgggctttggagatagaggtggagccgagactacaaaacacagggattgaacatccctcccaggatgctgggcctggggagcagggtggcatgacatcatcacagagcctcagcctgagatggaaatgctcacagcctcttgatgcagagcagtagaggtaggggtggttttacttctctgaaatcagttagccaaagcctagattgatttcatacatgagtatatataaatatatatacatacatacataaaatagtaatattaatagaataacaataaagaattttacatttctaaatatttatgttctggctactgttctaagtactcttcgtaaatgagctaatctgcacaaaaggaaatagatactattgtaccattgaatagatattaccaagttggcataggtaagagcaaaggaagtcaggattctaatggggcagactggctctggctaactgatttcagagaagtaaaaccacccctacctctactgctctgcatcaagaggctgtgagcatttcttaggctcacaggtcatcacctctcagccaagccttactgttcctgaggattacgacatgtcaggctctggtaagtacctactattaatgtaccatttagtccccacaacactctattttggcttgttatgtttaggccaatgctacaggttggttttctttctgtttttctatttttttcccacacaaagcatattattaaatgagaaatcccatgtaaaattccagattgatgatttcttttgattaaaaagaaaacaatacagccatactgagtttccctctcacctcttgccagcaactggcagaagcgacttttcaacatgaattccacctcacccttccactactgtcctcaccgccccctactgcccacatctaacctaacttctcatcacctgagtgatcactgtggacatatgagtatgtgacatctatcgtaattatatctgtgtgttaaaaaaaaaaaaagctgaaaagctaaaggagttaaatgtttagattagacagtccaggttcaacctccaagtccacactcataagttcctcttttcttgggcaaatgccttaatctctttaagccttattatcctcacatctaaaatagggttactaataatgcttaactgagagtgttcttatgaaataattaaaccagataatgcctgaaaagaatttagcttggaattcaatattcatttttattgccatttttaccaagaataccaggaagttggtataaataggtcatatatgccacctaaagcaatcaggacttaggcacagattggggtagatgaggttgtgtcttgtgttgagaaagccagaggagaggagcaagtggaagcaacccctcttggggacattgggcctgcagcatgctgcccggcaggagagctgcccaagaactgtcccagaaagagccccgtgggcatcattcttgtgtggctttgactctataaatgaatttctctagacagctgaaatgttcatcaaagtgaaacactgaatcacagctttctgtaattccaccattttctcaggcctgagaagatggatccatgatttctcctttattaggtggatcttttgagttctttcacaggccccgtaacacccattctacagggctgccaccttgaccctggcccacagctcctcatctgcgaaccagatgaaatgcgccttaattagcctcttgtctttcacctgtccccatcttcaagtctaatggcaaactgtcctcagcatgaactgtcctcaatagcgtttgacacatcaccctggtttatacaattttgctgtggtttccgtcagcttgcagaatagaatctgaacatgccagtcatcactggggttcctggctggtgcctggggtatttacccacacttgcacacctgactgcccccagcactgtgtccttgacacccccgtgtctgtgttctctccaccgcggggactggacacgctcggcctgcatgccctctattgcaaccacatcacatccagccaaatcccttggagccaccgagccggaacctgacactttctatcggggtcagcaaacctgttctctaaagaaccagtgagtatgtattgcaggctttgtaggccacccagtctgtttcccagctactccactctgcacttaaagcaggaaaggagctgtaggcaacatgtacagaaatgggtggggctggctctccattaaactttatttatggacatgagaatgtaaatttcatgggtcacataatgttattcatcttttgatttttcccaaccatttaaagccataaaaaccaactttgcgtcaggggctgcacagaaacaagcagtggccacagcagacttcagttgactgacccttgctttatatgcatactgtttgctgatccatactctttttttactttttaaaattaaggtataacgtacatttggtgcaccaatcttaacgcaacagcccagtgaatgttgacttttgtatataaccatgctaccatcacacagatcaagatacaaaacatttttagcagcctaaggttcctaaatggtcccttctaatcacaccgtaacagaagcccaacctctttttgctgccaaagcactctccatacttcctttcataggcctggataaagtaatggggaaacaaccctgtgtaatctaaactttcacagagcagaaagaaatccagaagacaaaggcgcataaacgaaacttcggctatcattaactatcacaaccacagaagagaatgtcttttcttttcaaagacgggtgatacatcattagaaaaactgaaaggcaatgtgttagtacacattcattttcctggcagtctcatgctgacactgcatttccttacctgggtcaaggtgagcgttgcctgcctgcaggtgctgcactgtaccctgagttttcccggctgcactctttgacaggggcctttgcaatacacataaaagctgttgtagattgatctacctgctggagaagaaaaagcagaagaagtggctaataatgctgcatctaaattgagacaagaaactctttaaaagcttgttagaggcaaattttaaaactcagtcttcaggaacattttgaaacattactggaataaatattccaatgggaatacaacaatttaatttagaaaatctaactttatgctccaagagtgaaatcttttctctctcttgccaacagccctgtgacttactcagcaaagtaagcagcctactgccaagagaatcgggcaagtgtatctgcaacacagtaaaatcagaggcactctttgccgaggaagtttgaaaagatgacaggaattctttcaggatgctcctgaattctatctcgtgcttccagacacagttttgaagactgcagatttttcctcataatatctacagagaaaaaccagcccatttatcgtgatataaatgatatgatcacagtttgctgggcttctagggttgactttctaactcacagtcacacataaaataagaaaagaggccaacgctgaggaactttcagagaccaagcagctatgtgcagaaatggatggtttgcatttcatttatgatctctctacctaggcaaacaccattcaaataatacattttcaagagtaaaaggtgaacaaacaactaattcaatagttcaatctcagatcatttctctcaactgtcaccatatagggacactctgtaaactagggaaatttaatcaatttatacttccatatctgttaagaattaactttattcagaagcacttaccagaaatacaaccttcttcctgaatttctaaattttgaaaattactaaatagttttttcttttaatccttacctgggtggataatataacagatcatgacataaaagtttctttgaaattttactatgatcatcagaggcacctagagataatatatttttttttaacatttggaatgaaaatcttcagcctcacaaatgcatatgatctattaaaaacaactagaacaaaaataatgaaaaaaatgagattctaaagtcctttgcagcttcatttcccgaatttacaaaaagagcttttgcagacatattggattatcatttgtttagctatctttcctaatactgtaggtgacaatactttgcaaaatctgaagcacaacaaagatgtaaagtttcatggttttatcatttgtttgcaatatattttataattattactctataaagattaatatttagtttccagtgggaaatggaagataaaatgtaaatacatgtttatattgatgtgaaagtactattttctgacacttctgtgtaactttaatgccctaatgtacaacatattcaagtacataaatatgacattgctgttagcaaacataataatgacataaaatgtttcacatgtaatatacatgcagcatagaaccatgtattaatgttatagaaatatttgtaacaactgactgaaatatctgtaatatgtaagtaaatgttaatggaaatatttgtaacataaatatttgcaacatgcagagtatcaaaagatcacaagaactgtgacaattctgacgtgcactaagaagtgcatagaagaagaagtgcttagaagaagaacctttactgttaaaacctttatcagcaacaggaacaaatccaatttcacaatttttataaccttttgtaaaggtcaaacaataaaaagaaaaaaggaggaagaaaaggaacaggaaaagcaaaagctttgaaaggggagtcagggctgcaaatacgctagcattgttgaaagagcatattagcaagagttttacaatattaaaagaagcatctcagaaattgcaggaaactaagtgactcttctctctcccttaaggcaatagtgatgtttgcaatattgtttcagctaatgatatatcaacgcagaatctgaaagctaaggaacttttccacctccgaatgctactaccttcgctgaagtccttcagaagttattcagaaaatactgtatgccaatgtctgtgccctagaagcatacaagatgacatgcaatctattacacacactgctttccagacccagccacaagttggggattaacagccagtctaaggaagatcaaggtcaggccagtcgtggctgcagcgcttttcaagctgttggctccacttggtcaagcagctggggcatcaggtaaatcttgagagcccctccagaacggcttccctatttatttagctacataacacaattaaaagttggcaaggttttctgtgtcatgctgtgacctggacaggcatgaaaacaaataacaccccgacaatcttctgggcaaggttcccatcggcctggctgaagggcctaaagtagaaactcttgaatatggagtcataactcttagaggaatggcaaggcaattccaaaaatgacctgagaaacctttcttgtggtatgtagctgtctctagtcaatagcatgaatctcaccctttcacttgttcttggaccttaaaatcctttctctctcctaatcaactcttctgtatggcagcttcttgattatcccaataactaaagtagcttatgtttgtgttcataagagtttcctctttttgtatagtaagttttgaaacatagagagatatttcaaaaattgtacaaatcacatccttcattgtaattcatcacttgcagatatttcgccacgtttgggttccctgtgcgcgtgtgtgtgcatatagctgtgtacacatatactacatgtataaactatttggttgaaggatctgtaacacagtttctgacatcatgctacttcacctctaaattcttcaacatcctaaaactagggatgtttttcatataaaaccatttagctttttaagtgatttggttattttgtagttctattcatagactaatcaggtatattttaagtaggcattacagaaaatgacagtggtttgcaagctaataaaagatgacaataaaaaatattggggattctctcgtcaaaccaatttaggtggtgctaagtgaagccacattaaacaagtcccctgaccataccccttctcagagctgagtgactctgtaaaaatgaaaggatgaagcacaggacatctcaaacttctcctgaccatagatgccttcctggaatgctgcatcgtgtgacactgtacttctcagaaaaaaacaatttagaaaaaaatatcagatgaaggattcaatccacttgtagggcttgatttatagaaagtgaaactgctcatgtttataaacccagatttaccaaattctcctggatatctgcctacggccaagttctttcctccaacccaaaacatcaacgaactcatataattactttgtcatgtgccaggaggttaagtctacttatgtaatgattttgcaaataaagtatgttaattttattcagaagttttgttttttttttttcctgcagagaagttaaaaagaaaagtgtactgagttcagggcccttttaaagcgtgagtcaccgtggccattcagaggtccactggctttctaccattccttagcctaagaagtccatcttcttcttcttttttttttttcttttttcttttttgagatggagtctcgctgtgttgcccagactggagtggaatggtacaatctcggctcactgcaacttcctcctcttgggttcaagtgattctcctgcctcaacctcctgagtagctggaactacaggcgtgcaccaccacacccagctaattttggtatttttagtagagacagggtttcaccatgttggcctggatggtcttgatctcttgacctcatgatctgcccacctcagcctctcaaagtgctgggattacatgcatgagccaccacgcccggccaagtccatcttcttctttagttttctctcacgctttgcctaacagaaccctcagtcaaatcttctcttttcctttcttttcttggtcaaaaaagttgctgaaataacaatgtttacaacatattgaatagagccaatatttgaaaatagtatattttatttgcttgggattttttagaaaccagtataatctttacagttatcatttttcttttatgtattttagataataggcttaagggttgaagacaggatacttaggaagagtcgttctgattctaatggaaacttttcattaacctgagaagtttccatcactagttgtcactgagaatttaattgctgggataatttgttttctaggtggggagagagtaagatttaacatatttcttaccttggtaaaatactgttcagtatcaacatattgtaacagagcaaaacagcaggaacaggacggattttaagtgatatttatcacatgagctattaaaatattaagtagaacaatgtcacccaagagaactctctgcaatgatgaaaatgttctccatttgcactatctcatattaatatatacacacacagacacacacacacacgtacatagcatatgtagccattagctacaactacctatggagaacttgaaacttagtgaggaattactctctgagttttattaatttaaagtagtttcaatttaaatagctgtctgtgggtagcagctaccaaactagaaagcacagaagaagagaataaaaaccactggtgtggctggtcccctcttcaactgacaacgcggagactcactgggcagtgaaacagcttgttttaatctgtgctcatataaaaataatgttggcccgagagaaggagaaggaagaaggttttactcgtggcactggggtaggacagaaacaggggggacttccgtagtgctagaagcagagaaaaggttctcgccatcatgtgcccttatttcctacaccaaggggatctgttcttgagacgcacctggacagcaatggctccatctccatttccatcaccacctttgaaatctgacccatatgctcaaggtacagttagactggcacttcttgtatgatttctgcccttgatttccattatcatatgatatttccctaaaaatgacatctaagagaaggaaagtagccagtgcagtctcatcctcttcgaacagctggcttgcaccaacaccacagaaccagctactgataaggagctgctggcatgaggcgtcccccaagcctttgtccaaagccccccacattgccaagcctggctattggtggtttcagctccttccctctttcctccttctgactacagagttgtccttgtttcttacacatcaagaatgctgctgctggtgtcattagctctcatttttcagttacacctgccatattccctcagttcagccctgcgcctagtcatgcagggagtcacctcagttctggtggagccctggattctcctgtggaatagatgcatggccagagtttctggacccgggacagggatctggtcagaagtaacagcaggggcacagaaccttcttcctcatcatccatcaggattattgctactgtatttctgggtgctggccttcagcagggcttgaccacatttgctggaatacacgtctccacaaggacacaaccagtatgtaccaaatgaacagaatcagcaccacctctgatgtccagcaagcgcttctttacacattatggagagagaacccacttttcttcatgttgagtgaaggtattcattagttctagtttaaccaatatgtacagaaatagtccaaagtggttccacatgaaattcatttggactggacttcctgaatcacctcttctaaggacaccttgctttggagccttaaaaagatggggatcggcctgccgcagtgactcaagcctgtaatcccagcactttgggaggccgaggcaggcggatcacaaggtcaggagatccagaccatcctggctaacacgatgaaaccccttctctattaaaaatacaaaaaattagccggcttggtggccggacccctgtagtcccagctgctcgggaggctgaggcaggagaatcgcttgaacccaggagacggacgctgaagtgagctgagatcccatcactgcactccagcctgggtgacagagcgagactctgtccccccaaccaaaaaagaaaaagatggggataacgaccatttcaccattatgcaggttactgggggaaaagttgctaaactgggcaggtcaaacacggaggcttcattatctcactagaaatctccctctagggagccacagtcagcactctctggaaaggtcatgcagccaaccgattcacttgaccgtcctaacatcccactcagcgcatggccccgtgtctgcccatctttccgtctcactatgtgagtggaccactctcttcagttgaacgcttccttccctctccttctgaaggctcatgggacctcatgtgcacaccactggccctcaatgcgctcaccttgacctttctgtacctgtccaaacttttctatggatacaacctctctgtgtgtaacacttcactctatttcatatgctccaaatggctagtgaagttccctgaactcaataaacactcaataggtatttgctaggtcaataaattctcccatatttttaatggggtgaaaactgaagtgagcatggtggtgtcagggcaacaaatataaaatagaatgcagccatgatcattcaatatctagaacatctttcctaccaaccagacaccctttaaattgttgggatatcatatttgaaatcagtaaaattaaacattagaaaaattacttacataagaactaaaataaaaaaatgtttatataggacttggtgtaactgaatgttaaggagaaaaagtgaaattctaagtttaccaacaagtagaactattctaaaggaagacagttattacatgaacactcttcactccaaaccttgtccaataggttattacacccaactgaatcaaactgcctgttccatgcttttaacgagccataaacttaactcctgtggagtaaccaaggttatgctatattgtaaacagcttccaattacataaccatccatccagtgaatgtacttctaaaaaatacttctaaaacatgcttagcaatctctaaggagactctacacttaaaagttataacttaattctcaaatttttgctggggttttaaattaacgtatctgcacaataatttgacctactgaggcaaaaactgctgattaaatctaatacctttttctgattttttggttgttgttgccaatttattttttcatttttcattttgaaaataataatgaaatttcccataccaagacaaaactgtagagtgaagcaaaatttaagaattaggtttaaataaataacaaagtacaaagccaaaaagagtaaatgtagttgctttttctttcagaaatggatacgggccaggaaatgggcacagttaaggtggtgccaggaaagtcacagctttccaaaagttgaataaactccataatataaatgtagatggaagaaaccatcaatgctgcagataatgtgtccagtttcctcacaatgacatctctatagcctggggtatgtccatcttggcttaaagaggcagcacctatgggaaaactggctagccatatgtagaaagctgaaactggatcccttccttacaccttatacaaaaattaaatcaagatggattaaagactaaaatgtcagacctaaaaccataaaaaccctagaagaaaacctaggcaatgccattcaggacacaggcatgggcaaggacttcatgactgaaacaccaaaagcaatggcaacaaaagccaaaattgacaaatgggatctcattatactaaagagcttctgcacagcagaaactatcatcagagtgaacagacaacctacagaatgggagaaaatttttgcaatctacctatctgacagaaggctaatattcagaatctacaaagaactcaaacaaatttacatgaaaaaaacaagcaaccccatcaaaaagtgggcaaaggatatgaacagacacttctatgcatccatagaacagacagctatgcagccaacagacacatgaaaaaatgctcatcgtcactggtcatcagagaaatgtaaatcaaaaccacaatgagataccatctcatgccagatagaatggcaatcactaaaaagtcagaaaacaacagatgctggagacgatgtggagaaacaggaacgcttttacattgctggtgggagtgtaaattagttcaaccattgtggaagacagtgcagcgattcctcaaggatctagaactagaaataccatttgacccagccatgccattactgggtatatacacccaaaggattataaatcatgctgctaataaagacacacgcacatgtttgcttattgcagtactattcacactagcaaagacttggaaccaacccaaatatccatcaatgatagactggattaagaaaatgtggcacatatacaccgtggaatactatgcagccataaaaaagaatgagttcatgtcctttgtggggatgtggatgaagctggaaaccatcattctcagcaaactatcacaaggacagaaaaccaaacactgcatgttctcactcataggtgggaattgaacaatgagaacacttggatgcagggcggggaacatcacacactggggcctgttgtgggatggggagaggggggagggatagcattaggagaaatacctaatgtaaatgatgagttgatgggtgcagcaaaccaacatggcatatgtatatgtatcaaactggtatgttgtgcacatgcaccctataacttaaagtataataataaaaaataaaataaaataaaataaaataaagaggcagcacctctctggagccatgacctctttgtcaaaccctggcctggccttgtcacctttgggaaatcagctggccctcaatgcctgttctctcatctgcaattatatgtctactattattgtctcagtagacaataatagtatctaactcagtagactgtggtaaggattttaaaaataataatggaggtgaggcacttagaacaatgtctgctatacatggaatgttcagcacatgttgtttatttgtatttgctgccaaaaaaattctgaactcaagctcctcccacggattcttcaagctgtaggcatttacccctcctacttcctcaggtggctactttcctgtttaataaatgttgattcttagacagtatttccatcttaaatccactgcatttttgtaaatagaggaaatataaatcttaaataattctttttaaaattacttcattcccaaccaaatcctttacaattaaatatttaataatattatggaacacaaaccctgatggaaagtcccaaaattgattgaaatttttctagaatcatatttgtttctgtgaatcacttttttattatgaggtaagagatacaggggtggactgcagaaaagttaggaaggaaaataataaacaattacatgatctagtccagttgataaaattttcaagttggctaatatgctttaaaaaaaagtatttccaaaataaaagctttttttattgtatggttgtggaatggtactaaaggggattcaatatgtatttcaaaatttaatatgaatggcagacttgttaaatttgcatccactcttctttgaaaggtaggtacgattgtcagcatttcataacaaagaaaacacaagctaatgggttgaatggtgtccccaagacagcactcggggtcatcagagatttacaggtaagccttcctcattagaaagcacaagctttccttttaaccacatgataataaccttgagtcagacggtggactttacaaaatactgtaggggactgattccatggctcttgcaaagtggcacttacacacagatcggcaattatggacccaggccagcagtcacaaacaccactgcaggtgctggctcactacccccacatccctcatgcaatcagtgctaacagtttcatggaaattcccattaatgttttaaagcactggcattcagtaagaatgtgcaggtacagcaattaccaatgaggaaaattaagtctcattttcaaagattagcacatgttctacaaattgaatgttatcccaagaaatggaatccatggaatgacctgagaatcaatacaatttcttttttatttttacagaagtagtacttttcttgctatttaaaaaataatttaaaattttttaaaaaaacattctaagtgttagaaaaacctgttacgtaaatgaaccctcagaggaatggcattaattaagagagtagagcaacacggtgtgagcctccaaactcccacattctttgttcatcttcaatagccaatataattagttttgtataaatattttatttacatataatatttcctatcttcactgctaacataaaataaacctcttacaaatttcgatgctttaagcatcttatttcacctgtaacaaataagacaaaacattcaatgttaaaaaatttggatcatttctagtattgatttccaaaagcttttggtggtgattgagattcataaaatctctactacctcttaaaagaggagaagacatatttttctctagtaacatactgataagttagaaacacatggtgatgtcatcatgctggggggaaaacatagattatttttttcctttaatcaagactgataagactatgaattacatattgttctaaaagtctgcactggaataactccagctgaaacactcttcactggtactgtgggaccatgaaagtctttctatatcatgagtatctcagtcaaaaggtttccaggaatccatctaagacctcactcaggggccgcctctctcctaccctaaacactccttgctgtaagttcccttcaagttgaatgtctgtagcaggctgagctatcccatcttctgcagtgacttcacctgtttaagtcagcaatcccccgagatttgaagcttctcaagggcaagtttcatgtcagtggtctcacttctattccccacccccaccttcaaccaaaaagaatgttgtcccaggaagacattaaaccctgtgaatgatcaagtaattaagaaattggtgagattaagaaagctcgcttaaactcaacattttaaaaacacaggaaagttgctcggcctgtgctacagattacagtaatgtttctgtttacttttgatattgtctctgcctaaagaagaaaaacatcgggctttgagaatgctgcagagtcacaggccggcatgtattcttcattgcctctataaaaggtaaacttagagaaatctaaacatgcttatatacagtcaggcattgtttaacaacagggatatattctgagaaatgtgtccttagacgattgtggaattgtgcaaacatcagagtgtacttacacacacctagatggcatcacctagtacacagctgggccctatggtacagcctattgctcctaggctatgaacctgtagagcatgttactgtactgaatactgcaggcagtaactgtaacagtaactgtaacacaatggtaagtatttgtatacctaaacatatctaaacatagaaaaggtaatgtgacattatgagggctatgatatgactgggtgatagaaactttttagctcaattaaaatcttatggggccattgttatatatgtggtccatccttgactgtatgtctttatgtggtgcatgactatattagcagtcaataggaaaaaaaatgaagatataaattgataatttatcagtcagtatctagctttctaaatgtactttaatcttgtctgcaaaaaggattgggttgtttgggaaaagggagaatgatggttagaaagtggggtggtggtcctaaagaaacagaagaatattaaaaacctatcaagatgccatctatcaataatgttaacaataaatattgggggaaatctcatggactcaacactagtagtttgtgagaaaataatgaaacaatcaagacaagcctccctttaacagttttcaaatcctagaataacactgagatgtattccgaaacaccgtgaagggtatttcacaatgcatacacaactgggaaggagcctagcatgctcacaatagtaaaacgatgctgggcacagtggctcatgcctgtcatcccagcagtttgggaggctgagacaagttgagcttgagctcaggagttcgagatcagcctgggcagcacagtgagacttcatctctacaaaaaataaacaaaaaaatagctgaatatggtggcacatgcctgtacctccagctaggaatagctaggaggctgaggtgggagaattgcttgagcctgggaggtcaaggctgcagtgagctaacatggtgtcactgcacttcagcctgggctacagaatgacaccctgccttaaaaaaataaaaaaaatgtatattttgtagaattattactatagtaaaaatatttccaaaaaaaaaccatacacacacacacacacacacacacacacacacacacacacacacacacacacacatatgaatagtaagaagtaatagagtcttatattgaaagttctttgatgtcctattctggaattattctagcttcactttcccatgatcctgtgttctatccagatgcatccactcatacccttaggaggccagaaggcagccatgcaccctagatcaaaaggtgttggctcaatgctgttagggagtgaccccagacacatcccctatctctctggagcttggttcaggtctcagacgtacagcatacacacacgaacaccaaggtgccaggagacactgcaggaagaccttcaaaggggaacagatcaaacaaataggcacctgaaggaagggaagggaagtttagaggtggggccaattcaacacccagagttctatgacttccaattgcacgcactttgtttcagctgtaccatcttttctatctccagtatcctaggttttgagcagcagaatcgtggtttccctagagagtcaagacagaaaccacagcacagactgcctcctctcctttcttcagggttggatggttctctctgtgtagttggggatggcagccactggttacctgtggctctgagcacatgaaaggtggttcctgaaactaaggaattcatttttaaatcttatttacatttgtttaatttaaatttaaacagccagttctgtccagtggttatccaaatttgggcaacacaggtctaagggaatgaattccttcttaacacagattgaaggttccagggaagttacctgtatatttgcagacttttatccagtacatatgcaaataatttctgtccagtgaaacagataacacccaaaatgtgtggcctggcggaaatttcttagttgataaatagatagatagaaagatagatccctaatttctcaaggctctctgaattggtcatggtatcttatgatgtccctcattcattaaaagattaaataaaaatttttacatgtgttcactttatatttgctttataattttaccttttgtaaattatactttaggatcttatttttgaggagagagaagattgttaaggctccagcttggagttgtctctcaataagtaagcaataaatattcacctttcttcctcatcctttatccctgctaacagcatctaggaatccttatttcatcctacttccccatctgcaaccttattgggcccagaaataccacttcctctaggaagtcttacttaattcctccatttaatgtaaatcccctccccctaaatgcccactacatttgagttgcatcattcttaggggtcgtaagctacattctatctcacaatatcccatagataattttatctctcctaccaggctttagattcttttgaaggtgaaggctacattttattgcattctccctggtgttgatgaataaaaacggtaaatattatgtggaggaaccaaataactagacttgaaactaatggtgtggtataaaaaagtctttcagcttgcaaaagataaaatcacaatcaactggccttaaaataacttaatctctgtgacaatataatgaggaatgttcttccaggcccattaaaatgacatgcaatttgataattatttttacagtgtcaggattctaaactaaatgtttctcagcttctgttatctggtgatactaaatgaatgttgtcaaaagattaaatgtaaattggttataaatcttcatttaaccacatcatgcagggaaggttacattacagccaccatgttcgtgtcatcattaagaaatggagtcttattttaatagtattaagactattgaaattattgtttattctatctaattggctttggagttgaggatgaagcttttgatgggcatcactgaatacaggagcaaaactgaaataaaaatgaggggcaggccgggcggtggctcacacctgtgataccagcactttgggagggcaaggtgggtggatcatgaggtcaggagttcaagactagcttggccaacatggtgaaaccccatctctactaaaaatacaaaaattagctggcatggtggtgcatgcctgtaatcccagctacttgggagactgaggcaggagaattgcttgaaccgggacccgggaggcagaggtagcagtgagcaagatcgcaccactgcactccagcctgcgctacacagtgagactctgtcacaagaaaactgaagggcaatgaacttaaacccttctggaccccaaatggacaaatggacaggatggggaatagctgcagccactatctgcaggaaacactatcattgtctgaaaggccatcttcactttctaactagattttccaaactaattaaacaatctaatttcagtgaaaagtccttcttttaaaaacccagtttgcggccgggcgcggtggctcacgcctgtaatcccagcactttgggaggccgaggcgggtggatcatgaggtcaggagatcgagatcatcctggctaacaaggtgaaaccccgtctctactaaaaatacaaaaaattagccgggcgcggtggcgggcgcctgtagtcccagctactccggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaacccagtttgcctggctttttcaggaaatgacctatggtttgatcacctgtccaaaccatctggcggcaggaatgtgatctagttagactctcacagacggtgtctgggaagctccatcattgggctttaatgttaaagccacacggccacacagccaggacactttgatgaacagccactcacggacacagtgagcccatcatgagatgatgagaccaagttgcattacaatgattttgacagccagcaaaattatatttaaaaatgaaatctttcttttggttctgtatttgaagtaaggaaaatcactttgggggtaaaatcagggttttggaagaaactgatacttcttattaggtttaatttaactggcagtaataattaggacatgataattataccaggtgaagcctgcaatagacttagttctactttaatacttaattgatattgcaaacaccaagattttcggtgtacagacaaatatagtatccttgtataaatgtatatgctcaactaatgcagctattctacaatcgaagaatctctccttaatcaaggaaaatgattcatatcagaaaaactgtaaaaagcacctcttgacacattctccatgtgctacatgaaccaaggcccaatcatttgttcccctcagtctctctcctgatatgcatggtttccacatccctttctacagcctctgtgtgggggtaggaagaaggaagcagaaaaacaaacacacacatccacatgttccttctccttactgctctggcttctcagacttggtcccactacttacatttttttgtttgtttatttgtctgtttgtttgagacacagtctccctctgttgcccagcctggagtgcaatggtgctacctcagctcactgcaacccccacctcccggattcaagctattctcctgactctgcctccctcccaagtagctgggattacaggcgtgtgccaccacacccagctaattttttgtgtgtgtatttttagtagagatggggtttcaccatgttggtcaggctggtttcgaactcctgacctcaagtgatctgcccacctcgccctcccaaagttctaggattacaggcatgagccaccatgcccagttttaaatttttaaaagagtattaataaatacatcaatcagaggaatatgtaagattctactgagaagcacaattcctattagcgcaagggagacaaaaacactatcatggtattgttaaggctccagcttggggttgtctctcaataagtaagcaatattcacctttcttccctatcctttatccctgctaacagcatctaggaatccttaatctatccgacttctaagtaggaggtgagcaggggtgtgggaaaacattctggcaggatctctatgcaaaagaaacaggtggtttagggtgcgattgagaggtagacatgtcccacacagctccagcacagaactgcacgccggggtgacaggtctgcctttcagaggactaagctgctgtggcaacagccagccacagccctccagaggaaggaccacagttcataaactttagagtctctgggagcacttgctggggagcagcgtgatggaggtgctttccagaaggcggtgctgaccaggccgctccctgcggaagcccctctggggaaggacactgggcagcaggaatgatggtggtggctcagcaggggtggagaactcctgtgtgcagcctgtgttcctgctgagagaggccccaagccctggagtcatgacatcaggaggctgtcgtgactcgttcactaggtgtgggaagcccagcactgtgtagtacatgctgcagagggcagaaccctgaggtgtgtggcagcctagagtcctgctgagcatggcagccggggctggaaacagtgaggcctgttctggagtgcctctgtgcaaatccacctatctggggttggggattggacatgagttatttattcgtttattagttattaatttttaagtttaccagggaaattgcatgcatagcaaaatatggaaaccattcattaaaagattcatgagactaaggtatcagttcagtggacacaaaataagcattccaggagtagaaagcaccctactttgtggggtgacattgagacagtgctgggaacctaacagtgaagctccctatgtgaggacctggtgccacaaatggggtggtagataatgcacatgggcctccactcatgttcctccgtggcagcgaattaaagaacatccatcttcttacttcttttctgtttctcagttgccaaccatatgcctgtttagttacacacctcggcatggtggctcacacctgtgatcccagcactttgagaggccaagaaaggtggatcacttgagcccaggagtttgagaccagcccgggcaacatggagaaaccctgtctctacctacataaaaaataaaaattaataaataaattagctggtcatggtggcatgcacctgtactcccagctacttggcaggctgaggtgggagaaatcacttgaacccagtaggtcaaggctacggtgagccatgatcctgccactgtactccagcctgggtaacagagagagttcttgcccaaataaataactaaataaataaaataagaaatcagccaaagacttcacttgctctgacagaaactttcacaaaatctactagaacgcagtggattcagagatctgtcaaacacttctttatctaatactgcataggtgactccctgtctagaaaaattaataaaaactgacaagccacctgcactgtagctcttccgcttcctctactgttcattattggctttatttcatttctatattaaactgcatattacaaactcaggccagctggatctttgcatagatactatatcttgtttctgccagagatgatttttattcagaatgaacagtaaaaggcaacactacgtagaaaatgcacttgagttttaaaataaagatgaaaaaacttgtgcatcatccaatggtcctccgcagcatggaggaaaaaaaaaaaaacatacttcagggagataatatctttccttctccatttcacaaatgggtatcttcaattaaaacacttgtttagattcattagtgtttccttgatttgattcttcggtccatgagtaaatacattttagagattaaatgattagtttctttacatatgaaatagggctaatagtatttgcctttaatgatgttggagaatagtaaataaaataaaatacccttgccaggcatgtacagttgctcccttgtatacataaaggattggctccaagacctcctatggacagcaaaatccaacagtgctcaacacctttatataacatggtgtggtatttgcctataatctgtgtatatcctctcatatattaaaattgtttcatcagcaatggggaaaagactccctattcaataaatggtgctgggataacaggctatagatatacagaagaatgaaattcaagatggattaaagacaatccatcttggagttcatttttctgtatggtgattcctatacagaaaaatacctatcaccatacagaaaaatcaactcaagatggattaaagacttaatgtaagacttcaaactataaaaatcctagaagaaaacctagaaaatatccttcccattctaggccttggtaaagaatgtatgcttaagtcttcaaaaggaattgcaacaaaagcaaaaattgacaagagggacctaattaaacctgcataattaaagagcttcggcatagcaaaagaaacaaacaagggagtaaacaggcaactacagtctggaatcttcaggaatgagcccagcaaggccagagttcatgggggaaaaattttcaacataaacgtaaaagagtgactaaatcaatcaagggtaagaagtgaagattcaagtacaaagcagagggcagcaaaccaggtacaaaggaatctgtcacctatgcagtgagcataacccaacaggtagtttctcaaatcagagacccaaccagtaaccaaggtaaaagagggactaaatcaatcaacgaaaaaaaagtcaagatgcaagttcaaggcagaggtcaggaaacggaactccacatggacacagaatggtctactcatggcgcagccaaggggaggggcaggcagccgtcagggaaaagtactcaaaaaggcaacacttaccgaatgactgaaatttggagtcatggatttcagcagggatttgcagtgaaagaaacaggcatatagagactaagttcccaataaacgttacaattcatcctttcactctcctcttgaaatgggatgtattgtgaatgtattgagctaaattatcctgcatggctttggccagctatcccattctctggtgagtgtttattttcaaagagttagatgagtgaagagcggagaatggtaatgtaaccaatctgatgccttgttagaaaatcttccctcatgataccagaatgctttggtgtgaaagactggttcctgctggaatagtttcttttttaagactaatgcacaaaaatgcatattctgcctatgtttcttcccatgatgtgtattcatttagtgcgtaaggaattatttcttttcttccttgttcgcctcagtcctagtgcccagctcagtatcttgcatttgctgctagttgatgacactgaatttgcagcaaaatgaaatagaccttcttcaattggtctggtctgtttgtcactgagtatatgtgtcattgctgtgacagtaacctggctgatgaatgaaatttactggactatgaacagtaataagatattcctgaagccctggtttctcactttgctatcttaaaccaaagctattaaactcttcaaataagcatgctttattcagtaattcatagacttcaattaaatttggagcagcagagaactctgaacattcccattgatgccacagtggtatggccagagctaggctcaactgctccaaaatcgtcagccaaatacctcagtctcccaagccaaaatttgacatagactatgcttctccggccttatttcattactcaaaataagatgattgaaaaatgtatgaagcttacagtagaatactagtgggcacaagagaggagatgtaaatattcaggtaaaactcaataagttcagaaaaagattttcagcagatgcaaattaattggaaaaaatgtcagatgataaatctttgctttaccactttgcagtctgggtttgacaaggacataatctctaaaaaggaaggattttcaaaagaatcaacagaacattaaaggtatagagaattcagacactaattcaatcatacataatcttatctaacagttaatacactttctaagatgacgtaccagttggaggataagatgcaaaggatgaaaaagataaaagtagatttaatgcaatgttttacaggtaaaacattggttttggtttgaataacgaccttttactcttaccactttggacaacataggaggcagaattctatgataatccccaaaattccagccccctaatatacatgtcctatgtaagtaaccctctcgccttgagtgcaggtggcacctgtaaaaatgatcagatatcctcctattaggaggttatattaaataccaaagataaaggatttttgtagatgtgcaaaaggtcagaaatcggttgattttgaattaatccaaaaggagataccctgggtcggcctgacccaatcagagaagctcccatagaaaaacagtccagatcttgtggaaacgaagatacggagatagagcttccgaccgctttgaagatgtgaactatcatgctgagagtcccacgtgtcagggcattgcaggagcctcaaggagctgaaagcaaccatggctgacagccagcaagaaagctaggacttcagtcctacaacttcagggaatgaattctgccaacaatcatgtcagtgtgaaaaatgaatcccaaactgcagaaaggaacatggcccaattaatgcgttgatccatccttgtgagaccctgagtggaggatgcagttaagcactgctcacaatgtctgcgggtcagacctgaggaaatgcgggacctgactcacagaaattgtgagatcataaatgggtgtcgtttaaagccactgcactagtagtaatttattacacagcaaaaaatgactaatacgtgtggctggtttacttcacctcactgttagttttcttttttttaattttattttattattattatactttaagttttagggtacatgtgcacaatgtgcaggttagttacatatgtcatatgtatacatgtgccatgctggtgtgctgcacccattaactcatcatttagcattaggtatttctcctaatgctatccctcccccctccccccaccgcacaatagtccccagagtgtgatgttccccttcctgcgtccatgtgatctcattgttcaattcccacctatgagtgagaacatgcggtgtttggttttttgtccttgcgatagtttactgagaatgatgatttccaatttcatacatgtccctacaaaggacatgaactcatcattttttatggctgcacagtattccatggtgtatatgtgccacattttcttaatccagtctatcattgttggacatttgggttggttccaagtctttgatattgtgaatagaagaccataataggagggcactttaagaatttcatgtgattgacactcttggcatgtagctagcatgtaataaaagctcagtagaggcagttaatcataataatagtgctgctaatagcactattagtagcagcagtataaactgcagtaattgtgacaggctggaactcctagatatgcttgtaaacaaaattaaattgggatgaagaattctacaggctggtatttgactaaattaaatcaatgcttgattaaatctattgacatctatacgtatgtgtatattggcttattccaaatagacacgtgacacacacacacacacacacacacacacacacacacacacacacacacaaacataatgctccagaaacagcacagtatacctttctacaaatacactacacattttcctacctttgtatctctttcttatgtcctggtttttccccctgaaatgtcattcccacagctctacctgtaaaatttgttgacttttcattgcctacctaggatattgtgtattaacaatgttccaagagctgttgttgtcgttttgtaatatgagataggaatcatatgagataaatattactattattccaatgtatccctttttaaaggacagggaatgaaggactacaaagactgatttggctgtgttcgtggtgtggtgtcagcatctgaaattagtcactcaagctcctggttgtgccttccaccaccacaataagctttgagtcgatggcccctcatagatactcctccataccccaaaaagatttttttttccttttcttatctcttaacgatattttatttgacttagtagggtttaagctaagaccaagctgagctatatttggcatatagatacactgagtttacagaactgcctaacaatgttctggtcaacaatggactgcatatacagtggtagttttataacattacaatacggtatttttactgtactttttctatgtttagatacacaaaaacttgccaatgtcttataatttcctgtagtattcagtccattcacgtgctgtacaggtttgcagcctaagagcaacagctgtaccatgtagcctaggtgtgtgcgaggctataccatgcaggtctgtgtaagtccactccatgatgttcacacaatgccaagatcacctaacggtggactactcagaatgcatccccctcaaaaagtgacccaagactgaatttacatccactaatgtgcatgtggggaaggacaagttggagaaaaagcttgatgcgtgccgtcatttatactttcccagttggaggagagaagccaatcaaagggaattaacagagaggctgcaggccttctggaaggaatctatcttgagggaagtaggcctggggaattggatgctgctgcatcctctttctgggcacggacccaccctgacccagccactctagtattatacgccctagggagaaaatcatggcaaaaaattaaggttgttgctgcaatccccagggcccaagccatcttgctctgagctgctataagagttttacacagtgcaaagccattttctgatcaaattttataaaaaaccatactcatctgagatgccctgggttagtggtacccgaaactcctggtgttcttgggagagacaggcctgttgtcttggttcattttctgtggttataacagtatacctgagactgggtaatttatcaagaaaacatttatgtagctcacagttcttgaggctgggaagtccaagattgggcagccctgtctgggctgcatcataacatggtagacagcaacacgtggtgagagcacatctatgagtgagcaggtgcaaaagacaaaacacaaagagtgaccgaactttataacaacctgctctcatagtaactaatacagtccctcaaaagtaagaacccactcttgtcagatggcattaatccatccatgactgtaaataccttatgacccaagcacctcccgaagttcccaccacctttaaaccaacacacctacattggtgaccaagactcaacaggagcttctgtgagaagaaaccatattcaaaccatagcacctgttgaacttgagaaattcaggcttacatgttattgtggtctatttttaaagctgagagatcgggataccttctttcatctctttggtatcttcagaagtttgaaaagtatttctaagttaatctaaccttctttttcatactaacctgacactgatgtggccaaagagacctggagaacctgagatctctgctgtgcacatctccccaacactatgcaccttggagctcctcatctctgcaccctccatggagccaactccaatgctgtacacacagcagaggcttaataaatgtgctttgaccaaagattttgttgtatcaacccacagtaacaaaattgacagtagatgtagctgatgtgtttaacttcagaaaacatatatggggaaatctcatataaaaggacaatgtggatttacctgggaaatagttattaactaatgtaaactgctggctacagaaaatgactgctgttaatgtagggctgtatatatatatatatatatacttttgttatatatttatacttctattattttattattttatttcctaaacatatatgtttaggaaaccatatgtatatacaaatggaaagagttggaagcaatgatcccccaggggaatctattgcatacaggtagggagaaggcatcaataagtttaataataataataataataataataataataataaaattagatcaaactgggcaggttagaaagaacttaaggagaaagagtcagtgcttaccctaagaaagaaaagactcataaaaaaagagagactgagaaaagcagaaaaataagaatcagggctatgcgctttgagacagacaggcagacaagacagaggcagagacagatacagagagagagagagagacacgcaggcaccagaaaggagagagtgctcccctccaaggctgcgctgcaccccttcctgggtgctgtggataggggccctagggctcctccttccacaatggcactgtaatgggaaaggcccacaacaagcatgaaaccagtcctcacgagcagagccatgtgggtcaaattactgcaatttgggagaaattctgcaaagacatttgggagggatttgtgcaggaggaacaccaagaattttgtttgtttgtttgtttgtttgtagagagagccttgctctgttgccaggctggagtgcagtgctgcaatcttggcttactgcaatctccgcctcctgggttcaagcgattctcctgtcccagcctcccgagtagctgggactacaggcgcctgctaccacgcccagctattttttgtatttttagtagagacggggtttcaccgtgttggtcaggctgatctcaatcttttgaagtcgtgaactgcccgaagactccatgagtataacaagattaacttgagcctaagaattcctaggcatgggcagctcgctgcttcagccactggctcaggccaaatcagttcttcaaaatcagtcatggctccagtcccctccttggtatatgctgctacttatgaggaaatcctaatcctgagcacagaagttcattctcttgctgcgctaatgatccggccagaaagtgctgacagccggctggctgcctggctggctctcctgcaaatgcacagtcttcttgtcatacagcaggaggagcacaatggataaccagtgtatatatctacatttaactttacgtaactatcctagtatacgtatgggacttgcatacagtcttccgcatatgtacatctttacgtagttggtatgatttctctgtaataaagtccaaattttagtgtgtgtgttaattctcttaacatccacaccctttactcattgactattgcattcatttttagctatgcaacactttgaaaataagggtttttttcccccaccttaatgtaataaaccaaaccactgcaaattttatcttgcttttcattatctggaataatttagctactttttttttctctctctaccctttatatctatatccattagaacacagttcctgaaaatcatggtttttgaaaacccaaaacatatccaattatagtttaaatgtaagagactctctcaatgatcaataaatctgacacccacaaacacttgttttactttagaaatggcgcaaatatgtgagtcccaaattatgaaattatggtgttgattttcactttgtgcttgacctctacctgaaggtacaaagctgaggtctaatttgacattaattaatcttactctcttcccctcactcttaaacttgaaaaacatagtagggaaaaatgcactagccttctaccattcttatgccctatgtgacataaaaacaaaagtgaagttagctacttagtcaaagctggcaaatgcattctcaccatccctagtgtccatacagaaaacgtgcatgccttctggacagaaaacactaaggttgtgttcctctattgaaatttgggggaagtccaaaaagatggacaaaggatgttgtattttaaaaaccagtagttccattaaaaaaaaaaaaaaaacttaactacttagtgacctgagtgacatcaatgtgttcttgtgagggctattttctcatgtttggtggtgaatgtgcagacacaatgtttatcgtagagagaattctccaaatagaaggtgtagaaacctcactacgctgagctcattcaaggacctgggcataaagcaaattacaagagggattgaaccacgtaataagagagaagcctttagtctttatttctactgaagcaggtatgctttagagagacgtgtttcaactgaaatgcacaaaccacaaaatcactaaattcaaaattcaaaagagaaattcatcataagggctgtggaattgacttcttagagtatattttgtggaaaatagaaatctggagcactacattttagatgcaaagcataagtgggtccccgatgttacagttggtcaaccacacgtacagacagggactagagactcttctctccaccttcaaaaatgacaaatattggtaatgagagtcccagaactaatcctttcctgtataaatgtgaatgctcatttaaaatttgaaaaataaagttatgattcattaaaatgaaaaacaagaaatttaggggaaaaagttcttagtccattgatcactcatctcactttgctgaaagatcgttaaatggtttgaaattaatgtctgataaatatgtgagctgattgaagttataaatatcttcaaacagctattcaaagcttattaaaaatcttcactttaatgaggcgaaaacatgaaaattgactctacctaatgcctagcagagtccaatattgcactttacatattggtttacaaacattatttccaggtgtctttaaatagagctccaatcttgcactgttctgatttttcaaaatccttccagatatttggactcaagtaccatcactaagaatagaacccacagtaacatcagcctagccacaagcttccacatgcaccaccagtagctgctgctttgcggtgttgtatgctggatcttttgtacacctctaaatgatggaaggtaccacagcgcaatctatgggaccacttctgttttctatccaaactcgctgctcaagtgatcttctcagtcctatggcttacgtatctaccctttgctttttgctaaatttatgtttccagctttgagctgcagatttgtacagcaaattgtctccctgactcatctgccttgccatctctaaattactatgcccaaattagaatccctgattgttcttcaacaaaacctgcttctgcctagtctcccccatcccaacaaaaacacccccagtcacccaggtgttcaagtaactgtgattcatccttaatttctctatttccatcatattcagcttctaatccatcaacagatactgtaggttttatcatcaagatcactccagaatgagaccacctctcaccaccttcagaatgacacaagcgtcacccacgcaagcacctgctcttacctggaatccattacctgcatccatttcagcctgcctgagccatttctccaacagaggctgggcttttcttttagaaacatgaattagagcccattattcctttgctcagcacctgctgatggctacctatgcatattctttacacacatctgcccctgcccctctcccagatcaccagttcattcccagatccagccactctacatctacatacaccaaactcaatatctgccctcggccttggcacttgccattccctcttcctttccactgttcctctcaacattgcacagctagttccctcaatctatccagcactcgacttagagaagcctttcagaaatagtctgtttttgtacaaacgaccaatacctgtatcctttcgatctgtttgacatttctgtatggactcataactagctcaaattatatagcaaattaatttaattacttgcttactggccatctttcccactataaggtcagctccatgaggctaggaatcctgcctgttgttttcaccattacatctgagtacttagaaccactccgccacagagcctgcactccgtaaactttcctttattgaaggaaacataattgaatgtgcatcccttttcacagcctgggtaccagacaattcttatattctattattgtaaaggtaaactgaagtgcaaataaacataactttgaatagcaaggttgtaggttgaaatcaagtagtcattacatatgtatatatgcatgagcatatcttactgaagcaatttttatattattggcctatatggagccagtgaatactcaaattaactgtaagtgtgtctatctgttggcatgagccaagaagtatgacaacagtgacggttcacagagcaggatgtagctggctgcatttgctgtataccaagccagctccttggctagaagcaagtgggaagaagcacaccctctttgaaataatcctgcaagaggcaagctgggcttgaagtctgggaggatccaggggaagagtgaagaggaaggcactcagctgataaccaacttcctcacttgctccacttatatttagtgattgctctgatcacaatttgaataatgctcaccagagactgttagtcagaacaatgtgtcccctaggactgatctactgacttcaatttcatgttctaatacagaacagcatacataacttgaagataggaatctacacaactgtgaacaatagaggagggtcacagaaatctaataacagcctggagagaatcccattcttgctttgctgtcatgccaatgaattgcattctacaagaaactctgttaattgactgctcctatcttgcaccaggcaaaccaagtcacagtgaagagaaggtatccatggctctttaaagcagtactttataaaaattctatgcatgcccatctgaaaataacttaaaatctctgttgtagctttctgatcttctttctatctcataaaaaatatttcaaagtaacatcgtgggttcagacacctgtctccccaatgtgatgtaaattcattggactgatggttcctgtacgacaaatgctggaggtgctgaaggcattccatagatagcttatcagctttctcagaaattaagaggaaattcgctcctcactggaaacctcagataaatatgcctccctctctctctccttttcctttctccctctccttctctctctcctctaaactcagttagtttccaaagaaaatatttcagagagctgagagatcctccctaatacagaagccaaccctcctgatcaccctccatgtaaactgaaatactaacatttctcaatgtttataaagaaaatttactttctgaaagggaaaaccaaatttattgtcccagtgttataaatagtgtttgtaattacaaattgatttcagagaatgtgaagttcagttatgcctaaatagataagcatactttttaaatgggtaagaagtcattgggaaaaaatttaacagtggtgttccctaactccccaaaatctcttcagatgaggaactgcattttatttatactgagaactgcaacaaagtgataaggtgtgagagggaatcctggaaagacagagcagacagtatcagctgcctgctggatctgtatctaggacagtgaaatatcacaatttgatcatttgggaaaataacagccatacacatagcacggtcctaggaaaatcatacttgtgtggtaatcccattcaataggttaataccgaatatgctgaggttttggtattgtgaaattagagagttacctattcattcccaaatcaggaagcctaatttaaccacctgatccgctgtcccaaatgattaactacatcccagagagagaaaaatatatatgaattaaacaaggcaatctctcccagagaagacagaaggaaaactaaggaaatgcagtgctctgtaatttctctggccccacctcactaataagggcctggctgggttaaggctgctgtgtccacagtatcatagtgtcatcacctgtcacctagagatgggggtctgtcactgtgaccacttccataccccttaacctctcagggaggttaatttcacagcccttggaaagccaatttctaacatagtgtcagaataaggtatcactttcccagaacagggagagaggctttatctcaagattatgcgaaacgaggggtatgtagggtatgagcagccacatagggatttggctagcctgacaatttctgcatctcctgactcctattttctgagcctagctcacggcactgttgctgacctgcagtgcctgttgaaggctatgtgctcagggcctttgcagctcccctcccatgcctggctactgtccccttcttctgcaggggctgccttcctttcctttgcaggggtaaaaggatgatgaccaggagaaaggcgacctttcctcctcactccccaactcctgggggttcatccccatcttcctcactaaatatagctcagtttatcaaatggccagttgaatgtcagggaaaatggacccttttcctcagaagtggtggattaattgcttttcctttcacttttctgaggataggcatataatggagcagccgcttggtatgaaatcattgatttgcctcaaggttgagattaagccagtcacttcaaacattttaatattagcaaaaggctttgtgtgattttttcttctctctgctgtgactttattcaaggtctttagatcacaggggctttgacaagtttgtcagtgatcaggggctgccttaatcaagtaagaaaaaaaatcccgccaagacctcctatgcatttatatgttacaggactgtttaatgccagtatctgcacaaagcgtggtgtgtaaactacaggctttagaggatattaattaatacagattggagaatttctgatgcagctcattaacagagatcaatatttaaaacttatgtttgggtaaaaaaaaaagtcatggtaaataattgagtaaaagaggaaatacacaccagcataaaagtgtgtttatttattttgcacaaatatcaccatgagcactaatgaacaactatatttccttacagtaaaataataccacatggagacttctaaaagaaacccattgatagagtcctatagtcacccttgtgtacaaaaagtcatgtgaatactgcaaaaagaggcacatcttgtcatttcaatattaactctccaagaggtttttaaaacatctccaatatctatatgtaaaggttattcattaatattggctattatttggatgtgaatcctagaaaaaatatagacatttttaaagcaaagcatatgcaagtatttctatatgatacattaaggaatgtattgactgaaaatacaccaagataatgcatatctcgtaattcagattgaaggaacttattctaaggaaatgctatacaaatatgcacatacaagatgttcactgatgcagtgtcacaaatgcaaaaacctggattaaaaactaatagcctcagttatgttaatggaaagtgaaatactgtgaagccattaaaatgactctaatatctgaggagaaaaaacctcctcctcattttatagacaaagatggtcaattaaaaaataattaacgaaaaaattttccacttttggggaagccattttattgaatacactcacttatttaaacattcaagaaatactggacgtgtccgccagatttcatgtggttagaaacttcatccccaagctcatatattaattttaagtggggcatttgggaggtaactaggattagatgaggtcatcgcagaggggacaccctgataggactggtggtttcataggaagagaaggagatacgaatggacatgcatgctcttgtcctctaaccatgtgaggcagcaagaaggccctcaccagatgccggtggcatgctcttggactttccagcttctagaagcatgagcccaataaacttattttattaacagattatccagactgtggtattctattatagcaacagaaaatggactaagacatatactgaagagttgatgacaaaaataaatatgtgattttgacacattctatgaggaaaagaaaaagatgcagctcagaatcatagtattgaacctaacataggatgggggaaaaaagcagagaatgtgttgttaggatactatgggaaagtgagaacaggtacacgacaatttgcaactaagaatgttttggactcagagggagaatgcccctggcatcatgtcaaggctgggccacactgagttggggcagaggtggggagacagaactgaggaaaagtggagccaggccccagtgagctggctttaggattctgaattttgatttatttcagttcagtttatatactaaaaggtttgattcagttggttcattgaaaagatttaccagggaagaaatgacacaagtcatatgttttaatttagttatataacataatatagagttgtccctgaggatctgaggagggttggttccaggatgcccatggatacgacggtctgcagacactcaagtccttgatataaaatgacagagtatttgcatatagcctacacacatcctactgtatactttaaatcatctctagatgacttgtaatacctatgacaaggtaagagctgtgctaatacttttcatatttattttaaaatttgcattatgttttatatttattgttattttttactgcttttccaccaagtattttttatggattggttgaatctgcagatgcagaaccaagaatagagggcagactgtggtgacagacaccgtctgtgttatcacttgaagagctgtcctgtgggagaaatgacagcatgacaaacaggctatgtggacttcagcacatcggcacaatgtgcctccagttttttcatctggaaaaacaactggcagtgggtggtaagtgatattaatgtcccttccagttccaagtgcagtttagtgctttgggaatagtattcagagattctcttatggcagtgacatttttaccagtgttaggtgaataaaatataactttatgaaaaaaatggtataaaaggattagtatgttatttttcttatacaaaggaaactagctgaatgagaggcttaagggatatttgtcttttattatgtgaggtttttttgaaatttaaaatatgaagaaccaaaacttaccactaaatcctactgtccagattgcttttaaaagttctactgtgagaggtaaactgggaatctgagtgtgtttccagttgtgtaataattacattgccttattgttttttagccaggtaatattcttatctggaggcgatgtttaatattgtttgaatatctatgtgacttgcagcactatcataaatgagtcttacgacatgcctccgtcattctgatattgtggacaaatgatgttatagctatctacgaacattacatataaagaatgcatattgtcaagattgaattttacctgaggtctgagcccctggaaaacaatgaaaattaaagaaatactcctcatggccgggcgcagtggctgaagcctctaatcccagcactttgggaggccaaggcaggtggatcatgaggtcaggagttcgagactagcctggccaacatggcgaaaccctgtctctactaaaaaaatacaaaaactagcgcggtggctggtgcctgtaatcccagctactcggaaggctgaggcaggagaactgcttgaagccgggaggtggaggttgcagggagccgagattgcaccattgcactctagcctgggtgacagagcaagactctgtctcaaagaaagaaagaaagaaagagagagagagggagggaggaaaggagggaggaaagaaagaaaaagacggaaagaaagagagagaaagaaagaaagaaggaaaggaaggaaggaaggaaggaaggaaggaaggaaggaaggaaggaaggaagaaaggaagaaagaaagaaagaaagaaagaaagaaagaaagaaagaaagaaagaaagaaagaaagaaagaaactcctcacccttcagtgtgatcaaaaacagcttactgccaggtccccctttccccatatgaattagatgtgtcacctaacactggtaaaaatgtaactgctataagtgaatctctgaataatattctcaaagcactaaactgcacttggaactggaagggacattaatatcacttgtacccgttgactacataggacaaggccagacttccaattcctatcctttgcctcaacaatgattagctggattgcttgtccctactgatgaatcagaaatgcttattggttaaatttggtgaaggttctctctatcctcagaaccctgacctcaaccccagccagcagagagcctctcctgagaagaagctggccctagggtaaaaccctctctcatttactatcccatatgtctttcttccaccccactcctccacaccagttcttactagcttgtttattcccctgtataaaagaaagcccaagcttggtgtggtggctcacgcctgtatcctagcactttgggaggccgagatgggccgatcactggaggtcaggagtttgaaaccagcctggccaacatggtgaaactccatctctactaaaaatacaaaaaaaaaaaaaattaactgggcatgatggcacatgactgtaatcccagctactcaggaggctaaggcaggagcatcgcttgaacctgggacgcagaggttgcagtgagccgagattgcaccattgcactccgcctgggtgacaagagagaaactccatttcgaaaaaagaaagaaagagagagagagggacagagagagagagaaagaaaggagaggaaggaaggaaagagagagaaagaatgggagagagagagagagaaggagggaaggaaggaaggaaggagagagaaagaagaaagaaaagaaaagaaaagaaaagccccttttgcctaacccttgagatgcctgcagatcttatggtcagagcattcttctattgcacccatcctcctcccactattcgaatagcccatccctaagcccctgcaataatcctttctaataacgtctactcttactaaattgagatttattttttatttgacagggtttttaatgagaaatgctttttacgaggttagaatagttctggtggttgttccttagtctctcatcacatctcctttatgacttggaaagataaatttagcatggaaaaaaatgtgattattagaaaacaaaaagaattttaaatcatgaaagaaatttatgcaaacaatagggcaagacctagtacataaaaagagtcagtgaagcgaataaaaacaacaacaaaacagcaccaccaccaccacttaaccacaaagtgaaacaatttacataatgatttcttgcttttcttcttcatattattgaaagtttctttgttcatgttatctccagtggtctgttaaatgtttgcaatgcctcagtgctcctctgaacaactttgttaggaatgagaagtgctctacctatcaacaacaaaggcagccgaatggctagaaataagtttgttgaaaatacttcttgggttctgccttacctgtcaatcacaaaaagaaggtggagaaaggaggcatgcttatggcatcccagttttaaggaagaacattttagcaataagcaagcagtcaccaaaaggattcaaaaaggcagtgggtttagggtgctttgtttcactgtgaacatgaactgtcataaatgcatatctgatattttaatatcagatatttggttaaaaaaaaaaaagtgaggtaggagggtgcatttcattatctctcccagatacgtactggccatctggtgggaaagaaaacaggcagtctcagtccagggaccagaggatctcctttgtccctgtacatacacgcaagaacgcacatattacattatccaggtagagagcacgtggtaggttacaaagaagccatgaggaagaaataggaaacctgaattgtagttgcactcctctcaatatcctcatcagcaaaatgaatgagttgttaataattacaattgtaccaactgtcatactttgccatatggcttgtatatgtgtttggtattttaaatctataacatacagtcatgtgccccatctgcatcaatcatggcatgtgtatatggtggtattttgtattttaccctactttttaatgtttagatacaaaaatactctccattgtgttacagttgcctgcagtattcagtacagaaacatgctgcatgggtttgttgtctaggggcaataggctacaccgtacagcccaggtgtgcagtaggctataccatctagatttgtgtaagtatactctatgttgtttgcacaacaagaagattgtctaaccatgtgtttttcagaagtatgttgtcattaagtgacacgtgactatacataaatatgttaatagcttgtaatgaagacataagctctaattctgatcaagcctagacaaagcaacttacatacataattcttaaaataaaaacccaaggaagacgttagtattccttgtttctggaaaaggagccaagaccctgggagttaagtggccttctatgaggccagatgactgggccaggacccactacctggctgaccccaaagttcacccttttattcattctgctgcattggttgtgacctagaatattctgttgtttttctggtttagagaaacagaaagaagactcagagtagactctgaaatgtccactccccacacattgcccagagccactggaggtacaatgtgccaggcacagctgtgtgggcagcaaggcacgtggagcaggaagcaaaggatgatgccgaggcacgggccacgtgtgcagtgcccgaagggggtctcctctggtcgtggctgtgcaccagtgacagaagggtttacttactatgatactggagaccaccatgatcactgacatttccttaatgatgcacaaaatgaagcgcacaagtatccaacaaatgaccagagaaaacgctagcatacttctctgaatgtacacttcagagaaggagggaaatgcttaaatgtaatattttagataaatcactgaatacaattagtatagtaagtacactatggatttgatggtatgtagtaatacgtctctatggcaagctcatctcctggaaaactggaactacatttgtccacaagcctttctcactgagcaggaacacagcttgcaggttggccgactcatctccccagattttattttctattttatctatatttttcctggctctaatttgtttctgttttgttacattttatagattcctacaaacctctttaactattttgtaatgcaagatatttgagcataaatccctaaaagacatattattttatgatgtaaaggtttcattttttccattttatagatgattaaatagaggcccggcatggttaagcggcaagcccagagtcagccatccaacgcagcgcagagctgtgatacaacccacttccactcccacggcatctcggcttcgtgggagttgaggagcgtctcaactgcatgtcaggagaacccatgaaaaggaaagaacccagaacaaatgggtgagaaagttcaagactatgttcagcgtaagagcaaaagcctcctgagaattctgcttgcagcccattcccaggcattacagtgcaaagctaattagggagaatggcatgagtagaagaccaccaagaccaccagctgaaacgggtgttctcatggcctccagtgggctcgactatttttatatttttaatattttggtccaatcactactctatacaacttagctgtcttaaaacaataaagccaaaacaaaaataaaacaataacccaggcctcccagatgttggcttcagtctgtgttcacaagttatcttcctaatataacagcatgagtactacttccccatactgttctcatgagatctatggccaggtccaaggtcacatcatagtaaatctttatgaaggttaagaaatttataacatttgcatttgttcacgaatgtcaataatcccaaccggcaggttttacgctcaggtttgaatgacactttgctaaccaagccattaaggtttgtttcaaggagtcgggggaagctccccagcagctctgagcaaatgaggagccagagaaaaacaattaaaaattttttaaaataagatctttgaaagtatattattaattctatcatccaataagtgttttcgaagactatgcaaatgacatcttgcggtataaaagctgttacagaacagaccttccaacatttctcagtctccttctttccttcccacgcatgccctatgtgtggactggcagcaatgtttttacttttaagaggaatttcatcatttgggaaaaatttagagatattaacgaaaaattgctatgtgtctcatggctacctactgattagaagcaattaacttatttctattttgaaaaattaggctagcaaatgaagcctgtgggagaagcatatttaataaatatagaaatattaattgtaggaagtaacaataacaccatgcaaagttgtcctgtacattgaaaaatcatactgattgtttacctccttattcacagcaagggaatcaagaccatagaagtcaacctgtagctgtataattgcgtccaaatcccagtgaagagtaaatgctaaagcattagggtgaacccattaaaactgagaaaagagagggaaataaatcaatacttaagagtagagttacctaccaaagtaccattcagttcaacacatttggaggcctctttttcatatatgatgagttttcactcatatacactgataaaaaggtgaagcataaaacatctagaatgatgttttgaagaaggtgaaagaatcactgtggtgaagactatagaactgccctgcctccatctctcctaggcactttagccattttactctaaagcagatttggagttgactttttaaatttcctttcaatgttagaaatttaaattagaaaatgtatgttaaagttgattaaaacttaacaagttattctgacccattttcctcttctactgcaattctgtctaatgtcttttatgatgcctttacaattactgttatcatcatcattattattttagtctatcatgtaggaaaatataactggattttgatttccttaagaggttttctacattatttagatttgtgaaagaatgttattgtaagtaaatagcaccaaatcttaaggatacaatatataactgctaacgcaaacagtatttgagaaatgcatctagatattcattactttattaaaaaagacatagaattggcataataaattgctagataaagcaattgagtaaagtgtaatgagttcaagtagagataagatcattttatggagataaatgaattagagaggttgtgattgagaagtgagaagtggttaaagtgttttaagacaaattataatatctaggtcttatccctacttatattgataggcatgatttggtgggaaaaaaagaaacattgtcactttaagtatttccctatcctaaatgaaagctactttattcaagagtataagctaccctaagtttctttattttaaactttgaatgcttcatcacacaaatgtttatattttaatagaaatgtattatgtctgatgatatccaacatatatatacaggctattgaattctatatgtagtaataatcatgaaactcagtgttttctcaattatatcagcaaattctctaacacagatatgccaggttttcttcaactttgatgaagtcactttagttctagtaaagtagaattccttctagaaggaatttaaaagaagctgaatttcctggcttccccccacccccaacaagcacctatataatttatcagtccatatttcaaactactttatttattcaattacaacacattccatggataattctaaaataaactcccacatttaaaattaaggagccacaaaagacacttttaaaataagaaattgcataaagagagaagaaaaaataaaatttttcacaacctacaaattaccaccaagttttacattgagtttgacattcctggtattcagagcaaaatatggacacaaagactcatgcacacactgggtgacctcatttcactgttgtatgtgtgattcctcattctaagtatagaatccaggaggtgcgggtccctttgtccccaccaggaaaatgcagttttccacagtgttaaggttggttacctttttccaatggcagaaaatgcaggccagaaactgagaaagttgctcagttcatacagaaagcagactgcctaacatgaacctcttagtagtcagagcgacatatgctattgaagtaatgtgttcctttattttctaaatggatccttcccaagtaaaatgtacctaagtacataaaccatttagtgggaatacatacacaaagagttgcctcctagatgtaaatgcctcttgaacaacaatcaactattaactcatgcaaaaatattttgataacattttcacaattatctgctaaattaaaggaaactactcacagcaacaaatgccatcaacatctggcagtgaaacaactttgaggtacatctggacaaaaatgactcatgtctaccctcacctgttgcaggctttacacctacagagaggcagctcctctttgccccaacatatttagtttctggactgcattttcgccttctgttgcaaaatggcaatcaaccttattaccgtagaaaactgcatcttcatggtaaggacaaaggggtctgtacattctggaattatattcaacacttacatttacatgaaagagccttgaaaacaatagaataattagacatgtttgtgagataattatgtcatgtaatgatgcctattacccaaagagctgttggttccttaaaaaaaaaaaaacatttatcagccaatcttgcagacttgtaggatctgaagaacagcactgttctcatcagagctaaaagcatatgctatgaatggggtcctccacatggcaatgaccgcaataaattaccagtgtgtgttctgttttcttgagatgggctcaatttatcattttattgaaaaggttccattatgctaatgtcttacaaaatcacattctgctgttgctggaaggtcatgaggggatataaatttttgcatttagaactaagaagttgtatagcagtcacagactccaagggttaataagaagccatcaaattacattcaaggacttatcaatgacagctcttcagcatgctctcctagttaacaaaagagaaaaaggggaatattgttccaagcttaacatcacacacacaaaaatgcttcaagtataaacgtattaaaacttggttttaacacaggttgatcatttgaaaaaaaagtcattgaaattttatctgtcagtgtgaagtatcagtataacaggtacatttaatacgagtttaatagaggtttctagtacatagtactcagtttgtttaaattagctactatcttcaaagactttcaaagataagtttgctgaagatctacaaagaatgcaaaaattaatatgcatattttagtgtaacctcattgtgtctataaggaggataatggagatttttgactagcatcaaatcccacatctcagtgagttcttagggaaaagaaagatgatgagctaattattcaatgcaaattagatattattccttagagaaatgttttgtttccatcttttcaagaattactgtttccttccaatcatgaaggactgtggatgtaattcacgaatatatggtgccatcaatctatcaataatttgcagttatgggcaacaactgtcaaacagctgagtaaaaacacataaaaccagatagctccctttggaccaattattgtaaaccatagaaacactgaggaaaaacagttgctctttagaaacacttggtatatacttggcatccaattttgtaatgcaacctaacaagcagaatgtaaacaacagtaactgcattgctagatttgtcattctgttttgtctggttcagcagctaagtggttacgaatattaacattctacaacatcagtgtaccttaaattcaagaggccattttgaatggatcactgattgcattttgatggaattcccagggaggtgatgagtaagaagccaggttgtggtctagggctgggcacattcaatcttattctgtattaaagtacagagatggagatacacaatatgctctttcctcacctggaactaatttgacagggaaaaaaaaagctttagaaatgggtctaagatagtttggaaacccaagttcacaaaattgtgtttaaaaatatataaaaggattatagaacttcttgacaaattcaaattattatataaagtttctcattgagtagctccaaacactgtcaaaattattttttctgtcagttatgtatgtcctgtcaacaggtatatgcattcacgccaaatgaacaggccatggaaagtagacatctctttatttgggaaaccattactcaaagattttaccaaaaaaataaaaaaagatttttggaagagcttggggtgaagtggttgtttttgcatcagggtatatggaattaatgttgattcttccaaatcatgatgactctaatgaatctaatcaagtacacataaacactttgatctaattcaaagaatatggaattttgaatcaaaagacagtggttccaatcttagcctcaatatcttttagctatgacagtttggccaacaatttcatctttactctcagttctccataaaagaaggaatgataattatggccctaagagataatgtaagtgtaaatgtttcacaaactgttagaagaaagggaaatacttattattctcttgagcgtaaaatattgtatctctctggtgatgtaatggttgcagggagcaaagtatatttaccaaaacattttacatattaaataggactattttagtttcattctcttaataatcaaaaaaaatttgaaacttagaattaaaccaaagagattactggtactctttcaatgcgatgtaggtttattatatgggctattttacaactcggtaggagcagtggttcacttttttccagtggaaatacaaagaatttctgtccagtggagcagacaacctcaaatattatggtttattgccctgtaaacacttgacaagatttgtatctagtctagcaatcttatgctaacatctctttattaaattgcatatttacctatctataatcaagacactaatttttccaaagccttttgaaccaatttatacagcttgctgcttctcacattaagtaataggttgaagaaaatttttgacacttgtacattttatatctaatataatatctaatataatataatataaaatagcaaaacagctattttaccttactggaaattataatttaatggttttagaggtcacgctcaaatggaccaaataaccttcatttccaggaagtttgcctcatggactaatatactaaggaatagttcctgaagtcagacagatcttgaaatctgcaaccggggttctccactttttcccctttttcttttctgaatttgtgtgtttggttttgcttggagcacagactcacaataatctatttccctttggtggtcacagtgattgggaattgccttgatagtctgactggcaatctctggacctggatgacacagctttattctttgttgaataagagacaacagagactatgtgtaagtcacttgtgtttacttatctcttggtgacctcagatcaattaaaaatcatatgcccactggggaggaaaacagctctttgaggtctggactaatacatttttgtgattctctatcttcttttgacgcatgactgaagttgtaggactgaagctataaattctctacatggctttgcgtctacatatctgtaattcacaaaagctgttgcctccgttgtgtgaaatgtttccctgcttgttgcaggctgaattacgtcaaaattcctatgttgaagctctaacccccagcacctcctaatccaactgtatttgattaattataatgaggtctttcgggtgagccctcatgcaatctgactactgtccttataggaagaggaaatttacacaccagacaagagggtatgtagaggaaaccccgtgagaggaaacggagaagacggccatctgtacaccaaagagacatgcctagaaagaaagcaaacctacaacaccttgatcttggacatttggcctccagaaccacaaaaaatagattttggttgttgaagaaaaataaataatgacatatacaaatggaataccggcaaaattcacagaaaataaagcaaactctgagtacttcaagtgttctagatttttagggaaaaatctcctcttatagaaactgcttgctcagaaatccaatcacatacatatggtgaatctttggacaatggaacagttttaataatttgggtttaagaaaggaaaaacttttctctcatttttcagtgttaaatatgtgataaggtttctattttacattttaacaggttggggtttggtttcccaggaaaagcgtacttaatccgaacttctcgtacttctcaaactatttttcaatcacaaaatcttgcattacagtgacataattttaaagttttttgaaaaatatacatttttagctgactaaatagaataataattctggcaagtttttctgtagtaggttcttatatctttatatataacttgcaaacatggattgatcttcagacagctaggtaatttgtattaaggctgaaaacaaaagcaatgataaacagacataatatttagtttacatatttttggccctttagttatacatactatagaatggctatatttttgagtcacattaattgttttagttttgctactttaggagcctgtagctctaaaaattgtactatatatatttatagctttgttagtctgctaaaatgtttgtgtttgacacacagctctcctattatgactttccagtttctttgtgaaatcaaagatcttattttgaatacaagttataatcggatttggtggctgagacttaaatagaagaaacagtaacagaaaaatacaacgatttatccaaagtaatgggatgagctttctttttcaagaatgaaaagaatagggtattttttccctaaagcaaagtgttgttttgtaccagtatatgaaatgacaccgtgaaagataaaacttgagagaacacagcaagttgtggaaaatttgagggaagtgaattttaactgcttttgtttataacacctatgtctgaaaagaagctataaaatatattaaaattcacctaattttgattggcttatttgtgagataaattaagggggaaaatgatctcataaaacctatatttccaatgcattaatgcaaaattaaaagtagtctttttcttagttgaattaataaattcatcttagaattcttaccaaggcatagtaaaaatactatttttcccttttgtgtgatatgaccagaaagcagagattttataacccaccagaataatctctgctttgtgttgattctagcatagtgttagaaaataaaaatctacaattatgaaaggcaaagtttcctcacttgtgaatgaaccaagattccctgcaatcatattacatttaccaacaattatttttgaacacttgttaatttgattaaatcgataattaaaggcacctaggattttattatagccaaacgaccaagtctactctgacaactactttaatttccccccagccccatgatcagatctaaaatttaaaaatatagaccataaaaattcaacaatatactttatacttaaaactggctttaaaatctcccacaggctccctggagagaggagctggaaagccttaggtttgtttcaagggttttgtatttcttaatcacctccccactacagaagagctatggaatgagctgtcaaatcagaaggacgctcagccttccctgggttcagtttgtgtacatgaaatgttatgcacagaaatctgttactaatcgaacattttatgggaagaccaaggagagtcatcagagcccatgctgtccattatatatatgttcttactctccggagaaacattgatcaaactcttataaaatagtcatacactgtgtcacaaagggttattttacactcgtcattctgatattgctggtcactgtagtaattaatccagccttttattagtatcaaactggtttctgtctccatctgatgcttgcctgagaactgtgctataaaccacaggcctggggttgtatcttcagcgtatactcctgtttccagacttctcagaaaggagtgtgccagatactctgaactactgatacttcaaagaatagactcttgggtactggcgttagagctgacatcagctcaacaactttcagactgtaccagggaatgaatcagaatttccaggacttattttagtctggaaatagatgttcttcatgaaactagcacctaacccaagatccaaaaaataacaattaattacacaagaacaaatgaactgatgagttaaattatggctacttattttgaatgtttttagtattgcatttaatgttaatttttatggatatatgaagttctctttcttcttcatcagtatcactttggatataatagactattgcttttgtatataattttttttttttttaagacagagtcttgctctgtcaccaggctggagtgcagtggcatgatctcggctcactgccacctccaccttccaggttcagtggattctcctgcctcagcctcccgagtacctgggactacaggtgcaccaccaccacacccagctaatttttgtatttttagtagagacgaggtttcaccatgttggccaggatggtctcgatctcttgacctcgtgatcagcccgccttggcctcccaaagggctgggattacaggcgtgagccaccagctgcttttgcatataaaatttaaaaaactgtaagtagtatctgatttttagcatccttcgaaaggcagaaagaaatacttttactgattctccttactttttcatgagaacatagttattaacataggttcaattaggatttgttctcatcttaccaggatacaattgaacaaattgattatgcaacaaaggatacacatggagaattatatatgagaataaatctcacttcatcaaacacagcggcacgctagtccggaaaactgacgagacacgtagctagtgcctacgaagcccagtggacaaatcaggtttactacctggctattagagtcctgttcctgagaacttcaagaagaaaggaattcatcccaatttatatatacagtgcaggcaaaatatggtggagagaatgtcttggaattgtttcccgagctttgagaaagaaaagcaaataataaaggcttttaaaagtcaaatctaagattccttaaaaaaaaatctcaggcagaattaattatctgggtcaaattatatggctatagatttgtaaagcaaactcaagcaggcctatctggttaattaacagtctcattggaactatgtaaaaaataaggccatgtttcatctggatgaaaatagcatttttctgtgattaaaacaaaacaaaacaaaacaaaacgaaacctttgtgggctaggtgcagtgtttaacgcctgtaatccagcactttgggaggccgaggcagagggatcaccttgaagtcaggagtttcagaccatcctggccaacaggtcgaaatcctgtctctactaaaaatacaaaagttagccgggcatggttgcaggcgcctgtactcccagctactccggaggctgaggcaggagaatcgcttgagcccaggacgcagaggttgcagtgagccgagatcacaccacaggactccagcctgggttacaacagagcaagactccgtctcaaaaacaaacaaatgaaaaccgttttgattatttataagggggggggcagggaatggagtgtaaaaaaatagccacaacttagaaatgggccaaatagacaactagatgtccttttggtgcagcgttgagcttgttttcctattggcagggagctgtaccactttgtagaggctgagataccttgtacatttttgtttggtaaagatttccatccagtgtaacagataaccccaaagtcaatggtttaatatcctcccatttatttatctctctcacacacacacacatgctagaaagaacttttcctttgatcctttgatgagtacacagaagtacagagagttgtataatgagtaaccatcccccagattcaattataaataatgtgtaactagctggttgtcccacttccactgatcctaagattgatcacatggcatcagccagattcccttcacttatatcaacccattcactttcatctaattgtttcatctatttatatctgttggcagaataaagtaggacttgcaaaatggtgaatatctaatttcgcaatgcatctccaattattgtctgaaacttctctgtaaagaaaaattttcctcaactactagggctatttggttaccttgaaatagaattcttacaggaaaagctagataaacccttattttatttttttaattatcaatttcctgagtttgattttagggctctagttatttccaggagtttctaatgtatttgggttttttagcaaaattatgacttgttaagtcttcaataacttttttgtcttagattacacttgttttcatcttggattatcccatcttgggacactgaatcttcattagcccctgtgtccttcaagtatgtcccttctgatttcataatctccactagctttcaaataagatagccacacaagatacacaaggttcatcttgcatatgatttgtcccaggcctaaaatcttctattcttcaatgattccttgtcttttttagttaaaaacagtattaagagaccacaatctgagtggccacaaacgtactcctagttaataggtttagatgaatgatccagacactctacctgaaaagaggggagagtgggaggatcaggagacaggaaaacactagtacatgaagtgttaaaactggctgctcatcagaatcacctgtgaaaccttcaacatagagattctcaggcctcaaccattatggaatatgatgatcaaaggggagcccaggttatgtaaaaggccctaaggaaatgaagtcactccggggcccactaggcgggagtgctgagttacagtctccaagcagccacatttccagaccttgggatccagtatattagatatgcttagcagttgaagaatttctttcttatcttaaatagtaatacatattcattctagaaagttcatataaaccaaatattcgaaataaaaataagtcacaatcccatcacaagaagaaactgctattaaatcttgcatctgcattttaatattcttctttatgtatgcacatgcataaacggggatatatatggttagttattttttatagagtaagatcacaaactactcagtaatttggaattgaattttgtcatgtggtgtctttccatgccattaaataatattctcaacatcatcttcaatggatccatagtgtttcattttatagaactgccaaacattcagaacctatggttgtacctcttgatagttttccattttttactaatataaacagtgttgaacatccttctagataatctactgtgtatatctgtaatataattttatcataaactctgagagtataaatgactaagtcaaaaggtcgaaattgcattttctcttgtgagaattctaaaataattccctatcagtttaaagtaagaaaagtctagggcacatgaaaagaactagaaatgaagaagcaagtgtgcataaagagggaaggaaacatgctgactcttatcttttagagctgtcacacattgaattttaatgtttggggaaataaccaatgtagctgttaggaagctgtgattcaaacatggtagcactaaacgatacatcactgtattgggggcaggtgcaacataaacctcccatggatatttgtcaggtgaagaattcaggaataaggtttgcctatctgtatatagaattttgaagtcagggtaccttctagtgttgactgcaatggttaagtcatctgtctgtctctgacaaaagagctagaccctgcttcaggaatgcaaacttctcccactgctatggtctgactgtttctgtccccaaataattcagatgttgaaacctaatcaccaatgtgatggcattcagacataagaaatttggaggtgattaggtcatgagtatggagccaccgtgaatgggatacgtgctcttacagaagatgccctggagagctgctgtgctccctccaccatgagagggcacggctggaaggcaccatctatgaaccagcaagcagccttcggctgacatcagctttaaaggtgccttgttctttcacttcccagcatctagaactggaagaaataaatatctgttgcttataagccactgactcattttgtattttgtcatagcagcccaaaggggctaagacacccacaattgggaatcttggatgagaatgaactatatttcccattttcaaaaagcttatcaatgagtgaataaacaaatgttgttttcattcatttaacacatattattaagttagtaagcatcaacaatgtgcccagcactgtgttaggtactgcaacagcccagagtgagaggaaatgcccctgcttcctggagcctgccttccagcgggcagcctaccacctgcgtgtgctattctggtggccaggacgctgttgtctacagtaacctggtaaattaactatgttaagagagtactttttctttcttcacagaaacaagaaaaattatttgccgtggagtccaagagaggagcatatctatcgaaatggtaattgaaagagaaactggaaacatcacctgtatgaaaaatagtggatggctctgttaacgaaacaggcatgctggtgacaacaggcaacaaatctaatctaatctaatctaatctaatctaatctaatctgtttctccataataagcagcaatcatacaacccactaaatgactgctgttgcttgtcactgaagatgtccatattttactgggacataacatttcttcttggcatgaagagaatggattaagcaaatgaataaaagctatggttctactttaccagcacaaatggacaaatccaaaataaataactgttacagcaactatgctaaccgtattaattaaaatatgcaaggtatactcattctcattttcataaaaggaaatcctaaacgctcaatttgaagtatgtttcctcactatttgtaggaacttctagtcctagaattcttggtccacctttccccaagattgtattcatttgttaaatatgagacaccaccaaaattgtaatgatgccacaatgggagagttaatgaagtaaaaaaatattaaatgagtcaactattattaaaaaagaggcaacttcatatccatcaattagaaatcaaagagtctggctggctatttatcatcaaaaatcttttattggtataaaaaagtccacacaataagcagctttttaaaataaccactcaggccagagtatcactcaccaagctgtgactttatgttctttgtaacaataaagaaattacatggcaaacaacaatctgtgaaaactttcaaatcatactttcctaagctatcgctctagattaaaatgtttgccttagttttcagggggttagagaagagtgtcttatctccaaacagaacaacttcatgaagatgcatacacactttcttcttgcagctaaggaaggaccgtctttgactaggtaaagatccatgtatttgaatcatgaaaatatccaaaaagacgggctgggcatggcggctcacatctgtaatcccaaatactgggaggctgaggtgggcagatcatgaggtcaggagtttgccaccagtctggctaacatggtaaaaccctgtctctattaaaaatacaaaaattagctgggcatggtggtgggtgcctgtaatcccagcttctctggaggctgagggaggagaattgctttaatctgagaagtgggggttgcattgagctgagatggcacctttgactccagcctgggtgatagggtgggactccatctcaaaaaaaaaaaaaaaggaaatatccaaaaagacacattagcaggactcagttcccagtgtgttgtttgaggcactgaccctgatctgaaaacagtgctcagttgattcaatctgaatctgtgtccaccgtcttcctgctcacttagaataagagctgtgtttgcattgcacaatgaacacccacttgctgaaagctaacttgttcctaactgcccccatccttcatccactgccagagccagctttgttaagccccctgtgacctatatctgtgacctatccctagctaatcttctctttcaaaatatgaagtggggtacacactcatcgccaaagggtcctttgagcaagtcccagtagaaaatttatccactttttggatgaagtactcaaaaaagagtactacatttcccaacataaaatggaaaacaaatacatatgccatacatcattcagggctggaaaacaacgaaaatgtaacactccagaaaaacagccatgggaagtattattcctcatgccatccatcattatcatagagcacccactattctaatttagctccaaatgtgtggtggaggtgatcaaactttaaaattaagtaaacaaagagattcatacaaaaataaaataaaataaaataaaataaaataaaataaaataaaataaaataaaaaccctgaccccaaaactagagtaacctgacgtctcccaagtatgggttggggacctagcacctgttctgggggcaattcaggcaggtagccctggatctgtaaacctaggtagtattttagagcctgagcacaatattgggcctttgtacatgtgaactagaaagcaaagggataactgaaatggataacagatagtcagcacttggtatattccaggcctttctctaggcccttgtcacgaagtatctgacatcaacttcatgagttaggtactttttccttatctctgtatgagaaatggggaaactgtggcctggtatgtttaaaaacaaaacaaaacagtgcactattcacttgaggatcttattaaaatgaaggttactgattcagtaggtctgatagggggccaatgattctgcatttctgataaactcccaattgctgctgctggcccacagatcacactttggactgcaagaaagtaaattctccgagtcctagaggtagcaagaagtagagccaagacgggctaagttgcttggctccggggcccacacttactgccagtcggcttagcatttgcatggcagacacatcacagcccaggtaccatgaatgcgctcaaggattcaaaatcaatgtctgtcaccctttttgactgcattttctagcaacaaaaattctgtattcagtgcgtagtatataccaggaactgtggtaaacactggttcaaacgattttcatttaatccactgaagtaaattatcggccatttgattcccttcttacaggaagcaaatcacaaccccactgatgcactgggactctagtgagtttaattatcatgcacagaaaagattgagcattaatttgcaaagaattagaatctaataacacacctctaacaccaaaggtagtcaacctttggggattgaggaagaattgtaagatcttacagagcatcagaggtatcatttggaaaattaattatagtcaaatagatgaagaaggtgtaggagtttgggcctgattctgtgaaattatcaaaaagtactctaaaaaagaatgtagtgatattttccttgtcataagggtttcattttctattatataatagatattttattaattctgtttttcttacataagtagaccataaattcttgatttatgtatgaaatgtttggaagctacaggtcatacaaaataacaccttctataaaatttcacaaaatttccattagtccttatttactcagaacaaatttagaaagattgaaaagagtgtattacagacagttaaattctaccacttaatttgaaattttttctttatcttccctttaagaaagtggaatccagcagcctgcctgcatttttggcagactctgcaataattacgatgctcagatgattcccaagatggacctccccagctgtaaataccctgcctccacgctcattcctgtcaagtgcagatctccccatcttggcatatgggcagtgtcctctgaaacacttcagggtttgaagagtaaaagatgtaaatgatttgcttcactggccatgtaggcctccaggagagggacacccagacactaccatttgtagaggcctgtcgttagaagagcacactgtccagccaggcctcatggagtcttgaatgcaatgtctcccttccccttgaaatcacaatatgaccttgcagaggtgacttcagaaaaatcaaaacattttgaggctccctacaagtactttacttaacttcaacaaccaatgctgtcatttctcacctactctcccccacagttactttttatttctttatgtttcaaaacagataaccaaccacaaaaagcaaaacaattcccacagaggcatgaacccaaacaggcacgaacaaaagcacaaggtagacggggccagcctcagcctgtgctgccccggcatggtattcctctccgcagctttttgtcaattgcatgctgacactccttcccgctctatttcatgacatgtctcctctccttttggaagcatataagcaaaaacatggggctgggtgtggtggctcacacctgtaatcccagcacttcaagaggccggggtcagtggattacctgaggtcagtagttccagaccagactggccagcgtggccacagtttttcttttttttttctcaaaagcaaaaaattctgaaaaagtagtataccttgtgatatagttttaaaatctgactacttggctgaaatcaattaacatgactcttcaaaaaggtccattttaagactatatctactttctaaccaaaacatctagaggaaatgcaaaatttcctttcacctgatagctatattcaggaaaacacaggctactggatattttacataagctctgaagtgagacggtccctgggtacggcttgaattgtctgggtcggttcctcaagtggtctctgcagtttcctcatctataaagaggatatgaacatggtctaccttacaaggctgcaaggaattaaaagaggtatttcagggaaacagggtttctatagtgccaggtttgcggcaagcactcaccgacaccgcctgcaggtatggcccgttcgcgatgttctgggcagtgcagcagttctaggatttgaaaaccttccgggttgtgttgcctccaccctttcctcctgcagttccttcacaagcagccagcatgaggcttcctgaagtcagatcatgtcactccattgttcaaaagtcaaattttctcaacagggtcaaatcctgggcccagcagaccctacctgacctctccaccctgccctttttctgacatcctcttctccgagctccacctgctccaagctccaccccatactggctgctgcgttttctgggcgggggcctgcctggggctcacgagttgctgtcgcctctgccatttggcacacaaatggatgctccctgagggtgccctcctcacagtttagctcatcacacaggcctcgcggctgctgtatattacggaactccccaccaatactctttgtccccttgactctgctgtttctcgatagaacacacacttactagctgctccaaatagaatagctccgttgaggtaggcatcttgtctgtttctattttctgctacatcccagtacctggcactgtgcttggcacagagtaaggactcaatcgttatttgtttatgtagttcgttaactgtatgacggatattggaggagcctcctatttttttgctaggtccaatagcttcatctcatctgtcaggagatgatgaatggcgcctcatttaggaaacaccaataacacatgaaggtaatttacacacaggcaccctggagcccaggtgcagctcaacgttcttattgaaaatgtagtaaaaatagattttattcactgaccatattttaaggaatactattttttactatttcgggcagtactactcaaagcacagcccctgggcccgcggtgttagcatcacctgggagcttgctggaaacgcaacttctcagcttccatccaaggccaactggtctgggcccagtcatctgtgcttttataggtcctcaggtgattctgatgagcactaaagcttgagtggcactgctgtaaaaactacttcaatgactcgttccagttctttgacgtcctcttacaagtctttagtgtgacatgcttgcgttcttagtaccaacagtgtaactggttcttcatgtacatcatgttatcacctctcatgttgaccacttatcttttgccaactaaaaatacttgaaaggcaccttctcgggtttcagaagtttccatttgtttcgacaacatatgaggctacagcccagctattcacccattagagccctcccacgtccagccagcacttatattcttcgaagttaaaattgaagactctggaagcacagaaaattgggatttcttttaatctctttttctgaggcacaggttttcaaacattgtataaccaaggatttttttcatcttttcaaatgatagatgttttatgtgtttaatatgtgaagtacgtaaagaggaatggtctcaggctgctgtgattggcttggtgtgttcacctctcaccgacctgcctctgttctcccacccagcgtccgattgttccgtgagaacaacaggtaggatccataattgtaaggctggaaaaccttagccatagggcagagtttctcagagtatggtcagtaccaacattttggggcctctacccccagacaaatacatcaaaatttctggtcacagaaaaagaatgaaagaagattttttttctcgccattctggccatcaaagaaacatggaaaaacatgcaagataattctgcacatgagagtctgtgaatctctgctctagtaactttacgctatcatttttagtgaagaaaaataatcatataggcatactgtttgcatatagtcatttcaaatcattccattcagtcttaactcaaaccaagaatgaaccaagacatttgaagagatgaaatctcaatttctctgtataattttaaataaagcattcgctctaaaagctaaatgcacaggagttctgttgaatgactgactatgtttacaatttgaagcaatttagtaaacatgtatcaccactcttctaagagattttggggaaaactacagttaattggacaaaaactccatcctcaaagagattaaaaggtgaagtcagaactggagtacaaaatagcaagtaataagggagagtcctaagagttctgaaaaggattccctccagttctaatgagcaggagaggattacttgtagtttagctgttagtttaacacagagttaaatctgaaagttgacctgggatgcaccatctctcttttcccaatctttacagatgcaacatatctttacagaggccttttagtagcagcatgtagggtgccaggaagttgcccccagtgtgtagtggtgcagggagaagtgttaggatggcaaccctgcagcccccaactgcaccatgtagagttgcctgagccagtccctagcctgccaaaagcacaaggctggcaggccacaagacagaggggtaaatgagaaacagggtgatcagaggttagatgtgactcagacatgagtggaaagtcaaggtgaaacagcgcatcatcatagatcatacagtactctgaaggctgctgtcatttaccacattccataaatttactagaatttattctctattgtttgggttgaaataatcacacatttcaatttaaaaatataaagagaatattagacatttagcagaattttctcagtgcctactggtacttcagaccctatatagagagaatactatattttcttaaaatattatggtctagagagagagagagagtcagttgaaagtgtcaataattctaagttcattctcataaaagaaaattctggagaagaccaagggcaattttatgataaaacaaaataagaagactaaaattttcagatgaatatggttgataagagagtagagccagatgcactaggaaatgtattaaagaacatgaatatgtacacaacaggattcttgtgctcaaattgtttttaatattcagataataagtaaaggtttaattttgctctaaacaatgtgatttttttatttttagtaagaattttattttgggaaatcaaattaaagaactagtagataggtctcctaacataataaatccaatctgttatacagttgtacaggaacaaacatagtaaatatagggtttggtaccatttttggtttcaggcgtacactgggggatttgaaacgtattgcctgttgatggggagggacaactgtacatgtgagacacccagaaaaaatgcataaatctcaaagaggtgcctaaaattcaggcttgaataccatcttcaatggcaaaggaagaaagggagaggagaagacaagagtaaggtttgttaggcagattattcagttggtgccttctcaaggatcagagtctccagagactctgtcctcctcatcctagtaaggagagggagacacccttacaaatggagacttccttggtagatataaatttcccttacaaaagggtcacttctactctgtttttagagcttttcctgtgtctactgtttctcaaaataatcagcttaaaataatacttatgctaaagtggcatattttggggtggcatattctggtctcatacacactcaaggtggaattttccattgtttggtttataatgttggagcatgagtattctctagaggtgtcagtgtcagaatgatcttatacatactctggttgaaacgtcagaattgttatgggcttgggttcgatatttatattaatatattattctggtcacaagagtattgcaggggtttagatttatctcatttttccccatttttgacatttatttccatttctcaatttttctttccagacctgaggtgcccagctcacatgaagcagagcctctttccctcccacaatcatctcaagatcaccagagcatcagttaatgccttactttctgggcttatctactcctgtatttaaagatgttgtttctacattttcacttgtccttggaaattatctttttttattttttgcaagatcatcgaaaatttttaagttccttaaattttatttagtaagtttagtaggaggcatttcttattatgttaggcttccatcttgcaggccccagaactttctgacactgtgaaggccataccagcccacaactgccaggatctattgtatgtgggaggaaaatcaacttctaccctgtaaagtcattgtgattattttgtgtcttctgtcaaacacagtaaaaattaattctattacacctttgactatttagattagagaataaaagactaagaggcacatattaatttttttaaaataactaaacaataacaatctttgccaaagaaaagcattttgaaatgggtggtagcatagagagaaggaagagtcctttcacactaaggatgtcattgccattggcatatctggctttagaaactacaaatggctcgattagctttagagttctttctgctttttagaatttttctacatcactagaaacatatctcttatatttaatctcaatatgaaaacctgtttcatagtacttacaataaatgcattctcaaatgttacatcaaagtactccacctacagtgatgtctccttgtagtgaattagagactccaatccaaaacgtatcataaactaaatatgcacccggtgaggccatgctccatgcagactgcactaaacaaacaaacaaaatgctttaataatcttagagcattccaattacctggacttccagctggtggtgagtccttcctgctgtcagtgtgcagaatgacagccagccccacagagtctcctgggaggactgagctgctgaggtccacccgagtcaagctctggggctcccgctcacagcctcccgccgcgtttctggggtcgtcgcctccagttgcattcatttcttgaccttttctccacggtctctgcacaatgtgaacaatgctctgctgatccaggtcacaattctgtttgggagcaaggtaaaaaaaaaaaaaaaaaaaaaggaaatgtcaaacatgaaatgcgagatagagtttaacttgccctccgtggtagaagggaagcaaaagtgacatgtaactgaccaacttaggtgctcctttgcccacagcagttacacactacacacggtagacaaacaacactgaactggggccagaaacagaaatttgggaatacgtgaaacacaatagaatgctgacgtcatattcaaaaggacataaaatctagcaggaaaaaataattaccaaactggatctataagcacagtgaaaacaataattccttttttccccccaagacagagtctcactctgtcatccaggctggagtgcagtggtgtgatttccgctcattgcaacctctgcctgccgggttcaagcaattctcctgcctcagcctcccgagtagctgggattataggcgggcaccaccacacctggctacgaaaaatattcttaaatagtaaaactgattgacatcagaattgatatgtcattcatctctgttttacaaaagtacagaaagtgagttattatcaatgagagggcatttctttaaagcatcggaaatgaatgcgtttgagtaggctccacacacaccgctccacgggcaccaacacacacatcattacactggtggggaagcaagacaggagcacactcttgccacccagggttcattctctttctgacgatttaaccatgaaaaccagctaacatttacgaaaaggttttgcatctacatattgacacgtaggaacagaagactttaacattttgtagcataaaaattaaaagtcagattatttgctagcacaagaactaggctaccctaaatggaattctagtttcagaatatctactacatagggccggccgcggtggctcaggcctctaatcccagcactttgagaggcctaggtgggtggatagcctgaggtcaggagttcgagaagagcctgaccaacatggcaaaaccccatctcaactgaaaatacaaaaattagctgggcgtgttagcgtgcgcctgtaatcccagctactcgggaggctgaggcaggaggatcacttgaacgccacccccacccccccaaccaaaaaataatatctactacatagaagcagttactcatatgcttgctaccctcttaagacacagcaaggaccttactctctcagtaaatcgatgtggccggccgcagtggctcacacctgtaatcccagcactttgggaggccaaggcgggcggatcacttgaggccagtagtttgtgaccagccagggcaaaatggtgaaaccccatctctactaaaaatacaaaaaaaattagccggctttggtggcatgtacctgtaatcccagctacttgggaggctgaaacaagataattgcttgaacctgggaggcgaaggttggagtgagccaagatcatgccactgcactccagcctgggcaacagagagagagactctgtctcaaaaaataaaattaaattaaattaaatacaaataaaccaatgcctttcaaatacctcttgccattgtcattttaggaatgctccaagaacactcaagtgaaatgcatccataactcatagcgatgaatgatgcccttccctgctgctttctcaagctcttctgttgccctcaccatcaatgtccctcgaacagtggtgcccagcactcaccaacacccctgaccccaaatacaatggctagaatctgcctcctccacccaggagggcaccaggacacccttcgtccttaaatcccattccaacctcttctctactcttacaccctggggctccgtctcatccccaggccctgtgcccctccccattctcagagctcccagtctctccctaggactgctcctactcagcagaggccactgtgcatcattctctgacctgaagtgctcccctgcatgacttcccagtttctgtcaaaggaaaaaccatcccccacatcacccgcttcgagccttcccctcccacctaaaaatctcattatcctcccatgttttgtaacgggctgcaagagaatcactatcttgaattcctcctacctaatctttgacatcggcaaggcaccaacagttagcaattctgtctcagaattacccttcacatcttcaactcttttacatctcaatagtcacctccccgttttaggccttcctcatgataatagctttgtaattactccccacatctgatatcgccatactccagtccaatacatacaagaattctgggtgtgtgctacataatctttctaaagtgtctcagtattacttgtaaaatggactgtaacatctcccatgttcttcaagtgtgtttgtacttttttcctttctaaatcatgatctagatttgatttttcatcttccttacccctcctatatgatacatgtggcagattaaactattcttcaaaatcatgcacgcctgtacattagtgcgcatacatcatgctccccacttcctccctgcaatctgtgtccagccacatgaatggctttggccaaagggatgttagcagatgtggttgaaccagggccttatatttgtcccgctgctaaggtccatcaaaagaacatccctgccaggcacagtagctcacccctataatccaagcactttgggagactggggtgggcggatcacttgaggtcaggagttcaaggccagcctggccaacacggtgaaaccccgtctgtactaaaaagataaaaattagccgggcatggtggtgcgtgcctgtaatcccagctactcaagaggctgaggcaggagaatcacttaaacccaggaggcgaaggttgcagtgacctgagatctcaccactgcactgcactgcacagagcaagactccgttgcaaaaaacagaacttcccagaaagcttctacctgttcacacatggcccagacctgagtccaacccactgaggtgaccaagtgcagccacactcacagcatgaagcagggacccgcagctgaagccagcctgaggccgcgggcaccctcgctgacctgtaggcacatgagaagatggcatacttttatggcactgagatttctgcttgtcctctaatcaataatggcagacagtcctctattttccattctatttggacaagctatcactgtccatgatcagctccgtgtcaggcagcactcctccagctgtgcacagcctctagcctaagtcgtttcagagaaatgggcatcaggatccgagtatactcaaggacttgcacaggagcatgtgagctttgccacagaaggaaaagtggagaattagcaccctagcctatcttgaggtttctatccacattttttccctacctttccatgttcaggactcagttacttcctgtgatcctcctagagaaaagtaacacctttctccctcatctgaatctaaaaatctttgcttactgtgctcttcttattgcagtggttagagcttggacagtatatacatatatattgtgtgtgtgtgtgtgtgtgtgtgtgtgtgtgtgtgtctgtgtctgagtcttatcttccaacttattttagaaatacttgagagcagcaacttggccatagtagcattcatcagaacacctcacacagtgctttggagccaggagatgtagaaacatatctatgaattctaaaagtttgaaaaagtgaatgactgaagggaagtaagaaagaatgaaggagtgaatgaatcaatgaatataaacagtcataagctcagtgcccaaagtgccacagagggaaccagcagaacaagaaagaaaggacacagaatttaaagtcaaacggactcaagctctacataatttattagctgtatgaattttggcaaatgattcttcctttcccagctttctgccattgacaataatatatcaactttgaaggctgttttgaagatttaaggaaatgtaaagagctcagatcccgatccgcaatgatacatcgttggtagtattgttaccatttatgagtttcagaaaactaaagaggatgggtccctaatcttgtacatgaataaggtgtcagaattctgtttagctgcacacttctgtttggaaaatatacagagaaggcagaataagcagaagctatcaatgtgacaatctctctggtagcattccaactttctgtgaactaaaaatcgatacaaaaaaataattcctatatcaccatatagccagatgccatgaaacacgtgaagaacctgagtgaattttcagggacaggtaaaatgtgacaaatgttgatgaaatctaaaagatttcaaatccagattttcctaatgctcagggtacagctgcaaaggggaaaagaaagttctcaaacagatttcagtagttacagtgatacttataggacgcatttccctcagttggcatccctgtttctgaaatcattaattgcttaatctttgactcttacagaaaatcttcttggttccagaagcggtgcctttgacagacagtggactcacacaccacactggttcagttcaaagccacattccatggacagtacattggatacagtccagttgtacagccacgcaaaagccccaaatactacttagttctcctagtatacaaaaaaattcctcagatgtgggaagaaagagattttcggtgggaagacatcagagtgctccaatatggtttcaggctaccttagagcagaaacaatgtcttatttatctttgtttctccaataaataaaatattacctgtcaaagagaaaacccttaatacaattctttctttttttataacaatatattaatccaacaagtaaggcagtaacaaattcttcagtgtagacaaaccaagtaggtatttctgtaaccgggtttggtcttacactgtcaagcacagctgatgacccatgggagactgagggatcagtatcttgggctttctgtctataggatccttgacatggaaacataccagtattaacaaaacatccatgggagttttttttgccaaacaatgatcaactctcatctggttggacattatccaataatatacaaaaaactgatgtatttttctttttccaaaaagaagttccttcaacggcacatagttaagatccaaatatttcagattcttccaagcacttaataaagagttacaaatatcatctctaaaatgattaataatgagattctaaaattgttaacaataccacattattaatacattgttttcaggagttatgaaaatagttatgttaataataaaaaacatatagaatatacttagccgtatattgcagaccattacaggttttgagacataataaattatttattattctcacactctgatgagggaataactatcaccatctgctatgtctcaatgtgtcctcaaaatttatttgtttcaacttaaccatcaatgtgattgcatgaagaggtggagcctctagaaggtgattaaatcatgatggggcagagccttcatgaatgggattagtgcccttataaggcagtgcaagtgactttctgtcctttttgcccttttagctcttcccctcttccagcaagtgaagacacaacaagaaggccctcaccagacactgaataccaacaccttgaccttggatttcccagctttcagaattttataaattgcccagtctcaggtattttgttatagcaagacaaagaatacaagacaacatacataaagttagtgtgtaaacagagctagaaatagtgtgtaaatccaagagaactgtgcctggcacagataatgctgttttacagattacttattgtggttgctgttgattccactttatagaagacaaaggggagccacagagaagttcacgatgggttcaacaacacccagctcccgagtgtgaagccagggtaggaacccaggccatcgactcctctgctggtgttcattgactctgctgagaggaagtggagacttggatgaggcagacaaactaggacaagtctacaggggcccatggtgaagaccagggtttggatgctgcaacggaaccaccccaggtacgaaggaatgattcagagaagagccagatagctgaaatgttaaaaacatgagaagacaggatctgggacggggctgtataggaggtagcaaagtaaagattagtccagtgtgattttaaagaggaaacaaaacaaaacaaacaaaaaggatgaaagtaagaacaagtgggttgcagaggaatcagtgagagtatggaaagtgaaaagaagatggtataggtgagctggtaacacacctcgcagactccggatgctggtgctggctcaaggtaaagtctgtacctctggagatcccgtcaccccagggaagactgcacttatcacgtcgtattgtagtttctttgtatgcgttgctctctgttaccagacaataccgtctttaagaaaaaatactgcaactgtgtctgtagtacctactgtagggacctgttcataaaacacactcccctgtgtctactgaatgactctatgatcctttaagcacatacctagaagtgaggaaacattccagatggcgttagtaacttacccaagtcaagtctgatgcataattgggaaatgaaagagccaggcctgcagcctcagttttctggctctgagcccaatgctctatttcaaacatcccaccttggattgtccacctctctgtgctcacgacataagtagacatgttggcagaagtgcccagccagtgtgcttttatcagcatactgatcagtctatactcattggcatacttactgtaccactgtctatggtctgtaaagtaggtagggctgtcttcaatatcttcagtatcattcattcattttcagttccttctaaatctgttaaactctatttcctcatacaaaatgcttaaaatcatttcagtgtatggccaacaaacatatgaaataatgtttaatatcactagtgatcagggaaaggcaagtcgaaaccacaatgcgataccatcttactcctgcaagagtggccataataaaaaaatcgaaaacagtagatgttggtgtggatgcggtgatcagggaacacttctacactgctggtgggaatgtaaaccagtacagccactacagaaaatagtgtggagattccttagagaatctaaaagcagaactaccatttgatccagaaatcccactactgggtatctacccagaggaaaagaagtcattatacagaaaagatacttgcacacgcaagtttatagcagcacaattcacaattgcaaaatcgtggaaccaacccacatgtccaccaatcaatgagtggataaagaaatcgtggtatatgatggaatactgctcagccataaaaaggaatgaattaatggcattcacagcaatctggatgggattggagactattattctaagtgaagtaactcagggatggaaaaccaaacattgtatgttcttactgatagatgagagctaagctatgaggacacaaagacataagcatgatacaatggacttcagggacgtaggggaaagggtgggaggggagtgagggataaaatacaacatatatggtgcagtaggtactgcttgagtgttgggtgcaccaggatctcacaaatcaccactaactaacttacgtaaacaaataccatctgtaccccaataacttatgggaaaaaaatcatttcagtggaaggctgtcaaactttctaatgtgtaataactttacattttaaagactgaacatttctgatttttatttggatttttaatagactacattttctatctagaaaaggaatacaatcagccaagaatgatcagactaatttaaaaatcaatagtgttaacagattctaatgttaaaacatttttacattgagttctttcttaaataactttgaagacacacttttaataacaccttaaattgtccttttttgtgctgaacaatcttggcattctttctattttttgcttcttctgaaaataacttctaacaaacagatttttttttttttaaggcagggtctcactctgttacagcccaggctggagtgcagtggcatgatcaaggctcgctgctgcctcgaactcccagactcaagtgatcctcttatggcagcctcctgagttgctgagactacaggcacacgccactacacctagctaattttctagtttttttttttttttttttttgtagagatgggatctcacttatgctgcccaggctggtctcaaattctcaaattcctgggcataaatgattctcctgccttggactcccaaacactgggattccaggcctgagccactgcacctggctttaagcagatgtggttggaagcccatcacagtttttaataacgtattttctatgccaagaaaagacaaaacggcaatgatttaataagttaggccgaatgcagtggctcacgtctgtaatcccagcactttgggaggtcaaggagggcagatcacttgaggtcaggagtttgagaccagcctggccaatgtagtgaaacccgtgtctactaaaaatacattaaaaaaaattagccagacgtggtggcacaagcctgtaatcctggctacttgagaggctgaggcaggagaatctctcgaacctgggatgtggacgttgcagtgaaccaagatcgcaccagtccactccagcctgggtgacagagcgagactccgtctcaaaaaaaaaaaaaaaggtgttatttaaaggtgttttttaatgtaatggctaagaactattttgtttggtcactgctaacaatgaaatgtgtttcaagacaagatgagccagagatgttcacagtaagtcagaataatcaaaaagggaattgttcccagtgatattttttcacttgaactccagttcccctccatagttttcaatgaacactaaatgccaatttatattaattggatgagaacagaaactatcctttcaaactgatccttcatttaaaaaaagggggacttctaaaagatgaatatttgtgatttagcctttcaatttatttcacatttcttatgactgattttcattatgatcaaaaatattatgctgtgtaaagatactgaaaggccccttctctggttcccaaaggcaggcaatacaattactgtgaaaggtcaattagccccacactaattagccagtgcaggcctgggccttgtcacctccatgtccctcccaccacaggcctgagacctttctgctgctcatgaggatcctacaccagaggggctccatagggggcgggaggggggaccgctcaggaatcactcggtttggctacatgccagcaactgcagtaagtgatttagttttgaagagcagaggacagtgctgtttgagcatgtagggtcgggatttcacttctctgggttccctctttcatgaatacaaaggatatcggatcaccaaagctatgcccattaaacccactttaaaattgtgttttatattgtcaacattgcaagaaatgcctcaagtatcacttcttttttctttaagtattattttattactagttgtgataaatattatgaacactttaaaatatatatattttatttgacagaattaaattaatgtttttaaagccatggaatacgctgtatagaattactggggtcagggtttgagagcttaacaacacacgctcttgatgaagctgacccggaaactcaggcacgtcggggaggtcagcactacccaacagaaccacatgcgagtttatgccacgcttcccaaattccaatggttgcgattaacactcaaaatcatatacctccgcgattgcaaaacaacatctgcgcaaggtgtttactgtgggattatttataatagaaaattatgggctgggtgcggtggctcatgcttgtaatcccagcactttgggaggctgaggtgggcagatcacccgaggtcaggggttcaagaccagcctggcacacgtggcaaaacctggtctctactaaaaatacaaaaattagccgggtgtggttgtgcgtgcctgtaatcccagctacaggctgggaggctgaggcaggatactcgtttgagccgggaggcggaggttgcagtgagcctagatcgggccactgcactccagcctgggtgacagagtaagcctgtgtctgaaaaaaaaaaaaaaaaaaaaggaaaaaaaattttcagaaacaagtgaaatgcttgaccatagaagacaagtacaatctgtgaagaaaaaagaaaacaaagcagaaaatagaatatagtaagggactttctatgtcaaaagcaaagaaaattaagtacatacaaaagtagctgtttttgtaaaaggaaacgtagaaaggaaaatcgaagttagtgaaaatggttacctatgagggagtagggaaatgggttaaagggatcgaatgggagccatgtttccctaacgtgactatctacagtttcaggtgtgaggcacagaaaatgtttcacaaaatcacaacaatacttactaaataaaaaggagaaaaaaagcaaactctaaaactgaaaattaccagaaacatattgagctgacaatgtcagtacataaataaaagtagttcaagtaacttttggacacagtgctctgtatatcctttagtacaaaaaaaggaacccaaaagaaattttgtactttatttactaagttgattactggtatgatataggtgtaggaattcagaaactatttgtatttatgttaagatgaaaaattactaaacttactgatgtttttggaaaccgagtttttcacagtggctgaagaaggtgagaaggagcttcatgatgttggagttgaaataaaggaaacaaaatgtacttatgaatttttaaaaaatccaattcattgaggggaaattactcacctatccagaagttgcagaataatgagacccatgtatatctattcatcaccttattcaacaattatcaacttgagtccaaccttgttttatcagtatgaattatcatggataaatgatattatcaatatcactacccactttcccttcctatattattttgaggcaaatctcagatatcatattatttactcaacaaaaatgatccatatgtatctctacgaaggaggaattttcctataaaacctaactagaataccattagaggaactgaaaaattacaaataagcatttaatggcatcaaatatttatgtgtccataattttaattttttccaaatctgtttgaatcgagatccaaacaagtccatattttgggactggaaggaatgtatattatatcttcttgtaatttaattaattaatttattaatttattaatgtatttatttatttatttattttgtgagaccaggtctccctctgtcactcaggctggagtgcaggcatgatcagggctcattgcagtctcggcttccagggctcaggggattcctaacctcagcctccccagtagctgggacaactggaatgtgccactacatccagctaattttttgtatatgccatacagacagggttttgccatgttgaccaggctggtctcaaacttctaggctcaagtgatctgcctgcctcagccttccaaagtgttgggattacaggcctgagctactgtgcctggcgttcaatgtttttttattaagacataactaatatattgtagttctcccttttaaagtgtataattcagcagtgtttagaatatttgcaaggttgtgcagccatcaacactctctaatttcacaacattttctcttcagttgcttttacaagttccctcacccatctctcttcctgtttttacaattaaatttgaagaaaaatgggttaatccattgtagaatttctcataatctaaattttgccagttgcatatgggtggtattactgaacaagtttcttcattgtccttattatagaaaattttatatttgtggccaggcacagtggctcacgcctgtaatcccagcgctttgggaggccgaggcaggcggatcacaaggtcaggagatcgagaccatcctggctaacatggtgaaaccccgtctctactaaaaatacaaaaaattagccgggtgtggtggcaggtgcctgtagtcccagctactcgggaggctgaggcaagagaatggtgtgaacctgggaggtggagcttgcagtgagtggagattgcaccactgcactccagtctgggcgacagagcaagactctgtctcaaaaaaaaaaaaaaaaaaaaaagttatatttgattctacaggcttgactaggtttaggcttaatatgttttgctgggattcctgtaagggtgctgctttgttcttcaagaaggaagcactatgtgactatgcctgagtctgactacatttggctgtagtgtatcttctttatggaagatacgctaaaattgtaaaatggtgatcttttaatattatcacttcttctcaaactattagataacatatttctatcaagataaattttccctcaatagctattttgttactcagagataaattttgtataggaaggcagaataaatgctctattattttcttggtttatacattttcaaaataagttgactctagcaatgaataaaaatgcaatttttaaaagcattattaaaaaattatagaaaaggccgggtgcgaggctcatgcctgtaatcccagcactttgagaggccaaagcaggtggatcacttgagataaggagtttgagacccacctggccaacatggtgaaaccctgtctctactaaaaatacaaaaattagccaggcgtggtggcggatgcctgcaatcccagctacttgggaggctgaggcaggagaattgcttgaacctgggaagcagaggttgcagtgaaccaagaccacacaatcgcactcctgcctgggtaacaagagtgaaaatccgtctcaaaaaaaaaaaacgaaattacagacacacacatattaatgatgtccatcgattgtacttattattttgattggtggttatctatagctaattggcacatcttagaatgggatcctgaactgtggcagaggcgcaagagtctttggtagcttccctgccatcctgtatgacaagagactccagtctgctttgaacactttttgttctagacctgtaataaatcattttgacaaataaaaatggcatttaaagatgacgatgtggatggttagagatactcattgctagtggattcataaacgtctgtcagctttttcagtgacaagaggtatgttttgttcgttttttaaagataaaatacatcacgagttcaatctgatatttcccattcaaaccgaggagtagagggttttaaataatctccttcgtcttccatcttaatcttcttttctcttgttcaaaatcgtgaaaatgaaatgattagatgtcacataattactcattattttagactacattatatacacaatgtgaatgataccattaaattgattactaatcatagtttaagtttttctgcttgtagttctttttgtcttgggatgtacctcattaaagatgtatagtcaaactgctgtattctaaagtcacttggaataatgtggctatgattacaactaaagatacttgcattcatttttttgactttattttttattcttagaactttctatttaaaatatttaattctgttttataattatggaaaatattttcaagtttctaaagtcaaactttaaaaacataaaattgtcaaagatgtctcacttctacttttgtctgtttaatatattcactatctttttgtttgtttttagatttctgctttacctctaacagaagctggtgtgtgtgtgtgtgtctgtgtgtgtgtgtgtgtgtgtatttaagcacctctcttagataattgatagcatgttatatacttttttcgcttaatttcccctacaattaattctacagtagtatatacacatttccttattatttttcacaaccatacagtaacctcacgtgtggataaatcatagtttattcaaccaataccctatgttctatgacaaatgaggtcccactggccaagtttgggaaaatataaatacaaaaaagaatagattgataacaggttataatacattaaagaaaaaatccatgaatatatgataatattaaaaagtatacgtgtgaggagtaagaaagagttcttccatacagaacaacagaataaatatggcaagaactgtcggcacagacaatcatatttttgaaggcactgatataataattaattcactcaaggatcaccagtagaagctacagcaaatggatccaagattggtgggaatcgggattttggcagtttccaagtatctgcccacagattccctaataatttcaaaagaggagggttatttctgcaatgggagattcggcaggcatcactgtaactaagattcacacgggcattgtcagttacaaaggattcagcattaacgacaacaaagtttaacccaaatttagcaatgaggagacaataaaacaaatcgaggttgcaggataattctgcaaacaactgacccttacaattcaaatttttgaaggtgcaaattaggtgtgtgtgagaagactgttctatactaaagcaaaataaagatacatgataactgaatgtgatctgtatatttgactaaacttttggtcagaataatttaaaaaaattatccaaagcatacaaacaacctttaaaactcatcagtaaataaataaacaaacattaaaaaagggccaaaggctttaacagatacctcaccaaagaagatacagagatggcaaagaagtaggctccacatcttatgtcctcagggagcagcaaattaacgcaagataccactacacaccaattagaataaatcccagaacaaaggcaacaccaaatactggtgaggacgtggaataacagaactctcgttcattgctactgggaatgcaaaacggtatagtcactttggaaatctggtggtttcttacaaaactaaacatactataaccacacaatgcagcaatacctggagtatttacccaaaggagttgaaaactaaaatcatgtccacacaaaagcctgcacacagatgtttacagcagctttattcaggattgccaaaattcaatgcaaccaacatgttcttcatcaggtgaatggataaagtatcagacatacagatcatggaaaattattgagcactaaagagaaatgaagtatcaagccaggaaatgacatggaggaaccttaagtgcatattaccaagtgaaagaaccaatttgaaaaggctacatcttgtatgattccaatttgaaaaggccacatgttgtattatacgacattcggaaaaaggcaacactatagagacattgaaaatatcagtagttgccagggactgagggatgacggagggatgaatagagacagcacagagaatatttaaggcagtgaaaatactcagggtgatactatgttgatggataaatatcattatacatttgtccagacccacagagtgtacaccaagagtgtaccctcatgtaagctataaatgtgaagtgattacaatgtgtcaatttaggtttatcagctgcaaaaaatgtaccgctctggtgggggatgttgataatggagagggtatgggcacatttgggcagggagtagatgggaaataccttcctctctatgatgtgaacctaaaactgctaaaaaataaataaataaaggcttaaaaaagctataaaggacaatttgggaacaattgggaggatctttgaatatggactacaaaagaaatatcattgtatcgatgttaaattccttgaaatttacatcacacattacagcggctacacagaagattgccctttgcctttgtagatataggctgaagtgtttaggaacaaaatgtcagtctatctgcaattatgtttagcttcttgagagacagaggaaaggaaggaggggaaggtgtgagtgagggagacaaagaaagataaagcaaatgtggcaaagtgttaacagttggggactctggagaaaggttgtacagatatttgctataaatagatttttttaaaaaattttttaaaggtttgaatctcctaaaatatcttcatactcagtcactaaatggaaagtaaccactgaaaatcagaaatgttggcgaggtgaggtggctcacggctgtaatctcaggactttgggaggctgaggtgggtggatcacttgagctcaggagttcaagatcagcctggccaacatggtgaaaccctgactctgactctactaaaaatacaaaaaattagccaggggtggtggcaggagcctgtaatcccagctacttgggaggctgaggcaagagaatcgcttgaacctgggaggctgaggttgcagtgagctgacattgcaccattgcactccatccagcctggacgacagagactccattaaaacaaaaaaaagaaagaaagaaagagagagagagagaaggagagagagggaaagaaagaaagacagaaaaagaaagaaagaaggaaagaaagaaaaagaaagaaagaaagagacagaaacaaagagagaagagaagagaaaagaaaagaaaagaaaagaatcctctgtcttaatcctgagttctaatttgattgccttgtggtctgagagactgtttgttatgatttctgttcttttgcatttgctgaggagtgttttacttccaattatgtggtcaattttagaacaagtgctatgtggtgctgagaagaatgatttggggtgcagagttctatagatgtctattaggaccgcttggtctagagctgagttcaagtcctgaataaccttgttaattttctgcctcattggtctgtttaatactgacagtggggtggtaaagtctcccactattattgtgtgggagtctaagtctctttgtaggcctctaagaagttgttttatgaatatgggtgctgctgtattgggtgcatatatatttaggatagttagctcttcttgttgtattgatccctttaccattatgtaatgcctttctttgtctgttttgatctttgttggtttaatgtctgttttatcagactaagatcgcaaactctcctttttttttgcattccatttgcttggtaaatattcctccatccgtttattctgagcctgtgtgtctctgcacatgggaagggtctcctgaatacagcacactgatgggtactgactttttatccaatttgccagtctgtgtcttttgattggggcatttaagccatttacaattaaggttaatactactacgtgtgaatttgttcctgcattcatgatcctagctggttattttgcacattagttgcagtttctggaaactgaacaacctgctcctgaatgactactgggtaagttatgaaattaaggcagaaataacaaagttctttgaaaccaatgagaacagagacaatgtaccagaatcactgggacacagctaaggtagtgtcaagggggaaatttatagtactaaatgcccacatcagaaggagggaaagatctagaattgacaccctaacatcaccattaaaagaactaaagaagcaagagaaaagaaattcaaaagctaaaaggccaggcatggtggctcactcctctaatcccagcactttggaaggttgaggtgggtggatcacttgaagccaggagttcaagaccagcctggccaacatggtgaaaccccgtctctactaaaaatacaaaaattagctgggcatggtagcgtgtgcctgtaattccagctactcgggaggctgagggaggagaactgcttgaactgagacctggaaggtagaggttacagtgagtggagatgacgccactgtattccagcctgggctacagagtgagactccatctcaaaaaaaaaaaaaaaaaaaaaaggctagaagacgacaagaactaactaagatcagagcagaactgaaggagacagagacatgaaaaacccttccaaaaaatcaatgaatgcaggagctgttcacatatacaccatggaatactatgcaaccataaaaaagaatgagatcatgtcctttgcagggatatggatgaaactagaaaccatcatcctcagcaaaccaacacaggaacagaaaaaaacactgcatccatgccataaaatacaactcagcatagtattccatggtgtacaaaaaggatgagttcatgtcttttgcagggacatggatgcagctggaaaccatcattctgacaaactgtcacaaggacagaaaaccaaaccccgcatgttctcactcataggtgggaattgaacaatgagaacacatggacacagggaggggaacatcacagactggggcctgtcagggggtggggggctagggaagggatagcattaggagaaatacctaatgtaaatgatgagctgacgggtgcagcaaaccaccatggcacatgtttacctatgtaacaaacctacacgttcagcacatgtagcccagaacataaagtaaaattaaaaaaaaaataagaaaataagaaatgcggtattactacaaaatttttaggatgaaaaattgtatgtatttcatgctatctgtcatgaattcagctatctaacctgctatatcctacacatagcttacaaactgacctaagaaaggagggaaaaatgaaagcaaaatccaaagttgcttataaaaaagaaatctttgttttggaatatgagaaagctattgtataaatacagattaccaatatggtttaaatagaagaattatagtcaaataccatagcaaatgagttaaaattttgcagctcattacagttttgaggtctctaaagtgaataagcataatacccaaaatactgactttgtagaatcctaaaatccagttatgcagtctacagcagcagtcctgaatctttttggcaccagggagtggttttgtggaagacaatatttccacagatgagggcaatggggatggggtgtggtttgtggatgaaactggtccacctcagatcatcaggcattagttagattctcgtaagaagcacacagcctagatacctcacacgtgcagttcacaatagggtttgcactcctatgagaatctactgccactgctgatcagacaggagctccagcgtcatgctcatctgcccatactcaccccctgctgtgcagcccaggtcctcacaggccacagacaggttctggcgccacgggggttggagacccctggtatagagcaacgcatgggcaaaagcactgcatgagtaatcaaggtcaaaggcagaattaatggatgttctaatttactatggaggcaacatagcaaaacctcttaaacattttacaacaaagatcctgtccatattacagtcttcaaacagatatggacttccatacaagaagagtatattaaaaaaaaaatccacaccctctcagatgttcactcaaagtgataaaaatggaaacaatggaatcacatctgctaaaatccatattagaaagtatacaaataaaagtgcttatgataaacagctaatgagaataaatggatacactattaagctatcttggcagaatttatcaatgtcttagatgtacatgcagaaattctcacatatgtcctcaaaaacacatgtacatggatgtcctttgcaaccacagtaaaaaccatggcaacaatctaaacagtcatcaatattgggctggctgccattcatacatacaattggtaaacatttgttataactctagaagtacacggaaaagaaggcggtctattttttaaataaaatcagcaagttgcagaatagcatgcactattattattagcccatttgtctgtatgttgtatatcactctgtatatgcattaacttattgggtacacatagcaaattttgattaactctgaagaatgggattaagtgatggaagagaggaatttgaatgtttctgaaattttaaaaagtctaagcacacattactttgataattttaaaaagacacctgggaaattatttgcaagtaaaatactcatttaattcctgataagctttcctttctttctttctctctctcttttttttttttgacagaaaagataatgacagtaaatgctttacttagaatagaatggaattttttttctacttttctgtcaatgtctttatggatgatgttgccatcttcattttgtcactgttagttgtaacttctttctgacctatgttttaccctttctggctacaagctcattttacacacagttatttatatgaacagttgggagccactcactcacctctcttttgagaaaagaaaaatatatttgtgctttctaacttttattatctttatgccaataagtctttttattttcacctaagatttgtgtccatttttggaatggcagagatgctggaaatcatatttcaatccaactgaaatgtacgtgtgagtgtgtgtgtttgtatgtatgcatggttttatgtctttagaattctttgtgagtgctccagtaaatctggtgccttctgagacgacaagagaggattaaggaaatggtatgagttttttgtaactatctcaatgaaaaagtagagaagcatagagtgaaaaaatccttagaacagtcttgctctgtcgcccaggctggagtgcagtagcacgatctcggctcactgcaacctccgcctcccagattaaagcagttctcatgcctcaacgtctgagtagctgggattgcaggtatgcgctatcacacccagctaatttttgtatttttagtagagacagggtttcgccatattggccaggctggtctcgaactcctgacctcaagtgattcacccacctcagcttcccaaagtgctgggattacaagcaggaataaatgttactgtattaaaagtattagatcctgacccctgcttgatgtgttaagctcagtgtcctctatctgaaataaagatacacactagcgtgttctccagattcaccttaattttacctgaacaatattctaaaattttcaaattatagcacaaacatactaagtacacatataattcacaaaaattaaaaacatatatttagccaaaagtaaataaaataaaatcagtaaaataaacaaatctgagaacttcatgaatggcaaccacagcctaaatgcaaagaaggaataaaacagctacttcttggctcttgggctttcatgggcccaggatccactaatgtaagagtaatttcagagattttgaagggtaactgggtatatttatgtattgtgttatttctttcttttttttttttttttttttttttttgagatagagttttgctcttgttgcccaggctggagtgcaatggcgcaatctcggctcactgcaacgtccacctctcgggttcaagtgattctcttgcctcagcctcccaagtagctgggattacagacatgtgcaaccatgcccagctaattttgtatttttagtagagaccaggtttctccatgttggtcaggctggtctcaaactcctaacctcaggtgatccacctgcctcggtctcccaaagtgctgggattacaggcgtgagccaccgcacccggccatattgtgttatttcatctcacatcttgaccttgaactttgccagttctcctataaatagcaattccactgtagtgacttacatttgaagtttgggcagtttttgataaatatccttattactggattttcttttcaaaatgaacaagaatattggacaactcaggtcctccgtttgaagacattcacagctgagaatgatattcgtatacatctgggccacagactagcagttcatctagttaatcagttactatgtagccaacctcacaagttgctatttactgccaatatgctgcacagctacaagtgttatgggctaaattgtgtcccctcacaagtcatacattgaattccaaacccccagtatcccaaatgtgactgtttggagatagggcctttacagaggtaaccaagttaaaatgtcagcattagggtgggtcttatctaacatgaatggaatccttttaagatgagattcaggtatagacagacacagaaaacagaccatgtgaaggtacacggagaagacatctgtaagcccaggagagaggccacagaaggaatcaaccctactgacaccttgactttggaattgtgagaaaataaacatattatttatttaagccacccagtctgtagtgaaggttcattttatacaagaattatacaacattttactggtccctctcgaattctatagcagcaggcatgtatcagggatcttcacagatattttggagatttttttttttttttttttttttttccgagagggcctctggcatatactcttgacataacatctgggcaccatgggtagtacctcctttatgacagatacttcattttaattaggggatgactgcattatttcaagacaaagcaggtgtaggttattattgggtgttgtatcaaagaaataaagaaatgtaggatgacatggggttattcatttctgcattgaaaataaggggaaataaggagttatatagtaggatcttcgcaattacactgaaaccagtatagtgcgtgcttgttgaatgaatgaatatcagtaataactctcaagaactgtattaagcaccatatttactaaatatcttacatattatttgtaatcatcaaaccacactgataaataagtattgtagcagagacagctggcacctcatcgaaatctgtttcctcctcttccccgacaccagatgacctgatttcccaaattccttaacatttagggttggctacactgattccttttatctgatgggtatgactagaagagatgtgtgccactttgaagccaaagcatgttcacagaagttgtagtgaacacagacagacaacaaacagataaatacacgacaaaatggttgataaatgtgtggcggcgggggcatagatggagagatgggcaaaatacaagttagagacaaactctcaactgtaagctgggagctcacatcctatggtttcaaccacacaaccaaagactacaaaatgcagcgtggcagcataatcaaatttacatcatcaggttttggattgtcaataaactttctagagattactctgcacagccaaaattttaaaatgatatcagatacaacagctaaaattactgggttgaaactggaagcttcctttttaaacagagctgtaaatgtataaaatgccacattagggcacaggttttatcacgtttatttgctagctaattattgaatccaaagcctttccaaacttgtttttggatgttcttgtgtttgtttgtttgtttgtttttcctaaatctttatagccgtgagccttgatcttcatgttttctttctcagaaatcaatcattcctttgtgctacataccacctcctccttcctgatagtatgtaggccatcttcaaactccctacaacttcaccaacatttccaactcattttcatacttttaagcccactggcattatacatgcaatactgactccaataaaatttatcatgtgggattagcataagcagaggtggcaaacttctcatttgttgctcccaaaaacaaaatgctagatcgctctcaagtaagaagaaacttgtatcacagtgtggtttggatggttgctatgacaatatcgagttcttctttgagaaagaccatgataaggcattcattaggaacataagtacctagcagtgagggttgttttctttttcatttttaaaatatctggccaagtagctggcgtttaaacagatcaagcattttacctacattctccaaactttaatttcataacgactccttgaaataagatgatggacaacaaaactggagctcaaagagatgcataacttacctaaagggatatcactggatttgcatccaggttcatcttgtaaaaccacgttgaactgcttaccttgactgaataaatcagcaatgagtacagatatctactttaattaacacatctaaattttgcttcattctataaccaaagcagttaaagggtagaatttggaagcacttaagatgaaccctccaattcttctctattgtctccaaaggctgtcccatctaatggtacagatgtgtgaaactcagaaaaatgataacagattacagatgagacgcaacgaaagcttccagccaggaaggtgagtgaggcagatagacaagctcatgaatttccagaggaacatatcacaattctgatttgtctgtgaggaaaagacatgatgtctccctataaaaattcactgcacattgccaggcatgggggttctcgcctgtaatcccagcagtttgggagtctgaggcaggaggattgcttgagcccaggagttcagaatcagcctggacaacatggcaaaactctgtctctacaaaaaaatataaaaatcagctgggcatggtggcacatgcctgtggccccagatactcaggaggctgaggtgggaggatcgcttgagtctgggaggtccaggctgcagtgagccatgatcatgccactgcactccagcccgggcaacagagagagaccttgctccttgcaaaaaaatcactggacataatgaaattatgaacataagaaaaggttggatttaagggctattttaatgtaattcccatcattttcatcattcttttgtgattcatattatttaccatggaagacttctatttaaatcaaaaggattaactgggagggttacattgataacaaataactagctatcacaaatagaaatttgtgaagggatggaatgtgagaaaattagctttgattatgaaaaatgaaagagaaaagcctaatgtagaattcgcagctaagtgggggcaacccatgccaatcatttcaaaggctggtcacacccgaggcgtgactaacccagcagcagatggaacctggattctacatttcaccatgcttggggtgggcttggggctccatgacccacaattttcccactgcatttcccaggccaaatgcctcaggttctgtcttattccggaatcctgttcatgattagaatcatgctcaagagctaaaatcttcttctgaacttaagccccactgacggaagcactgaatatgcctaactcttacagtttccctccctgcctggaagtgggctctataccaagccaggtggtccagagccactcttctgcccacatcctatcctcatcctcatcttaaatgtagccaacaagaggaaaaacatccattctggttttggctgctggtagtaggcagcggtctaaggtagctcttgagtgtctcactccctgatctgtgtatctgccttctatgagcagcatctgtgactatgaagaatgccacccgtgtgattaggttacactatagggccaaggagaggggggttttcagatatacgtcaagtctgtaatcggctggcttgttcagcaaaagggagattatccccggcgggcctgaactactaaaaagaagtgtgcaagtgagctccatgaaacggggtctcaagttcagagacatgaagtgacagagacttcacgttcctgctaggcttgaagaagcaagtcatcgtaagttctacagctgcaagaaagtgaacttctccgaaaaggacacggagccctcaccgaggcccccaccaaccccttattgtagcctcatgagcccctaagcagaggacccattaaaccaagcccacaaacatggaaatggtgaaacactcacatttttctaccatgataccatttataaacatcggatacatttatcattccaaggattcttgccatttgcagatacctatgcttggctgctgaggaaggctgaagccccttgaggacaaagaaacatgagcttgttgtcatttgatcaaacgggctcttgaagcttaggtcagcagtaccattgtgaagtctgtttttcactttaaggccatgtgagacaaagagatttgttgtggtctgtagggttttactacaacataggatgtggaatatggcaaaagtgtagtttcctacacatgggtttcctaggatggcagtaatcaagtaccacaaactaggggtttaaacaacagaaatgcactgtctcacagctctggaggccagaccctgaaatcaaggcatcggcagggctggttccttctgagggctgggagagaaggacctgctccagggtgctctccttccttgtagatatccaccttccccttgtgcctgcacatcgtcctgcctctgtgcttgtctgtctcactttttttcccctttttctaaggacacttatcatattggattaaggcccagcctaatgaccacactttcacttgattaccactgtaaagacctgatctctccaaataaggtcacattcccaggtgcttcaaaataggtgtttttttttagccaggcatagtggctcatgcctgtaatcccagcactttgggagactgaggcaggtggatcacttgagctcagcagttcgagaccatggccaacatgatgaaaacccgtctctactgaaaatacaaaaattagccgggcatgatggcaggtacctgtaatcccagctacttaggaggctgaggcaggagaattacttgaacctgggagatggaggttgcagtgagccgagataactctagcctcagccaacagagcgagacactgtctcaaaaaaaaaaaaagattttttgaagaacacaattcactccataacgcccataaaagaggaaggagagagcatccaaggactaggtaccttactggagggcagatagccagctgcctctgctgtggcagcaagacaccaaggtgaccctcccaatttcaatagccgtgggatcatcaagggcaggagaaagggaaaggaagaaccttgaatgtgactgcatatctaagtccctaaattgaaacagaatgacctacctggaagtaagagtatgatttttttctttccttctgagagtggaaatgagggcttgtgagaaagttgaaaaatagagaaagtttcatttcagcttatctgagttgtgctgcatgaatatttttattcgcctcctatgtcctgagcatgagaattgagcaccagaggaagaatccaagactccttcactttatccccagtccacagaccgaccattgtcctcagcaataggctgactgtcattccctctcattttgcatgcagggattgtacacgctgaaaaactcccttctgtctaacctcccctgcagcaggtcaagtatagttgtttgctttaatataagatatctgttgtactaagacttcattgaataagtttcttaaacagacgagcaagtcatttttccactcttgagtggcctcttagtgagttaatcattttgtggaaatacaaataaatctaacacaaaatatcagaattttttccttcttaatagaatttaaattctttgatttaaaacatcataatttattccttgttagatttttcaaataatatattcaaatgtccatgttaaatgtcagattaagagacaatgatttttatgagtaattttttatcaccaaaagttaattgcctcatgtatatttctccactgagttagtaatattatgacaatattaatgccgtagattttcaagctaaaacagatctatttttcaaatggaaaattaattctaaaaaaatgaaagtactaatttaaatcattaatggcaatttcctctttgcagactgccttgaacttttccagttctgccctaacagtccaggagaaggaaaatacaaattttctggcatggaaataacataagaaggagctgcaagtttcttggcaaagacattgacaacttttcaggataatcacaaaagggataggataactctaaaaatgaacataatgctagtctgagccagttaagtgctcactttcatagcttctggtagaaagagcattcatggaattaaatattaaatatgttctccgaagttctgagatagtaggataactgtgtgtacttataagaaaggagcgatgtcatgggtgattttcctaaacatagcagagaatcaggaaaacagccaagcatttgctgagacggaggcacataaaacatgaatctgagaatcccaagggtagaagagagaaatgtggagggttatcatcataaatcatgttagaaactagggcaagaaactcatggtgacctctggacactaaaatgcagctggtcataattaagcttcaggctttgctcttcctgggccagttcattggcatcgtctactgccaggcctcgtaccagtctacagaagagattgcctggaacaagcctcttgatgttattcacacttatgaaccaactctggtactagatgcaaaaagcatgtcacaagagggatgggtgggatgggggggaagggacatcgcaggaatcatgccactttccagccccaccaccctctggtgccacgtccacccttgatcactattaccaacccagtatccctccagcacttcacgggagggtgtcagggatcacaaggaaacacatgggacccacacatttcgagatgcctcacctcctgctcgaaagtcaggtgaagaaggattcttgagccaaacatgaaagattttttgagagctaagctgacaggagaatttcccgtaaaaagatgaaagccctggctttaacagagccccttttcatttttacctttaaaaagcttttcctttcatgttaccctgaggttattcaccgctacgacaacaatctccaaagacgttttctccattatagaagaggaaaaggttggcgttgggatttggtcaggaaatgaagcgttgaagacaaacaagatgttctaatatagagcaaacctgatgagtcattttctaagtgagcagccacttccagatacaattcatagtatcttcctagttattactattattattattgtttttttttttttttttctgagacggactttcactcttgtcatccaggctggagtgcaatggcgggatctcgcctcactgccacctctgcctcccacattcaagcgattctcctgcctcagcctcctgagtaactgggactacagttgcctgccaccacacctggctaatttttgcaattttagtagagacaaggtttcactacattgaccaggctagtctccaactcctgacctcaggtgatctgcccacctcggcctcccaaagtgctgggattacaggtgtgagccactgcgcccggcctcttccaagttattctgtcatttggcactgatccgtctttcaaagacattcaattaatcaccagagatgcaacaccataaaggagcagaatatttcaatatattacctgatatattttcttttgtcattacccttttgtaccctgtagctttctaccttaaaggctccacctacaggcagaggctcattgccttagagaaggagagacttaaaaaaaatcccaggcaaacagagggtcaagtaaccagacttggaattgcacagatgttggtgaatctacagcagccacaatggtccaggattgaatctactccatggaagcttcgaagtgggaagagccgaggatgacctagagcccataagaagataagtctgaatcagctggaggaaggtggatacccacaggatgtgtgatggggtctggatgagagcagctgggtgagaagcagcaccactgccttccttagacccaccaggatcagttctttcggtagtgatggagatggggagggggatataaaaacccccagatctctttgattaggtgaaagtaaagcaaccaatggaatgccctaattctttctgggatctcctacagcacacaaaaaaacctgatttccaacactgggtagcagcaatactgtaggtatggccccacagagtgtctatgcacagagtcctgtggtcgctggggacccaaggggtgcagtaaatacctcatgaagggcaaggaggaggtcaaagagactttctgagaataacagtatttccaaagggtgctggctcaaaaaatgaaaatatgtaagccagatgtttagcatcctgggtaagatattaacaagcttcaacatcagatgtaaagggaaggaaaagaaaattgattccacaacatccccagtttcacttcagtagaggccaataagacagaagccaacaggaaattagacttcccttcttcaggcagaacagtggtgaggccctatgggctgatcatccccaggaaaaggatgaaaggataagaagagggaaagaacccgaatgggaaagagtatttctcaaaggggcccaagttttaatttataagattaaaagaatgagggttaaaatgtaaacaaagccaccaaaatatagaaaacacagatttggaattctaaatccatgtactccattcatggaggaggtggaaacttgctgagttctcggaccactcagccagttcacagacataaaaggagacccagcggagagggagtgggtgagtgggagatcaccgccctggagagggcagctgtcccattggggggccccacctccactttttcgagtgctcttcctccacctcaagcccggtggaagccaggggatgactcagagatggggacacagagggctctcctcccagcctgaagagctagagcaggctgtcaggaggaatgtgaatacagtgggtggacctgtactccagggctgtgggaaagactggggttccccaaggaccagatgtgggcaggtggagagacagaaagagagagagacagaggaagaagggagacagagagtgcccgccaccgcacccggctaattttttgtatttttagtagagatggggtttcaccgtgttagccaggatggtctcgatctcctgacattgtgatccgtccgcctcggcctccgaaagtgctgggattacaggcatgagccactattcccggctgggagaagtcttagggcttagacatgagggccacctggagggtggcaggaccctggaaacaagaagccaaagtcaagtctttagggcagcaggagagatcagaaggggccatgcaacccggctgaatagagaggcatcattgggaggcaggagagatgcagaaaagaggtttccagcggtgcaaatgtactaagagttcatgaaagcccccggtgctgaggaatcagctggaacccttggccaggctccaagtacccgagccaaaagctctgtttcctggccccattctcctccttcctacaccctttcaagcttcctcaaacttcttcagagcttggcctgagagagagaaggaggtgaacagagagagaggagagagacagagagagagagagaagcagagactctaattaaacctcttcctcaatgtcaatgtcaggcagagaagaacctgtggcttgaaatgagcaagaaatacaaattgtggaattgattaataacttgcctgaataccaggattagtaaatttagactttgttcactacttcaactgcccacaggactgagtaaaacaaaaatcacagaccctgctgaaactgcaggaatgatttaactcctgcacacgatttaattgggcaactggaaaaggaaatacaaccttttgttctgacgttattaaagatgtgcttgctcagcatcattattgtattaagttttctgctgaagaagattaagaagagaataagaatagaataagagtaaaaaaaaagagaaatacaatacaataaaaacataaaagaaaagaatagaaaaaagagtaagaaaaggaaaagagggatgtaagtaatgcagattcaggtgtaagcacaaactaagttccatctagagactactgaaatactgcactcactttgataacccagaaaacacaggacaagatctgaacgagacctggatctgggttgtgcttcctcgatcactaaccctagtaaccatacttattagctaaaacctctgcctctagcttttcatttggaacatacatttaatatacagccctacataagttcagccaatatgcagctcaacaatatattaactaggcaagttgtatttcagaatctgtgtgagaagcggcatgcacgcagcctcccagcattcgctggtgctggggcttgtgcgtgacaacatcagggagctcttccaaatgctggtcgctcggtacccatatggaggctttcttcctctagattgccaagctttcttaccagaggaagatttaggctgtgtccacttagggccaaaataatgaatcagttcagttgttatgtgtgcaccatttatactggggtttgacagaattttaaactttttactcgattgccttgatatcatggaattattgctatttatcagtctatatttacacaaaaggcctgacatggctacacacaggccctgtggtctgataccacgtaaggcacccacagcatccctcgccagctgagatcgaatttattcacacacatgcgtctcccctccaaatggaacttattctgactttagatctcctattaggactaatgccattaactaattgtccaataatttcagcaaaattcaaagtataaaacggaagtattacctggccccactacaggagttgtgggaacctcactggcaatcagatttttcctgtctgtcttctcttgctcttcacttcccaggaaagcaggcagatccactaacttcataattctagagcaaagtggggccttacacacaagcctacgcttgcccttggagtttattttgacttctgcataggtggctgccactgcagttgtcagaatctgaaattcaggagatgccccttgacaggcagggacaccatctgatggcagtgtgacaaggagcattgttaatacaggaagggctttctaattgagagtggatacccatgcagaaattttcggatgttcccaaggccactacaaagaaacatgaaataaaaagatatatcccatgaaactacaattttggaaaagtaaaaataattacagcaagtttgtatctgggatttgttcattttaaataaaatttaaaaacaaaaacaaagcaaaagagaacaaggaggggagagggacagtaaatgggtaaaaagaaggaaaagatggaggagaaagaccaagagctgtcaaggcccacagtcgccttaaaacagaatgtgcccatccccccacccccttctatgccccccacccccttctatgccagcgcccagtacctcactccctatctgcgctgcctcccagccaggggccttgacaagcccacactctccaggaagggtatgagcacagcctctactgcaggagaggatggagacaagctctgttcttcttgcttttatgtgagtctgatactcatatcactcatctcctttctgagcattgcaggctttaaggaccctctggctggctccttaacccagcttctgaaatcccccggagctgcctgacttcccactctggaccctaagtaaacatttacagaagcagtggatgccgcttatttcttactccacaactatctatccattcttttgccaaccaaattattatgtgccaatcacattgaggtaaagcaaaaatgaacgcactttaaaaacattaaaatgtgctcagattgcaaatgtatacagctattatacccagcaggaaaaaagccaattaatttacgtatttaagaaaattttcttacttgaggacaaaaattaaaaaggggaaggaaactcatgttgaatttcacttagaaaagtcaaagtgaaaataatcagaatgtcttcagctacccaaggatttactgttaactagaaaaaagcatcgtttccatgccacctcagctttccaaatctatcattctaatccatttttaaaaaagaataaaatctgaaaaataaagtacatctccaggcctctcatattgcaaatgacgtgtccaatcatacttctacaaggaaaaaattaatggcaaagggggccaagagttaactgctggaatggttaactagaaaaggcccagtcgaaattaatccccatgatttcatgtgaatttcaagccatagcttaatcctacatgtcagtacaacaggaactgcttagctctgctaatcagattctagaatttttcttttctttttttttttttttgtaagcatcttagtttcgcaaaggcagctggctgtgatggtattggtcactctgctgaagaatatacatgggacctaaaatagctctgggtccttttcaactgtggcagtttcatcaatggcatccgttacaagatcctggtagtaatattgatatatcaaagtaccaattaaaccatctgcacaagggtatccatccacctgtgtctgataccatgtaaggcattctttcacatctggcacaaagaaggaaaaaaggcacaattctacaagattggattttgaaagaacttctgtttgaagagtgaaaagaatagatgtgacatgaatggacagatgaattaggaggcatacagtgtaataacacaaagaaattattgtgggttcatatctaaactccatcagaaaatatattcatatattctgtaacatgaacacatttaatctatagtggttgttctcagagtaacagaaaaaaaatattcttattattaagttcactttcagaaaaatataattaaaaaccacataggacaaggagagacaaagaataaatttccttgaatcatctaaaaataaatgtatcaatatagcaacataccactgtgggctcttcatccttcctgcttcattaattacagtccagtgacacctccatgcccagtcctagctaaaaatcatactctcaacactaaatattaagtctcagattctgacaagtatgttcatgtcagtagttacaacaagcaaaatatgtgaaatcaggattatagctgtgggtgctagaagtggattctctgtcctattattctccattttcacacaactacacatccatccatcttccatctttccgattctgttctgtgccctcagaggttgacacccacaggccaaatcacttgggctcccttgtcctgcaacctccagttgggttttgacaaggggaggtaccaggaggtcaatgggtacagacggaggggagagagagagagagagagagagaaattgactggggcttccctccatccttcctggccctgcttgcttgaaatctctggttccggtggggactgcaaccctctaggatttaccatccaccagatgtcccttctgctagggctccaattctcattagctctgggaacagcatttattcctcttgtccctaaagacctaacaatagtaacagcttcgcaccatgaatagttcaggtgtcttgacatccttctttgttttttttaaaactgttttcttcagcctcctatctgagggtactgttttcttctggaatctgaactgacacaccctggaattacagggttatgtttccctgaagggaagggtgacaataggaagtactaatgaagatatttccccctcaggatgacatatgctctctaatttagtgactctcccacccccccaccaccccccaccccccaaccccatgaggtcagcatggaggcaccagaggacatatttacaattcttggccttcaccttgatgaaagcagcaatcttggggagagggagaatggtaaggaaaaactgccgaggtgcaagctgtttcttgaccctgtgcccatcctgagctgtataagattctcagagcacaggaaaagaaagccagagccagggctgagccaggtggaggaggggagggctggaagcctggacctctgggaggtgctgccccgccatgtgccctgagggccttgatgtgggagcagaagagatggcctggtgtgtccaagacagtgagggcctggttccagcccccgctcttccaggagctaaaaagagcctccacatcctactgcactgaaaagaggagttggccttgctgaagggaggatggcccacaggggctcacagggtcagggcaaagggttgctcttggggaaagctgcaaggaggtgtgaactggaggcagagctgctggaacacatctcagatgccaaccttaacagcgaagacgcatcaggcatctcagccccttcgggcagacagagacactgtgctggatggtgggacgctgcccatgacacggctcactgtgagctcccgacttagattcaatgccagaaacaggggcagagaggccaatggctgaatagaggagacttccaatctgaaacgcttgagtgtctctcccggtgggtaagattctggtttttacccttaggtggaaggtggaatgggcacactagaacactattcttttctccctctttgtgagcagcttcttcgataaaaacagtctatttttttcccaggtgcacccaagtgttcagtggcttcagtgaataaagtcactggaagatatggggctcatttctatttaattagatataacttttcattatcattattgtgaacttggctttaaattatgcaaatatatataaactatacattatcacttccctttatttaatcctttatatatatatgtatttattcctttaaataaatatatacatatatttattcctttatatatatgtgtgtctataggtctgtgttttcatggccatacagtgggctgcaggccactttgcaggaattcttcctacctaccacacttactgcttagcacacaggtgttcaaaagacatctgtaacaaataactaattacacataattgtaaagtaaagtaaagctagaccaaaatgacataaaatctgaatcaatgtttccatgcagaaaatcctagctttcactacagctttattcatttcatacttatataaaatactcatggtatttttccacatacttagtgctgagttacactcatgtttgctttccattctctgctgtctttttttaataatacagaaattttcatacaaaaatgtactgaacacgtgtagtagcattatagaatcagagcagtagctgcaaatgatttatgaaactatctactctggataatacaacagtgctatacatacacaattacttcataaaatatggaatacaaacatgaataggaatgcctatgacattcaatgtgttttgtcggcctttaaaaacttatttctgaacacagtggcttttcttcttctttaaaaaaaaaaacacattctatcagaatccatctaaactatttcagagatgtgaaaagctgtcatatttgcaaagaccaacagagaaaaaggtattacagttatccattccacctcttgatgccagttaaatatctttgggagctcatttaggtttctaaaagagaagatcatgcaaaatgcttattttaggtctccttaatggagactgaagaatgttatgcagctctctgcgttttttttttctttttatgtctaaattatttgacttctttaaacctttcacctggatacttttcaagttttccacatgcatctttaatagaggaggcctggaaccaaccaaacatagattagaacacctcacttctctaaagttaacctttatcgggcaagctcagtcactcaagaaagagtcaagagccaggatgtagacaaaagaccactgagctgccacatcttcacaggaccaactaacaggcaacagaattgcaccaaagcttgaggtctgtaacctgtactcagatccatcgtaacccacttattctttttgtagacaacctaccaacaaccattaacaaccttgtcttcaacctatacattaacaaaataaaatgcatgtcaggacacagatgacagtacctaaacaccaatagcaaactggagctgatggtggagctacatccacagacatgcactaaagaagaatagatttttttttaatggatgcaatcagaactccacagttttataacttctgaaaaaaagagataatatatttatctagtacttcttatacatgatttttatagaagaaatcgtttaattgtatacacatatatcaacataaaaaaaaggccacagaaatgcaaaaacttttttaaaccttccaatgaccaggaagatatgcactatgatttctcctttgtgcatcaagcgctttgggagctaaagaggcttgccaaagtaaagtagcgcgtccatggaagagagaagaccagattccaggccatttaacccccaaggctactgatctttgtagtatagtcaaagacgcagactcagcattcttaaacttctgattgcctttcactcacttgcctgctcttgcctcctaaatatatgtctgttcttaggaactgtatttggtctttgtagtagtcagtgagggatgccataaccaaacactactgacagggcggcctagacaacagacactgattttctcgtggctctgcagattgcaagtccaaaatcaaagtatctggacgtttggtttctcctgaggcctcctgcgttggtcttcagatatccattgtcttgctgtgtcctcacatagccttttctctgtgtttgtgctctcatggtatttctgccttttcttaaaagcatgccagacctattacattagggcccaatacttacagcctagtttaacatgaattgccttggtaaagaccctatctctaaatacagcctcactggggaggttaaacttcagcaaataaattggccggggcggggggggggtgcagaattcactttccctgaaaggcatatttattctcaatgcttcgattatatctccaatatgatgtacaccaaacctgtctcttcaggtctcaggtcttatttgtgctacagtcacaaatgtatttccaactacctacgcaatattctcattctgatatcctgttagactaaacttgtatcaaaccaaactcattggcatcctggtcaaagacattttcttttctcgtgtccttgcattaatcaatggtttgatttggtttgaactacttttcactattcctgtcttcctcatttctccagccgataagcaagtcttactgataactctgttcaaaatgtgtttgcatttagtcattttatcctccccctctaccacttgagtaaaggccttcataacctcacacctgaaagagcacgataatcatctaccaccttggacccaaggtagatgctcaaccttatttaatgccctcctattgtgtatgagaggaatccattaataggatggtatgtcactcttattgttaggttatgttataagacataggtagctttaagaaaggattaacctaagttagacttaacctaatcaagttaccccttaaaagagacgtagctcatcctggtgaaggagacttcaatcatgagagaaattcaacaagaaacagattgttcattgttagctttgaaaatgaagggagcactcactgtggcacggaatgcaggcaggtgacagtccccggggaagagccagtgaggaatggagtcctcaatcctacaaccataggaattgaattctgccacagctacctgagcttggagaatgaccccaagctcctaatgagatttcagtccttattgacaccttgatttcaatcttgtggcactccaaacacagaacacatctatctatgttatgccaaaacttctgagctacagaaatggtgagatcaccaacaggggtctctttaagactctagatatgtggtaagttgttacacagccatagaaagctaacattacttggttaccctctaattcacctcccactgccacatttatatttcttgttcaattagttcattattttggtgcccttttaccaacctcattgaacattatcataatgctaagggcctatgggtgagtattatatgccttaaacatacacacacacacacacacacacacacacacacacacagacacacacacttcccagagaaagcagttacgtgacttttggaaacataaccaaactgtcaaaagaacataaaactagttactcatatttggaaaggtaattcagtactatttgttctgctatggtgtaaaaaaaatccacaatattttaatggcaatagttattaaatagtgaaaatctagcagcatttacatcaactaatgttaagttccataagtactatgcccaaatattattttatcccttatcatgttaattcctgccattgaaacttacacccagttttcaaagaactttgatttttgcctcacctaagacagcaagtctattcccccaatttggcaatacaaaaacttttgtttcaggcaagccaatgttctcagtgctccactgtgcatctctgttcaatgcgattcctttcagaaccacttatgaagaagaattcctctccatcaatccaaacctttgagatgcatctatgcatctatgaacttcttgttcataaattcattaattaacaaacatgtactgaagtacctactgggtatactagaaatgatgagatgctttttcattggaaattggttaaaactaataaagattaggaagctgtaaaaaaaaattagacaaagatctctatgcaagaatatcaaattatactggtcaaaattcatctctactttacaaaagatgtctgtaaaccacaggaaggagacattgtttttaaaagtatacatgtatagttggctatcttttgcttaacagagaaggaaaataagaaaacatttgcttatctttaagaaaacaagctcaggaagagtaagctggaaacatggcgttgatggaacacaagtggtggatggaggtagtggagggccaggaggaggcaatgggaggataggaatgaggagggaggcagccttctctgcagggaattttttgtatagattttgctcctggaaatatgttaaaggtccaaatacattcagtcaacaaaggcaggacaatcctataactgaaaacatactgaaacaaataaacctaattatatctcaaatggatatcattacctctgtgaagggagaaaaaaaaagaaatagaagtaatccaagtgattataattcatttggaataggccttttcctcacctctgaattgcaggggttgttggtatttaagtgattgaaggtcgtctcttatgttgccgcaatcccctattattttggcaggactcatgactcgtctaaatagtcagttttcatcttttatttatgctgtttttttctcctatgtacacactatagaaatggaaacttcactgtagtaaacttttccctctttgttaatgaccactgctggcctaaaaatgttacctttattttaacactgctgcctatggctattagaaaaagttgtttcacacataaacatacttcttggaaccaaaaactttccatataactaaaatgtaatgcttgactcatccagttctatctatctatctatctatctatctatctatctatctatctatctatctatctatttatccatctgtccatttatctatctatccatctacctgtctatctatctatacttcccccacacttatatatgatcctcttttaacgacttggggaacttttcaacattttgttactccactggcttttcacacaaatggggaaaagacagacttaagggtaccagataaacaaaaattactaaatagctaagagcaactgtctcaagggtcctggggacctggaggccctgctgccaatgctgggacccagcacctccactccagctgctgctgccagatgtgagtgccagggtagtcagatgtgttgtttaactcaagtgaaaatggaaatccaggtttttagatgtaatcaaacagtttccaaatattggcattcaattcaagatatttatttctaaactatctgagggccactcccaacccatctataggtcacattcagctgctgaggacattgtgagacctcagatatggaacaacaaagccaactagagatacctaagcaccaagttatgtattacaaacaagatttgcacacaagggagaaataaaactgggagcagaagtggaaagtgctgcagaaggaagacttgaactgaatttagaaggaaaacactacatcttagagtatagaaaataaaagggaaaaaaaagtttgccaatatgtcatggctaattatgccctcagtgtctttgtaaacggaagtgccaggccactattcactgaaacttagcttggttttaccaaacctcgaaaagttaatattatgatacatccagaaagatgaagataaacatgacatgtttataatgtgatttccccattctacctctaattttttaaaaaaattatcattgctttttttttaaagttgtgagtatgtttcatataatgtttctgatcttttctcaatgtccagttgtttttacttcttgctgggtcagagtataattcttgaacgagcttcgctcttatttccaaatgcttttagaccatgggtccaaaaagccatattagctagaattttgcataaactgaagataagaaaactatgagtgcatgacattcttataagaaaaatgttttggtttttagtttcctaattaagttttgttaaatcaatgttgtcagctctgacttctagtgtctctgtgtcactagcatttgattgctgaataagtattattttggtgtattttaaagtattattatctgtcacaatatatatgattttggaactatttgtaagtatactgaaaattctatatctaaaaccatatatacatttatcatatagatacacctatctatagtatctatatctgttttagatacatattttacatatatacatgttaatgtcatgttaatgacatgttgatatcatctcttttcttttacatgttttaatctttttcttgctcaattcccttgactatttcacaatggaaataaaaaagaagttcttaggaccaaatcttctataaccttattacacaattgggttatttctattattttttaaatatatggaaaataatcttcataagttccctttctcccaaatagtatattgtaaatattcttatacaattaaagatgggtcagaaaaagaattctacaagaagtaaccctaaatgaaccctagtctacataacaaaagatgtacaatggtcagagatggcctgactgagggtgtcgggtaatttggtaatgctggttcacaagaaatgatggttctaaggggctgcagggctggagagagtaccagacacccctctctgtggaggccactttctagtaaatgatcagctggtgttaacccctatggggcaatttccaatatgagtaattacttcttgtgcatctaaatcttccctgaatgtgcagctgggaatactttcattacatgttattctttccacaccataaattaatccctacacgtgctgtagatcccctgtgaatctcaaaaaggagttgcgaagattaatcatttaatttgtgtgaattgtgtgaaaattgttttcccctggctctttgagaagctcagtatatgctcagctgcacacaacggaagtatttgaacaaattaatttactgagcaactactatgtgtccggtactacgccaggcagtgggagaatgaagaaaattattagacaatctctgacttcaagggatttattagctagtaacaaaactgaaatgacatggttaggccacaacctcaaatgcctatggccaacgaggcagagctaagagcaactgtttcaaaggcccaggcacgctgccaatgctgaggcccagcacatccactccagctgatgctaccgatggacacgatcaccagtgtgtccaggtgtgttgtttaactcaagtgaaaatggaaatcctgctttttatgtgtaattaaccagttctccaatgttggcattaaattcaagatttgtatttttaaaactatctatctgtgggccaatccccacccacctataggtcacattcagctcctgaggacattgtgagaccatggatctgaaacagcaacaacaaaaccagctagcgggatggtgtggtggcttgtgcctgtaatcccctcaatttgggaagccaaggcaagtggatcacttgaggtcaagagttcgagaccagcctggccaacatggtgaaatcccatctccactaaaaatacaaaaattagccagtcatgctggtgggcgcctataatcccagctactcaggaagctgaggcaggagaatcgctttaacccaggaggtggaggttgcagtgaactgagaccatgccactgcgctccagcctgggcggcaaagagacaccgtctcaataaaaaaaaaaaaaaaaaacaccaactagatataactaagcagcaaattaagcaccaaattatgtattatgtacataataaattatgtattacaaacaagatgtgcatatatgggaaaaatgaaactggaagtggaaaatgccacagaaggaagacctgaactgaatttggaaggaaaatactatacctttgactatagaaaatgtaaggggaaaaaaacagtttgatgacatgtcatgattaatgatgctctattgcatgctaatacaatggagattatcctaaatgatggagacatgaccttcacagaaaaatctggaaggcactgcaaacattgaataattttcatataaactcagatgtgaacaacatccatgctcccaaacatttctccgctagtaataagaagatgattatgaaaatgaaaaccttgttcctttcagctattacgatataaaaagtggttattgttaatacattgtgagatcaagagtgttatacagacaagaatgatgaccctaacatttgctttcaagatgttttgaaatatttgtcaagctggtcattgtgtggagatgacatttaaggattaaaggctctttgcaaactcccctctcctggccatgcctggcctatgcaggatcctttctaataagaaaggatgcaaatgcatgggtggtgacaggcacgtggccttcttcaccgtcactgctaccaggaaccgagggatcactacacatgtctcagttgtttgtagcccctcagggtcaggaaacacctttcaaatccacgttttatttcctgatcgatgaaatgcagccactgtggcatattcatgcatctctgctaagaaagaaataatattcatgcatctctgctaagaaagaaaagtcaaaaatagaaggggaaaaaaaactttttgtgggaagagagaaactggaacaaaatgggttggaataaaagattgatgaagaggtattcaatgcttgcagggaaaaaactgggaaaacaattgatgtcaggaagctttagataagacactcaagaatttcattttaatatttattgcttgtagtgaaattgatcggtatctccggcatgatgaggtcatgaaagaagagattgatgcaggcaaattcattatttctgcttctgttctttctgttttgatattagtctattttctcccaataaactatcctattgcatacctcccaacttttgccatttgtggtaatgtaattttcctgtcatcttttatgaaatactagagtacccatctgttgtacgggtagggataaaatagcttccttcagaagaaaacactgactgtaaacagccaagccccatgaaagacaagtgaatcttctagtggtcctttatcagattatattttctggtgccagggcagcccatcttgcttgaccttttttacttatgtacatgagaaaaaccgtgggtcctaatcagtcatatgataatattctgggtttttttttcctagcatagttattcaactaagatattttaatgcaaatactctgatttcaatttattgaaatcaaggaaataaacataaaaaaatggaaacaaacaatgtaatttagtcaggtatcttgaaagatcaagcactacattatgtgtctcagagactggcttcagaagtcagccgctgtcctcagagacatgactgaccttaaaacgcaggtgacaatgataccccttttcctcagagattgtagcaaatcccaactcaaaatctcacaaaaacaaatcacaacaacagagtctcactctgtcacccagcctggagtgcagtggcatgatctcagctggctcactgcaacctacgactcccaggttcaagcgattctcctgcctcagcctcccgagtagctgggatcacaggtgcctgccaccatggccaactaatttttgtatttttagtagagatggggttttaccatgttggtcaggctgttctcgaactcctgacctcaagtgatctgcatgcctcagcctcccaaactgctgggattacaggcgtgagccagaaaatcacaactctatccagaagatgctcctgaatctgacatccagggggataggatcagctgccttcttggatgtggtgaagggatctttatctcagctgtcttgccgaataagcacatggagctgatttcgattgtgcactgcagatcagcaaaaatctttctacttacactgtgcgtaagctgtatggaaaaagttgtactgttgaaattatttttaatattatcacattgtaattgttagattagattttttttaacttttaagctcaaaggtacatgtgcaggatgtgcatgttagttacataagtaaacttgtgtcatggagttttgctgtacagattacttcatcacccaggtattaagccaagtatctattagttatttttcttgataatctccttcctctcatcctctgccttccagaaggccccagtgtgtgttgttccctatatgtattcatgtgttctcatgacttagctcccacttatatgtaagaacatgctgtgtttggttttcccttcctgaattagtttgctaaggataatggcttccagctccatccatgtccctgcaaaggacatgatctcattcttttttatggctgcatagtattcaatggtgtatatgtaccacattttctttatctagtctgtatgagaatatagacgggaagacaaagagagagtaatgaaagataagagctaaagtcccaccaaaccatcttaatttttgccaccaacttaggatacttccctcatgtcacatgtcaaccaaaactgcagctgtctgatccaccgtctcatgtccaggccaggtggcctctcaacatctgtaataccataatagcttcttccttggatgccctgcctctaccaggccagttccccaccatagccagagggccgaagtcctagcaggtgccatggtgacggaagcagaggatgccagaagcagaggatgccagatgcagggtcaggagctgaggaaagcaggcggcctgcagcaagaaaatgggtccctggagcctgcaggagcaacagccctgccgacaccttgttttctgcctggggcattctgacctccagaagtctaaaggaagaaatttctgttgtttaagttcccacgttcatggtaattgtggggtggggggagcggggagggatagcattaggagatatacctaatgtaaatgatgagttaatgggtgcagcacaccaacatggcacatgtatacatatgtaacaaacctgcacattgtgcatatgtaccctagaacttaaattataataaaaatatatatatataaaaaaaagcagcaatgggagactttacagtactggatacatgaaggttttatgtacaatttttaaaaactagtgaattcaaaacaactgacatacctttagggtcaatgaaatttgaaacaaccacagcaaatactttgttagtgtccatattattacataattattaataacattaagtataccatcttttcagtatttaagtgaaaatttacaatcattcagtaaggaaagttttctgatgaccatagcgttctttttacttggtaactgaaatagtgaaaacagaaaatcataaaggctatctttttccaacaaagccctgactggaaagaaataacaaggtcatagtctctgctaacaagggcaactaactttcctgtaacagttgaagttttgttatagtggtttgaaagattgctgatttataactttgagatttaaaacacttgctataagaatagatttgttaaaatatttgttgtagcaaagaaaaatagctgtgaaagatgcttcctgggagatggtttgtacctggcaactcataatcattagctcacaatgacttcactgatctgggtctaatcaaagcatgaggaatctgaaaatcagaaacatagctaagttattctcccctgtaaaatctattatacaggtgaaaataaaagttactctaacgacacataatctcaacttgtttaagtaataataatttttttcctttttttttttttttttttgagacagagtctcgctctgtcgcccaggcaggagtgcagtggcacaatcttggctcactgcaacctccacctcctgggttcaagcgattctcctgcctcagcctcccaaatagctgggactacaggtgcgtaccaccatgcccagctaattttttgtatttttagtagagacagggtttcaccgtgttggccaggctataaataattattatgtcatattcttaagactgctcagtgcttagggtgagaaagccttcccaagggagggtctgttctctcctgcctggtcatagggcatagtacatctctctccatttattttctattctttgagacaattattcctcatgttccaatattctttttcttttcactgtctttctgtcttgaataaatctccaacatcccccacaactatcccttttaagtttcagatacccagacaacaaagcacataaccaagacgcttgatcacacacacgtgcatgcatacacgtacacacttatacaccatgcatatatgtgtgtgtttgcacacaaaaatcttgcttcgcaaacagaaggcggcatgtaaataactgcttggaactcattggcagataaagaaacagaggagatgtcaattatttaagataacaaatgggtcttttctcttagtattgctcccctgccagagcaggttcaatcttaagaattttacctttatcccacccctctgccactgtttcattttatggccttaggactgtcatttggcttttccttgaccagttctttccataagacttgctggcctttgtttcctttctgatttttactgttctcttgtccttgctgccctcactgtaactggcttctgttcatttctccaacctgtcaagagcatttagaatcccattcctacccagctaggttctgttgccccatctgactttacgacatcctcatgcaaggtgaccatgtactctactccatcaccccagtcactgacgaagagccctgggcacagggctgacccaggcgatacaacacctgtgtctgccaagttaatggcattccattattaattactcgttaggagaaatgtgtgggatgacaggggataacacacacctctaacattcccagacatcgaagcaagcatctcatgggcttctgtggaagttcatttacataagtggttcttgatcctgatcttgtagaggtcataaagcctttgtggatcggataaaagctatggattatcttttcgaaaagctgtgcacacacacatgccacagcattttgcataaaatttcagaagattcaaggatttcccttgaagtacatctctagaactcctggagtttagaacattcaggttaagagtatctagtgaaggtaattttaaatattgtagcatctacattatctttaaaagaaatgtacactagatgccagaagaaaatataatttgaaggattttctttaatctagatgatatcacatatataccttaaaaataatcttgattgacctatgctctcaggccaaagaaagaattattcatgcaatcaaatgaaaatgatttttttctgctgtaaaaagtaaaattattttttaaattgtggtaaagtacacatttcatacaatttgccatcttacccatctctaagtgtacagttcagtagtgctaaggaccacagttgtgcagccaatctccagagccatttcatcttaaaaaactgaaactctatactcattaaagcattacacaataactctcaatctcccccttaacccagtccctagcaaccaacattttaccttctagtctctatgaatttggctactctaggtagttcacagagtatttttctttttgtaactggcttatttcacttagcatcatgtctcaaggtctttgttgctgcatgtgtcaggatttcatgcgttttcaagggccgaataatattctattgcatgttgcatgtatatactgtatcaatttttttttatttttttgaaatgtagttttgctcttgttccccaggctggaatccaatggtgcgatcttggctcactgcaacctccacctcccgggttcaagcaattctcctgtctcagcctcccaagtagctgggattacaggcgcgtaccatcatgcccggctaatttttgtatttttagtagagatgggtttcatcatgttggctagactggtctcaaatccctgacctcaggtaatccacccacaccagcctcccaaaatgctgggattacaggcgtgagccaccatgcccagccgctgcatcagatttttgtttatccattcacacatcaatgattacctggattgtttccaccttttggccattataaataatgctgctgtgaacgtgggtatgtaaaatcaaatttttagcaaagaaatcttactgctgtgtaaatactattgtttgttttaaatttttgaaacttttaaaaatcatttcattgttaggcacaactgacaaaaagagaagtacacaaaacaactcaatgagtcatcaggtagcaaacagtcatatcgccaccacccaagtcaagacacaaagaaggtttccatgtagcgcttgctctctgaggtgtgtctactacacaacacagagttcccatgcagaattaatctggtctccccaagaatgctgccagacagagattagtaatcccatgttctgggttgagtaaagggaagcttagagaatgtcttacaaggtcacatagctagtaagtgatagaaataggattctaaacatcagcctttttcaccccacctccacatgggttggactacatagaggccagctggtgcagtaaaacacatcaattatattaaaattatccagaggtataaatgtgactcatacttggttaatgaccacattgtttatccttttgatattcttcattgtgacttctgaccactgttctaattttgccctttagagtaatttaaacagatgccttaacatttccacatgcaagatcctaagtagctaaagaccgtgggcacatccccaggaagactcattcccaggaattctccctaggttctctcagggaacggcatctccaggcaacttactcccctgactgtcctcttgtggtcacattagtgtgttaacacccctagtaagtaaaggtatgtccagaactgacactgaattttagatgttcactatcaacccaacgaacagttcattcactcattcaacaaatatttctttagagctttgcactattccagactatacctcctctgacaatgctttgattaatgcagggaaagtcacaggcacatttttctactcttgccacactgttgtcttatactgaacatgggatcaagtaaaatctgtatgcgtttcacaggaactactgccaaggaaggtccccagcatcctatatttatataattggtttttcgaaatgatctttgtgctgtcttcacagtagatcaccagggtttcatgtggtaatatttcaaaattagtattttggtggttgatcaacagaatccaataatattttttaaatgttttttcagactttaaaagttaaatttttatatctgtttagaaagaatcctttccttccttatatgcctctccttccttaaaaacaaacaaatgaagtgtgtataattgttctctgttgttatggtttgcatcttatagccatgaactctaacgaccgacttcctatgtgctaaaagtggtaattgatctaactgcattacaatttttcaatataagcaactagttattgaagtggcttaatttggcaaggaaacacctaatgagtcaatggctttattcggttaattcagtgaaaagtgctaatgattcagaaagtttaaggagttattgtaaggccgcctgtaggaaagtactaataaccaagctatgaccaactgcctcaaaagcagggttgccagggtaggcaacttaggatacaaagcactcagtgaaatttgcatttcaaatttgttgttcatctgcaattcaaatttaactggttgtcttgtgttttatctagcaactctattttgcagccttcaacatagcaatgattaattaacaggagatgttaataccagatttacttctccatgggcattcactacccacaaaaaaggtagccaacgtattttgatgtttgacttctgcaaaattagaagacataagtcttttttggaaatggcttaaaaatagaaggggcaggataaaactgcagatgccaactgtcattttccactccatccattcatttcataaaattatacagccagaaaaagatcatttagtccaaatctatttacttagaaatgtcacaagaccaagaaagtatcttacttttcaataattcctcagaatctgacttcgcatctactcaacctatttcattttggatgctgtaaggtcttcagagctagaaaggatgctgcagtaaatctggccatcaggcagctaacaaagagggcacaccagacagcagacaatgggctaatgctggagatggccctggaagggcatgggtcaggttctatgatgtcctggtgatagaagtattccaaggctggacagttctgcaaaagggataggagctggggaaatcaagaggagcagtggccaggaaaaatgtgcgtgacttaggcatacaagatgtataggaccatgaaaaatgggaaagcaaaactccataagaatttttggtaggctgctagttttttaagttacattccacagccggatgtgatagagtcccagtcatgatacctcatgtcactggccaacagggttgattgagccacaaccaggcttatgaagttggctttgcccctactcactgcttcagctgaatatctccctaaactgaacattctggtaaaaatgacatcttcctagaaataagaccaatttaagcataggtgagattcacagtctataatagagaaaaccataatttatgactttttataagctaagtttatcattgctaacactgttctttctttcatgcacacattccaccgacaaacagccaaaaattttaaataaaccaaaaggattcaatacatattcacagttctagacttattggctctagaaattggggccttttccttttgttttatgctaattaggcttgaagtcataatttcccttaaacacatgagcactattaagcgccaattctggggtatttaaagagttacaaagagagtgcaaaaggggaaaaaaaacatgaatacgacctcattcctttctttaaaaggatctcagtatagttaatgaaataagacatatttatatgaaaagttggcatatattgcctgtgcttttatgtaaaagctgcattagtataaaaaacagtaaagattatagaaattcaaagaatccatatcacttttgataggggtgctcaaaatttcattgcagtaaaaaaaagagggaattgaacctggacttaaacagttaagattcaagtaaaactgattatttgagcatctactcaacggggagagtaggcttattcacatatattctctaaatttatgtcatttcattcaaacattaaagcatatcatttaccaataaagcctcaaccatttacttcttccatatttcatatataggtaatgatatggtttggctgtgtccccatccaaatctcaccttgaattgtaataatcctctcacatcaagggcagggccagctggacataattgaatcatgggggcactttccccgatactgttcccatggtagtgaataagtctcaagagatacgactgttttataaatgtgagttcccctgcacaagctctcctgcctgtctccatgtaagacctggccttgctcctccttgccttctgccataattgtgaggcctctccaggcatgtggaggtgtgagtcaattaaacctctttgctttataaattacccagtcttgggtaagtctttattagcagcatgaaaacacactaatacaggtaatgaggtatgctagtagaaattaagtttgtactgtgtttgttttccctatgtcttgggaacagatgtatcagaaactcacacactcactcgattggggagaaacgtggggattctctctacaaagagcacaatcactgaaagtagtctgcctgaaggatagtgtcctatttcaactttgacatgtgatggctcctgagggtagagcattgaaaagaaggcaaaggatggtcgagatacatcccattcacctatttccctgtctcaagtaaatgtatatcctgggaaggacagacagacatgtaatagggagaagtgaggtggctggctacattcagttcagtaattgaatatagatacaggtattggttctgaagtttttttaacatggtaaaatatatatataatctacctttttagtcatttgtagttgcacagttcagctacattaagcatattcacattgttgtccaaccaacaccaccatccaactccagaaatttttaattttcccaaactaaaactccatacccattaaacactcacttcctgattcctacccctctccaggccctggtaactgctattctattttctgtctctaggaatttgactacttgagtatctcataaaagtggaatcatacgatatttctgtgtgactgcttatttcacttcgaatattttccgagttcttccatgtcatagcatgtatcaaaattttattcctttttaacggtgaataataatatcagaatatgaaaaatgcctacagcagcaaaaagtaagccaaatagatgtgaagccaacaaagggcctccatgttatatacatacataccacattttatttatccacttattcattgatggacatttagctactatgaattatactgctatgaacagtgatgtacagatatctgttcaagtccctgccttcaggttttgggggtatatacctagaaatgaaattgctgggtgatcatctatatttcagttgtgtggaaccaccatactgatttccacagcggttgcaccagcaaagtacaagaatttctatttctctacatccctgttgaactttttacttccttttttgttgttttgataatagttatcctaatggatgtggtacttcactgtggttttgaccagcatttccctaataattagtgatgttgagtgtcttttactgagcttattggcgtgattatgaagatttgaaagttacattttataaacatagcatcaatccaggcaggccaaagatataacatttgtgaaagcaaaaacgaattgaaaaaacacaaacaggtgacttttcaatgccattgatcagcatgctacatttagtacttaaatactgaaaaagaaacttaaaaatccaaatatagaataaacggttaagtgtattacgaagcacttgtcacaaaagaacactaagttataaaagtaggaagactggtaggtaatacaccaaaatgtttaaggtggttatttttaagtgtgtttcataagtaagctttgttttattctttacacagtcttcatccttggcactcaagaaatatttcctgattaagtcacaaattgatttttttataatagtgtgtaattacgaaataagaaacaaacatatttgttttaaaaggaaaaataaagtaaactagtaaattggttctgctgtacattagaattgtctagggagcttttaaaataatataaatgtgtggtacttctcttcatcaaagatcagaatctttgggggtggaggagcccaagcatctgtaatattaatacacaaagaaagttgagaactactgttgtggaaaataagaatgaattaggccctttggaagtgttctcttcatcgtccgttgctgcagttgattaaagatgaaccactcaaccagcctaaattgttgacccacaaaaccatgtgcaaactataatagctgttttaatgctctaagttctgatgtggttacttacacaacaacaaattattaactcacttaaaattttccccaataagggcttattgtgtgttaggcacaatacaagtgcgtaacattcattatctcattaaattgtcctaacaaaccaataaggaaaatacattatttcaaatgaaaataggcttgggatgcttacacagtttgctctttagcatccaattccaatcactaatatactaacatttgcctaatataaattagaggaaattaagagagacaaattgcaagatattgcattgtaaatacataatacatacacaaatacacaaaaattcattgtaaataattcatcagcatgcttatttttcaactaatgtaaacactcaacattaggtagtcagttaggtatgcctttggcataactgaataatatatataatatacattgtactcattaggtaacttctcatcattcatcctacttccacccacttaccctgccaagtccattgtctatgactgcacactccatgtccatgtgtacacattctttagctcttacttataagtgaaaaaatgagctatttgtctttctctatctgacttgtttcacttaagataatggcctcccgttccattcatgttgctgcaaagtacatgattccatgttttctatggttaaatataattttattgtgtatatctgccagtttctttatccaatcattcattgatggacacttaggttgattccatatctttgctattatgaacagtgctgcaataaacacaaagtgcaggtatcttcttgatgtaatgatttttcctttgggtagatacccagtagtggaattttaaaactgtaatagaaatacaaaaagccaaaaaaaaaaaaaaaaaaaaaaccaagcattttaagatcaaacaagcaaaaaaaaccaaaaaaaaaaaaaaccccacaaaatttcaagatacttcaccaaaaaaaaaaatatatgaaaagcaaataggtaaatgaaaacatgtgcaacatcattaaccattaagaatgtgcaaattaaaaccattaagacaccactacacacctattagaattgttaaaaataaaaagactatttcaagaattggccaggatattgtgctgctaattgggaatttaaaattatataaccactacaaaaacagttttgcattttcatgaaaggctaatcatatacctcatatggtctagccattccactcttaggtattacccaaaagaaatgaaagtttattatgaaatattgaaaaaatgaaaatgcatttctaaacaagccttgggtaaaagaagaaatgaaaatggaaattaataaaattcaaaagtgaatgaaaatgaagacataacataacaaaatttaggggatgcagctaaagcaatatgcaaagaaaattttttgggactaaacagaaaaaagtttccaattgtcttcacattccaccttcacaaacaaaaaatgaagagcaaatgaaaagcaaagcaagaagaaaaaagaaaacaataacgatcaaggtgaaaaatcactggttgagaaaacagaacaataggaaaaagaccatgaaaccacaactttgttctttttgttgatcaataaaaattatactgtcttgtcaggctgatcaggaaataaagagaaaggatacaaattaccaatgtcagaaacaagagaagtgacaacactacacattgtagagataccacaaggataagagaatattctgagcaattttctacctataaatttggcaacttagatgaaattttacaattcctgtaaaggctaaacacaaggacctactaaatttcaagccagagagaaaagaaaacttgaatagacttatgtctattgaagaaactgatactgcattaaaaaacctcaaacgaagaaaacttttaggcccagatgtcttcactaatgaagtctatcaaacatttaagaaagaaaaagaagcaattctacacaaatgcttgagaaaagtgaagacaaggcaatacttccaatttattttttttcagccattattactttgatacaaaaacaagacaaagatattgtgagaaaagaaaaccgaaaatgaatattccttaagaacacagaaatgttaacaaatagaattcaacaatatgtcaaataacgatacattgtgactgaatggggtttcacccaagaatgcaagtttgatttaacctttgaaaatcaaacataatttaccatggtaagagagtgaaaaagagaaatataatactctcataaggtttaaaataaaagcatctgacaaaaatctgaagtctgtcttatacagtcccacagcaaattaggaaaaatagagaactttctcaacctgataaagatcatctatgaaaatctacagttaacattacatttaatgatgaaagattgtctactttccctctgagattgaggccttaatgttaagtcttacaacttccactcaacattatactggagctgatagccagtgcaataagtcaagaaaaataaaatgcataagattagaaaaaaattagaaaattcctattctcaaatgacttgattgcctccatagaaatttctatagaatctaaaaaatgtcattaaaactaataagtaaacttaacaattatctcggttataaagtcaatatacaaaatatctaaaattggaattaagaaacaccatttacaatagatcaacatataaaatacgcaaaaataaatttacaaacagtttgtgtgaattgtacactgaaaagtataaaacattgctgagtgatattaaagaagaaagacctaaataaatggagcagtatttgctctggaattggaagacgtaacattattaaaatgtcattattccccaaagtaatctacagattgtcaatcaaaatcttagaagatggtgatagaaactgacaagctaattctaagattcatgtgacaatgcagagaacctgaaacaggcaaaaacattttgaaaatgtagtacaaaattaaaagactaacaccatctgacttcgggtctcattgtaaagctacagaaatcaagacaatgtggaattgacatcaagataaataaatatatcaatggaacaaaatgagggtaaattcaaaaatatgttgaccattgagcttttgaccaagtatcaaaggcaatttaattgataaaggacggtcttttaaacaaatggttctagaacaattgactatccattataaaaatatgaactatggtctatatcttgcatctcttgcaccatatataaaaatgaacttgattcacaatagcaaagacttggaaccaacccaaatgtccaacaatgatagactggattaagaaaatgtgacacatatataccatggaatactatgcagccataaaaaatgatgagttcatgtcctttgtagggacatggatgaaattggaaatcatcattctcagtaaactatcacaagaatgaaaaaccaaacaccgcatattctcactcataggtgggaattgaacaatgagatcacatggacacaggcaggggaatatcacactctggggactgttgtggggtggggggaggggggagggatagcactgggagatatacctaatgctagatgacgagttagtgggtgcagcacaccagcatggcacatgtatacatatacatatgtaactaacctgcacaatgtgcacatgtaccctaaaacttaaagtataataaaaaaaaaatgaacttgaaatggatctcaccaataaatgtaaaatctaaaactgaaaatttgaaaaaccacttatagaaaaaaacataagagaaaatctttataatctttgcttagacaagaatttcttagataataatacaaaaatctataaaaatctataaaagacttcatttattttgactgtcaaaataaaaaaaattaaagacttcaaatttaaagatttttttaaaaagccaaatattgagagaatatcttgcaaatcacatatttgatatatgatatattcttgtatctaggatatatataaaaattttcaaactcagtaagaaagcaaacaatcatattgaaaatactaagaaaaagatttaaacaaacacttcatcaaagaaaatacttgagtggcaaataagcatgaaaagatgtgcaacatttttagtcattagggaaacgcaaaataaaaccacaatgagatactactacaaacctatcagaatgtctaaaattaaaaaggctaatcataccaaatactggtgaaggttgggaataactgaaactcccatgcaccgcttctgggaacataaaatggtaatcagtttggaaaagattttggtgatttttacaattgagacataagctgatcatatgactaagctattctactcctagaaatgaaagcatatgtctattcaataattagtacacaatattcagagtaactttatttataacagtgcaatagccaaaaatgtgataaaaacaaatgtcaatcaacaggtaaatgggcaaatactgtggtaagtctacacacctgtatacaggtgtgcaactttctagtgtgtagatttaccacagtgtttacccacttacctgatcatttgtttttatcacattaaatataccagcaacatgaaaaaattttaaaataattatgtttaataaaacaggccagagtaaggagtgcattctatattattccatgtaagtacattatagacaatgcaaactaatctagagtggcaggaagcagattagcagcttcttgaggctgggaaagagtggggaaggtgccgcaaagcagcacagagaacttcttggggaatttctgtgtttactgtcgttactgtggtgatggtactgaggtatacaaagacactaaaattcacaaacatttatatgccagatacatgcagtttattgtatgttgattatgcctcaataaatccacatgaaaagaaacccaaattaacccaaaattatttgtaggggtaaagtaaatgcattagaatacaggtagacaaggagatactggaaatcttgaacagtatcagtaatgctttgctaagcactggcacagggggtccacaggtgcgcagggggtccacaggtgctcagttcataattctgcttcacaacttgcacacacactataaactctagtatatataaaatagtaaaaatattgatccttatatacaattaaaatggcctctatttcacaatgacaaatatgtgtgtatatgtgtacgtatctatgtgtaagtgtatatgtgtacatgtatatgtactggaatgtgtatcggcatgaaggggaagaataaaaataaaaataaaatgacaaaaatgtctcacatgaaccaatggcaatattgtgtcctaaactagtgagtatgactaattcaacttttgcatctgatgtaaaacaaaacaaaacaaaacaaaattactactgttgctttaatccactgggtgatttcccagtaatttaatttaaaaaaactggcattaagaactaagcagaacgaggatattttaatttggaaaaaaaaatccataaatacacaagtaataacattattttaaaattaaatgactgatttcagaaggaaatgttttcaacaactttattagtgctagagccctcatgccacagctcctggaagacttcaggctctcaatttaagctctttgaatgtaaagagagccagacaaacagcttttcttctgtaacactccatttggctggttaacacaagttatcgattctgggatttagggttgccaaatgctttcttaagagctctgtgctattgactatcctcgtttcctctgcacttcttttcttagtcttgggtaaaatttaaaactctttgtaccatttttcaactcatctcgacggaaacagcctcaatttactataaaaatgtcaatggctcactagtgacctaacctcaaaggattgggaacgctgcctcagacatctcttttctatgttcccagggtctacagaggctctaccacaacaagatggggaagcccagtctgtaatccagcaggacagtggaatgctactggtgagacctacaaactaagtctgcagcacagtcctgcagcttccccgaaagctcagcccaacaagcttcctgaatttcacattcattttacacaacatacatgttagtagatatttttaacgtacatatgtctatttaggggaaattattagcatcattattgccaacttacaagttattattttgcaagttttatgccctttagaagtgactttgtaacagtttaaaatattattttctttaggtaaagagtcatatttgaaaaagagtaagtcaaacaaattgtatacattttataaatttgttgaaaaccttattcttagagactgtaaagcaatggagatctttgcaaacatccgtggtcatgtctaatggtgacggcacacataatagccaatcagagctcagtaaaacataagccagcaaatcagaggccgctcatagaaggagtccaaattcctttactgcaggatgaataacttgtaaaatcctaacattcacattctaatcctctgaatgaatgctgagtagggaggagacgaagcttagaagcaaaaggaagcttgcatcctttgatgtcctctattgttgaagttacaacaaattaagacaaaaataatagttatgttagaagacaaattaaatacacgaatcataaagtagaaagaatttttgaagaaatgatattcagcgttcccagggattataagtcaggcaaaattaagtcatgcagcattttaatgtaaatattttgcatgatacatttacccacaggcttatcctaaagcagtatgtttgcacttttatcatttgccttaggatgaaaaaaaatcaatgaatttaagagttttaaacctctttaatatttgcacaatattagatgtgctataatctcatataaaactacctcctagagagcttttgagaattgcttttgcctggggtctctggtactaatacttcaagagattagaaacatcttacttaagaagagttttctttttgcccattaaaatcaaacaagctttgttaaacactgaggcagaagagattcataaatcaatgatactcccctgaactgcccaaggtttgcatcatagattaaaaaccaatctcagaattgaaaaagctacagtgccacatatctgtcacaacactaatttactgaacttaggaagaaaataacactagcatagatttaaatagttttctatgcaatatgcaatgaatcaatgtactgacttgcttggggtttatgaaaacaacaactgacaatgaatatcatcctaagtaaagagaggagttatggtttaaaatcatgtgactacacaattcctacatttttttaaagaataatttacatcaaaatttttctctaactctaccctattatcacagattcttttccttgcattcttttcaatactatttatctgctatgaataatatttccatgtttaaagcattctattattttatgacctaacaaactccaggatttaaacaatgctcatctaacaggaaataccgcccttccaatctaaccttcatatgctttcgttttcttccttttcttctctctgaacatggaaaatgagtgccatttctatgctgaatattgatcaggagagaaaaatatatgaggtgtgagttatattgtgactacggtgattttccatccactcagtattacttatcgtgtcaatcacttaatcctgcagcataagttcttttttgcttatgatggaaagttttgttgtgttttattttttatttttgttttttgaaaaaagacatgagcaatctgattttctttggacttcacaaaatccaagaaagaagatttactgaaaattcatttcttaaaaaatgtgaggtccttgacaatggtcttctctacagtttcaatgttaggttttgaaaatgtgaggtccttgacgacggttttctctacagtttcaatgttaggttttgaaaatgttaggtccttgacaatggttttctctacagtttcaatgttaggttttgaaaatgttaggtccttgacaatggtcttctctacagttttcaatgttaggttttgaaaatgttaggtccttgacaatggttttctctacagtttcaatgttaggttttggtcatctctgagcgtgcataacatgaatggaaagtttttttcggagatcagaccgttatgatttttggaagtgtttcctgtcaaggagaagctcatggtctccaaggtcttatctttctactgggtggatgggccaagggaacacgaagaagcataatggagctctgtctgagagaatcaccagagtcttccccagcgtttctcaatggtctacaaacaggtctgcgggcttggatcacagacggagatccaagatgggcatgggcatttacgtgggcagggcaagcgacgctggccacactgcaaggccctcaacgttcccacgtgaaaaaagaaattgttcctcaaacagcaccactaggtcgggtgcggtggctgacgcgtggaatcccagcattttgagaggccaaggcaggcgggtcacaaagtcaagagatcaagaccatcctggccaacatggtgataccccgtctctactaaaaatacaaaaagttaatgggcatggtggtgcacacctgtagtcctagctactcaggaggctgaggcaggagaatcacttgaacccaggagacaggagacagaggctgcagcgagccgagatcgcaccactgcactgcagcctggcaacagagtgagattccgtctcaaaaaaacgaacaaacaaaaaacagcaaaacaagcacacgtgagaagccctgcttgttctgtgaacacagtcatttctgcctttccttcacagtaattcaaaagcatttactgaacaacgaatgtgtattagaacttacaaagatgggtgaataagaaacagctccttccttcaaaggtctccctatctacgggagaaaagagaccggtaaataaagggccgtgcagacgtatcttataagtgctgagctagcagcaggacaaacgaataaaggaagaaatggcagctctgatattaaagccctcagctcctcctggaaagaggaaccaagccttggtgaagcttcagagaagaaggaacaattaaaacaggctccagggatgaggagaatggactggatggaggaggagcgagcggctgccaaggtaggtgtgcctccaagcacagaaggcagccaatggtcatgcccggttcctgggccagagagcaggggggtggtaccaggtggtgctagggcccctgctacatggctggagtttctcttcttctctagttcattccatgttctaaacacaacaaatcacattgcctccaggtgttaggaccaagaatattaaggtcctgaaccaaaatgccaatatttggtaaaatggcattccctcatttatatatataagtgcgtatctgtatgtgttcgggtacttctataaaatctgccagtttttaacttcctaaatataatggctaactcttttattgtagacaaaataactaaataattgcacagacataatccaacatcatgggtttgattttcttaagggtagaacagctccagccatataaatgcagtgtgtgagtgaaaatgaggacggaagagcgggtgcagcacgggggacccagcagtccttgagccaaggtctggaccctcaaaagcagtggacgtggaaggtggtagctccgatagccagtgggcatatacgcacagagagcctcactctccagctccaaagccttccatatcgatggctccttttagcactacagggtcctaaggagagatgtcaaaaatgtttaacaaccgttgcagcagtaccgggttggaagggactccgtaagcaagttcctacctcctgagcatcaggtctggccttggtgatggtttttctctgtcaaggagattttcagcatttgcagtacattaattttatgcatgaaatttatcttcatgtactgttcctttgtttatttttgagaggaatataaaggggaactaagaacaaacttttgctcgaagccctactctagaaagaattctagagtaacaggatctctaaatttcaaaggaagccaaaaaataaaaaaataaaaaaactcaataattttgtacattttatatatgttttggtagaataaaataaatcctgtaaaaccacagaaaggtaatttaagtacttggaaatctatgtcaatatagccaagataatggaggtaaactaacctggatcagagaaaacaaaagttggaaaacactgagggatcatcttgtcggcctatcagaaacggtatccaatctacaacatcacagcaagtcaacatccgatttcttcttaaggctttccaacagcaagaactttgccatcttacaaggcagtccatcctatcaatgaatagctctacgtcttagaaagttcccctcaggaaagaaatctggtcctctatacctttcatctatcaatccaagttctgtcctctggtgtcctaaagagcaagtcaggtcttttgaaaaagatgtctcttctcatatttccagtgcttatcatgtgcctctataattatgctcttttccatggtttataagcacattgctgatgtgatgtggggtctctgcattttttcttggtgctgtcttgggaagcggcatagtatggtggtatcttctgaaactgcagactccaggcccaaatgggctgtggaaaggggaccttctttatacatgtacataagttctgagcaataaaaaattttattctatctggtatttgtgcagtagctttttataaaagaaagcaaacagcttcacctttgtttctgttatatatcctcctgttggttcagcgcataattccaactataaaggctgaaactgaattctagatattgagtctgtcactcagggcatccgttgttcctgcaagctcagaaccaagtctgctatgcattccttctgtgttttgtacaagcagatggaaaatgtctgaaacaaaaagaaactaaacaggtagtgctttcacatgccactagagatttccttctacttcaactgtgccattgtatttaagtgaagttctggaagttacaaatccccctgttactctgctgtcctatgaaaggctatgaagaaggtgcatgtgtgaaagtgccagctgcttcactgacacactcaccttcacagcctaagcaagggtgttgatcccacttgacacatcaggaactcgtgttgtggaggcattcaacagcccacctaaagccactgagtgggtgggaggcaggtgagtgactgcaatacagaccccaggggtccttcacttacaaacacatcaagagaagacacagtgttgatgcccagatatatcgtttcaggttttccatcactctattacgattttagaaataattttaggcagggcacactggctcacacctgtaatcccagcactttgggaggccaaggcaggccgatcacttgaggtctggaattcaaggccagcctggccaacgtggtgaaaccccatctctattaaaaaaaaaaaaaaaatgccaggagaattctatcacaagaagcacaaggatgatctgtgccccgccataattcaatcgctcccaaccaggcccctcctccagcaatgggaattacaatttaacaggagatttgggtggagacacagagccaaaccatatcaaccatcaatcctaaacagtgggtttaactttcctttcaggtctcagaaaagtacacaggacaataaaatatgcccgcttcatcatttcatttatgtatccatcccttcattctttcatgctgtaaacaacataaactgtagctcattcctttcttctgctctatgaaaacatttttacagcttcccatctttcttcctacttatccttggttacttgtcatttcttcagcatttgtacttcccctttcaaaatgtgagcttggtggacaccacctaaattggttttgttagatatcaccccatttttctttctgagtatcatcacatgtcagtaaatagttggaatttattcttccagaaccttaaatcaaattccttcagaggatctagaccctgccttttctagaaatgtggaggccagttttcctaaaagccatagtacgtgtctgattgacctggcattttctttcttgctgactgagacctccgtagcggtggggttattgtctctgacactgcaactcagtatggaatatgtgttccccttgtagcttcctccaccatttttgagaatgcatgttaaccaataaagtcaaaactttaatgacttttagtgggatgtattcagatatttgttcattcaataagtattgatcaatttcttgcaaaatgccagtcttgtgacctatgtagttaaaatgtcacccctactcttccttcccaagaactctgccatctgctctttaaaggttacaaatgctggctcagctcaaccagaattaatccaggcatgtggtttctttggctaacatgttgcattacaaaacgaagtcatttctccaaaatttcacatacaagatttcacatacaattccaaattattaattcctcttgaaaaactggaagacaactctgagactatatatccatagggccaaaaccagtgagagacaagcagcagcttcccctgcagaaaggttttatttctccatgtgaatgaagataagttctccaggagcagtgtcaacacagcacacaacctggcctgcgcccctctctctcctgagccctgtaggcatccaggtttatacctcctgccctaagtaaagcctcaatcctcctctcctttaggacgcacataaattatttctgccattcctgctcccttggattggtaaattatcgtatcagtataaacccatgccatcactagcccatatggcccttcatgaaaaattggaaaaaggcaccctaattctactttatatccatctgttggaaaattgctgtgaattactgattttgtcatatgaagttacatggcttctttatcccagaaatttatcataataaataaccaatagcaaatcttggaatcgcactgtgtgaatggtgtccctccacatgagacactggcaggcagggcccagacagcaccaacatccacgacagcccccaacccacacctgcttgtcacctactacagttccatccaatagcaccaccaccaacacttccactgccccacacacagcttcatgaaggccattatgccaaggggaggttttttccttccaactattatttctatgaaattttttccttctaaaatttgctctccaaatattttaccctgcacagggctctacatgctgctatttgaaagaccagtagcagaatcttcactaaccttccaaacagatattttgagataatattaaggggactttatttccatagtttaaagaaatattttgccctgttactatactttttcctattttgaattttaactagagaaagagacccatatattcttgatgtgaaaagggacaagttactctttctctgctactctctttttataaaaaataaagcaaataaaatgccacattaaaatctttttttttttttttttgaaacagggtctcactgtccctcaggctagagtgcacatgcaggcacacctcttgtcattgtgcttcaagttgttgtgctttgaagatactgcattttttaacaaattgaaggtttatggcgaccgtgcatcaagcaagtccacaggagacattttgccaacagccatgtgctcacttcatgtctctgcatcacattttggtaattcatataatatttcaaacttttccactatcattatatctgttattgtgatgtatgatccacgatcactgacataaatatcgtctagttttggggcaccaccaaccatgcctatataaaacagcaaacttataaatgttacatgtgttccgactgatacgccaactgcctgttagacactgtctctgtctttctcctcaggtgtgcctcccgatagcctgagacgcaactatactgtattagaccaattaataatgctacgacggcatctaaatgttcaagcgaaaggcagagttgcatgtctctcactttaaatcaaagctagaaatgataaagctcagtgaggaaggcacgttgaaagccaagacaggctttgcaccaggttggctgtaccaacaagttagtcaagttgtgaatgctaagaaaacttcatgaaggcaatgaaaagtgctactccagtgaacacacaaacgaaacgaaagcaaacagccatattgctgatatggagaaagtctgagttatctggatacaagatcgaaacagccacaacattccctaaagccaaagcctaatctaaagcaaggccccaactcccttcaattctacgaaggctgagagaggtcaggaagctgtaaaagacaaggttgaagctagcagaggttggttcatgaggattaaggaaagaaactgtctccatcatgtaaaaatgcgaggtgaagcaacaaatgctgctgtagaagctgcagcaagttatccagagcatctagctaagattggatacaccaaacaacagatattcagtgtagagaaaacagccttttattgcaagatgccatctgggactttcatagctagagaggaaaagtcaatgcatggcttcaaaacttccaaggacaggctgattatcttgttaggggcaaatgcagctggtttaaagccaatgctcatttccattaaaatcctagggcccatcatgctgaaatttctgtggccatgctctataaatggaaaaacagcctatatgccagcacatctgtttacagtgtgttttaccgaatattttaagtgcactgttgagaactccagctcagaatattactgcttattgacaatacaactggtcacccgaaagatacacaaggagattaattttgtttttatgcctactgactcaacatccattctgcatcccatggattaaggagcaattttaacttgcaagtcttattatttaagaagtatatttcataaggctatagctgtcccagatattgagtcttcttatggagcttggcaaagatctttgaaaaccttctggaaaggattcctcatcctaggtgctctaacaacattcatgattcatgggaagaggtcaaaatatcaatatgaacaggaattagaagatttggattccatctttcaatgacttactcctcagtggaggaagtcactgcagatgtggtaaaaataacaagagaacaagaactagaagtggagcctgaagatgtgaccaaattgctgcaatctcattacttgaatggatgaagagttgtttcttatggatgattttgtttttgtttttgagacaagagtcttgctctgtcctccaggctggagtgcagtggcctgatcttagctcactgtaacctccgcctcctgggttcaagcgattttcctgcctcagcctcccgagtacctgtgattataggtacacggcaccacgtttggctactttttttctttttcttttttttttttaattgttgtatttttagtagagatggggtttcgctaggttaggcagggtggtcttgaactcctgacctcaggtgatctgcctgcctcggcctcccaaagtgctgggactacaggcatgggccactgcacctgacctgtaggttggttttgagacataatgctatcgcataattaatagactacattacagtgtaaacataacttttaaatgcagcgggaaaccaaaacactcatgggttgcactttcttgctatatttgttttaccgtggtcttctggaatctaacctgtagtatctctgagggtgtgcctgtaacaataccagagttcattttttctaaatataccttttgttaaatcaccaccattttcttaaaaagcaatatgtttatgccaacaacatactcagagtgagattaaattctttaaaagaagttgactttttgaatgtaataaacttaatatataataattacatcaaactgctcttatttctcctattttatcgctcaccagtgattttgataatgccttcttctcctcacccttctacacagttcaaggccaggcctgccattccttcagaggtagagggctacacaactggtaagtccatgccgagtgaagcgagggtggccaactcttccagcaaagagaggggccctgggacttgagactttaagtgctgaaacaggaaacgtcctgggtaaactggggaggattggtctcacttaagggcaactagattcaagtaattacagtgattctgccacacaccttggctttctctgagcagtgcggcccatctcacactggaatgcgtgatgctaaagaacctctacagggtaagcaagggcagcaaggacaatggaatagttgggctccatctgtgaaataccagagcagcaaacaggagtatgagaggtttccataacactttctgaagactgtttgtcatttttccacttatctaatcaggtgttttcataaaactcaacagaatatgtatacaagtataaaatgtatacaatgtatacaagtataaaatgttcatattactctatcttcacctcttcttctttttcactagaaagatgtcacactctcaatgccaatttcagtctatgttacagctacaacgatacctcctctctctggaagcctcaggggaatgtctgggtaatggagagcaccgtatccacactttacaattttaaaacttaaagccacacatctgcggcacatgacagtgccaactgccaagtactgaactgacagagattcacaccataatgctaattctctgcacaaggaaggaataaaagtatgtgtcaaaaatctgaaaatgattgatgcctgccatctcatcaagactgtctgtcacacgatttcgattgatgatttgagattgcatgtgagcgggacgcaggtgctgcaggttgcctaactagctcaacacttattctcaacaacacaaagacaaattaatctccacatcagaatactttccataaagttcattagactttactacatctacaaaaggcttgaggtggttggcctaatctcagggatactaaattcctaaccatagaggacagctcaacaaatcagccactttcaaaggtactggtgagtccaagagacccaaaaatgtgagaagcagtgctctggccattgtgaaggcactgaattgttttcatcactgggggagaacatatctactctcagataaggatatccctggattttctggctgtccagttgagactgctaaggactcggtcagaggtgtaattagaagaacaacttgtgatttcagtgattatttctaaagcacacagtactgtttaaacatgactcttatgtatcttgtgactacaaatattgaattagtaaactctcatctctaaaaaggaaccccaaatattgacttgaaaataaccacttttagccacaagattatagatgcaacctgttgaaccatttagtatgaatctgcctaattaagcaagaggatttcaaataaccaaatatttctattataaaacacaacccaaaataacagttaagaaaagttatctcacctcccccatcctcacataaccaaggtatttgaaattgttttaatatttgcataaatatttaaaaagtttcacctttaacagaataggtaactagacgatgcctcatcttttctcagagttcaacacatttggacccattctttagatgaatgcacttgtttataaaaatgtgtgatgaatgtcactacattagcacgtaatagataatccaagttattttcagacttaatcagttgtaagtaaagtgtgagggatttgagaacacagagagagggctggtggctctgcagctcctggtcaacatggaaaatatgcagcatttcccgtggagcctctcagtctcgctggcagctgcaggatcagcaggtctcgatccatcatcattcctccttggccccatacgggctgtgaggacacctgggtctaataacagaagctaatcactcggcagtcatttatgaaagagacataggaatggaaagaaaaccaggaaaaatgaaacagatgaatacaaaagtacgctgaagagactgatgttaaatggaatgggattataggatattttaagaaaatgtgagagtattacaagtaacaaactacttctaatagcaaaatattgccataaaaatacattattaatgttacataatacacaatatttcattataacatattataaatgcatctttaaatatctttaaagttttaagaggataaatctaaaaattaactttccgataagtttggaacatgcatagaatgtagagatttaactttgataaataactctgtactaggacagtggcccgggagacagaaggagaagaagcatttgctcctgacttcaaggttcttaccatctccaggagagacaaatgtacaattataaccacagcaggagatgataaggctaataggtaaatctaaaagaagtagtctctgaaaaagagtgttctctccctctccctctccctctccctacggtctccctctctttccacggtctccctctcatgcggagccgaagctggactgtactgctgccatctcggctcactgcaacctccctgcctgattctcctgcctcagcctgccgagtgcctgctactgcaggcacgcgccgccatgcctgactggttttggtggagacggggttttgctgtgttggccgggccggtctccagcccctaaccgcgagtgatccgccagcctcggcctcccgaggtgccgggattgcagacggagtctccttcactcagtgctcaatggtgcccaggctggagtgcagtggcgtgatctcggctcactacaacctacacctcccagccgcctgccttggcctcccaaagtgccgagattgcagcctctgcccggccgccaccctgtctgggaagtgaggagtgtctctgcctggccgcccattgtctgggatgtgaggagcccctctgcccggctgcccagtctggaaagtgaggagcgtctccgcccggccgccatcccatctaggaagtgaggagcgcctcttcccggccaccatcacatctaggaagtgaggagcgtctctgcccggccgcccatcgtctgagatgtggggagcgcctctgccccgccgccccatctgggatgtgaggagcgcctctgcccggccgcgaccccgtctgggaggtgaggagcgtctctgcccggccaccctgtctgagaagtgaggagaccctctgcccggcaaccaccccgtctgagaagtgaggagcccctccgcccggcagccgccccgtctgagaagtgaggagcccctccgaccggcagccgccccgtctgagaagtgaggagcccctccgcccggcagccgccccgtctgagaagtgaggagcctctccgcccggcagccaccccatctgggaagtgaggagcgtctccgcccggcagccaccccgtccgggagggaggtggtgggggtcagccccccgcccggccagccgccccgtccgggagggaggtgggggggtcagccccccgcccggccagccgcgccgtctgggagggaggtgggggggtcagcccccgcccggccagccgccccgtccgggagggaggtgggggggtcagccccccgcccggccagccgccccgtccgggaggtgaggggcgcctctgcccggcggcccctactgggaagtgaggagcccctctgcccggccagccgccccgtccgggagggaggtgggggggtcagccccccgcccggccagccgccccgtccgggaggtgaggggcgcctctgcccggccgcccctactgggaagtgaggagcccctctgcctggccaccaccccgtctgggaggtgtacccaacagctcattgagaatgggccatgatgacaatggtggctttgtggaatagaaaggggggaagggtgggaaaagattgagaaatcggatggttgccgtgtctgtgtagaaagaagtagacatgggagacttttcattttgttctgcactaagaaaaattcttctgccttgggatcctgttgatctgtgaccttacccccaaccctgtgctctctgaaacatgtgctgtgtccactcagggttgaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaaaaaaaaaagtagtctctgatttttgcaattttatttcgtgagaaccaagaaaatcagaaaagctctctaattctatgcattttgtcccaattactcagtttctctatttcaagtaaattggatataacacttgaataggattctgccttgataagtatttatccaaccttattctaaagtttaattcattgttctgaaaattggatgaaaaaagtgaacttcttaaaggtttgtgaataaaaaatatatagtcaaaccataatgaaattcttcctgaataccaatgtctagacatttccctgtagaaaactggcagatatctaatagagtattgcttctgaaaattaactgtgtagttctgtggtacaaaatcacttgtaaaaaatctcctggtgtcaaaacagcatggaactggtaccaaaacagatatatagaccaatggaacagaacagaggactcagaaataacaccacgcatctacaaacatctgatccttgacaaacctgacaaaaacaagaaatggggaaaggattccctatttaataaacggtgttgggaaaactggctagccatatgcagaaaactgaaactggaccctttccttacatcttatacaaaaattaactcaagacctaaacgttaagacctaaaatcataaaaaccccagaagaaaacctaggcaatacctttcaggacataagcatcggcaaagacgtcatgactaaaacaccaaaagaaatggcaacaaaagccaaacttgacaaatgggatctaattaaactaaagagctttgctcagcaaaagaaactatcctcagagtcaacaggcaacctaaagaatgggagaaaatttttgcaatctatctatctgacaagggctaatattcagaatctacagggaacttaaacaaatttacaagggaaaaaaaaacatcaaaaagtgggcaaaggatatgaacagacacttctcaagacatttatgcggccaagaaacatatgaaaaaaagctcatcatcactggtcattagagaaatgcaaatcaaaaccacagtgagataccatctcatgccagttagaatggggatcattaaaaagtcaggaaacaacagatgctgcagaggatgtggagaaatagaaacacttttacactattggtgggagtgtaaattagttcaaccattgtggaagacagtttggtgattcctcaaggatccagaatcagaaataccatttgacccagcaatcccattactgggtatatacccaaaggattataaatcattctactataaagacacatgcacatgtatgtttattgtggcactgttcacaatagcaaagacttggaacaaacccaaatggccatcaatgatagactggattaagaaaatgtggcacatatacactgtggaatactatgcagctataaaaaaggatgagttcatgtcctttgcagggacatggatgaaggtggaaaccatcattctcagcaaactaacacaggcacagaaaaccaaacactgcatgttcccactcataagtgggagttgaaaaatgagaacacatggatacagggaggggaccaacacacactggggcctgtcagggggtggggggatgggagtggatagcattaggagaaatacctaatgtagatgatggattgatgggtgcaggaaaccaccatggcatgtgtatacctatgtaacaaacctgcctgttctgtacatgtataccacaacctaatgtattaaaaaaaaaaaaactcctggtgtcacttcggccattcaaagtcaaatgttcttctaaatctaggtattcattaaattaacattgtagagggtttgctttttaatgaaatagttttttttgaaacctcactaattggtatagtgactcttgcatggctcttccatcggtatacatatttaagtttgaattattgctaaatcctctttgtgaataactaacttggccttgttctttagttctgtgtcaacctatttggtagaaagtggcaaaagtagaggcaagaatatttcaaatcatgcaagtgatgctgaactcagtttctgtcatatatttaagcacatctgattatggccaacgtttcccttcaactttcactctacatgattgcaatatagtttttccacgagtaagtgagaagtgcagataatactttcaaaacaaaacaaaacaacgttggtgtttaataagaccctgaataagctattgatctgtgaattagcaccaggcacgatgtgaagtagtttacatatattatctcatatcaccttcttaataacttaatgaggtgctattatgataaatattatagggtgaaaaggactaatcattaagaagtcaggtcacttgccaaagtttacatagtaagtaagtggtggacctgggattttgactcattgattaattgacacgacaaataattaagtgtctactatgcaccatgcagtgtgctagggagggaagaatcatttacttactcctcagtgactctaaggcagatttaaggcacggcttctctaagctcttgtgttgtcatttgccgcatgacacagacatagaaactagagtgattttcctccttgtcaagcccaatcatggtgatgattttaaaaaatattattaatgattacctttggcttctaatccctaacgtgatatacttatctactgattacagaaatctttgcttagttttattttccaagcaaacacaaaatatgatggtaggaaaaaagagtccaggttgctcctttcataaaatcttattcctaggtttctctcttgtggcactttaaaaaaaagtatccatgaaagccaaggattgatgtaaataaccattaggaagagcttaatgttgacaagtagaagtcgagtttgttttagaaaaacaataggaaaacctgttatatactgtctgcaatgctaaataaatatttctcatcagaagaaatatctgcttattacatttttgtcttcctgattagtatgctttattcctgacatcaacttgaaaaaagatgcaataaatgagaagtttaaataacacaggtataagactgttaaccttgggatcaagggattatttgttaatatttttaaaatgataatacctttatattaaggctaggttctagacgcacctcacattctccacccctttctggctttgcagaagccatgactgggtctgtggaataaagccttagccatcccgtgtggttgttgtttgctactacagcagtagccatagctcttaccctcccctaggaacagcaagttgcattgctatcctggtttcccagaaacagtaataagaaaagagtaggaagtataatggtagactacatggtggcactagtggtggatcaggtgaagtatattggatatctgagactagatggggtttttttaagtgtacttacataggatcaaacaacatttaactttctgaatatgcatttagtaagtataaggcacaagttgtttctgtacattcattttcatggaaggggtgtgtgtgtgtatgtgtatgtgtgcaagcatgctcacaagtgtagaagacagggattatagaagtaaaataataatgcaagatatgcaaaatttaaacagttaaaattttaggaaacctacatgatttctaatgttgcaagataagaaagcttctgctaaaaccaacatatacaaaaacgttacttatgaaatacttttgtagagatttcacccatgagcaatagaaaaaaaggaaagttatttaatatattagaaaaccctaagaaacgtggtctgtggtcactccctctctggcacctttaccacagtgatgacagagctatgcggaaaagaatttctgtgccagttcagccatctgctgttggctcacaaatggagttaacagtctaaaaggaaagtttgttttgaggtgccattcccatgtgcatacaatccacaaactgcagtgtataaacgtggctcagtctaataccaagttaagacttggtttttttgaagagcatattgcacagcattttctggaaatgctcccaatattagatacatgtcacattcgcatagaaacatatggtcttcaatgtgcaatctcaaatcgtctacagagactctgcaatcagagattccctgttttaccttccttttataagtcaattttcacttagcaaactatcacactgtggtgatttggaggcattattttaattcctaatgtaaatttacttttaacagatgtgattctatgaatcatatagcagcatatgatattagttattagctgaaatgatgccaaggggtgttacgtgctggaaactagagcaactgagccaaaccaaggtcacccccatcactgccctcacagctgggtcagggaggtctggcctggcccttgtccattctgaaggttgagagaaaaatggcgtctttatgatgccccctgcccaccgagatactcagatatatttcgccctgtccttgaagcagccccactactactaacagtggctctgaaaatgtggacttgacagatagtacctgtcactggctttctatccaggctccattcctttctgggctgcaggtttgaaaatggatgtgccccagggaacctgaatacagtgagttcacacacaagcaggaaagaagtgagtttcttttggtttgggttgaagcagttgctcaaacgtgataggcagaagaggtaaggatttcactgtgctttaacaaaatgcttccatggtaatcagtcctgtatactgtataatcactatacagaaacaaagtgtgcaccaaaaggtaaagaattttcctaggacaagaccgcagctccacaaacaaccaaggaagctgttcagaaacctctttctgtgctctcttactcccctgagttcatccccaggccccagggcctcccattccagatgtgaagaggtgaagaccacgcctggaataactccgaatacaacacaattgctcctcacatatcagctgttcttttccctgttcactactgagaaaacatagataaatcacggcactttctgtctagcattgaaaatggtcattttaagaatcagggcagatgttggctacacacagaaagctgcccaagggtaggcttgaagcaaaataaattaagaaacccatcatgtactcttgagtgcagggaaacaaactgataatagcaacaagtatgcatccttttcaagtaaagataatgagtcaacctgctgattgcatattgtggtgactgaatacattgtgcaatgattaacaaaagaactgattgttcgtaattcaaggaatatctttccatttactgaggctttacttaacctctagcaatagttttgtcaagttattcacaaaggccgtataaatcttttgttagattattccaaggttcagcatatttttgatgcacgcaattttaaatggtagcttagaaaaatcacatcttctgcctgttgttagcatacagaaatgcaattgatttcagtatgctgaatttttattcagcaaagttatacattctcttatgaatttatatgacttatcgttatattcttttgagctttgtagtcacattagctatgaataatgataggttcttactttccaaccttgaaacttgctatgttttgaatgtgtccctcaaatttcatatgttggaaacttaatccccaaattcgtatgttgatggtatttggaggtggggcctttgggaggtaattaagattagataaggccatcagagtggggccctcataatgagactggtggctttataagaagagaaaggagatcttagctggcatgctcttgccctctgccatgttatgacacaggagaaaggtcctgaccagataccattgccacgttctaggacattccagccttcagaactatgagccaaatgaactcttttctttgtaaattacccaggctgtggtattctgttgtaacaacataaaacaaagacaataacttttgttcttttactagccatattcctttcagtggactggtcataatgaatataatcgtgttttttcccaatcttaaaaataacctttgagcatttttgccgtattttccacagtttttaaatagatctttttctattagattaatgaaaatttggctgggttcagtggctcacacctgtaatctcagcactttgggaggcaaaggtggatgaattgcttgtgcccaggagttcgagaccagcctgggcaacatagtgaaaaatctgtctctacaaaaaaaaaaaaaaaaagctagccaggtgtgatggtgcatgcctgtagtcccagctccctgggaggctatggtgggaagatcacaggagcccaggaggccgaggctgcagtgtgctgcaattgtgccactgtactctagcctgggtgacagagtgagaccttgcccccatacccccacccccaaaaacaagaaaaaaaaagtcctctatttctagtttgatacgtttttaaccatgactgcatgagaaattttttaaaatactttttcagcatctactgagatcatgtaattgttttaatctgtcaatatggtaaattacattattgattatttatgtttacataacatgactatttcatgttactccagacaggtatatctggaataaatcctagagggttgtgagatatatatctatggatatatacatatatctatatatgtgtctatatctatttctaaatttgctttcctagtatttgtagtcatatcatcctttaacaacattttaatttcagatttatatttgttaagtgtacttttttattcctaatattatttgtgtctttagtatttttttcttgatcagtcttgtgagatgtgtatctattttctttgctttttaaagagcaaactattatatttattatatttattttatttttttctttgttgatgtctggaattatttttattattttatttatccattttctttaggttctttctgttgtcttttttctgacatcttatgttggatgcttagttcactaattttcagcctctgttcctttctgatgaaaaaaaaataaagctcaccaattttccttgaagagccattatagccacacatgtaaaaggatcaatttttagtatatagaattttttttttattttgtatttttctacattaataataccatctaatttcctttatgatttcttctttgatccattagttacttaagaggttttcttaattttcaatatgggttgacctagttaagttttctaacttcatttcattgtattcaaagaatactgggtataagaaattaatctttggctttgatgattcttgctttatgacttaaatatgtgtgtttgaataaagagaatgtattatttgtgatgaatatcacatttataaatttgtgtcagatatagtacttatgtatatatatatttttatatagcatttgttaattttattgcttaaattttatctatggctccctcttatttcactgagacaaatagatttagaaatctcccattacattgctgaaatgatctatttcttcttttaaaaagagcttcaagctcattcatatttttttggtaattattttacttgaaacaatggttttgaagatactggctatcaagcattgaaaactaacaatccctaagagacagaaacaaataaggtgagtcttaacattactccaacttactgccttgagagcgtttccaggctggggcctaaggctaaagtgaggagataaagctgagagttgagggagacgatggcctccaaatttcacaggacaaaatattggtgagaggtgctcagagacagagtgtcagagatctgcaaagacttgttcaagtttatgcatgtgagaaaactaaaaagaacctacccaaaaggattagagataacagtgtcagggacccacgagggtaaggaacagtgcctcttatacccaccagtgaaactgaaaaccttgctggttcacagagcattgagtagaatacacagagtggccggcctctggtgggcaacagtaagtcctagactgacccttattccagttctgcctaacaaccaacaacgtgacctggaaggataaaactatttccaagtaacttaactcggtcccagaacaacgaccaaaaatatctgtagaagagaaaaaaacatatctaataatccacaaagcataagtcacaatatctgatatccagatattgtggtcaacagaaactgacgaggaatgcaataaatacctatattagaaaagaagatctcaaatcaatgacattttctataatataaaactaaataaagaagaacaaattaaatccaaagaaagtaaatcagagtcaaaatcaattatataaaacagggatggacaaattttttctgtaaagtgtcagacaataaatattgtcatctttgtaagtctcctatggttttgttgcatattcttattatttctttttacaaccctttaaaaaagtaaaaatcattcttagatgcaaggccttacaaaaacagagctaaatttggtctacagactgtaatttacccaatactgaagtaaaaagcaaaaaagaaaaagagagagagaaagagagacagaaattctaaaaatcaacagcaaattagttgagatagtacaatagataaacatgtaggcagagagagaagacataaattataacatcagcaaaggcaaaggttacatcactacagattgtgcagatattaaaaatataaagacagattatggacaattttataccagtaaatttgactacttggatgaaatggacaaattctttgaaagacatagtcagtcaataaaaaagagataataacctgaatagaatttgttgaagagactgattttgtaaaaacctttcagtgaattctagcaaatatttagggtaaaaattacatgaatctacacaaactttagcagaaaattaaaaaggaatgactggcctggcacggtggctcacgcctgtaatcctagcactttgtgaggctgaggtgggtggatcacttgaggtcaggagttcaagaccagcctggccaatatggtgaaaccatctctactaaaaatacaaaaattagccaggcgtgttggcatgcgcctgaaatcccagctacatgagggggcagaggcaggagaatcgctggaacccaggaagcagaggttgcagtgagctgagatcgcgccactgcactccaacctgggcaagagagtgaaattctgtctcaaacaaacaaataaacaaacaaaaaatgaatgactactttccaactcaatgaagccaccactgccataataccaaaaccagataaaatattacattcctcagaaacagataaaaaattaacatttttcacaaatgaaattcaacactgtattttaaaaagtacattatgatcaagtagagtacattccaataatgagaggtgatgcaaaacgggaagagaagtaaacttccttgccctgataaagagaatctatggaggacctacagctaactttatagttgacggtaaaagactgaaggctttccccttaaaaggaggaacacagtgaggatgtctgctcttatcagttctattcaacattgtactggaggttttagtcaatgcaataattccaaattaagaactccagataaacaaaagacatcgaggctgggaaagaagaagaaaaactgtattccttcaaagatggcatagtttctatgtgaaaatcctatgggaactcctaccagaagtactaagtgagtttagccaagttggaagagaataagctcaatatacaaaattaattgtatttctacatactagcaacaaactgttggaaattaaaacgttaacactaccatttaccacatcatttaaaaaaatataaaacaggaaaacatctgaccaaacaacagaaagaaacagaagagacattgaaaacccaaaacaaaacaccactgagaggaaataaagtagcctcaagtaaatgaagtatgttatgttacaggttagaagactcagtgttgtcaaaatatcaatactctccaaattcatctatagattcattgcaatcctaatcaaaatcacaacaggctttatttatttattttagaaactgacaaagtgattctaaattttatagagtaacacaaatgacctggaatatctaaaacaaagttagagaacactactaaatttttagaactaatcaagctaccgtaaaaaagagtacgttattggtacagatacagacaaatagatcaatagaacagaagactccagaaacagacacaaacatgttgacaactgatcttgataaaggagcagaggctattcagtgcagaatgaatagtcttttcaaaataccatactgtagcaattagagattgatatgcaaaaaatgaactttgatttctgctttacatcatatacaaaattaacacacaattgatcatagtcttaaatttaaaacctaaaactatataacttctagaagaaaacaaaataattcctttatgaccttgggttaagaaaacactttttagctaagatccccaaagcatgaccaaaaaaaagagcaaagttacaaattaaatgtgttaaatttaagactttctgcttgtgaaatatactattaaaatatagaaaagacaagtcacgaacttggataaagcatttgcaagttatatatctgataaagaggacttatgtctgtaatgtagcacatgcagaactcaatggtaagaaaacaactcaccatcctgggcaacagagcgagaccctgactctataaaaaataaaaaaataataaaaatccaagcaaggtggcatgtgcctgtagtcccatctcttcaggaggctgagatgggaggatcacttgagcctaaggaggttgagtctgcagtgatccatgatcctgccactgtactccggcctgggccacagagcgagtctacgtttccaaaaataaaaataaaaaataaaacaacccaataaaaagtggaaaatgaagaaaacaacccaataaaaaaatgggcaaaagatttgaatggacactgcagcaaagaagacatatagatggcaaataagtacctgagaagatgcccagcattactttctattaggaaaatgcaaattaagaccacaatgagatactactacacacctgtcaaattgaataccttttaattaaaaggtagaccaaaccaagtgttgtcaagaatataaaacaactagaattcatctatgtttctggtctaaatggaaaatggtacaactactttggagaagagattgccattttctttgggaccaggacatttcgcagggaagtatttgcacaagaggcaaaaaaaagcacatgactacacaaagaactgtatacaaatgtccagctttacatgtactcgtcaaaacctatttaaacccaaatgtcagaacagataaacaaactgtagtatatatttatgcaatgaaataatattcagcaataaaaaggaaggcacttgcaaaatacactgtaacatagatgaatctcaaaatgattgtaatggatgaaagaatccagtcaaaatgtatataccctgaggtttttgtgtgtgtttgtgtgtgtgtgtgtatgggtgtgtgtttattaaaatatatgtaacttttctgctagagtttttttcctgtggtataaaaacaaggtagttttcctaccacctttgagtagataagtgtacttaacattaaatgccaaaggtagacaccagcaagcttttgagccaccccctccggacaccagagtgctacttattctaacataccctaccgggtcagatacaaatgaaagacagactgagcaggggacacagagctcagtaatattgacagcggggttcaaaaggatttgagacatggacttcacaaacagcagcaccgtaggtctccctgaagcactcccagtgaattcctatggttggcaatatctggaagatctctgcacccaggtcatcccaccagggggccctgagaaccagaactactttttatcactgtgcttcacgtagtctatgaagcagaaaaggcagattacggcaggttgtcacaaagaacaaggtgagtcaaaccgcaggactgcctttacttaagcatacaacagaaaaggctgtgtgtcaaactttctgaaccatttatcttttatagactgctgaagactgttgagttcagcgtctcttaatccaaagcgctgttttagaaaagataatctacgtggcaaaaaatctggtcaggtcagtgtgactgcgcatcctggggccatcttgattatgaaaaactctaatatgggaggagagagactttcagtaacaatcactcaggggaaagcaatggcatcaccctgaagggcatggattaacagataaatagtgaagcaggttaaaatctaacagtcacattcctgtaaaagatatcttcatctcacgtctaattattttcttttccattgctcttctctaattagtacttgcttagtaatggaagcatcgagaaaggacagagagagtattataattctagcaatagaaagctagacacctcattttctagatttgattacacatcttaaaagtatccatttttccccaaatttacatggcacctataatggcataatttaaactttaagtagataagatgaatagatggggactgaatgcagcgtgcttactttaaaacaaaaatgtgggttccttatttcctaatgagtaaacagaaatagaactttcctataattttcaatgctgtattttattttgattatctttactagtatgttgaatgagaagtttttcacacaccaatgtccactgcaaatgtttttagaagttctcactaagtggtggtagcaggccaatgccaccatgctctcaacctcatcgtgtggcaggttgatttagtcagcttcccatattttccaagttctgcttttatttccatccccttaagcaatgaaagtcacaccattagagttggctctaagctacctagggtaagagtggacggttagcagaaaatacataagcaataaccaaatctaatttttatctttctctcgaataggcagcacaaaaattactggaactgctaaaaaaaaaaaatgaaattgagtgctaagcatttcagcagctattctttcacatatattaaatgctatttagctattatatattatgtacataaaataaatgttaaatgctaaaatgttaaattttaaaaactaagtatacgtatatgaataaatttttaaaaaaattcatattcacatatgtatacttaattttttgaagaatattaaaggtaagacaatatagagacatgaataatacacaatctgcaaaaattaactattggattaatcaactatgtagtttaccttgtacatagttcctggaatttttggaaagtggcatgatataatagaaagagtccagacattagaattaggtagactgatattgaaaccccacagcctacttgattttgagcatgtattacttaagttgtagtgtcctcatctgtgaaattccatataaatctaatgtggggattgaccaattttatgtgtctgtagtgtcagtatttgctagcacatattggctagcaaagaatgtacagtttttaatatgcaaatctgctagaagtagggacaaactgcacacttacaacttaagcatgcaattctccatagcttttatgatgattgcagttatattattattttatcgttataagttccacaagtttctttgactatccgaatataaccaaactagtttcctttatctcttcatatgaaatgggtgtatttgtctagaatttaattctgcagcatatggaaatttgcctctgcaatgttatgtattcctgtgacattctctggaccattctcaaccgaagaggaaggtatacacaccattccttgatttttaaaaacttaacaataaaagaaaactaagagagtggttgttatcatacctcggtatttaaaatagcaaggcaaaagcataaatcctctgaccatttactcacaattgctcatgaggcagatagtggcaacttttaagaagacaagatgagaataaaattgcgtcacaaagcagtctcttgattaccaatattaaaatcatttgtacttatcaggaacaatggggagatcagaccttctaactctaaatgagtaatataacagattatagtctctattttggccagaatcacaaaatgtactttttaaagtatactttaaaaatatggatcatatgaagtatgcataaaaataagatggcatttccacctctaattagcagctggaaaagctagagtaagtgtatggcaaatctctactatggccaattatatttccaatgaagcaataaagcatacatttattacataatttaacagatatatatattttcagttccttcctcccttcgttatactgaggaatcttcctctggacagtgctatcctcagatgttttactctttgtattatttgtctttactgtgtctatcaaccatcagcaaaccattaattgaataagttgacgtattagcttttatatttttgaactaagcaaataaattactagtttatttatgcagttatccttatttggagactcttaaaatatcatatgaaaggtttttttttaaatgcaaacacaatttacttttcctcagtcaattaaaaaaataatattgttactctcacttaaaagaatatacatcaacaacagaaatactcattaaatggaactatgtcaggctctgtgggagattagaaatacaaagcctataagacagtctacaggtttgaatttctctttaaaaatatttattatatttttctgttttcatagaattagagaataatatatagtttcatgttatattgataatagagaaattggactttatttacaatttaattataggtgtttgaaattatgttctaggctagagatctaaaacataattatgttttagatctagaacataattatgttctaggctagagatctaaaacatagatctcacattatctatttaattaagagactttttaaaaggcaagatatgagaactggaacttaaattttaacaccatctgtaatctatctatctatctatctatatatatataacaatttagtttttcattttgtgtagatatatatacacacacacatatatgatttctgggaggagtcaggaaatacctctaaacaatacatactgtctctctaaagtccttcaccaattacttcccatattaagtactgaaacaaaaaccatttacctaactgcagctgtagtagcaagaagaaaagcccatttcttcagcatgaataaaaggcaaaagtaagcaggaaagtgggttggagatgaaaaaagaaattactcaggacaaactgggtatttccttttgaaccaaattaaaaaaaaaaaacatggtcaattttgatggattctaacattcatctcagggaccctgagtgacataaaggaaaccaagtcaggaacaatgtctctgtcttcggaagtctcctgtgaagcagaatttgtttacaaggtaaaggattaattaggtttaccttaactgatctatttgacaaaaactcaaatgtaaattattaagagcaaagatcaactcatcaaaagaaatgaagattctgcatacaagtgcccagcagatccatctataggttgatacagggagtacttatacaggagtcttgttggtcctccagtatacagggctatctcagacattctgtgtgagggcactgtgggcactttacacctgccacattcagagacaaggccaaaaccaccaacgtgacctttattatctcccttaaatgtagatttctgtaattaaatatcttctacccttggtcactactacttagcaggattacgctattcaataaattgactacgtaatgtagaaagcagaaaatgttcttgcagctttaatcttctctaactgaaagatgctaatctttctactctgtggtcctaaattgtgccccttgctgctttcatagccgtccccccacccccatcccatttcttccagggccatcatttcctctttcaggacaagaaatgactacagtgttccatgaatataataccatggtttacaccacgataagagactgtgtttcactatgattgctgtaaggtggccacatgggccccagactaccatagtagactacaatatttaagaaataatctaatatataatacatttttttttgcttggtcaaaacaaagtttaaattaaatattaaaatcacataaagttattttgaggatatcaacaaactgattctaaagcttatatagagaagaagaagacccagaaaagcctacacaacactgaaggagaacaaatatcattggtaccacccgactttaatgcttactataatgtcacagtaataaagtgtgattattagtaaaaaaaaaaaaaaaaaaaaaaagataagatagacaataaacaaatcaatggagatcccagaaatagatccacacaaatacagtcaactgatctttgacaaagaggcaaaggcaatagaatggagaaataatcatcttttcaaaaaatgatgctggaacaaatagccatccacatgcaaaaaatagaataaatcattacagtttacatccttaacaaaaatcaactaaaaatgcgccataaacttcaatataaaatgcaaaactataaaacatggagaagataacaaataagatcatctagatgaccttgggtttgctggtgattttttacatgtaacaccaaaggcacaatccatgaaagaaataattgataggcagggcttcattaaaattaaagacttctgctctgcaaaagacactctccagagaatgaaaagccgagtcacaatcagagagaaaatattcacaaaatatatatctgataaaggagtagtatccaagatatacaaagaagtcttgcaactcagaaacacataagtaagggacccatttttaaatggtcaaaagagttaagcagacatcctaccaaaggaaaaataaagaaataaataaatacagctggcaagtaagcatattaaaagatgctcaccatcatatgtcattatggaattcagaaataaaacaaaattagatagtactgcccacctagttgatggctaaaattcagaacactgaaaacagccaatgtcagtgagaatgtggagcaaaaagaactctcattccttcctggtgggaatgcaaaacgttatgaccagtttggaagatagtttggcagtttcttacaaaactaagcagatttaccatgcaatccagcaatcacactttattcatatctggacaatacctggaaacaagatgtccattaatgcatcagcaggtgaatgaacaaactctggtttatccttacaatagaatattatgcagcaataaaaagaattattgagtcaccaatagatatgaaggaaatttaaatacatattgctaagtgaaagtctgtctgtaaaggctatatactttctggctctaactaaaagatatttggaaaaagcaaaactatatatagaagcagtgaaagatcagtgattgccacaggttcaggggaaggagggagagatgagtacgtggagtacagggtatgtttagggtagtggtgctcttctgcatgacgttataacggtggatacatgccattagatatttgtcaaaacctacagaatgtacaacacaaagaatgaagcttaatggaagctatggactgtagttaataataacgtatcaatattgcttcaccaatttaacaaatgtaacacacaaatgcaagatgtgttaataacagaggaaagtgtatgtgtgtgttgggggagaaatagggaaaatctttgtgcaacttttctgtatgtacaatttgtctgtaatcctaaaattacagacaaaagttagtttatgaattttaataaacagtttggaatatttttcgaaatctttatttttcacttgccatactgaaagttacctggcatggttcttttcagccttgtaagcaatcaaaatatttccacaatctaattcaatcaagcttggtattttactgtttgaaaatcttagcattatttacagatttaaggtatttctattccttctttttaaaataataattaaattgtttaatgaaagcatttctgactgtaaacgtttaaatgctacaaatttacatttctctgttcataaaagaacttatttttggtttcttatctttaagacaatgccacattcatgataaaaatatacttcaccaattttgaaatagttctagtagataactattaaagatcattaaaaactcttgagtggatgcattcagttctctaaatctagagtgcagcatatcataaagtgtctcctatccctatcttatcattttagatttttttctccaaagtagtgctcactatcagaaatcaccttgtttaggccaggcagagcagctcacgcctgtaatcccagcactttgggaggccaaggcgggtggatcacttgaagtcaggagttggagataagcctggccaacatggtgaaacctcctatctactaaaaataaaaaaattagctgggtgtggtggcggctgcctgcaatcccagatactgaggagactgagtcaggagaatcatttgaacctgggaggtggaggttgcagtgagccgagattgtgctactgcacaccatcctgggtgacacagtgacacactgtggcaaaaaaaaaaaaaaaaaaaaatatatatatatatatatgaaatcactttcttcacatatctgtttacttgtttcctaaatcatctctcccaattccccagcccatcagccccataggaacagatgtacttggaagtgccacagcagaggaaaaccaccaggtaaataaatatttgggaggtgactgattgaataaattaacttatctagatttggtttgtcaaggacattcggaaaattaggtagaatttagctccatgaatgttgagaaagttgagttttgagagccctaacatggccaattcattttacagaggtggaaaatggggctgacagatgttaactcaccttgtccaaagtcttagtaatggaatcaggaaaaaattcaatcacttgacttttaaccaataatcttttttactacaagagttaatttgctaatgaaatctcctcagtattttctcaaaacagaacaaaaccatgagttaagtattcctttttctttgctataactaaatataccttttaaaattaaaaaaaaaaaaacataaacatggttataagtgatcttatttcctgcatttgaggcagctaaaccagtatttcccaaaatgtcttaatacccacttcttgatctgctgcaaggaaaaatattgttcagtggtcaaatacgttcaagaatcatgattattatatagagaatagacgtttgcctcttaatggaattggaaaattcctacagtaaagatacatgtttagttaagggttggctaaactacttcactgtggcatcctctcttcaaagaacccatcaatattctacagaacaaatatgccatacaacacatttttatccgaaaatcttttataattggcttatattattgttttattcttcaaaatgttttctaaactgtctcagttctcgtcccatgtcatacaatattttataatttttcaaattctcacttttatgttctcacttactaaaatacggcaaaatataatttatatatacatatgtgtgtgtgtgtgggtgggtgtgggtgtgggtgcgggtgtgggtgtgtggtacctggaacacaataagtggaaaaatttgtttcctctgtcttatcgcacccctttaaaaataacacaaacagaaagtgttctttctaatagtgcaacttacggtccatttattttttaatatttgttatttaatccatggcactcacttttttgaactgcagtaaggtgttcttcaacaattcctaatttttctgtgaatcgtttacttggacaatgccacattcacatatacatcccctaacatttgcatttattcagtttccttttaaaataagtgctaaacaaattaatggattttgaaggagaaaggctttcctttcaaaagaatggtaacctttatgtagttgtttttagatatttcctataaaacctgtctactctcgatacagtcagacatcttttcttcttttttaaatattaaaaataagcacataaaataagtcatttgttctttaaaaaacaaacaaaaaaaccaaaaaacaaaaaacctacaaacacaaaatcatgtaaaccagaaatctttcacagaggtcaagaagtcaaaagtaaacaccgacaatgaaacaccgacaatggtaagatccttgtgaggctctcgctccacctttctcattacttctatgtttccgtggcacaccacgggccagtgcttactaagacctctgcttagcgatggagttagtgggtctgcacctctgattgtgctgggcatgagacatactgattaaaaatggtaaaaggataaaggaactggcctttgagagacaacatggatgaatgatgagtttttgaattaaatttttgacagctttgatctttactgaaaatttaaatgaaaaacaaaacaaagcaaaacagagttccaggattttagaagtgccttttatcttaagtgaaatgttctcatcagaaactttggcatcccatccagtgcctttgatgctggctgtgaaacaagacaatccatcttcttagctgggaagacaggcccttcaccacccaggaaaccataacttgtaaacatcagtcaagttcagatggctacatttttacttcagaagttcgctttgcatttggagtggctcattaggggaaaagagagagagagagaaagggttatggaccaaagtgtgtttctcaaaaaattcatatgttgaacccctaacccccaatgtgatcgtatttggaggtagggcctttcgaaggtgattagggttagatgaggtcacgaggatgaggtcacaagccaggattggaaagcttgataagatgaaaaaaaaagagtgagctttctactctgtgtgagaacacagcaagaaggcatctctctgcaggccaggaagagaggcctcaccagcaatcaccttgatcttgaacgttccagcctccagaactcagagaactaaacatgtgcgtttaagtgcccagtctatgagactttcttttatagtagctggagcagactaataccgacagaccaagagagagaaaatggagagaaattttctggcttgtcttttaattattctttatttataaaaaaagccacattgatttttgcagcagtgatgcaagtgtgctgtgcataggtttgatgttctgctcaaattaagtctaagtttttccactaaaggaattatagtgttaatatgccaagagtcctatctgctcacgtacttccagtctctgtaaatacgtgcagcctgatatcaaagcaaaccttgaggccattaactataacattcttggagaaacagctgaagacctactaagaaaaaagtaccaaataaccaaagctggcaattacaattccaccccgaaaagaaggaaggcatgcatatgaattatgaaaaatagggactgtgcagctctcagattttcaacaatgaattgctcacattctacaccgtgtgtgttaaatgtttaaaagtaaaagatcccaaacattttgccaaatatgcagtgttccaaagggaagtatcaaaaggatactcatttataaaattatggttcagtagataaattataaggcctcaaagaacatgctgttacttctacttgccaatttataaattgactcaagtcttcatttaatttatgaaaaatcaaatcatctcaagaatgttttcgttatttttctctaccatgtaaaatatatgttttgtatgtttgataagttgtatcctgtcaattttagaatttagctatttggaacatataaaccacatttctacaactcaaaatagtataatgcttagttacctatctttaaaaaagtaatagtaatgcactgagatatttgggggtgggaggtggcggacacaagtttaactttcaaaaataagggccgtgtaaaataactgaaaaataatcctatttgaattaaaattgaataatattaaaaataaatttctactgaaaattacacctgtttctctattttatttttcttccttttaggatagcagaaaattctgttagataaatcagactaacatgggagacattgtaaatattaagaaacaatagtaggaagaggcggactcacattcatcttgctctttctgctattcccttccaaaaccaactgtgaacaagcactcagggtggccagggtacgtgaggaagcctcctctagcccagaaaaaaactttatttcacaaaaagttatccttcacaataaaaaacactattctataaaaattgtttcccctggccaggcgcagtggctcacgcctgtaatctcaacgctttgggaggctgaggcgggtggatcacgaggtcaggagatcgagaccatcctgactaacacggtgaaatcctgtctctaataaaaatacaaaaaattagccaggcgtcgtggtgggcgcctgtagtcacagctactcgggaggctgaggcaggagaatggcatgaacccaggaggcaaagcttgcagtgagccaagatcacaccactgcactccagcctgggtgacagagcgagactccttctcaaacaaaaaaaaaaaaaaaaaaaaaaaaaattgtctcccctgacttgagttatgggaaagagggttagcttcacttggccctccatgcccctgcccaggcacgtgtctgtattagtgttctgcagaggcaattcaaagtacattgtccaaagcccctctttgaaaatcttttgatgctgctgtaattcaatttggtttctatgttgaatctgaagttctgtgttactactaaccccctttctgtaggaaaaaaatgtatttttctatacaaacccatatgccatcgaggtacctgtatttaatatacctccatttagtagctaataaatatgtctatttgaaaactatttattcttccatacttaatcatagtgaactataaatccaaacttgacagcacaagaaaagtgacatttttcttctttcatttctatgctactttttccaaattatttcttgttctttttaaaaatgaagcaaagacatcatcattgttactattatgccttcagttaacaaaaaccttttaaaaagattatttgaaatgcatatgtaatatgcatgactacgttaacaggattatatgctattagatattgtgatataaaattacaactcactgggagatacagtcctctttgggcctctctcccttctatacatcttgctggacttgccaagatcaaaaggtcctgcccgcttttaacagactattactcagggttgcttatgcaactggtaacctaaagagataaggcaaggtcttcccctagacaaaaggcttgcatgcggcttgctataacagtagtcccagctcagtattcaccggctgtgatgcaaatccacccatgagtaagttccctctgagccaattgcttcattccctgcacacaagctgctgcactgctgagcactgtgtaataaagccctttgcctttggccccaagactcacgtcttccaccagcagcctgatacagtagcaggctcactgatttgtaagaggggtaaaatcaaaccccagacttgataataccatctacacagacattcactggtatgattcaagaatataaataactggtattcaatgtatccaaaaacaatcatgatgaatatttcaccaatgcattgctctttaaaataatacccaaataattatctgtactgtttccataccttgacctttcaactggacttttccttaatttgagcttttttgagttgtcatcagtgtcgtggagacttgcgccttccaattacacagtggtgttcaaacagaagaaattccaaacttttcttccttttgactataactaccctgggagtaaaatgtcccccaaataaaaacataaaataaataaaataaaagaaagaaagaaagtatctacttggcaagtgggaggtcagaagaaaaggggcttcaaacatcaaagaaggttctcaaaatactctttcaaatgaagaaagccccacgctcggtgccttatcttgcaagctcacatggccagacagcaacctttaaaggattatcttaacatgcggcgagctgggccctctcatgtgttctgaaatttaaaccagaaaatggctgcacaactgacatggttgtggggtgtgaaggggaatcaggaagagggaggagaggcttacatttccagaatgagccagagttcagataaagatatttgtgtaaaaaacaaagcaaccaggaatatgatcctgggctgtcaatttgtagaatacaatctaatacttatacgccataggtagtcacagaagttataagaaactacaagccctaaggcattttttagaatagaaatctctcttctccctctctctctctctctcttttttttttttttttgccaatatgtagtgtgggattttctttggctaaaaactgttccaatttccctgttttctaaatatactttactaagcatttttttttacaatcaggagtattgtaacctttgtatattttatcaataataaaataaatccataatttaaaaaaatcacacaaaagtgtataaagtaaaaagtcaaagtcccacatccccacctctgaatttcacctttatctgtgtgtatatgtatattttgatattgtattttgtaagtgtattgttctgtaatgtgctttttcatttaatagcatgattcacattcttccatgtcagtaaatacagagctttctatttttttcatgtctagacagtactttacaagatgattatattcagtaatgtatttaaccattcccctactgatgaatgttgaaatattttcccctaattttttactgtttcaaaatcaaaaatatgtacatcaacttcaagctttttactatagcccgtggactcttacgtgatttactacctgtctttgtcttcctctggaacttcttataccaaatctttgtgcccctggcctttcttccatgcctgggctaagccaaccttgtctctgcatctctgtggaatgtcctgtcccaaggtattggcgtggtggttcctgctgtctcatcactcgctccaaggttacttccttggtgaggtctttctagagctcctgttctacacaatctaatttatccttagtcaatatcttttataccttctcggtttattttctgtacagcacccatcaccctctggaataatcttgttcatgtatttcttactgtttactgttttcatgtaagatttttctctggtatgctctaatgtgtcctttattagaacaatgtctgccacatcataggctctcaataaacgtccactgagaagatgcataatggaagtatacttcaacttggattgtagcacatttacacaaatatttccattagagagatgcctcgaagtaaaattactgcccaaagatttgtacacacaaaatattgatgggtacttgccatgggtactgcaaaaaagctttaatggcaatttatattgtcaccaatattatggcaacggcccttttcccacaaatgcagttttataatgccaatttgacaggttataataatttttttgtaaattaaaaatcaccttgttctaaagaatctttttacatttatcacatttgtgttttatctccaaattaatcattgttgaaaatcttttttattcttttatcttttgggattacagaatgtcattctagttttcttccattattatacaagattgaaaggattttggttggctttcttagatcttatatccaaatgggatttattattatatgtggcataataagaactattattcttttaaaatgtattaattgtcttttgcttattaaaaaatagtcatggtggacatttctttaaattttcaaaaataaacacagaaaagaaaataaaaatcaccccaatagaaacttgcctgatttctttccactgcattccctgtaaaggtgtgttaatagaaatgtttctttgatcatacctataaagtggtgtttataaaaatgtttattcccggccaggcacgatgggtcatgcctgtaatcccagcactttgggaggccgaggtgggtggatcacctgaggtcgggagttcgagaccagcctgaccaacatggagaaaccccgcctctataaaaaatacaaaattagctgggtgtggtggtacataatcccagctacttgggaggctgagacaggagaatagcttgaacccgggaggtggaggttgcggtgactagagattgcaccattccatgccagcctgggcaacaagagtgaaactccatctcaaaataaaataaattttaaaaaattaaaatgtttattcccttatacaacattccctcatactcttttgtatacagtttgatatggtttggctgtgtccctacccaaatctcatctcgaattgtagttcccataatccccatgtgttacgggagggacccggtgggaggtagttgaatcctgaggccagttacccccatgcctgctgttctcatgatgtgaatgagttctcaggggagctgatggttttatcagggactttttccccttttgctcggcagttctccttgctgccatcatgtgatgaaggacatgtttgcttccccttccaccatgattgtaagttcactgaggcctctccagccatgcagaactgtgagtcaattaaacctctttcctttattaattacacagttttgggcagtcctttagagcagtgtgaggacaggctaatacactgttttttcgcttatgctatgaacattttcttttgaaaatgtgatttttaataatggtacagtatcttaatgtgtatgtgtattgtaatttgtatgagtgtattttaatggttcctattgttctacaagtaattcctttttctgttattaaaaattaacccaccaatgaaaacccatgctcataaaatctccaggaccatctctgatttcattcacaggatagattcctaaatgtggactcaataagaaaaggagtataaattatttcacagctcttttcaggccttttacaggcaggttgtgtgtactatttaaagtactattaatcccaccacatacaagatgtattaggtacttcttaagagtgcactgaatataagaaatctgttacaaaatgttagcagagcagaaagagaaaaaaagaaagaaaaaagggatagaatgagattagatcacctggtaaactgtaggaaacagctactgcccccaggactcaggaaactcaagaaagtactttatcagaacttctgagtgctgagtgcatgccaggacccctgaggatgggccgactgagtgggtagaaaccaccaaggcactgcctcccagtcacggaggagtggcatggagaagggatcacagacacttccagaagcaggagagagggaagggtagaaaagagaaaatgacagcgcctttcccctgacctgcctttggatccactgagcagatgtcacaggaactcgctggcaagggcatctgggaaatacagtttcctcccgagccaagcattgcggagcagcacaaagggcgtggctggggaagggttgggagaacagggaatcactctcacacccaagagtgcatggagcatatctgggtgtctacacaggtaagagagtgaggggtcaaaaccgggcttcttatgactctaaaatgtatttttagagcagttaccaggagagctgacattgttgaatctacctgagaagccagaagccagactctttgtattactacagaatgtgattccatgctgttgccaaatgccaggaatttctacatcgactgccatcaggacatggaagtctcattgtttcttaaaacgcaactattcttgaagacatggaaggtcatccttcttacatccttacatccttctttctgtggccctcctaggcttgtcacgagtcagcacgaatcccaaaggtaccagcagcacagaagctcacactctgtcatcagagctgggttggcagtgacagaaatgcttatgcaaacacaggctgacttctcactgaatgtatagaacatctaggaaagaaaggcaaaggatttaggccaaagcaatacctcaatgcagacaactaactagtggcagctagctagtcacctgctctcaactcttcaacgtccttcaaatattttctctaattgatatagcataatttgtgatgccaacaaccaagtgttttttcacaattacagagagccaaacctgtgtctctgctgctcccttaggctacttataatattggcctagttctcttagctgtcagcacaattaccttgtgattaaaaagataacatcaataggaatttcttttttatcagctaagccatggttacatgttgcatggacactagcactcattaccccatccatattttggtgagatttttgcccatttccttcgttttcacagaaaatgaaataaagcataagcttgttggttgcaaaggtgacatatagtaagtcaaataaacccataatgaagttcccttatacttcaggttagcttcaaaatcccactcaaatatgtatccaaaaagaaataaaacaggaaactttctggaataagttcttttgttgctatttttatattgaattggcaaatgtcatttcactgtctgaggtcaagggaacacaagggaacaggcagttctcgaaacagaaaagttggaggtgctgtgccgtctctagctaagaaaactctagttctatgaaatatcattccacctgagaaaattttcacatgattaaaagataacagtgccataaatctacccttgaacatcaggtgtgactcttactatactacccaatgtcttttaaaaaatatttagatcattagccaatttgtgtgggtgatacaattgtacacattccacaaaaatatcagccatttgtctagttcagcatctggtaatgtcaattaagggttttatttactcacaaagagaaaaaagtaaagatattagtttcaaattaagtccaacagtctattgagtacgtagtttaaatgtatttcagctcttcatcctccccagggcagagatcactggcagaaattagcatccacggataggaaccaacaacagggtagctgatgatgtttaggtgaactcccctctttataataacagaaataaccccttttcccctacaaagcccgtctacattttgcatagcactaaggatggcagacctaggagctgagttagccaaccctgaaggtatcctgcctcaagacttgtggctatttggaaaaataagcatcctcgtcatggggtcagtggaatcggggcagtttgctggagtgaaagcccccaattaggtcaccctgtacttgtcatcaagaatgagtacacatggcctctctatcatcaagtggccacctacgctttttgagtggtaattcttgaaatatggttttctctatgaagaaagcttttctctccatagaaaaagcttaacagcaaatttcactgtagtcgaaatgtttcacctttctttcctttttgatgtgatcgtcagctcttgactgcatctcgttttctcatgcctgctttctttctgctgtcagtcacaatcctttgtgacaaggtgggatcacctggcagatgatttggatgttgcctctcatggagatatatctcattgaccctttcgaattcagagatttttttttaatatagaaaaaaaggcatagcattttaacatcactaactaaggcaaaagataaggacactggactgaaaaaccaaggatgttgtataaatattcgtccttgtgtcactattttattggcttgaggtatccaggaaacaacttcatttccccaaattacattttattaccaaacaaaagatgaaaaaagtactacttatcccattaaactagcataatggttactttaattggaggggtgggagagaaagaaaggtgaatctacttagatttcttggagaaatgaacttacaaaaatggaagctggtggcaaagccaaagtgaaattcacgtttacttattccatgcaatatttctctgtccaacctatgtaaagcactacaaatgaatacagtcatagcaactaattgagttatcagcatctccagagtagatgttactagtatgtcctggcatatgaatggtagtattatgtgggatattagtagttcactaagagtcctataggacttcttgtgtctggaaaaagagtttagtgagtgatactgaaaaaccaacagcttggctcacgggcatcattgaacaaatggtactgagcatggaacgcagctactcagaacttatgagccaaatgggtgttttccgtacatggcttcttgtccagaatgctactgctattagcccaatggccatcactggttatcaaacatcctgacccaagtcaaagccagacgaagacagaaggccatcgtgggaaggtgaagcgattcatgcttagggcaagataattatttggtatcctttcaatccatttgttcaacatttgctcccaggagaggcgggatgcttcctggggacagattagagaagaagggacactgctaagtgctcatgtattatttcaagcagttcactctgggccccgacccaaatcctcaggcaacaaagcagcaccctgcaggtaataggaactgtcttctttagaaagcagtgtggtgaccaggtgttgctaatcatcagagtctcttggtgactcacagccgccctcatgcagctttgcgagttctgactgccaacacacacaggactcttcctaagtattatttcagctgaattctgggatgtgaacatcagactttcaaacccggctttctcactttctactggggtgaccctaaatacaagttatttcatttctctggactcagtttcctcatttataaacatgagaataacattatctactccactggttgctgtgaggaccaaataaaataacacaattaaggtgttatctggtatataataaccattcgataaaacttagcgattattatttatggcatccattccacaatggtactcaatggtactgtgtacactgcctaagaatcctaacctttatttttgctccactcatcacttctatttccagttctgtgatgccaacaaattgggtaattgtacagcagcatgttattatgtttcttcacctccccttcttactatgggtcccttctccgccttcctcaaacatggcagccctgtgggatgttgaggctcttgaggctcctcagtttgaaatgaatgagcttgctgaagtggaaacattagaagggcatgattggcagattattttgctccagcaccttcttgacagaagtgcacaaagctcttcaagaagatggagctgctgccagatgccctctgtccagcctcctggaagcccaggagaaagctggagtggacgccatccttctggcctcctcctgaaggacatactggtttccttaatttcttttctactttttgtccttcagtctgttgtccctgcacagctatagagaaaacaaggattacagattccatgtcgttttgcagccagggaacatctttggctagagatttgacggaagtcagtgccaagtggctgtgtccctgtaagcagtccattatttctaatggtctatttgcatgcaaacctccaggccagaggcagaagtaaacatcccagaaacttgtccctggagactctgggacactctcatttacacgctgtgctccattcacggcgctgagtttactcacacgtgctacacatgcgatcctcacgacagccctgtaagatggtattagcatctccattttatcagaagaaaaataacttccgagagggttaagcaatgggtaaacacggacataaatatggcaacaagagacactggggactactagagaggggagtgagggaggagggagggttgaaaaactaactattcggtgctatgctcactacttgcgttgcagaatgatttgaaccccaaagctcagcatcacgcaatatacccatccagcaaacctacacaggtaccacctgaatgtaaaataaaagttgaaattataaaaaattgtaaattacaaataaatgaataaataaaattttttaaaatacagttaagaaggggactttgcagtctggtgtacctgacactaaagcccgtgtatctttaccatatcatgtttaaaaaatcattttcaagagaggcaagaaatttcagtggagaaaaagactgagtatgtagaatggaagattctctagatgtgttgattttgtttatcacggtgtcaactaccggaggagtaggcaattttatgtggatgtagaccatgcacctttatcaggagtactttttcaggtcaattcccttccctagcactaaaaataattaatagatctctttgagagactaagacagtgaggagaaagtacatttacctaccacaactaatgagacctgaataactggaacagaatatttggaaaaaaataatggtttaaatggttaacgatgtgtaactagtaatataatagctacttcaacggagctttcatgtaaaacagaatttcattgcaagtttaagttttcttttgagaaaaatttggctatgtaaaggtgagtttggcaattttaagtttacaacttattggtcaataagtagtagtaagcctcttttgtgtttgttgagttaataaactatggttcttggacaatttctttgttggatgttaatctataactcttatttgacctgttatttgacatttctaacctcttccttaaacattaaccagaaccctgagtactttcttttccaacacgggtaagggattgattttttttcttaatttcataacttatgaagctaaaatgtgcaatattttgactgagtgaattaggaattcttgttgggatttgggaaaaagaaagttatgagaaactgatgactgcctatgtaatacttcctttataggaaattcttaatacccttatataggaaattttaatacccttcttacatatcttttgttcctggtgacatagaagaacaagtttaacaacatcttaagaaagaaaattattaaatatttacagtcacaaacctttgttcaaaaaagcacttaaaaattatatttaatagagtttaattgagtaaagtgaatcacatagccctcaaactagaataggtttagagagactagtgtttttgtgtggtcaaagaagacttatggaaaaaaaaggaaaatgatgtacagaaaatggaagtcaggtacacaaacagttgtattggttacaccttggtgtctatttgaactgctttgaagaatttgtcacctttcagaggccaaaacttggtgatcttcgtgattggaacaagaggaggttatagcctgattacacagtttactctgtacagggaaaactttaggccagacttaaaatacgcaaggaggcagcttaggctaaatttgctttaacaattctctctttatggtcaacctccaaaaatcatgaggggttaaccaaaactctaggcactgatgacattttgtcactattataaacatattcacacagttttaaattttattgggaagtagttggatagtgggttttgtaaagtgaaaagaaggactttaggttacttttctgtaaggattagagtagaaggaacctctgtgtgttgaaattttttgattttaggagataaaacctggtctgctatagtttttttttttttttaagttttagtttgtttatgtgatatttagtatgagtgactttagtttggtttggtctggtcggttggagcctagtacatgagtttagtcaaaagcaatagcctcttataattttatgttttatttatttatttgtttgtttgtttatttatttatttattcatttattggataggtgagagggtgacccaaactttactgttggcttcgtggtacttttagctattattattttcagttttcggtctcagtgtgtcttatatgttacagtgacttgttgatcactttttggagtttttgttgtttgggttgaagagggaccagttgacagtttatagatgtctgtatgtaaacatttgagaaaatatagtattttggggaggctactattatgactattaggaagataatattaagagtttgaaatatggtttctggtcagagtctctatgaatcaattaaaattgaagagttttaaacgtgagttagataaatagtatttgttttagccaagtagtctgttaatctctcacaattgaatctttataatttttatgtataacaaaaagtgttcataacaaaacagattctttttgtgtagtcaatggataatctagtgtgattttattattaggaacaattttagtaacagaatttagtcttttgtgtaacaatagtctttgtagtagaatttcttatggagtctattatgagggatgcatttataatgactgtcccatttattttaaactatggaaaaagagacctaataagtcatgtatcctgagaagagtgaaggacaaaatctttaggccaaacgttataaatagaatgaaacagctttagactaaacttcatgtaacaccttcaagtgtgagccacagtgatgagtaaccagggtctcaagctggtattttttcaagcaaaaaatacttcaaaaaagccactggagtaggggtggggagcgggtaagaagatccatatctgcttatcaactcctgtttttttttttttccatttctttttgtatttggtg

SEQ ID NO: 854 - DNA, 49601 bp, Homo sapiens
tgctctttctggaaaacaaattcctttttattatggtatctttagcccattctcagtgactaagtcttttttctcagtttaatggtaattcatttgaagttttttgtgtttgtttttgtgacttctctctctttagtggagaagcttaccagaagtacttaaagagccaattaagttacagttttaggcccttattttgtcaaagcatttatttttcaaagtgttttagtaagatatttatagtttttatgtttgtttcccctagaagataagatgagcttatatagcatacccagtttgagtatgaggcaggaaaatacattgtttagaggtgaataatttattttgtactattctttctgcagataaaattagtaatatgtattaaaaattttaaagcatgagccttttctcttcaggacattgatctgggaaataattttatgaataatatctcaaaaacacaggcaacaaaagtaaaaataaatgggattatttcaaactcaaaagcttctgcacagcaaaggaaacaacagaatgaaaagacaacctacagaatgggagaacatatttgcaaactgttcatctcaaagggaactaatatccagaatgtactaggaacttaaacatctgaacagaaaaaaaaaagaaagattaaaaaatgagcaaatgatctgaacacacatttctcaaaataatacatatacatgagcaacaaatatatgaaaagtatgctcaacatcactaatcagggaaatgcaaataaaaaaccacaataagatatcatctcatcccagataggatggccattattaaaaagacaaaaaaaaacatgctggcaatgatacggagaaaagggaactcttacacactatgcaggaaagtaaactagtatggtcactatggagagcagagtggaagctcctccagcaatcccactactgggcatttatccagaggaaaggaaatcagtttatcaaagagatacctgcacttctgtgtttattgtagcactgttcacaatatacaagatatggaagtaacccatgtccaacaacagatgaatggataaaaaatgtgctatatatatgcaatggaatacgctattcagccataaaaaaaaaaaggaagtcctgtcatttgagacaacagggatggaactggagggcattatgtttcttgaaataagccaggaacagaaagttaaacaccacatatgttctcatatgcagaagctaaaaagaagttgatttcatagaagtcaaaagtagaacagagaataggagggttgaaggaagagtgggggatagggagagagttgttaaaggatatgaaactccagctagataggaagaatcagttcaagtcttccatagcactgtagggtggctatcattaacaatgattatggtttaaatatgtaggagggtattgactgttcccaacacaaagaagtgataaatgtttgagatgatgaattatgctaattacccattactatatattgtaatgtatcaaaacattactgtgtaccccatacatatatatgattattatgtgtcaaataaaaataaaagtgtgagccttgctacccaacaattacacttttggggatttgttgtatgaaataagagtaacaacaataatagtcaacatttctgtattgcttgctatgttttgggcatgatttaaagcatttgacatacatgtacttacctaactcattgaaatcctgtgagtaggtactgttataccagttttataaagaaattgaggcagagaagattaagtgatttgtccagttttagtctgtctctgttacatccagagatacgcataaaaaatatgtagaggattagtaattttaaatccatttatatttccacaatagaggttatcattaaataagaggagactcatataatagaattctatgaggagataaaaacggcaagtctagccttctgtaatgctaaacttataagaagtataattctattttagtaaaaaggatgttagtatacatatattgaatgcaaatattgtgtgtataaactagaaagccatgcaagagaatattaatagtactgatgaactctggatattgggattaggagtgattttatttgtgcatatgtttttctattttacagtgctttttcattgagcacattctgcatttgggaaagaaaggttatttaaagttgttcttattaaagttactgcatttaattctgtttttgccattgtgtcaggcaagtaaaaatgctagatatcaagttaccagaatcttctctggagcccttcctctgggggttacatgtatatgctgcctgtcttttggaatagtgatttgtaagtgacatggtttaagggtttggaccaacaggttcatagtttcaccctgctttcttttagagctgctggataaattctgtccggtttcaatgatttatctatatttaggttgtcaacctaggtaagaacatcctgtgcagctctctgtttgctctattgagtccttgtatggttatcttgttagtatagtgctaatgataacaggctgtgtgtaaaagctctctgtacacagctgtcgaactctgctgtgtttggtggtgcagactacaccctgaatcctgttaaagaaaacctttgagatcataacaggatgtttggaagttttaatataaatctcttacttatatcaaaagcagttgaagcaaatagtcttaaaatatagtagaattctaatgtatctgacctgcttccttaagaattcagtttggctatggtaatctctgcaatcttctccttaaataaaaactgaaacattaagtctgccccttttctttaatccctgttcaagagggtatgtcgatacttgaacccttttaccagcatttaaagaaccagctgctgctggcatagcatgtctgagattgcattttgtcctgcctacctttttattagaccttgcacagccatatttgtgagtggattagtttcctgtttttgccataataaattaccacaaattgaccagtttaaaacaacactcatttatcatttcccagttttgtaggtcataagtctaggtaaggtatggctgcactaagcctctgccctctcacaaggccaaaatcaaggtgctggtagggctgtctatgttcctttctggaatctctgaggatgagtcttcttccaaacttactagaattgcctgagttcagtttctttgattgtcggatggaagcctccatcttctgccagctcttggccaggggctggtctttgcccatgaggctgctcacatcccttcgtgttttccatgtgaccctgtccagcaagagcagcttgagagccattcaagggaatcttttacttcccttctgctacatctttctgctttaagagatcatgtgattagattggggccagccaagtaatccagagtaagctccctactacatttgaaagtaccttttgctttgtaaagtaacagattcatgggttccagggatccggaacatggacatcttttgggggccactctgcctaccacagtgagcctgttctcatgtatacaaacatactctttctatctgtttagcactacagtggatacccagaccataagcgtcatagtcctgacacacgagttggtaaaaaactaactgggaacttgtgataagcacttatgttagtgttttaggagtttaaaggaaagaaaaattagtgaagatggaaaatagcaaaggccttatagaggaggaagcacgtgaatttcgcccttgaagactactgtggattcgatagtctaatgattgaggagttacagaagtgggggaagaacttgatcaacttgaacaaataggatgtaggattgggcctgatgtgtttaatgtgatagcagagaggcgatattaattaggaggaagtagtaaggaataaaatatacagttgtacaaggtttggagaggcatgcagtggaatttcaatttgaattcctgaaaagggattttagttcaccaagatttgagcgagatagtaatataggaaataagtgtttcataaagatgagtctgggagtgatctgcaggacagagagaaggtggagaagatggagttagccaggtgagcatacgatatggggtttgggccaccacaatcaggcatcttcttatttagatcatcttaaatcttgacttcataggattgttaccatttcaaaacataggctttaagtgactacttcattaactccttcattcaccttactatctttggttttattgtatacaataacttttttttttgaggccctggtgttaatcagaatgatgcatctttctcctctgtcaggctttcagtgcttcacatacttttcagatagtcttcagaactccttcaggacagagagaactgcttttcctatatgaatatagagagagctaaaaattcagaaatttgaagtgattatatgaggatcacccagcatgtcagtgtctccagtagaagtgaaattccagtctttaattcggagacaatgcccaatcactgtggctactcttagaaacaatttaagagaatcttcagacccacagcttaaaataactcacgtacatggcataaaataaatacttgggagttccttggatgcagggtgtttgtcttgattatcttgggtgccccttcagcttattatgggtcctggctcatagaaggagccctgatatgtttattaaatcagggattgatgattgggaccacctgggctgacctttgaacgacttcttacttcctatagtcttcaaaactgccagaggctggggggatagttgacaaaccgggggacgtgctatcctaatctgcagaggtgctatcctaaatcactgaccaattccagctttaaggttcacagaaccttttgaaaaacatgatctggttttaaaattgtttccgtgttgatccattttgatggggggtgaggttcgctattcacatcagtgagtatggccagcctttgtctgcggagatctgattagtttgttaaattcaaagtagcattttagacatgatttcagtaaaggttaggggcactctttggctcttaaattttaatagttttataaaaaccctcttcaagacaaagttgtaatttaatacaaaatcgtaaattggtaaacctgtaacatttgtatcatgaaacaggtgatgtaactgaagattaaataaatgtaaaaaatttagatattgcttttgaattggaaatggcaatatttgtatatttttgacaaagcttgaaggagcaaaatctcatgataaacactatatgcaattgacctgaatgatgtaatgttaaagagccactgcagaagcatttgcaaatcataaattaaagagctctttctcaattaacagttacagatgtcttctcagtgcagggaagtgtgctagggactgcatcctagagatacagtctgtgctggcatagggcttctaacctagtggaggtgacacagatacaggatgtagtttccaaagtagtctaccacgggtccagcgagagcatgcaaacattattaacacagggtaagttaccactgagtgctagattagtggattaaaatgacctttctacccctctctgcctggtgaacggctgctaatctttcaatgttagctaaagctcctaagactcctgtagacggtctttttcgaccccatacagcctttattctctgcggtactcaatgtgcgctgctttccaagcatttgtgatacctcaatgggcatagtctaccagaatgagtgcaggatggggaagtctgggactcccagcctcccagagcacaagaaaaacttgtaactgtcagaaatcagaattaatcgattaataatagcaaatattaagtaacaaatattaaggttaattttttaaatattctaccagccaatttagtctctttgttctaatttcatcttcaccaagcagtcttatggttgtacatttggttttctacccccttatgtggcaaaaatattgctgtgattgtggttatagcccctgctgtcagcttgagacttgatgtctgtacattctcctttgagtctggatccttgatcctggcctgtgattccatctcaggagttagaagcctgtggtgcctggcctgagtcagctcattagcttcattgacaacattggttcgttcaacaaatattgcctgagaagaagacatttaagcaaagacctgcaggaaggaagggagttaactaagtggatatgtggggcaagaacttcccagaatgaagaaacacccgcattaattgcttgaggtatgagaggtgaggtcaggggcaccagtttgtatagggctttctaaaacattatttggagtcagatgacaagctatagaggatgctgagtcaaggtggaaacaacaaaatcctacttaggttttaacaaaattactgtggttgcggtgttgagaatagtgagatggtggcaaggatggaagcggggagatcaattagggggctgtttaaatgatccaaacaaaagataatgaggtaattggatcaggtgatagcagtacagatggcaggaagtataggattggggaatatattttaaaggctatgccaaacaggccttactgacagatgggttatggagtgtgtgtgtgtatgtgcgcgctcatgtacacttgtacatgtacctgtaaataaaggagagaaagaacagacaaaggataaccccaacgtttttagttgagaaattgtgttttcacacacactgagatggggaaactgagagcagcatgtttgatagtcaacgttaggagctcacctttagacatgttcactttgagaagtctgttaggtagccagaaggaactgttgcacaggcatttcgatgtacaaatctggagttatactctgtagaggtccagattagaaaaaaaattggagggtcatcaatctaacaaaaggtttaaaaactgtgggaatgtactgggtgcagtgagtcacatctgtaatcccagcagaaatgaagatcatgctgtaagagagtgggattacaattgacctccccatgtctcaggttccacatgcacagattcaaccaattgtggatcagaaataggtggaaaaaaaccaatacaacaatagaaataatacaagtaaaaaaatataactatttacgtagcatttacactgtattaggtactataagtaacccagtgatgattggaagtgtacaggaggatgtgcatgggttatttgtaaatactatgccatttcctatctgggacttgagcatctgaggttttgggtattcttggtgggccctggaaccaatgcccgtggatcccaagggatgactgtatgcctgtacgtgatgatgggcctctctccatgaatttaagtcaccaggactgggtttggggagtgtcagctcattttctgcctgtttatcagcagacacagatggggtagttttctcacttgcacctacggaaaatcctccttgctcctggggttgtttgactcagtgtctcccttttcttgtgtctgggaggttgatggcatagtacatttactccccaagtagtctgtgagtgtggttggttaaggtggctgaactgaactcggcatctcccagcaccaccaacctggaaagtgtttttggtaggtgctgtgtgtacaacatccttctgattgcaaaggcctgtactctagcattaggtcgggttaattcctgtcaggtcttttttttctcttagagccccatttctaatgaagggattaatttggcaggtgatatcaacttgcaagccaaatttagagttgattttccaaatgacttctcccaaatgccctattatttcctgtctccattgtaaaatatttcttcttcctggaattctctaactccctcttctttgagaaataaaaaaatatcaattttagtgtaataatttgtcttatttaattttgttacttaaatatcattcacattttaccaagcacttaaaatttggataggaatagagattgagataatatagctctactctcaggtaattcacattgtgggccaggcgccgtggctcacacctgtaatcttagcactttgggaggctgaggcaggtggaatcacctgaggtcgggagtttgagaccagcctaaccaacatgcagaaaccctgtctctactaaaaatacaaaattagcggggtgtgatggtgcatgccggtaatcccagctattcaggagctgaggcaggagaattgcttgaacccaggaggtggaggttgctgtgagccgagatcgcatcactgaactccagcctgggagacagagcgagactccgtcgcaaaaaaagaaaaaaaaaaatcacactgtgacctttataggatatctttttactgtccagttttacatataatttaccatggattttttaattaggatacctattttattgtaatctggcaatatttttcacatattggagataatttttgaagtcagttctttgtctatgatatattataacttccatttaataatcattggttttagattggaattgtgtcagctccctttctataacatatagtttccatgtataaagtaatctgagtatatatcttatgtgtgagtgtgtctctgaatttttttcattgcagatagtttggtggaattctatttttagttatgttttttctccatcactttgcttgggaacgctggatgaagtggttactttcatttctctttttcaccatcatgattgtttcctgcagtcccatttatttttgtcaagtttttcttcatgccatcaatctgtctcatttgtgtatctgttctgtttctttttcttttttcacagctgcgaagagccatggatggtcttttatttggttggttttcattcctgatgcatatacaaaccactagagtatgcatttttgaatcttatatatatcttccagatttagctttatattatgaagatatttgtcatttgggcagctgagaaaggctttttccttgagacactctctgcttaccttttataatgttcagacaggaggttgtcagttaacttgctataaatctaccttcagcttcagtgtgatataattatataagttctattattaatgatgcatttctggtttggtctgctcttgatagtgctagtggtcaccagccctgctattttggcatttatagtgagcacatatcttctgataattatatttctcttttataaaatgttttatatacacatttcttttaatgtgtcagcatagcaaatattttccaaatgtccacaacgtctgaggcattgttgtaagcaatgggaatgctatggtaaataagatgccatatacaaattacattctagtgtgggagagagacagcaagtaagaaagacacttgatagagctgcagagtgttgagtactgtgaagaacacgaagcgcgatgtgaacgtggagatgaaggcatgtgctgtggtcatggaaggccttttgggggaagtgactttcaagcagagacctgattgatatgatgccatgaagggcagtttagggaagggagcagcaagtcaagaggccctgaggctggagtgtctcagggccagcaagaaggtcagagtgcctggatgatagttggctagtgggtgagtggtaggagttgaggctggatcatagccagttagagggtgagtggtaggagatgaggttggatgatagtcagctagggggtgagtggtgggaggtgaggttggagggatagccggttagcaggtgagtggtgggaggtgaggctggatgatagccaactagggggtgagtggtaggaggtaaggttggatgatagctagggggtgagtagtggtaggtgaggttggatcatagccagctagagggtgaatgttaggaggtaaggttggatgatagtcagctagggggtgagtggtgggaggtgaggctggatgatagtcagctagagagtgaatggtaggaggtaaggttggatcatggccagctagggggtgaatggtaggaggtaaagttggatgatagctagcgggtgagtggtgggaggtgaggctgggtgtcagttagctaggggttgagtggtgggaagtaatgttggatgatagtcagctaggggttgagtggtgggaggtgaggttggatcatagccagctagggggtgaagggtaggaggtaaggttggatcatagccagctacggggtgaatggtaggaggtaaggttggatgacagtcagctagggggtgagtggtgggaggtgaggctgggtgtcagttagctagggggtgggtggtgggaggtaatgttggatgatattcagctagggggtgagtggtaggaggtgaggttggatcatagccagctagggggtgaatggtaggaggtaaggttggatgatcgtcagctgggggttgagtggtgggaggtgaggctgggtgtcagctagggggtgagtggtgggaggtgagcctggaaaggtagcagaagtgatccaggatcctaaggtgtgagaaagtgcttagattttattgattttcttttaggcataagagaaggccatggaggattttgagtagggttgggctgtaagcgtgtttgcatttatttacaaaaagattactctccttgctgtctggagaatcaaccataggattgcaagagagatcacgtaggagattctcataacaatctttgtaagtgatgaaggcagcttggattgtaggatcaccctgaaaatggtgagaagtggcagggcttgggttttattttgaaggcgtaatacacaggacttgataatggattagatctgcagaatgagggaaagaggtgaacctacattttgccctgagcaatggggtgaattgtgctatttatgaaaaagtggaagactcagagagagaggtaggtttggggctgaaaatgagccccatttgggctttttatgggctcttcctgatctccttctctccccttgcttttgaggtattaccagctacaggggctgaagaaggagcaatcaggccagggtttaaaggggcactgggactgagccagggaggtagctagcatgagtggtaagttgtttacatgcaggggattgaacaaataagtaaatatattgagggtaaagggaactaggtttatcatcaacagataagggatttataaatgtggaaaggggaaagattaaaaagaaccttgaggtgttagactagaattggaagtattaatgtaaacacatggttttggaaacatgtatatataggtgataatatagagacacactcatatacacacccagaaggcctaggagcagtcaatcacttatcagcagtgagtttgccaactgcctagattctggtttgtaaattccatcctctactaaaagggaagggaaccaaggctccttgaaggaatagttaattccaggataagtacaaaatgaccttggaaaactatctgtgctagaaagtaaggaaacactcagaatgatgggagcctttcaagttacaggtcccagcttgaagggactctcactggccaaattttggacaatttgagcaagagagtaaatgatggcgatggatatacattaaataaatgggagagaagcaaagtttgttgttgttgttgttgttgttgtttacggtagaatggctgaggaaggaaggagtaatggagtgaaaaaaatcaccatttggcaaccactgtggtggtggttggttcaagtggtagttattaatagacactaacgttggtgtgaggatgtttgatgagaaacagaatattgatgtagtcttgagatatctcccccaaaacatgtattaattacagagggagagctggtgaccaggtggtcgaggggtgggctatgctcacatcacgtgcctcccaaggagaaatactgagatgggcaccgcatccttgctgacaaaattgtattcctgacgacatcccagcctgagtctgggtacgagaaaacactgacagactctggttaggggacgtggcagagagggacaggcctgaactcttactattatgtgataagtacctttgtggatacaagtctgtatttaagagtattccttagaatagagttctaagaatgtagtaactagatcaaagaacaagaaattttaaagactctcaaaaagtataatcaaattatgtccctaaacctagcaccaatttatatccacactagtcatacataaaaaggacccattatattagctcaaaatagcagtgagtttatttgcacacattttaaaataaagatacaataaaccatagagccttagaaacgacccatttcaacttgcctgagagtaggaattagatatttctgatgcaagaatatcatctgtggtatccttcacagatgttcctcccaccccccgcataaacattttcaatgaaagtttatggattttatgtgtttcatggtggctaaatgattattaaaattttagggcttcccaaattactaaaggaaaatttgtcttttgtaatgttattaacctgtgcaataacctacagaaaacatctactgataatgggttctcaaaatgtaaggagttgatagaacttaaaaattcactcatgctttgtaaaagaaaaatatattgatagaatgaacaacagaaggagtaaatagcatttctgttgtttatttgtgataacattaaaaatactttcacatagataggcatgtgaaatatattatgtattaatatttcagaattattgtgaatatgaagttagcttatgtacataaataaggaaaatgtaggccaaggtagctaaatgcaaacacagaatatcagcattcatttacctcaggagaagttactagtgagtctttgaatttcatctgtgaaacaatttgtgtgataacatattttctgaaagaattaatcacttatttccctatgcataaaaacattgtccacaagtatccataggtcaagtctaaatatcattaaaatttgatttgcagtgagaagtctttatcgtatagttgataacgtctgttgaattttcattgatttggaaatgatgtggcttgtgtttggaattaagctattagaatattctgtcactataactctgcttcatataccagtgaagaaatcatcattcatttaagagtctaacaagatttgactaatatgaactctgctttgaattttggacatgttcctgattgtcacaccagaataccaccctcaaactacatagggtttgcagttgatcttcagtgtggaacttttgataagttcacgtttttacttgatcacatcgagcatatttggggttgatctttatctgtacgctatgctaatgcttaacataagtcctttatttacccttggttttgtattgaaatgttcacgcttatttcgacttaggttatttagtagtaagaaatatgacagacattatcttcatttgaaaaataagcatttgaaaatttaaattttttattttcttaaattttgcatattgaatttagctaccatgtcctttggactttttcactgagaccccagttttcccagccatattccgagtccagcccagtagagaatgtagtttggttagaacatagtgtgtaagtaattaaatttgtgccactacctaagtatgtctcagatagtcaaaaataagtgatacaatgtattcattatttgctatcagccatactattttctcccacattagtgtaggttattgattccattatctatttttgtcgcctcacctaggtaatgacaataaagtgatacatgggagagtttattcttagaaaaggaatgattttgggttactatttatgatgcttatctgaacaatgtaaagtgttacagagtcatattttaaatatacaaagagttcataaggaatactttgcggttcaggtaaaaataagctgtctagaaattaagtaggcttttgttttaaacttgattcatttatttgtactaaagtagcaggttcagtaacacaccatttatctggtcattttccagaataagatggaattttccaggtaactgatcataaattagttttccaggtaactgaatcttaaacttcaaggactgaaatcctataaatttaactattgttgatggaaatttttgtagaacatactttctaccttcttacttttctgtatcttttcaatcagaggatactcaataaaatttgatctgttttctggctcaggactactgttttttccacctccagtacctcttctttctcccttaatgagtttgctttttattcccagtggcttgtgaacccaaagttgttaggaattgttgtttctggtaagccaggatccagggaggctcagagtgagggtgtagggaagaaagagtattctttaatgttggtcttttttattagttgttatcaggcattcacatcttcccactttggttctggctttggcgctttgctctggaaggctgcttaatgggaggtcactgactcctggtacgttaggtctcacctggtagctttgcctcctcttcatggtggagtaaattgagccctgagagtatcatgggaatcactcaagctcacacacactaagtagtgatggaaccctgggtttaagacccaagtcttctgtctgcaagtctagtgttttcctactataactgtcatgttaactccaggtcattattaggaacatagttagtagtcttgataaataaagaaggctctgttatttcttagtgggattcttgcctctcactttcttacctatgttggaaactagagtcatcctagactcctctgcactctgcattcgaagggtgactaaagccttgtctagtttacagcctatgcagcctctagcatcttacctcctctgcgttcttgtcacatggccctctttcaggctcttttcgtctttagccctctttccctccttgttctcctccctgcctctggactcattgtcaaacacaccatgcatcggcactcagaaaaaagtagcaaaaacatggtagtggagaggagagactgtacaaacatgaacagctgaagggcagagaataagtaccaatgagtagaaaaatcaaaacagtccaattattctatcaaattatacatgtattagatcagaaagaaaatgattccagcactgtagccaacctaaaccatgtgattcaggtggagtttggtacagtgcaaaccttgagtgcatgtggtgtgtaacagagacatctctcttaccactctctgaagattaatgtcactcctgataagactctgattagaatcctatttccaacatgtggtgatgctaagtaaacagtactgacaaggctgaaggatgtgagctctactaagtgaattgaaaagttggataaaaagactcgctgataaagatgagaggacactgattactcatgaaaaggaaagaccaagggaggacttccatttgacttcaaaataacatgaattttattattctgatagtgccaccaaaataaatcctatgtattctccaggcagtaagggcttatgttataggcattgttttaaatgtaaatatttttatcaaccgaatatatttaagatgtgaaatcagttatccctataagtctgtaatgaaaaatggcagtactgggtactctgtttatccttaaaatttagaaattcatgttctgagaagtttttttggtattatttctttgataactttcttctctttttgtcttttatctcttttaagaactcttgctagtttcctgttgaatttgctggattgatcttcctgttttcatctatttttctttcatccatctctttggctgcttcccccgccccccattccttgtttcacgataattttttcttagttatgtgaatatattcaatatatttccttttgctttctttgttgcctgtttcatcttccatttattaaaaaaactgttattttcttgtaaaaacccttaacatgagatctaccctcttagcagattttttaaggtgtacaatacagtattgtgaatataggcacaatgctgtatagcagatctctggaacttgctcatattgctttattggaactttttaccttttgattagcaaatccctgcatttggcctccctgcccgacattgttctgttctctgcttctatgagtttcactattttaggaagctcattgaagtgaaatcatgcagtatttgttctctttgaccaggttatttatctccctgagcataagtctcaaccatcttgtcacatattgcaggatttcgctcttttttttaagttaatattccattatatgtatatactacattttctttacccattcatctgtcaccaggcatttaggtgcttctgtgtcttggctattgtggataatgctgcagtgaacatgggagtacagatgtctctttgacttctcagttcctttgggtacatatctggaagtgagattgctggatcatatagtaattatatttttaattttttgagaaacctccataccattttccataacggttgtacagttttgcattcctagaaacaatatatagcattcaaatttctccacatcctccccagcacttgtctttttttttggtggtcccatcccaacaggtgtgaggtggtgttgcactgtggcttagctttgcatgttactgcttccttttttatttctctcggtctctgcctttcacactagaggctttcctcggttgtttgtgatacaggtgttaagaaattacttaggtagatagtgagggtatggaagtcctcagtaaggttttccatttaatgaaaagcagccccaaatcattttcctttctaacagaaaaatctgtgaaatcaagctggaaatagatgccggcagttgtgccaatcatgttcaaaatggtggccccatcttcccttctctttatcagccacgtgtacatgtacagtaaggagcagacaagacagcgccagtcagtggacagctcatttgcataataagattagggtggggtggccagccttccccgtgggctgtgtaaatgtcatgcagtggctcactcctgtaatcccagcactttgggaggccaaggtgggcggatcacctgaggtcaggagttcgagaccagcctggccaacatggtgaaaccccgtctctacttaaaaatacaaaaaattagctgggcatggtgatacgcacctgtaatcccagctactcaggagactgaggcaggagaattgcttgaacccaggaggcggaggttggagtgagccaagatcacatcattgcactccaagagtgagactttgtctccaaaaaaataataaataaagaaaaagaaaactgttaggctataaagagtccctttgtttatctgttagcttaatttaaaagtaaaacatatactattctaattacatgcattaatgttgaatgttaccttcaaaagtttatagctcttatccctaatgccaacaacatctgattactttgcaccatatggctgcagtgtggtgtatggaaagaaagctggctggggacccagccaggctcagtcatactattctttagtagtgtgaccttatgcaggcttcttaacttctttgcttgaaagttttctcagctgtaaagcgcgggccttctataacatggtcccttagcatccttatatttgtaatattccctcattgtatgagaaactatgtctatattggtcgttctttttcagttagtaatcagatgttttctgtgtatgtatatgcgtgtctacatacacagcgtggttgaaaatacataaatacatgtagttaaaacaccacccccactcaaaatagatttaggctatatttgctaatggatcctcataagttcttgcagatattctcatccatgtgtcaatatttgcacataaatcattatccaggcactatatcattttttctcacatcttagaaatgcttttatgtaaacatattcctgaacatatttattactagtcaatatctagtactataatttataaattaataagaaatttaagtttttatttttttatctttttttaaaatctaattccccccctgcatgtttgacttgtgctggcagaataatttttttttttcttagacggagtctcactctgtcgcccaggctggagtgcagtggtgcgatctcggctcactgcaagctccgcctcctgggtccacaccattctccagcctgagcctcccaagtagctgtgactacaggcgcccgccaccacacccagctaattttttttttgtgtgtgtgtttttactagagacggggttgcaccatgttagccaggatggtctcgatctcctgaccttgtgatctgcctgcctcagcctcccaaagtgttgggattataggtgtgaactgctgcacccggccactagcagaataattttttaaaaaatctatgcatggggctcgttggctcatgcctgtaatcttagcacttgtggaggccaaggtgggcagatcacttgaggccaggagttgagaccagcctggccaacttggcgaaaccctgtttctacttaaaacaaaacaaaaaaaccccacaaaaattagccaggcatggtggctcacccctgtgatcccagctacttgggaggctgaggcacaagaattgctcgaacgtgggagatggaggttgcagtaagctgagattgtgccactccactccagcctgggcaacagagtgggactctgtctcaaaaaaaaaaacaaaaacaaaaaacaaacctatgcattgaaaagtgtctgaaagtaaataaagcaaatgttaacaatacttgtattcgttggaatttgaagtgatttttctgtgtatttaatatttttaacaattgatattttattgggaaaaatccattttaataaaagtaccatgctattatgaagtaattatgaatcagtagttgtttagttgaattataaaaccatattctttattgactattaaatcacacatcattaaaaatatttttttcttcaatctctctatttttttaattgaagtataatttacacatattaaaatgcacagattttaactataccctctgagtcttttacccactgtacttaaaatataaaacattccagtaatctcataaaattcccttaaatccctgttatccctcttaaatcagtccattccctcttcgcagacagctaccgatctgatacctatcatcatggattagtgttttctgtttggaacattgaataaatggaactatgcactcttgtgtctgactatcccattatccatttgatcactgcttacagatcttatgactgtcttaaaatacccattgttcttcttttcttaatgtctatgtaactggccctaagtcacacagctgggaagtgctagagccagggcctggcctcaggtccatgtgcccctgagctctttcccctaatcctgtgtgtgccgctttccaaggcccccgactggaaatccgcttgctggggagggttaggttggactgtaaatcactttgtcactctaaggaatttgttccttattcctcatatatggattctccattgtggcaccatgactctttggggttgaaaagaataacaaactgcaagcttgtttaaaaaataatccagtttttcttcagtgactattcatcaggcagcagctgtgagtcagatactgttctaagcaggctgctgactgcgccctggatgtgggatgatctgtctgtgctgtggagtccaggaacttgactcttgatgtgtcggcattttgaggtgtttccccttgagctggtcaggttccctggagaagactgtattcctcttctgcctagaaggtgatagcctggctgccagtgttcaggaagcagagttggggcctccgtgcacaaatccaggtaatctccctgttttcagtgaggcatcctggtggcagataccccagagtctccctctgcaaagagtgaacctccagtgctcctccagggtggagagggcagtcacctagtttgcatgtggggaaagggatccaggcactgatggtttttttcctgcctttcgtggagtctttcttattttggctctcctgggtgggaagacatgacagaccacgtggccttagtccccacattataaggaataaaatccagatttcttagcatgacatccaggatgtcatgggtgggtaggtggatggggtggggcagattttgtgttggcaattacattggccatttgtttgtcccattgccaactgcggctttgggcctcttgggtcagctttcacacctcccactgctgtgatgttttccagctgtccgcattttgtcttttcttgtgtttccacctttaaaagaaaatcctgtgctttttttttgtttttaaatcttggaaggcctttttgaaaaaatcagttcaggtataaatttcttttcattaattttgccttttaatgtatcctcttcactctgaggcaagttcagaaatctgaatttccttatttaccgtgaatcaatgtcatttcgactccaacacttgcctgtttccctgtcagcaaattatccttatttatgcttaaggtaaatctccccacttacctaggcaggccaatgctgtccatatcttggattccatgttaaggaatttgtattttattccttctaatgggagaactgaccaagtccacatggtttcctcgtgtctgcccacccggctacttctgtgccaggcttagggcacaggagtttatactctctatgcaaaccccagaacttcatgaacctggagtgggggcagaaaggcccattcaggcccagatcaagaggaagtcactctggtggctggatgacattttaagtaatagaagagggccaaagaaagtgttccaaaagcacacttatgctgtcggcatgattttatggttgtccacacaaagaggcagacggaatcttcttgaaagttttttgctggattccttttcttgttcctgtcccatcccccaaactggcatgtctcttcaatgcagtcactaactagtgtggctcagttcataggaaagagtgtctggttgttgtttgttgaatactttctgcgatcattatgcagacaagaagaccaaaagcagacagattatattagctctgtcttctttcctcatgccacctgtttgccaggttggtcatattttctatccccaagttaggggctgtggggagatggaggccaggggatctcacttggacctatcaaggagttggagcatggctataaatactttttccagttgctgcttagtttttagcaattccttcaaaactagatagagagagttggtgcttagtttttagcagttccttcacaactagatagataggtaggtagatagacagagcttaaaacaattattagcaagtttccatgggattttaatgggaaaaggagagaggaaatgttgggcctttgcctttattacctggagtacgcagaagagggtttcttgaggaagttttaggctagaacagctgagtttctgcccgccttgaaagtccactatcagagagatccctgctgcctggagctcagtggagatggatggacttgcctggctcattaagagcagggccgtatcacatctgtctttcaaaaccttgcatctgacataattcgtgatgtgtaataggtgctcaataaagggttgtagattgaatgactaaatgaggcagcgatcaccatggcagtcatccacatcagggtgagtagtggaaatgaatgaggttaggaagaattattgcattaatttttagggctcaccaactcagtgcttacaggatccaaatgaaagaataaacactgcccattctaggatgataaatgacagccgaaatttggcctcagtataggggcagagagtggcagcctggagggcacatgcctcatctgatgggagctgttgccagctgcagccagtaggcataatgacatacctcctaattttttttagatttaagtaaaactctggatggtagtgtgaaatatctttacttttcatttcaaatttatgatattttgagtcacaaaaaaaacacatatgtggatcacatttgattgaaggccttctcattgtcctctctggtaaacccaaaagaagagggaggccgggtgtggtggctgacgccggtaatcctagcactttggaagaccaaggcaggtggatcagctgaggtcaggagttcaagaccagcctggccaacatgacgaaaccccatcactactaaaaatacaaaaattagccagacatggttgcagtcgcctgtaatctcagctattcgggaggccgagacaggagaatcgcttgaacctgggaggcagaggttgcagtgggccgaaattgccccactttactgcagtctgggtgaaagagtgatacttcatctcaaaaacaaaaaaagaagaggcctgggttgctgggaaccttcatttaaggggcaagtggaagaaaaataatccttcaacaagactgaaaaggcgcagttaaagaaccagagagagaagtgactctgaatctaagaagaagactttaaggaaggctggtcaaggttgatggacatctgctatgatatgtgctatggggaagtcagagaacacagtgaattgcttatgaatgcagggagaatgcacattcacatgcagctattttgggtctgacacaagcatggtgcagtctgtgacactggtatcacttggaccaaacttgcttttaaagttgtttccataaggctctggcaagaaaagagtccaagatcatataaatttttatgttgaaagccatcattcgtatatctataataaaggactttaaaggagtatttaaaatatttcaaggaatttacatgaaactgtcaaggaatcactatttttatatcttcaccatgatagggtggaccttcgtcttgtcttttgggggaagttatgacagtagatcctattccaggaagttttattttactggaggaaagcccagttaaaatcccagtgttaatttcctgtcatgttaactaccaaagaacagatttccaaagtgtctcaaacatttgacacaatcatttccgttttctaaacttgatctgtgtttcttgggtgatacatgcattctgattcgaaattgaacaaagtatattcttaagtataactatatcctgtctaaggcagtggactcatggagtatgttttcatttttatgttaattgtcgagagtttataagtcattgtaaattagtctgagtgctttgtgtgagttagaaattgtctagtagagcaaaacccttttactaaactcctcctgtgtgcttccacttgctcagagccatgcaggcaacttcttacatgcagaggagggcgtaatctaagccatacgctggtcattgggtggacttccatgcctctatgcctttctcatgtgtgtttgcctctgcctgtaattttccatccattcccaacctcttttccttctcttccttcttatgaagtcctagttatgcttcagggatgatttaatatgtcagtccttctgtagagatccctaagaccttcttaccactgtacccatgaaactttatatataactatggatatggcacttatcaaataatatatttggtatttatttttctcttccacatgactgtgtatatcctaaagtccatgtcactaatttctgcatctaggcatgtatctgacataggggagcttttcagtaactgatggttgaattaggtggaattcctccaataagacatcaccccaatgcatgacttaggcaaataaggtattaaccctgtgtggtgttgaagaaccattaagcttaagagtattaaggagctaaatgccctcttatgttttgttatgtaatttaaacagaggaacaaaaaataaaattctttaagagaagaaggactagatatgtccgtaagccttgataaactaattataaaacttgtgggtgcagcacatcaacatggcacatgtatacatatgtaacaaacctgcacattgtgcacatgtaccctcaaaattaaagtataatgatagaaacttgacacaattatattttaacgtatttcacattgatttaaaatttaattgtcgataagtcatcagcggcaaacccaaactgtagaattttaattcccaatgatagatttttctaatctgtagtagatttcttattatgttatggcctgatacacatagcttagatgtgccttgagtaaaatcatgaccctgaaatctagcgactgtagatgttttacatattagaacttagggcataatttttctccccaacagcagggctggaaaggtgattacatttcagaagggtcctttcagcctgtgccttgtagcgatttggggcatgaccctttgctttacacctgcatagctggtgtggccttttctcccaggctcctgggctgggcctttcctctttcagagagaaggacccagggaagaggggctgaaatgggagacatcgttgtgtgccaagcataggatcatgcctggcctatggtaggttagcatttaataagtgtttatgcaatattgcttgattaaaatagcattgatcttttaatcaataacattattaaaataaaaatgttttaaaatgttaaaaatattttaatatctttacaataactattggctatgccttacagtactattgtctctctttaaacctctcttagaaactgtgtgttaggtttggttttattctttgattactagaagtgcttttaaagaaggtacagagctctaaaaagggcttctttcaagtgtagagagagaaattagaaaaaacatcaaagacaaagacttctaagaaggaaaataaaaattgatttaccttcgctttagaagcttcccaaaaggggagactaggaaaaatagcagaccagaccatactgaaggcttcctttattccctctgttgtctcattccctggtgccaagagcctctttggggagattacactttatggcaaggttgcatttgttgttattttgttctcatctccatctgggacaagcttaggcataattcctatttgtatttcaaattttcctgccaaaaacgtgttgacctatgtctccaaagtaacggaggttatgcatcatttctactctagttgtggaaatcgacaaaataatgtttctaccactagcaagaaaaattgagatgttactgtagagaacttgccattgaaatggcattagtgataggatttgacgttttgaaaaaatagatcccattcttcttggcttcctgttatactccttgcttaatttctgtttcatggacgcgatcactatctgttgcaagtgtgaggatgaagccacagatggctagactctgaccccataggggagccattcttactaaagagatggctcttaagaccaaatggagcactggtagaatgggtgccaggtgagtgggagagactgccttcctcatggtctgctcgtggctggtaatatccttgcaggggccacctctactcgtagggaataaggatgacacatagccacataaaggcaggtctggaaactcgcaagatgtccacctgcttacttctgagaaaaaaagtttggaatggtgcactctgtatgtttctcagcaggcagagcgctgggtttgttgagtgagattgtgttacacgtactcatagacacaggcaggagttacctggacttcatgtttacagtgtgttttaaattctattgatgttcgtatgttgtgaattccattttgggtgtattctgtacgaaaggatgatcttttcagagtatgtaatgaatattaacttcttagtgacttcagaagacccatttattggttacttgatagtacaaacaccaacagccatctgagttctgtaaattgttactgagatgagcttttttatttttgaaaaacgatcatttctctatgcatagattattatcactggccatctctactactgctcaactgaattccttcctcaaccataaccattgtgtagtttttatatttgattattttcctcatatatcgttatccttgactaaaggcctttctccttaggaaatgctttagactacctggccttatagcatcaatttcatttttaaatgcctgtggagacatgcttgactgcatatgaattttctagtagagttctgtaagaattcttcacctcccaaagaccatatgtatccatcttggttcccaacagtttataactgccagaataatttaaaagacattttccctttgcaagttaatttagaatagaacatattttgtcagagaaagtggtgtgggaaacagcttggatcaagcagccacagacctctagcgacctcacaggcagcatggggcctgtagagggcactgcaccaggagtctgatgatgtggcctgggtcccggccatgcccaaatgaggggcgaagtctttcccagtcacttctgctctcttggcttaagtttcttcacatggaaaatgagtcgttggcctaatgatgccccaaagtagcgtttagattttaaaatgtcattgattctagattttaacatctacaagttcaacatgaacgtcgacagctcatttagtcttcataatcctctttgtaccaaagcagattttgtgatcgcattctgaaaacatcaggaaaactaggatatgctacagcacttaccaaccataaaatcaggaaatctaggttatgctacagcacttaccaaccaagaaatctcagtggcttaaagcaagtttatttcctgcttagggtgcacagttagtgtgggttgagtgaggtgtcactgctcgtcacagttacccagggactcaggctgatggagcagctgccatctcagatgctgctgatagctgtcagagggaagcagtatggtggatttgtataaaactcacggactcctgagccttgtactgtaactgagtccctaacttctgcctgcctttcttttctgcagcaggtgaccatcactgatggagggggcaggagagtgtgctcctaccaggactgggaggagagctggtgctatgtggtgggcggcagtattggcaccacatgttacagagggctgcttctgaccaaagccaactttaggagagagttttaattgacgcctaacagacctttgctgggctcatttccatactgtgcccaatgagaaagaactatgaggaatggggaaaaggcctcaggtagaaagtagagaagagtcatgggattgatgcaggggtcagaaaaatggtggggcacaccaaataaacattttggcaggcggtcaaaaggcctagagttaatggctaaagtgaggccaagatgatattgaaaatgttcatctttcatgttgaaagactaatgtgcagtcacttctagcatgatggggatcgtggttttcctcatagctgtcccctgtagaagtctcagttactcctcatccttcaagacttaatgcaaatatttatctgcgtgtattttcttttcctactgaaatgtgaatgtttccaggacaaggagccatttcatcctagcacctagtttacaggcactaagtgaatattacatgattgaaatgaaaccacctggcaaccctctgctatggtgcccatgtgcctgccatcctctggctggttcagcattttaccaggccagagctgggcacagaattggttctgtagaagcagctaaagcaagatgacatttctgagacttctggccgctgttctgttaattttggtgctgtcaagcgaaagggtaatcaaatagtactttgaaatctgaaaagtgaaaagagaaaagtaaactcatacctaaaatataatttctgttctgtatattctagtttccttcttttgagttgctgtccatttagtgtagtgcaatcaagaatacctaaatcagtataacctcgtcattgaaagaaagactttagtaacctattgatatttctgtcttcattattttattattatgaaattgctgaaaataattacacaagtgatataacttttaatcgttgggatgcaaaacagtggttctcaagcttcagagtgcctcagggttgcctggagggcttgctggggccccactcccagagtgtgcatttcaggtggtctggggtggggcctgggagtcagcatttctgtggagttccctgaggatgatgacaccgcgggtctgggaaccacactgtaacgaacaatgatgtacaggaaagggcactggaaacagaaaagcatgggtgtgaatcctccatgctccctaataaccatatgacagtaggtctctcggcccctctaatcctctgtttccaccttgtggaacgtgaaggccctagttgacctaacagatgatcagatgaggttgtacactaaagccgtttttaaaaaaataaggctctctgaaggtatcttcttacaatatcctacagattgagaatcatggacacttgttttacattcagagtatacacagctctgtaccaggtagtggaaaacaggacatggaaagaaaaagagaacaggagaaatgtggcacatgccaagcaccaaaatgagtgatgtgactgtttaaaattaagagaaagacacgctgtggtgggctgcccaggggggacgtctcccaaactgtactgcgtaaagaccatcatttcacaaggaacctgtggtcactttgtgttccaggatggcttattgcacgggtagcgtcctggaatctagaaatctctcatattagtgcatttgggtagtttatcttttcttggactcaatctcaggttacctacccgttagagtttatgaagttaagagtttaaagttcctcattttgcaagcatttaaaagtcatcatctcaacaaggaggtgctactgtaaatataagtatcagaaagatctatgaagtcatcttttcacacttttgatttaactaattgagggaggggaggaaaatctgaaaatctcaaggaatttttaatcttaagattaaaaaatgtagctcatacatagttgaccagcactagcatttttcttttaaggtgtgtgaccttgtctacacttagagttttagataatttttattatgatttaaccctaatgttttaaaattacaattaatagtaggtttagaaattaatgttgtaagtaatatattaacatttttactctactttaagtgctttgatagccacatatttaaggttggataaaaactgtaatttaacagtcataattattataattgatctgaataaaaatatgaactaactgtattggtcaaagcaagttatgtggtaaataaaaattaacaataaaattgaggttttaaaacttaccttgggcaaagactgtatctgggtgatagattgagctctagacagtgaagtgtacctatggatactaactgccgttatgattaataaacacgttgttatacttcaattgtaatagcattttattatgtattatttttcaccaaagaatactaacaggccagttaccactgtgcaggttctgtttaaactcttggcattaaaaaaggaatcctcattcatacttgaaaaagattggaaatccctgacctagtccatgcttgtccatgatactaccctggcccttcatcttgactgactctgtagatcactgttaatgttggtttatgtatttcttacccttttggatagataccttttctaaaggaagcaatgatggaaaactggctgttagctaggttgagatgtgtgcacacttcattacactcttaacaggcagatacccgtcagccttaaaggatgactttttgccaccctgctttcctttctgcctggccatctgcttcttagaatcttccctgaccatgctgtatgttccagtaccttctttgttgaagaacgtattggaaagcatagtcagtgtcttttaacctgattcttccttctgttcttttgaagacagctttgattgtttctaaagtgccaatggaaaaataaatccaagaatttgtctccccagtttttgaaaaattgtagtgtagggcaactgtaaaacacatactatgtactataagtttcccacaattaaatcagtatgaatagttgttgaaatgcatcagttgaatagattagagattcaagtatatatgaagatctgaaatgtaatagacctggcaaaactcagttcatggaaggtggttgattcaataaatatcattgatataactgattatacatctggaaaaaataattgtaggaacccttcccacactgtatacaaaaattaattctagatgaattattgttctaaatgttctaaaaatacacaagtaatagaggtaggtcttaaacctgggtctgtcttactccaaaactactgagctacattttaaatgttaatagataatgcgagattacgagtcccaaagatgagaggagagaaacattttcttttgctaacatttgactttttattttttgtcgtaaacaatgctgagatgaacatcctaatgtctacattggtaagtggatacatgattattttctttttaacacattcctggaaatgaaatagctgtgtttgagggcacccaggcttttgaaataaacttccagattgctctccagaaaggctgtgctaaattagtgactttattcttttgtcatgtttaatatcccactatttttctcttcagaccatcttttgttatggagaaggattgtactcccatcttccttttatattggcaagtttctaattaacctagggcttcctgtgaaatagggagaagctgatattttgtatccttttatcatctatattaataagctcataaagaaagtatcactttgacctcagatatctccttctctagcattaatcggagacttctgttaagatccagccatatagaacaacaacagtagggttttactctccctactatcaatatattggctgtgctggaggtgaggcgccccccttcctcctgcagccagagagctgcatccctgggaagaacctgctcttacatgactttaactacttgccattcaatgtaagtgcagcatatttccaaactgcgtaaaaaatgagctgtgtgaaggcttcctcctgtctttgttatctttcatgcaaacagttctttttgatagaatttggaatttaccgaattcattccgaaggctgtgaaatgtgatctctatgagttatagtcttcctgtgaggatgcgttgtttttgtggaaggcaccaccgggttgacacagtattatttatttttctcccacatacttcttgtaccttcctctgtaaccaatatgagactgtattgaagagaaataatcttgccaagtatttgatatacatagaattctttgtgagttgctatcttaacttaaaaattttaatatgctaaatatccatgtgccaaaggaaaataaaagtaagttcttttcagagcagggacttttatgtcttacagtattcagtgtgaagtaggatagaggtatatcatcgatcacagtgcacaccagacagaatttagagtgtttacatctgcgatcagagttacctggtctcagggcagagcatgttttgttttttttccctactttttagcaaagacttaggctattgtaaataagctgaaaattatcacagaaattgttgaagttggctctgaacaagaatgcttgatctttctataaacagctttattaatgcacgtcaaggcactgttctctaccatttccttctgcttgttgcagaccagctaatgtgttaacagagatctgaatcatgacctttttttcccataggcataggccgactctttccttgagctaaaatttagccagaaaggaaaaaaaaacccattttggtgcatgtggcatgaaaatgaaacaatgcagctttatttagggtctcctttaacctacatcttaaaaatatattttaagtctgtaatatgcctattaaacattagcacagttatcaaaataatgatatttgtaaaatcaatgtgaatatgtgaaatttgtagctttatatacaaatcatatacatgggcatgcatgcatacatatttcaacatattaatatgtgtctatctcaatatatgcatatctcaaatttacatatgtatatcttatacatatataattgagatagcaccaattataaaggatttcttaaagaggctgcaaatttaggcatttgtcattaaataatcccataatatttcagtgcctgaaatcattctagcctttatattgtagtcatttgcgttttcttcccttttctaaatgtagtctccagatgaattaatatactcacaatcaacatactgtggcacgagtaagaactatgtgtattagacaagttcaaagcagtcctgacgctcacttgactaaggcatgtgcctcatgtcccctttaccttcagctcttctgggccactgctgggtgctcattgctgctcctgtgctgactgtctgcagtgtgtgccgtggaatacttctttgcctatttatcatatctttggttcctctccatccttaatgctgaacttttagagcatgtagaacaaatcagaagtctcttgtgctgattatatccatttgacagatgtgttcagaaattttcttgcactcattaaaatataaagtaaaaattgaaatgctttatatgatattaatatggatattactatgacaagtgatagcttacaatgaaaagatttcttttaagaactcttgccatatttccttctattttcatgttttgatatttctagaaaatgtttttactgtattcaagattagggttttgtaatttttagcaatactgctgtggagcctagttgaaattagtgtattactttagttcagactttcttcttatcattcttgattgttaaaagaaataaaggtttacacagaatgtatagcagtgttgagtgaactcaaccagcttttaatatattttttagaaggttaggagaaagattaacctatttaaggacctaacctacttttacatcctgcaaactattttttttaaattttaaaacatttttcgtttttgttcttttgtattttgtttattgtaaccgtagtttgtcaggagttacaacccggccaacaccgggggtggggggcccaacatcacacatctgtgtttgtaatgtagtatttattaatacaggtcatataacattaatgtgtcagcacctcatggatatgtgaattatttaaaatgagcatctgggtactattttttgatatttgaaataaactgaatttttaatgttcatatgttatacgatatgccaagattatcctggtaaagttttcatatccaactggggaatcagcagcaatgtttctccctcatttcttgggtcaagcaagcctaaagttggacacaacctttaaaatgagctgattatggacacatttatacatcattttgttaataagttgtgcatcagttaaactgaaagcttgctttgcttgcctcattggtttttttttttttaatttttctggaattaaaaccactgaaaaataagtccagaaacatcaatttggctgaccttagtttccccctaaatttagtagttttatacagcagaaaacttgtaaagttacttatttacagacaggctctcagtgtgtcacccaggctggagtacagcagcacgatcacggctcaccgcagcctgagactcgtgggttcgagcagtgtttccaccctggcctcccgaagagttgagattacaggcatgagccactgcacctggcctaaatttttttttgttgttgtttttaaggaacaattttctttacagaattatttagaattagaaattgtgaatcacattatcaagcttttaaaaactcttaatttaattgagaaaattaagtattaatactatggcctgggtcgttcgggttgtagtgtgatacaactcctaaacatgaaagattttactcttcttcttcttcttcttttttttttgagccggagcctcgctctgtcgcccaggctggagtgcggtggcgcaatcttggctcactgcaagctccacctcccgggttcatgccattctctgcctcagcctcctgagtagctgggactacaggcgcccaccaccaagcctggctaattttttgtatttttagtagagacggggtttcactgtattagcaaggatggtctcgatcgatctcctgaccttgtgatccacccgccttggcctcccaaagtgtggggattacaggtgtgagccaccgcgcccagctgattttactcttttgaaccctgtggttcctggaagttgaagtcctgtcccccagtagatgcttgttgaatgaatgctcactcagccactctttttgccagaggctactagtttctcacctacctcttctccctctcatctaggctgacatactctgaaagcaaggcagaatttgctcatatattcatttatgatccatattttttccttggaaataattattttcattttgctggaccacgttttagagagcctcacttctgttgatttgattctgagcaatgtttctgagctggactgaccacagagtaagatcttaccttattcatggctgtgaatcatattgagccatttgtcttagctgtcatgcaatttgctaattaggtcattctaggggttgagggaaatgaaagactttgaaataatcattaccttctcagaacaaagcagcagcagttaaatgcttttgcccagtcattttactctgatgttcaataaattcagaagtggaaggtaagttgggatcttactgttgcataattatgctttccagtttatctgaagattgtgcagaagatatttaaatcagtgtcttacacagttataagttgtatatttctgtttttcttattacattttttatcataaaactaaaacctattagttgaagaacatttggaaaatacagagaaatagtaaataaaaaatttaaaagtactcctcatcctaccatctagtataattatttgatggatttctttctggtctttcctattcatatatttttcataaaacttaattattgccttatattgtacaacaatagctgacattttctgagtgtctatttcatagcaggcagtgatctaagagctttaaatgcattatctacttaatgttcatagcaatctaggaggcagttattttccaatgatgaatctgaaacttaagattttgctctatgtcaaaaaatgagaaatttaagacttctagcttggacaaaatggcacagacctgtttctcccactttctcccaactaaatacaatgatagaccccagaaataatgcaagaaacagaaggagaactctaaaacttggtaggaagaagtcaagatggtttggggcccaggactaaaggactgacacaatggcagggcatctcacattccctcacccatcaggagaggcagacctggcctttcttgacctctgaactagcaaccgagatagtccagggaggctgcttcctttttttattcaaatggaagcaagcaagcagccaagggaaatactcttctttcttgctgagatacccttttccagtgtgtgatacctgggcttctgtgaagcaattgttagaaggatcccactgcaacaaatggtccagctgagtagcttctttgtcctcatgcacctaagaccaccttcttctgcccagagaggaataggtggttaggaaagcctaatccattctgtgggcctgaacaccaccactccttctactgagggacactgggcattaggcctggggaagtcccttcactccctcaggcagcatcagcagggacccgtgggagcccccatcagaaccagacaaatgaagcgggcacaaagaatgctgcaaaggctctgaaaattaagctggccctggaaccatagcccacaaaagtagaccaggacccacatactaagcctaaacagggtgactgcctagacaggaaatcagcaaggatgtagaaggtctgaacaacacaatcaagcaacaggactaaattgacgtttctggaatacttcacccagaaaccacagaatacatagtcttccaaagaattcgtgggacattcaccaagacggcgcacatcctgggccatagagcacttttaaacaaccaaactcatgcggagtgcactctctgatcgtagtggagtctattagaaatcagtaacagaaagacaacaggaaaaccttcaaacaggtaaaaatgaaacaacacactattaaataatacatgatttaaagatcaagttttaaaggaaataaaaatacataaaactgaaagcaaaaacagaacataccaaaatatttgggacgcaggtaaagcagttctgagagtgaaatttatggcactaaattactacattaaaaatgaggagagatagagaaagatagttcaatagaagcctccagagattgtactcactcctccataggatcaccaaattacccacagaaaaaatcatcttcataagaaccaagaatcaggtgagcaatcacagtacctggttttagcatcatactaaggaaagaggcactgaggagagtaggagagatagtcttcaatcacctaggccacctttccctcatccaaaaaatataactgataaacaaattcattatagttgctgaatacaaaattaacatccaaaaaggagtagtatttgtctatgccaaaaacaaacaatctgaaaaaagaaatcaagaaactaatcccatttacaatagctacaaaaaaatactaggaattaagttaaccagagaagtgaaaaatccctgtaaggaaaactataaaactttttgcaagaaattgaagaggacacgcaaaaaaatggaaagatattacatgtttgtagatttgaagaatcaatattgttcaaatgtccatattacccagggcaatctatagattcaatgcaatccctatcaaaatacccatgaattcttcacagaaatagaaaaacaatcctaaaatttaaatggaaccacaaaaagccaagaatagacaaatttatcctaaacaaaaagaacataacttgaggagtcacatttacatgacttgaagttatactacagagctatagtaaccaaaacaacatggtatgggcataaaaataggcaagttgaccagtggaacaaaattaaaatccagaaataaatctatacacctacagtgaactcacttttgacaaaggtgccaagaatatacattggggaaaggacactcttttcagtaaatgttgctgggaaaactggatatccatatacagaagaatgaaactagacctctatgtctcatcacatacaaaaatcaaaatggattaaaaactttaagatgtgaagattatgaaactagtaaaagaaaacattggggaaactctccagggcattggatggggtaaggatttcttgagtaatactctacaaatatgggcaaacaaagcaaaaatggacaaatgagatcacatgaagttaaaaagcttctgcacagcaaaggaaaacaatcaacaaagcaaagagacaattcagtgggagaaaatatttgcaaaccatccatctgacaagggattagtaaccagcatatataaggagttcaagcaactctataggaaaatatttaataatctgattaaaaaatggacaaaagatctgaatagatattttgcaaaagaagacatacaaatggcaaacaggtgtattaaacgtcattgatcatcagagaaatgcaaatcaaaaccattatacaacaaggtatcatctcactccagttaaaatggcttttatcttaaagacaggcagtaacaaatgctggcaagaatgtggagaaaagggaatcctcatacactatcggtgggaatgtaaattagggaaaccaccatggagagcagtttggaggtttctcaaaaaagtaaaaatagagctaccatatgatccagcaaagccactgttaggtatatatgccaaagaaaggaatcagtataccgaagaggtatctgtacttctatgttttttgcagcactattcacaatagccaacatttgtaagcaacctaagtgttcttcagcagatgaatggataaagaaaatgtgatacatatacacgatggagtatattcagccataaagaaaaatgagatcctgtcatttgcaacaacactcgttttgttaagtggagtaggtcaagcacagaaggacaaacttcatgtgttctcagtcatttatgggagctaagaaaagtaaaacaattgaactcatggagataaagggtagaatggttccctgaggctggaaaaggttggtgggggtgcagcaagtagggatggttaatgggtacaaaaatatagttagaatgaataagatctagtatttcatagtacaacagggtgactaaagtcaataatttattatacatttaataactagaggccaggtgtggtggctcacaccttgtaatcccagcactttgggaggctgaggcaggctgattatctcaggtcaggattttgagaccagtctggcgaacctggtgaaacctcgtctctactaaaaatacaaaaattaagccaggtgtggtggtgcacacctgtaatcccagctactctggagactgaggcaggaggcagtgagccaagatcacgccactgcactccagcctgggcagcagagtgagattctgtttcaaataaataaataaaaataaaataactagaagagtataattggattgtttgtaacacaaagaagggattagtacttacgtgatggatacccataccccgtttaccctgatgtgattattacacattgtatgtctgtatcacaatatctcatgtaccccttaaatatttacacatactgtagactcacaaaaattaaaaatattaaaaaataaggaaaggtctcaaatcaataatctaagttaatacctcaagaaattaggaaaagaagagcaaaataaatccagaacaagcagaaggaaagagataataaaagcaaaagtcgacaaaactgaaaatagggaaacagtagaaaaaaaatcaatgtatcaaaaacctggtcctttaaaaactttaataaaattgataaatctgtaacaaaatcgagaggaaaagaggacacaaatctgtaatatcaagaatgaaatgggacaacagtacagatcctaaagccactaaaggactcataaaggacaagattacactcacacattttccaactaagaagaaatgaggtcagtttgtcaaaaactgcaaactaatactcaaccaggatgaaatagataatctgaagagtcctgtaaccattagggaaatggagagagggtagtggctatggtcacaaaagagcaagaccaggggtcctgatggcaatagaaatgttcagtgtcttgatgtggtgatggacacaggaacccacacatgtgctaacattttatagaattaagtacacacctacaagtaaatatcaaactgaggaaatctgagtaagataattggattatatccatgtcaaagaaatcctggtcccagcattgtactaaggctttcaaaatgttgccattggggataactcagtaaagggtactcagaatctctttgtattacatcctataacttgcatgtgaatctgttattatctcagttaaattttcgattaaaaaaagctagcagcttgttactttaggagttgaaccctgactgtatgactccagagaccttgttctcattcacacgtctgcatctccatgttatgttgagacattgcattcctagtagttttacatgatcacatgtagatcataccatatgtaaatagaaaagtatgcttgtacattgtctttaacagcaattatcagtattagacaaagcatagttttgtttccctcccccaccccccgaccctgttcctgtctcatagtttgaagtttcccttaagtattcacagttatagtccccaaagactttagatgccacgtggcatgcgtaaagccagcatattctattgaaatggccggtatagttgccgaatcagatgtttttagcttacagaaatgacaatttcatatgacatttcttttcatatgttcaaagaaattacttgagcaaaatgggagatttctggagtaggccataggatcaaaggagttgctggaggggacaagagagctctagtatcctcagagtttggaacctaggacacattctttttatttccatctcatactttcttctccctggattttggcacatactgcctgcagtggaatcattggtggtttccagtatcttctttgaccagtcctgcagtctgaaggaaataacttctgtattccaggatttgtttgaaaagatcatagagaagattagaattagcctggcttggatcacagccctacacttttccagtcactgggcaagaggcagtgattggcctggtacaggccatgtggacagggagggagaggttattgctctgtgaagggagtaagagctgggagggggcagaggggcaatgcagacacagctgttagagcgaccgctgggatccagcagctgctgaagcctgtgtctgagattatcaagtcaagatatctaaatggcagttaaatcatgaacataaaaataattttcaaagtatgcttaattgttcagttttttaattcagcagaatttttctcctctgctaatgacaaggcagtctatattagagactgtcaaaattatttcttaagaagcatttaaacaaataatttttgtagactgctatatgcatttcattagacaaatgtatattctgctacaaattcacataatcatttttccctcactctactcaagactacttagattgtttgaaagaaggctttggctaatgggtattggaaggaatggctgattgttttaaaatatcctgttgcatacaggatgtatttttttgaagggttaagaatgaaaataggaagcaagcatgttccctctgactgaaattactttccttgaagccattagtgtgtaagtcagatgctgaacttacgatatatagatattatataatatgttacatatatacttgaaaataaaattccaaacagaataatgactgttgcatggatatataatggagtaatttactatgatgaagtctgacttgatagcacatcaacacagtaagcctcattttgaacagttctgctgtttcctttgtgaaatggtagttggaagtattgtccgcggttatgcagcatggtgtttatgaagacctttgtggactctgcttggatccatttccaggaaaaaaaatttctctgccagtgaacttttatgtttcttttgccagaaaatggagaaagatgaatgtttcaaatttttttttaagtgccaggatacttagaagcagcctggttcagtgccaagatgtagtaatcagcttcctcagatgtagtcattcattgacgctcttttctgattcaccaccagtgtcttgcaagagctttcactttatctgcctgcagccctgttttaacagtagtgttgacacaactcacctgtgtccatttgtgatttctaaatagtttttaaatcataaatatttgaacctcaaggtaacgctgtaaagtatgaatagagatgacattgtattttttcaaaaaaaaaaaaaaaacacaaaaatctaaacggaaacaagcacagatgaacttaatgtcagtgtaaattgtagattatagacttcacaaggctggtctttgttttgttcactgtatcccttgctcctagtatagtgcttgacaataaatgtttcaggatgattgatgttgaataaacttaaaaagtactcagcacctcacaactttgaagaacatggaaacacttgtattggcagaagacagaaatgtgtagccccaggagacaggagatagctcaaagcaacctgtcatgagcacatttctttgaagcctggtgttttatcttaataacccatacaaaattgaattcttctttgtattaggaatgtttgttttatcatagagattgttttaaatgttacttatcataaaatattatgcttccgcaaaatacactgtttatcttgaataccctagcgtatctttagaagtacgtacttctattgcttttgaaaaatacaaatgtccaattaattacattttattgatgtactgtctatatgctgatgatatccaaatgtatgtcttttatctttatttcatctctgtaattaccattttagttaatggcaagtgtgtttttccagttgattgagaaaaaaaattctaagtcatccttgatgtgtgttttgtttttttttaaacttatatccagtgtgttggatagtatcattgggtttgacttgagaatatatctggaatttggtcatttttaaccattcctactactgctaccaatctgccgccattgtctcttacctggattcctgcactgggtttttagctggcctgtgggttttcccttgcaccccacagcccagtctccacacagcgttggcacgatcctgtaaaaacatcagagcaggtggcacccttctcagcactctccagtggccacccatttaaacagagttcagacccacgtctccactgggcctggcagagccctctctgtatcctcctctcctactacccctccccagctctgctcttccagcctctctggcctctttcctgttcctccaacctgcccgagttgctgctgcttctggggtctgcatttgctcttcccgaaggtgtccagatggctgtttcctacacttcctttgagtcttttctcaaaacatttcaatgaggtcatccccattcattccacctacaatttcgcaccaacccccaaacataaggtcctttctcacattttttttcttttggcacttatcacatctaacatactatatgttttatgtggtgaggatattgaatttctttccttcccttcccccttccccacccctagtgcaatgctagattgcaagcttgatgagggtaggggagaaaggcacctgttacctaagagacctgccaggaaatctttgcttcatcctgatctgtctccacagttctattagaatccttcctttttactctccttgtttttcttcaagggcagggggttgatccctaacaccctcaaaagactgcctcttggctttaggatattaagccaactttttgacaaaaacacatctgagctgctttccttgggcgtcagggatggagcttttattgaagaaaagaaagacactgtctcctctctggtcacttgtttgttcctgggtttcataggtgtgtttctacgtgttagactccacaagcagtgaaactcggagatctctgagaacataagctttctcatgagcactgttttccctgtgggtaggccacccctaaggtggtggtggtggtgtttatttccctaaatggtagttacgggtcaggtgtgattcctggcacatggtaaatgctcagtaaataatttctgaatcaagactggttccctcaattttaatctgatgacttattttctccttatatggattatacttggccttcccattttaacattctgaagctgcaggagatattattaaaggccaggctacaaagagctcacgttcccttccagaatacactgtttctaacaagcaagctgaataaatttctctgaatctggatttaaacaaaattcattataagactggccttgcatttggaacatgttcttataaggaacctgtaagtcatgaatatttcactttcttttctaagttttcttttcaaatgcacatttgctttcattttcttgttaaaatggattgagaaagattaacacaaatgctggtgggaaaaaatatagaggaaataagcattcataaatattttaggcctccgtttttcaacaacccacagctgtgtgtacatagttgatctgggacagaatgccacgccttgtctctacaatgtgttgcctcagagccagtgttcacctggggaatagaacttggatgtttcggaaactgcatagcaccctagtgaaaaatgcttccaagtgcaagacagactcttatctccaaggattccagaccgtattctaccgtttccaaaaataacctgccatcatcagctttgatccctacctttaagataacattttattttctatttgttcaagtaaaacatgttcataaaaagtactttggccttttcttccatagattgtaagtgtaaaaatttgcctaggtttcggtctcagccaagatggtcaactgcatatactactgagttctgaataccatgttagctattgagaaagaataaaagctagagggatgcatgggtgctaaaaactaacaacaaaaatgctaggaaccccttgggagactgaagtgggctttagcttctgtatagtggctaagtagacgggtagctgcagcctgtggacgaggcagccataggtgtctggagagtctggaggaaactggtttttaaaactattttttctaagttatgataaagtatacataacataaacttaccatttttaagtgtactgtttggtggcactaagtgcaatcacgttaagttctgcttttgcctctcctattgccttccctgaattttatttccagcccaattgtcactcacacgtgaggatataagaagtatcttcagctatacaagaccttataaaagtttctatataaagagccacactgaaacatgctgggaggaaatacttaaatatgaagggaagcaaatacacgggcagctacaagagataggggaggtaagggggatcaagtcccctggcaaagttcattgatgtcttgaaaaagaaggctaggacataagaaaacagaaaatacatgcaagtaacccagagctaaacttctagatgttaccgttattgagtggaggagaaaccaaagacggtagggatgaagaaacatacagatggatctgctggggagacattgtgaaaatgaaaagcaagaggtgcagcttttaaaccagcagaagaaaattggatctagccaatcaaaaataggaaaggggaagtgggatggaaagaataaaacaaaaataaaatacagtaaatggaaaatatgaaaaaaagctggaaaagttcaagttttagagtaattacaacgtatattcctggattatccatcgtaaagatgtattctcagatggggcggaaaaacaagatacaaaaaataggttataagagacacacttcaaaagaagttggaaataaaaggatggaagagagagtacacaaatatgaaccaacagaaagcagtggtaacttaaatatattattaaagatgaagaggaatgctatatattgataaagggaatatgacaagaagatgtaaccataaaaaatggtaatctgcaatatagtttgaaaatatatccagcaacaattgacagaattgcagagagacatcaacagttgtagctgaaatttttaacacactgttctcagaaattagtaaatcctacagttgaaaagcaggcagaggtggagaaaacttgaaaaatacaattaataagcatgagctgttaggaatacacctaaaactgcatacttgagacaatgtgtattttttaagctcgtttggagtgattataaaaataaaccgtgtattatgccatataagaagcctcaatttcccaggaatgaaagcaataacaaattaggttcactcagtataatgcaataaaataagaaattactaataaaatgatagtccctaactcccaaaaaaccgcttgtggttacaaattaaataacatatttctaaatagctattgaattaaaaaaataaaattatgatatatttagaactgaaagacagtgaaaacatgacatttcagatttgtaggatgtagttcaagcagtacttaaaaggactttatagcttaaataaacatagtttattaaacatatagtttattaaatattaggaaacaagaaagataaaaaatgagccaaaaagttggtaaaaagaacacaaagcaaatttcaaggaaacaagatagaaaaataaaggtaagtacagaaagcaatgaaatacagaataataataataacacctgacatgatagagaaggttaaaatcaaaacttgattctttgaaagataagatagacctctgacagactcaaaaagaaagaaaagagaagctaaaaataaaatacaggacaatgctggcacctgtagtcccagctgctttgggaggccgagacaggataattgcttgaacccaggaggctgaggttgcagtgagccgagattgcgcaactactttccatcttgggtgacagagggagactctcaaaaaaaaatttattttaataaaaaatacaggacaatgacaaaaaaggaaatagctgtagaccaaagaaattttcaaatgattttattggaacaaaatgtatacttaataaatttgggggaaaagctaaataaaatgaataaattctcagaaaaaaatataaaatgtaaaaattatcctaagaaatacagaacatgatttcaccaatacatggtaaagaaatggagaaagtagtcaaaagctttcctcccagaaagcacctgagagaattttatggttgagttctactaaactttagaaagttggttcttttatgaactaatccagaaaacagtgaagagagagatgttcagcaattttctgaagttaatgaaacctcgattacagtacctgtgaatgtaacagtgtacattaaaagagtgaaggcaaaaatgcgattatctcaagcagtcactgtttaggagacaaatctggatttccaagcagaaggagatataatataggggatcaggtactttaaaagttgtaagcgttggagaagcagttttgggttgtggggtcggtggtaagatcacatgacaatccaggagacaggaagttgctactactgtcacttttattacttttttttttttttaaacctcacaaggggataactagacactggaatatagctgggcccagcaaacacatctctccagtcttgctttcttccatccgctgtagcaggaaaatggcctctacttcacctccctcttccggaggtcatgataaagcatctaaattgcatccagaaccttagctacaaaggaatctgggaaatatggttgttatctgtcagacctattcaacagagggagattgaaatggagtttgagagatgcactataaagtatgtaccacaaatgctcattacctctgctgctacttaacatagcgttttcattttatgtcctgatcagtgctatccaggaagtaaagcaagaggcatatggatctaaaggaatagataaaattgtcattacttatagaaagtatggtcatcttaacagaatttagtaaactgattactagaactaaagagtacaatgacattactgtgtataaacagtcatctcttggtatctggaggggagtggttctggaacctccctcagataccacaattcacagatgctcaaatccctgacttaaaacagcttagtatttggatataacctgtgcgtattctcctgtgtactttaaatcacatctaggtaacttatacaacttgatataatgtaaatgctatgttaagtagttgttatattgttcagggaataatgacaggaaaaagaagtctgtacatattcagtacaaatgcaattttttccgaatattttccatccacagttgatcagatccatagatgtggaacccacagatgcagaggatgaactgtacatatgatcaaactataagagtcaatttattctagtagtatccaattaaaaatgaataaaaacataagatacgacttacagcaacgaaagcaatataatatctatgaattaataagaatgtataaaaatctcttcagggtagaatttaaaatgctaataaaagaccaagattatctgagtaaatagagtttttattctcttggaggtagtcgtaaaaaggtgtcagttcttcacaaaatatttaaaattaaaccccagcatttttattgtatgtttttgggaacttgataaacttcttcttttttttttttttttttgagatggagtctcgctctgtcgcccaggctggagtgcagtggcgcgatcttggctcactgcaagctccccctcccaggttcacgccattctcctgcctcagcctcctgagtaactgggactacaggcacccgccatcacgcccagctaatttttttgtattttcagtagagacggggtttcactgtgttagccaggatggtctcgatctcctgacctcgtgatctgcctgcctcggcctcccaaagtgctgggattacaggcgtgagccaccacgcccggccgataaacttcttaaaaacataaagcagtagaggaaaattgatccacttgattttatcaccattacagattctgttcaatgaaggtatctgtagacagatgggcagatgacagaatggaaaatgatgtaggtgtatggaatgtccacaacttagattaacaggaaatctttgtctagaactgcaagaaactactgccaaaaaaaaaaaaaaaaagtgattgcaatccaaggagaaaaataagagatatgaccacacacttcacaaaacagtgaacgcaaaaggctaaccagcataggaagaaatcttcaagctcattattaccgagagaaataagaatcgaagcagtaaaatgatatccttattacactagcaagagttggctgaggatggtagatacaagtggggatgtgtgaacataggaattgtcatgcactggtggtgggagtgtagacttggcacctatactggagaacagaagttgctgaattaggcccagaaatactgatcccacatttattttcccgggtacgcatcctaggaacacttttagataattgaataagggatatgcctgaggtatagcatcattaaggcaagctgcccttgtcgtgaagtatttacattgttaggttttttaaaaacactgaggatttggtcacttttcgtgttatctacttaaggagaacagtgctttgatgtttgtttattagctttgcaacctcgacaggtatttatcctccattcctcagcggcttcgtgggttgttgtgagaatgaaatggcttgatacctgcaacaggattagaagtacttgtgagagtaaatgcctagtcagtagcagctattattgtggaattattcctagaagccgaagcactgagttgattggtatggactttccaaaggctcatcttactttgaatattt

SEQ ID NO: 855 - DNA, 20161 bp, Homo sapiens
aaattataagacatcaaagtgaccatctctgagattacagcccatattatatatgacgcataacagtcacattgtcttaattgaccaaaataaatagtaaaattttaaatttcagataggttgtgtatatataaattacatataaaaataaatctaaaatatattattttataataataaatttaagatacttaaatttataaatatttaaaataaatttaaaacatataaatttaaaattatttaaaataaaattaaaacatactatttaaaatatattatttaaattaaacaagtgttatcaggaaggaattcctcttatgagtttcagatttggctcagatcaaataaaaaggcaaacattactgggaaaattgccatttgtcaactgttccatgtcatatcatgtggtaatacagttctttaaacaccaaatgtcagaatactgacactatactgtacaaactaaaacaagtacaaaattgagcataaataacccaaaaatactggcagctgtgcatttgtaaacgagtggtgtttgtgatgactaatattttctttctgtggttataacacactgcgtttattttctataggacacccctggggaaagggggcagaaaacacatgagagacaagttatttttaaagttgacaacaacaaaaagattttaaatctttgcttaattaaaaaaggaatagtacaagtagatgactcacttctatctttaaaagctgaaaattaaaaattatgcaatatcctaaaagtataaagactgattcaaatgttacttcacataataatcttcaaatatatctcaaaactcacctatctagactatttgttcctataactgaattgtactttaagtgcaaaatataagcaaataaagagaagggcatttattccatcaaatagatccttatgttataatgataaaaccatgcttcccttttaactgatcaaaaagttaaagcatacatttttcaaatattcaaatcttacctttagagaaacattaacatgaattgtttcttcatccaactgtgattcaacattccctagccagtaaggtactaatttatgtacaaaagcagaggttctgtgtgttacattttattcagaaatatagatgacatttccttttactaggtagcttagagtgactagttcttgtcacaatgttgtcatagtgatagtgacatcaatgtacttcatggtaatcagtgcggcgatttatctgagaaaaataacagcaccgatttctagtgtattttacatttcaaaatgccatcaagtatactatttaatctactacaggtaaattggtttcttaagtagagcacccaggactttagatgaattgagggctatatgtatctgcgaaatgcggacaaaaacagtgtctgaatggatgatgggggtattggtgaacatagccaagagatcataattaactggttgctaaggaagattttgctctcaagtgcctttgccaaatacaaaatctcctcaagttatgagctcaatttaattattttgttaaatcctttttaatgttttttggactccaggagtgatagagtggtgatagtccagaattctggattctgtcctacagaacattgacaaaatgctttcagtcatcatctttcatgacaaaggactgttactgagacttcagatgttattcagtggtccaattacctctcgctctggtgctatgcaggttgccattacaataaacagtaagaatgacattagcagagcctctcagagatagaaagctccaatttttaggtcaccatcatatcaaaaattaaaaaaaaagtgttataatttttttaatatttaaatgtttttctataaactattctaacactaaactataatacaaaataattgagcttttcagacaaatgttttaagatttttgaaataataattaataatgaaccattgtgctaggccattattgcattgctataaagaaatacctgactgggtaatctataaataaaagaggcttaattggctcatggttctgcaggctttaccggaagtatggtgccaacatctgcctggctttgggggaggcctcaggaagcttaaaatcatggcggaaggtaaagggggtacagacacgtcacatggcaaaagcaggaacaagtgagagagagtatgggaaggaaggggccacacacttttaaatgaccagatctcatgtaaactcagagtaaaagctcccttatcaccaaggggatggcacaagccattcatgaggcattcgtcctcatgatccaacacctcccaccaggccccacctccaacagcaggtattacaattcaacatgaaattcaggtgggaacaaatattcaaactgcatcaatcatggattttggtcatattggtcccatgatgacatctggaagaaagttactccctgttctagtcttggaggcatatctctgacggcttgtgcagcctcattttgagaagaccattatgtcgttcatgaatgtgtgaatctggccagacatcaattccttatctgttaagataattttaactaattataattaaataaaggtgtatcagaggctgtctgggcaaagtaacattattttcataaatattttttgatttgtgttaaaactctcagtttgtagaagacaaaccacgagaatggcaacgtgactactttcaatgaactatttgcctcatttatcactctcactggttggactctgaaaagtagcattgctcctttgtcacccttgtaattttacttcaaaaataatgacttagatatgatcatatataatagtctgcattgaaaaggccatctttgagatgattaaaaaatcaatgtgtttattaagggctctattaagaaaggttttcatagagctgattttgattccatactgttaataaagaattttctttttgtacaggaaattttcacaagccacagatttgacatatgatgttttgagtatgtattttatgccacacagtcccagactgttttagtgtgagccatttgagacaaaagaggcagaagatggtgtggctattttggcttctaagcaccatctctttcttagttgatctgacactccagtacagcctgaatccctgccagtctctcacatttcctaagaactgatcctcctaccttaatgtttgttggggctgccactgaagcagaaagttgcaactgtttccaatagagttgagccagagatgaggttcattggcaaccattgctactctgctattacctacaactgctatgaaatctgagtccaggtctatttcagccagacaggagggttgcttccttatgttatcagagtccaagaagggacttctagagcataacgtataagaactactttctctatctgtcctttattaggaaaaaggacccgaccttccctgaatgccactaggccagggctagcttttcaaatcctaacaacctcagaaacaggtatctgatttttattttatatgcaagaaaacaaagttctaattgcaatgtgcccagcccaatgtcatacagaattagagaaggctgattaaaccatgtctaagtcagtacattattgtaactaaacaaaaagtagatgagtaaagctctgaagtcataaagaaaaatcactttttactctcctataatactgtgccatacaatgtgcagccatgtctgctttaaacagtacaactttgtgtggctatactcaagagagacatttgctattgccatacaggaggcatcaaggagttaatgatttttgcatagcaaaagagatcttgacctaggattctcaactcagagtgtgctttccttctactcaaaccaaaagacctactagacatccctctatgagcctagcaaaggattaagggttttttgttttgtgttttttgttttttcctactatttccaagttcataccagataactaaaaacagaggtagaatcctgactacaaattcatgcaactatgcttaaagtgagattgaaatggttattccttgttattaaaagatctaatacagagatttgaccatgtagtaaagaatattacgtgacttatataatatttttagcaaatttaaaaaattatcatgaaagaatggaaagttgaggtccagaccttaaataaatacctcccagccctagtagctttactacattgttagtaaggaggtattgagggtgaaaagcagcactaaatacatgttactaatagcacattatattttcatttatagaaatgtatttataaacatacttatactgtctaataaaatgtaatttttttgcatcatttgtgtttagtcattatcacttcttttacagtctcacttttaaaaggttaccatagatcagtgcttcccaaatacagattattttgccctcctggagacatttgcaatgtccagagacatttttcattgtcacgactgggtgaggtggaggggtgctgctggcgtctagtggctagaggccatgttgctgccaaacatcttccaatacataggacattatgaccctgacaacaaggaattatactgtctcaaatgcctcaaatatcaacagtgccaaagctggaaaacactgctatagacatacacacatacacacacacatacaggatacataaaactgaatgataatcagggccacattcattaactctaaagagcagattggatcatttgcatcttataaggatgttaatgtaacaaagcttaatcttaaacatggcatgcgacgcaccatcctagttttcagacaatgaaaactaggctacctcaaaaccagtaccagtgttgaacactgtttcttataggttatataagacatatatgggcatgtaatttattgaatcaaagtgaatatgtctggctgcaatgcatatataattgggaaagtaaccatccttcaattcagcaggccttgccagaaagtctaatcccaaaggatggactatttacattatgaacaagccatatctggagggctaaccgtcttgtgatgaacacgttttcagagccatccaaggaagccttcttggctttgtgaaacagcatatgcttgatttttctttttttttcttttttccaaacatgttaaggaaaaccgtcaccacccagaagagtagaggtcaaatctaagataatgtgtcatttctggtctatcataacagacactttatctctgttttctttagcttaaaaaaatgaaaaaaatgtttctgctgtgttttgtgtcttacttcccataactttttctcccagactatctgatcttacacttaggttaacatatattcaaataaaatatctctggtatactccataaaactcttcctgacaaataatgccagtagtaaatgaaggaattaataggcacacatattctagagaaaacatctccaatcgtgcttcctgctatgaaaaaaaaggctctccagcactggctaatatcatagcaactagtcatatgtgcctattgaggctttgaaatacagctagtcactaggatattaatttttaattttatttacaaattaattttcggttaatttaaaattttaaatgttttaattgtatttaattttgactagtagctactgtattgaagaacgcaatttagaataccaatgataaaaaaaaatgaggccagaagaaacagatacaatagatttgaacagaaggaaaaaaataaacactgagacaaaaaaagaatatttatgaaaagtcaatatcagtttaatcttcctttgacatttgggttacatgcccttattaaggtggaaatgtcatattatcaatttctgtttaaatgacatgacttttttttatttgaggacaattctaagcatttagaaaatttcagatttgggcagggcattcctgtaattgctttatagtaaaagaggataagttacatgttttatgagatataaagacttttttgatggtgggacacagcacattgatactaggatagataaaggcagaactctgctatttactgctcgaaccaagatgtgaatgccaggtagggccagataggaaattgtatgtaggaacagggtaatgacaatctatagctgtaggggcaagtaggatgggtttagctagttacatgggccccctgcaaatttgctggctaataagtttgcaggctctgggcataagggggtgtatattggtcccagagtataagagcctgataagttggggttggagtgtggatgtcattaacttctcagaagggggaactgactggcctctagccagagactcaaaactaggttaagatacctagttggaccccttgttgtcttgacattagtgacaaactcaattattaggggtattacagtggcccaaagagtaatggagacttttaaacagtagggtataagctcccctaagcagtgtacaaaaacatttagtgtaagagtagaaaggaaggaaacaagtagaaatataaggagtccttgcaggccatcctgttaccaagtttcccatgtatatagcaaaaaagtctgaaattttggggtctctaacagtatcttgttggagttattgtgttttcttttcactattattgtatattgaaagccccttaagccagagtaggctcagagacttccaataaagtatgtttgaattatgagttttattatgtttttgtggtaataataacagtgtatttctcgaatcaaggtggcaggtacagcagttttgttgttggagaatatgaactgaaagtttaataaggtgtatgtaaaggctagcagtatttgtaaccgaggggaggagtagttgtggtggtcatggtcagatcagcaaggcaggaagttgcagtggcaacctggaggatgcaggagggtaggagaagttttctgaggagtgagaggtccagtccaagtatggaccagtatgaggcaataacatacattaattttagaatggcacagagagtagcaacttcacaaggtttccttttaggaatgggagtatagataaagagcaaggaacatgccaggattctgcgctaagcaaacagtaagctcaggaaatgtagtataaaacctaatatcaaaagaaaaaattagtaataaatgtccagggttccatttgaaagaacgtcaggggaggtatcctgggagtgttgttgacgtggcggtcttggtgttgagatgaagttgtctttggcacaggggatgaagccatcgccaattctgtggtctcaggctgggttgacattgcctgaggtgatgtcatccccaacagtgaactcctaggacaggtcaacgtgatctggtctatgaaactagggttccatagtaggtactttcataagtagttacccacttgagttgttgtgggtcttgttcaccatattatggtaagactgagcctcttgagaaattttaaggcaaccttgcacctgggaatttgacttatacatatcttttaagacaaggttttatgagtacatagctaagaatggtgatattggcatttgtgatgttgttgtaattgaaccaaagccctgtaacctggctggcacaattaaggccttaagagtggctgaaccaaaaatcccccaatagtccaaggttttgtctggatgggtgatggggagggttttgctgcaaataggttttaaatgatatggccagatttgcatgcatgtggttaatagggtgtcacaattttgcctattaaaatacctgtggttgagcttggaggatcagcattagcctgtaggcaagccctccaatttagccaatgggccttttgcctcagttgctggtttggttgcagatgagcaaaccaggtgagtattttgtttgtagggcttctactcaccttgccaaactcaatggaatatggacctaagcatttgctgtggtcaaacaatggctaacttggagagtttgagcctctgggctgcaaaccaatggaagtatccagacctatagtagtgaaaccagtggttaacagaatggtgtgtagctgcacctgacaggactttgttatctgatgctgattttccaccaggacatattattgccagtgaggtgttgtctgcttttgtcattgtgagatatgacattgatttcactattacctttgaaagttacttttattttattcagtaagtgtggttttctgtctcttttcttggtagtccacactgtctatgggaatggccctggaaaaccaattttaatttttctacagagaatcagagggagagcctgaagtaatcatccacttcgtacaatgtaaatattaaagaaagtcaattggatggtggaaattttgactcagatgcttcccatagcacatgggtagtgttctggcctatgggacaatcaatggttaatgggtttcaaaggagtttctgattagatatggtgtattgcctttatggggtagaagcaaaatagaaaatctaaaaagataggaggagacattaataaggggccacatatataatgagtcttcataataatggaaatgagacatttccctccctttaaatatagcagagggtgataagaaagctttttttattttttaatttttttaattacactttaagttctgggatacatgtgctgaacatgcaggtttgttacatatgtatacacgtgccatggtggtttgctgcatccatcaacccgtcatctacattaggtatttctcctaatgttatccatcccctagcccccatcccccgacaggccccagtctgtagtttctctccctatgtccatgtgttctcattgttcaactcccacttataagtgagaacatgcagtgtttggttttctgttcctgtgttagtttgctgagaatgatggtttccagcttcatccatgtccctgcaaaggatatgaactcatccttttttatggctgcatagtattccatggtgtatatgtgccacattttctttatccagtctatcattgatgggcatttgggttggttccaagtctttgctattgtgaacagtgctgcaataaacatatgtgtgcatgtgtctttacagtagaatgatttagaatcctttgggtttatacccagtaatgggattgctaggtcaaatggccactgtcttccacaactgttgaactaatttacactcccaccaacagtgtaaaagcgttcctatttctctgcatcctctccaacatctgttgtttcctgactttttaatgattggcattgtagctggtgtaagatggtatctcattgtggttttgatttgcatttctctaatgaccagtgatgatgaactttttctcatatgtttttggccacataaatgtccttttgagaagtgtctgttcatatcctttgcccactttttgatggggttgtttgtctttttcttataaatttgtttaagttccttacagattgtggatattagccctttgtcagatggagagattataaaaattttctcccattctataggttgcctattcactctgatgatagcttcttctgctatgcagaagttctttagtttaattagatcccggttcctatacaccaataatagacaaacagagagccaaatcatgagtgaactcccattcacaattgctgcaaagagaataaaatgcctaggaagacaacttacaagggatgtgaaggacctcttcaaggagagcgacaaaacactgctcaaggaaataaaagaggacacaaacaaatggaaaaacattccatgctcatggataggaagaatcaatatcatgaaaatggccatactgcccaaagtaatatatagattcaatgctatttccatcaagctatcattgactttcttcacagaattagaaaaaactactttaaatctcatatggtaccaaaacagagcctgtatagccaagacaatcctaagcaaaaagaacaaagctggaggcatcgtgcaacctgacttcaaactatactacaatgctaccgtaaccaaaacagcatggtactggtaccaaaacagatatatagaccagtgaaacagaaaagagacctcagaaataacaccacacattgacaaccatctgatctttgaaaacctgacaaaaacaagcaatggggaaaggatcccctatgtaataaatggtgttggggaaactggctagccatatgtagaaaacttaaactggacccctcccttacaccttatataaaaattaactcaagatgaattaaagacttagacctaagacctaaaaccgtaaaaaccctagaagaaaacctaggcaataccattcaggacataggcatgggcaaagacttcatgagtaaaacaccaaaagaaggtttgtttaaagtgggtgtgagttggctgaggggccttgagttgagagatattaatgcctggcgcaggactgagatatccatttaggggttaattggttattttgcaacttaaatacaagttctttgaggagcccattaggcctcacagttaaaccagttttcttggacatatttgggatatgaaagttatattgaatgccttctttgagagcctggtgtgattctgagaaatgaaatgtgtgctttgattactaccactaatgtctggaactccaaggggaaaaaggagtgtcctagaaaagcttcatattacagccttagtatacagagagatatgtgcgatttttatttatattttggatatctgtgaagcaagggattcacagagttctttattctgaagggacaactcttaggcaatgaccaaataatttgcgaacatttgcttgtgaggcaatttgctgaccagggcatccagtgctaagatgactacctgaagtccggccaatcatgctgaccctggggttctgtccttttgtcaggaagtaaaacaacaaaatttcagtgagttctatcacttacaatggtgacagtgccatccatacagcctacaaactcccattgctgaacactcagttaatcccaaggggctcttcatatagccaacgggtttgagggaaaggtgacttcatttaacaccattgcatctgtcaaggaattgacagtggagaccaccccttccaggttaattatccagagggactaggttcggctccatattatattaaggaggcctcagtagcagtgctgagtttttgggatgctgcttttatgatccaaggcataatgggcaactggttatggagaatcacaggctcagggtctgcaagggcctctatttccaggaggttccagtatgtggccaacattttttgctctaatgctatatatagcacagggtcaggaaggtcagtttcttgttttaaaagtccatgggctacctatggccatcataggttgtccagagacttcaggaggcatgaaaggaggttgctaaatcttctatagtgaatctatcaagtgtctgtcattctttttttcctaaatcaatgattttaataacaaaaaatatacttctgagggaaaataactgagctcattggtctgcagtccttcaaacaaagaaatttgatttttagctgagagtaagtattaaagctgtcgagatcaatacaattcaatgactctccatttcaatgcaaagataaacctcgttcttgtttcctcttacgagggatattttactgagatgagaggccaaatttcatttttcagaagatagctttactttgatctttattttcttcctgtcaagctcatacacaatagcatgtcttgtgagagtttgtttcatagccaaccttttgccacagccagcatgttcacacataaatgggtgcttctccttatgaaaagaaagaagacagctctggagattaaatacagttcttctgcagtcttctcttggatgttgacatacatctctttctgaggcatgagttttcacaggttatctgagataatcttcacatttgaatgttttctggcatacatcatgttatttcctttctatggatttctctctgtccatgtttctgccacaaaagaacatccctattgacatataattttctgatgaacctgcatctgtcctcccagcctggagggtgaaacaaagtgttttccacatccttcaaggttaaacttgaataggggtttattttcatgctggcactgatggattttcagctgctgatgcttcttaaaggtcttcttacatccttcaaaattgcatacatattgcttttgcagattttcatgtttgcatgcaaaatgtttcttccagttggattttctgtgggattcttttttttttttttatcacagccactagctgcacaaataaaaggcttttctccaatgtgaatcaggatgtggcgattcagaaggtagctcctgatgaaggctttgacacaccctttatagtcacaggcctctgcaggatcagctaaatttaagttggaaagaatttagagccttttatttgagtgatccccaattaaggtgagcttatttggaaacagcagtatcagagacattaagtagaatttgtaaatgggaatatattgcctccagaatgaaaaaaagaactaaaagatgttgaaagtttatgtttataatgagtatgtcaaataaaactccttaggggaagatgttatcaacttaatatcaaacctgtgctgctggagaaaggtgggtgcagttaagctcttgtctgcaaagattgcatgcaatggcaacactgttgaggtgccctataaggcgaactaggaaaagcatacttttttccttggagataaaggcaaaatacagtcaagaggccattgaaatagccaccaaagttaaatattagcaaaatctataatagcaaagtatttactggttattagttaaatgatgtaattttaataatttaggtattacgcatgaggatcacaacagatgaaaccgcagcattgtaataaaccaccctgaggcgtctgtctttatttattttttttgaggtttgcaaatattagttaaattttatacaaataagtttgaattcctgaaggtccttttaaaatttacattggaacatcttaactgttttagtaagggggcccacagggtcttgtttctcaggcttatttttcagtgccaaaaactttatttaattttaatgcattgctcattgtatcagaacacatatgctccaaatggaatttagaaaaccctataagtaaagtaaagaatacctattttttctctatttaaaatttttttaagtttttgtttgtttgtttgtttgtttaagagatggcggtctcattatgttgccaaggctggcgtgcagtggctattcacaggtgcaatcatagctcactacaaccgtgatcctcctcagcctcctgattaattgggactacaggcatgtactactggaccaggctctattttatatttagttactctcccaagaatatcggaagtattatgtttaaatttagcaagatccctgagtaaaactctaagttgagacccagtctgattaagtctgtaaagctttgtcgtttggtgtattttagcagatcttaaagttaagttagaacctatcttttacagacagaaaagcccaatcagtacacatttcatattagtgttataaaaaatattttagcagatttttggatttctaattaggttaatttatgtacaaatttttttgtgtgtatacgtatatatacagagttatataagtaaataaatatgtgtatatatacacatactatttatttttaaatttcttctcctatatcaaagttttctctttattccattatttctcctctgttttgggcttctagcctcctgaagtcatggtttttagtttccatctgtatctaatagttcataattcaaacctgggtggttacaggaaaggagttggggaagcggcccagtggtctgccttgtaggcagccattcttcatcctaaggcttcccagtctacctgtgaaagaatgggatttcacttgagagctgcagtcacctgtccttgggacaggcaataagttcctttaagttttttccctttgcatgttgacctgcaggggcacttactaaagcccaatcacactggctaggggccttgcatcatttaagcaactgggtaacttttgcaggtgttcagaagggggttgctggggtgagatatttgtttccttgccacagacagcctctctgggttaaacattgaatggctggtatccaacggggcagcccatgatattcctgaggatctggggaacttgaagttccctaaaaacagcaacaaaatatgcagcaaagaaggcaggtcgacggctacccgaccagagcaacactgactatgagacaggggtgccatttctttaccatgggggaccccagccaacatcttttttcacaaaggttgcctgaaacacatggacaaatcatcattctgccctaattaatgattatacaataaaaagtatccgaaacaagtctcaatcaatttagaagtttattttgccaaggttaagggcatgcctgtgacacagcatcaggaagtcctgacaacatatgcagggcagttgtgctacagcttggttttaaacattttagggagacagaagaaatcaatcaatacatgtaagatgtacattagtttggtctggaaaggtgggacaacttgaagtggtgggggcttccaggtcataggtagattcaaagattttctgattggcaattggttgaaagagtttatctaaagatctggagtagaagaaagtgactgcattaagataagggtttgttgagatcaaggttcctattgcgcaggtaaagtcatcaggtagcaggcttcagagagaatagattgaaaatgtttccgatcagactgaaagagtctgttctatcagtcatagggtctctgttttaatgtcaatgctggtcagttgtgcctgaatttcaaagggaggagagtataatgaggcatgtccagcccttacttcccatcgtggccctgaactagtgtttcaggttaactttggaatgctgttggccatggagatggtctgtcagtcagttagtgggcttagaattttatttctggtatatgtaataaaaaaggaaacaaagaggtaagggcatctggggtcagcctctgttgaacacagtgactagaaagaggatagaatgcccaacgccagaaagtgcagttttagcggcccatcactcccatatccatggggtgggcccccaccaaggcttttattgagcctccagagtttaatctgttagcactgttcattagaatattctgagcgatgtggggatacatggcaaacacagacagacacagcagcaggcaacagggctaaagcacaagctccagttctgtccaagtcactctcatagaggtctggaaccaattagtaagccaagagcagcctcttgaaaagctatccaagagtcagcagtcacggccatgctatctgctcacagtgcaaattgttttataagatttaaggattattttgatggaaggatacaacacactgtcactcaaatacatgaaaggcagaatttcttattactttcagctattaataagagaaggctgccaggcagggccatatagggaattgcactcagggacagggtagcagcaaaagagagctgtaggaggcagctatttagggtatccatggcaagcaaggtggggttagctaggtttctcagactgccttctggttggttataatgctgtgcctaattgtctgggatttggcctggggcaattagggcttgtgcataatgacccacagtatgagaacctgattaaggaagtggttggagtgtggaagaaatcaggctccgagaaagggcaattgaccagtctctaaccagaacctcaaaattgactaaagatattaaaaaattaaaaatcccaaaccaaaaactatatgtctacattataccacaggtaaaacaggattatgaattaatagtggtaataatttttaattttttaaattcattttgaaaagtcttattctaaaatgattgaattaggaaagttacctacatattttaaatttccattcctgagacaggaagaaaaaaagtgtttgtcttttccatttctaaattcccaagaaactacagacataaattactagctaaaacaacagcataagcccaaacaaaaagcatctcagaaaaaagaacaggtatttatgctttctttgttctgttgatgactctcaaaagttgcatatatagcaaatatgataaattaatatacttatctataatttctatctcttatattgaataaatgatagtgacagttacaataaattctatgccttttcacaagtatattgcacaaatttaaggaaaataagtgggtttactgaagtacaagtgatataaaataagctgtctatatttaaagtaacaaattttatactttttaaccaaatatatcagtatacatctctacatagttacacataaaaaatagagtaggtaaatagatgatagatagataaatagatagataagtttgctagggttgccataacaaagttccacaacctgagttaaacaacagaaatttattttctcatcattctagaggttaaaagtttaaggcattagcagggttggtttctcctgagacattctctttaggttgtaaatagccaccttgttctccccgtgctcttccctctgtatttactgagtcataatctcttcttcttataaggacaccagttatatgggattagggcctactcatttaatcacatttctaaagaccccatctccaattaccatcccattctgaagtggtgctaggggttaagacttcaacatatgaattttggagggatgcaattcagcacacacacacacacacacacacacacacacacacacacacacacacgattgaccctgtttgcggatgacatgatctttcacccaggaaaccctatcatcttagcccaaatcttcttaagctgataagcaacttcagcaaagtctcaggatacaaaatcaatgtgtaaaaaaattgctagcattcctatacaccaacagtcaagctaagggccaaatcaccaacaaactcacattcacaattaccacaaaaagaataaaatacctaggaatacagctaactagggaggtgaaagatctctacgaggagaactacaaaccactgctcaaataaatgagagaggacacaaacaaatgaaaacatattacatgctcaaggataaaaagaatccatatcgttaaaatgaccatactgcccaaagtaacttatagattcaatgttatttccattatattgacatttttcacagaactagaaaaaactattttaaaattcatatggaacaaaaaagagcccaaatagccaaggcaatcctaagcaaaaagagcaaagctggaggcatcacgttacctgacttcaaactatactacaggtctacagtaaccaaaacagcatggtactcatacaagaacagacacatagaccaatggaacagaatagagaacctagaaatatgaccatacacctatctgatgttcaacaaacctaacgaaaacaagcaacggggaaaggattccctattcaataaatggtgctgggacaactggctagccatatgcagaagattgaaactggaccccttccttactccacatacaaaaattaacacaagagggattcaatacttaaatgtaacccatgactataaaaaccctggaagaagacaacacaggcaataccattgaggacacaggcttgggcaaagatttcatgacaaagaagccaaaagcaatggcaacagaagcaaacattgacaaatgggttctaattaaactaaagagtttctgcacagcaaatgaaactataaatggagtaaatagatgacctacagaatggaggaacatttttgcaaactgtacatctgacaaaggtctaatatacaggatctaaaaggaacttaaacaaatttataaggaaaaatcccaaccccataaaaatgtgggcagatgacatgaacagacactttccaaaagaagacatacatgaggccaacaaccatataaaaaaagctcaacatcactgatcattagagaaatgcaaatcaaaaccacaatgaaataccatctaacaccagtcagaatggcaactacagaaaagtcaaaaaataaaagatgctggcaaggttgtggaggaaaaggaacacttatatcctgttggtggaagtatgaattagttcagcctttgtggaagacagtatggtgattcctaagagagaaataccattcaacccagcaatcccattactagatatatactcaaaggaatataaatcattatattataaagacacaggcattcatatgttcattgcagcactatttacaatagcaaagacatggacttaacctaaatgtccatcaatggtagactggataaagaaaatgtggtacatatactccatggaatactctgcagccacaagaaagaacaagatcatgtcctttgcaggggcatggatggagctggaggccatatccctagcaaactaatacaagaacagaaaaccaaataccacatgctcacttataagtgggagctaaataatgagaacaaatagacacatagaggggaacaacacacactgtgggctaggaggagggacacaatcaagaaaaacaactaatgggtactaggcctaaaacctgggtgatgaaacaaacccctatgacaaagttaacctatgcaacaaacctgcacatgtacctctgaacttaaaatttttaaaaaaagtttttaataaatgacttcaaattccactttttaaaactagaaaaataagagatgcaaagtcgaagtaaatgaaaaaaaaataaagatcagagcacaaattgatgaagtacaaagcagaaaggaatacacgaaattaataaacctaaaatcatgttctgtgagattgtcaatatcactggtaaatctctagcaagactgaaaagaaaaaaatatacagaagacacaaattcccaatatcaagaatgagaaatgctgtatcagtaaaattcttgaaaaattaaaaaataagagaatattatgaatatatatatgcctatatattcaataagttaggttgcaggatacattagcatacaaatattttatttcatttctatatactaataataaacaattagaaattaaaattttcagtagcatcaaaaatatgaaattctagacacaaataatgaagacgagaaattttgggaagtggaaacaaacaaaaaaaaactattttgaagttctttccaagtctttcatgtctcaatcagcattgtctttttcctatacttaaaggaaaggcatttagtcttttgctattaagcataatgttagctttaggtttttcaatgatgctgttacttaggttaaggagcttcccttatacaggtatccctagttttaagaagatttttattagtaatggaatttaaattgttttcaaaaaaattttttattcccatacgagtttgtgtttagttaatattggtgtattacattaattggtttcaaataccaaccttgcattcctgggataaacctatttgatcatgatgtatgatcttctttatattgtaagatttgatttgtttataatatgtatatctatattcatgaagtgatattgttagattgttttcttgtgatgattttgtctgggcttggtttgcatcaaaattgtactgcaggttctttccagtgctataaggcaatcaatacataataggcatccagaaggataaagaataaataaaactgtctttatccacagacaatatgatcctgaaaacttactaacctcacttatttgtctaatagcttttttgtggattctataggattttctgcataacaatgtgagaatgaactccacatcaggaaatttatgcaatcattcttgataaaaatattccataaatgaagaatagatagaagcatcttatatatcctatggatgacaatttgataaaatgtacaaaagttataattcaaatacctctaatctaggcatcccactgtggaacattta

SEQ ID NO: 856 - DNA, 85419 bp, Homo sapiens
tacctccaccactacaatgaaaccagtgacttctaacagtcattgatgattgtaactttacaatcatcatcatacttaatggccactctccttcagcatctttacatctttctcttttatggtttctcctttaaatttttacattctctaagactaatttttagcccttttctcttctctttctatacaattcctctatgtacttttatccgtatctatggatacttcagttactctccatatggtaagaacacacaaatctgtttctccagcctttgcaatctcttgtgatgttccaggatcctatatccaactgccttctagacatctcacacttgccaatgatatgccctgcgagcatgttaaacacaggtccaaagttgaactcattctcttctccctcataccttcttcctcttctcttttcccactcacaacccagaaacctaggaagcattctaacattctccctctcccatatcttttacattcaaacagtcacaaagaccagcaaattctccctcatcttacttttcctaaacattctcacttctctattcccactacttccacctttatctaagctttcaacctctcttatccctactgatgtactgtccttgaaagcttccagtcttgccatgaccccacacccaaccccactctaccctcaatctacccagcacactgctttcagtgatcttccatgacactcacaattcttcagtggctcactactacacatggtataagaagtgtaccctgaactggctatccagtttcatctaggaagtgtaccctgaactggctaaccagtttcatctcctttcactcctgaccttgtccttcacactctaatataactgacctacatatagttcccagtatacactatgttctcgtaatgccacacaactactcatgctgttagctttacctagaaatgctttctattgcttgtcaacatgcccactcctactcagttttcaagtctcagctcaaacacaaccactactaaaacccttacctggtattgcaggcagagatcaagagctcttgctagatttcatttgtacttgtacctacctctgttatagcaaatagcatacagtatttgaactattggtcaagatatctgtagtcctacagactataagatccttggtcaaagatgacttttcatctttatatcctcctaactagttcaattcacacagtcactagttccatgtacattactagctcaatgcagatagatatactaaaaaaaggaggggcgaggttaatgaataaggtacgagtcaatgaaagaacaagaaaatcaactggactttgagtatagaaaaaaaaacaccagatcttaagaacgtacagacatctttagtacagacatctgttactgtagtacagatatccattactaagtcctaaccattaaaaaaaatagaaaaatatggttattcaggtagtatgaagatgacaaagaaaaaaacttattattggactaagtagacattaagaaggtaagagtttccagcggaacagttgacaaagatcaacagagaagccagagaaaaagatggttctttctaggaaacaagtaattcattgatctaaattcatggactgagcaaaagactgccacctttctctcagttcacaacccctctcctttgtcattattctgcatgaccccttctgagtcctcactaccaaatccccaataccatgggtagttcccctccaatggagccacaggtccaggccagtgacttaatctggatgcaagggcaagggatagaagggtatctttgttcttgtgtctaggactttgaggaaaaatgaaacaactatttactgagaatttattttacggcagattctgtgccacattacactcactcactgaatttcacagtaatcataagtaattatcccatttatagatgaggaatttgtgtccaaggtcaacagttaagcaataacaggccctgcctgaaaacctaagaatgacaacctccagagctttttctatacccctcactacctcaaaatggagggagacgtggtccagccattctaggttggcactcaggagacacttacctccaaaacactattatatatgttgattagagtctacagtaccactaatatataataagcacacaatgagtttaaaaagctttccttagtacctttaggaaagtaagtactagatttcctggggttctgatctggaaatctaaatgctatttattcctataagtacattgttaactttacaaacaacagacttgaaaatgaacttgtggaatacaatgggttcttaagtaaggcttttctttaagaatattttcttgcttccacaaaaaatacaaaagccaccaaagatagaatgattttgccttgttaacttgtaagaacaatgacactagaagaaacctatgggaaatgtgcttatctgaccaggtgctcattttcggtgggctgtcatttgactaaaacatcatactaaaccctacagaccacagcttatgagagaaatgccacaaactatagcagtacagttaatatgcctataatctactgacaaaacatactcctcagtaaagtgaaaccagatgtctggtgtgaaatcagatgtctgtgaacttgtctttctcagtttccagagcagtatcagatatactaaatacacagctaagctgtatattaaatccacaacttggcaaaatcatgacagtttggacatgaagcatcagcatttttattgtaatccttataaaccaaagacatttccaaaatggaaatcctaagtttaagtactcagctaaatacagtaatatgtctttctcactttaagaatagtgtcagggctttttaaacacattatagaaattctttcccttcatttttcaagctgacactctttatccaaggctgtggaatgatctgataaggccacatcaggtgtcagtcctcgtcccagaaattctaggatcagatacaccaggtgaacccctgtgaaaagcaaatcccagggaggcttaacagctataggaaagttaggcactacatggctttccacaatcaaaaggaagatcataggaaagtaatgggtgaccacatagaaaaacagggagggaaatttaaaagtaagtacttctatgccaggcactgttttttcacacattcttttatatatactctttgttctgttttgatggataagaaatcaagcagcagagaaattttaatggcccaaagtgacacagctaataaaataagagccagaaatcaagctcatgtccaaaagactgtaaaagtcatgctacttctacatgaagttgtggggtggagtgaggaggggtggtaaatagccaagaagaaggagaaaaagaaagaaatttacaattttatcaaataacagtgaaatatatatatataaaacatgtattatgttccacatatgttccatatataatacgcagttaagatgtatacatgtttaacatatacttaagctgcatatttagtatgtgtatatatggaacaaaaagttgaagaaacaagtatcaaattgttaagtggtcatctgaaagtggactcataggaaactcacttattgccttttataccctcccagatttaattctaaataacttttttttgactttttattactcttataaccagaaaaagacaaagaactattctagcttagatcttttaaatgaggctaaatgcacagaaacccatgcaagttaaaaatggtctactttcgaatttatttttctaagtacatcatcctttacactctccatgattcctaatattaggtccttcttatggaacaactacaaaagttatcctcatctaattattatactcgtacactggaaaatgactataacattattcattataggaaacaaatcatcaaggtcagccatccttgtaagtttattactgaaagtactagaaaggcggaataataattctgttctcccacaacactgtatagacctgcaaaccactatgatcagtagtacagggaaagtcttgtaaattaacatgtaactattgagaaaatccacaaaactggtgaaaggcctaccccaaaacagccatctccaatacaatctcatcattctcaccatcctacttttatcaaagtgctgataaaagtgcgtagcacatggtaagagagaattagctattgaatcaatgaaggaacccattatcaataaacaatcacttcctgttttccataaattatgtggtcacctatcacttgagcacaaacaaataggcacgttcaggacacaggcagccagtatcagaataggcagcctatcacagagggcaattctacttttcctgtgtaagaatccaagaatgcagttttactacattcctgcttgtagctaatctgaatttcaactaatttaaaacggttatttatatgtgacatataggatgcataatgagctcccaaccttgtgagaggagctgtgtttcatttcaccatacaggggagagggaagcagtgtattaaagaagtgatagaaaagtcccacagaagaaccaatgaaatagaccacactgaaaatcacagtaagcctcagagaacttcagtgtcctttttggcaacttttcaaaagtgaatggaatgcttgccaggaggtaccaagagtgaaagcccagagaaaaaggcccagcctggtcatctctctcccctcaaaacatcttcttctgtaagcttgagagatcccaaagaacttcaacacttgtaatcttgttactaactttatgctttggggtcctaaaggattttttcaggagtacccttttaaaatgtaaacatccctaggggggttactgttcattatcaaacaggacctggattctttagtgctatggtctcagggattagtcaaagctggctaataagataggggccggagacagacaactagagaggaccaatgttccaaggtaaaaacaggtaaaggggaagtgcagttttctgtcgggtcaaggggctaaaagggatccacatgcccaagctgttaaactctatagactgtgtgaggctgaaaacagtccggggcctggagcctgtgactttgaaggtgggtcctccagttcccgatgaaaaggtagaatctgggcccaagttccccacgagcagttctggacatctagcccttctctctctcgctcgctctcaggataaagtcctaggtccttccacccctgaccattccttacttaccctttctcccgctcttcctcggtgagaaggggtaagtggttattttgtgccctcgcccaatttggccaaaaccctaaaagtaaaaaacgacagacagacacgtgctttaaaatcatgttgttcaagcctgacgctctcccaccacctgcccaacacttccaggcagaaggcagcgcgcccccacagcgctccctcacggccagagccgggggccggactaggcccctttgtgaggactgggagagggcgcgttgttggggcgccggctcggcggggaggagcgggccagctccgggccaggtgtgccgcctgtggcgccggtttctcaacctagttagccagtggcaccaagaagaggactaggctggggtggccgccgcacgcgcctcagataaacacgcgcacgcacacatgctcgcgatcacgcaggactcgcggccgcgcacccctccgcctcccggcaacgcccgccccgccggggccggggccgactcccagggaagggtccccagcccaagagaccaccaagggtcggcggctacgcgcccgccgacccctgccagcctcacagccccccacccgccgccggacgccgggcgcccgccctccgcacccgctgcgcagctcagcccgggggaagtccccgcgcagaccccgccctccgccggcggcaagctccgccccgctgccccgtcgcgcgctggccgcccgaagctccgcccccggcggaaaactggtctctggaccgcccgcccaggtcgggctcaaaatgcggcgtggatctgaaaggatcaaacacaacactaattcagcaagctattattgagcacttgccctaagctcagcaacgtactaatgggggagactacaataaagagccgaaaagtctatgaaactgtgtcttcagctcttcctcttgttttagaagccaggaaacagagaaccctcacagttacttaagtacagggcagtagtggcaaagcacctcactagcgatctctgggcaactcttcatttcattttttcctactcatgagcactcaggaaaactattcagttttgctgcctccaggtaaaacaaagtgagtaacacaggacaggcggtttacttgagagaaacgggaatttcatactgaagcttttgccctcaaatggtacaaactctttttttttttttcctgagacggagtctcgctctgtcgccagagcgacactgcaatctccgcctcccgggttcacgccattctcctgcctcagcctccctagtagccgggactacaggcccccgccaccatgcccggctaatcttcttgtatttttagtagagatgggatttcaccgtgttagcaaagatggtctccatctcctgacctcgtgatccgctcacctaggcctcccaaagtgctaggattacaggcgtgagccactgcgcccggccgaatggtacaaactcttaactgggttattacaacctacaaagaaaccttcttatccatgttattaattatcctaattcaatgtggtttaaaatgttgatgaaagtacccaaatcatggtgctccaacaagctggatgccaaccaggtactcgtaagtacttgcaattacaggtgcgatattttcattccatatcatcccaagatgcccttccttcacgtgaagcagccagaaagatcaactaccagattccgcatgattgaggaattgataaatagaaagggaagaccgaaaccggccaaattttcccttcgaagtgaaacttgagaaacttgcgtgcattttacctgagttcctttctcagcagataaactgtcagacctcccagatagtgtcaaggaaatgcaactttccagaacactacatctggacaatgaggtgcatctgctgcctgttcacaaactcctcttccttacccctccataattccctgctatagaaagccctaactttagtctccctaagacatgtttgagactggtctccctgccagcatcacctgcattaaagcctgtcttccctggcaatactcgttgtctcagggactggttttctttgctaggagcaacccaacctaggctgaagcccaggcatttagcagcagtggcacctagaaatactgaacagacataaaatactttttttctccttttcttactcctccagttgtatcttcattatttctgtctctattctccctctagatactgccaaactactctgtgcactttcagatcacttaatactaatgtaaataacagacattctggcactcttggttcaaaatttattctaaaggtttaagaatctactcagggtcttaaatagcctgataactaaaattccaagagtttcctaaagagagcaaaattgctctcctgtgaaggggatatgtcccagtttttcttacttgtcactgaaataattactgcaaagtaagctcttttcggccagtgcttaaggacttaatttcaagagcacttaggtgacaggaccaccctcatcaaatagcagtcaagaactatttggtaccatgaccccaaattgaatggagctcctggtcactaggaactgacagtctgggatggaatgtaggtgaataaacaacaaagacaggtgtttatggcctttattgtattgggaagtcaataaacatacaaaaagagttgctaggtctggcctgattttatcactaagattcatcaagtgtacttaaaaagaagctaatatctggaaagggcagaactatggtatattagtcagggtttcctagagggacagaaccaataggatagacatataaatataaagaggagtttattaagtattaacttacatgatgacaaagtcccacaataggctgtctgcaagcttgaggagcaagagagccagtccgagtctcaaaattgaagaactttgaatccgatgtttgagggcagtaagcgtccagcacaggagaaagctgtaggctgagagactaggccagtctctccttttcatgtttttctgcctgctttatattcactggcagcttattagatggtgcccacccaattaaaggtgggtctgcctttcccagcccactgactcaaatgttaatctccttggcaacaccctcatagacacacccaggatcaatactttctatccttcaatacattcaagctgacactcagtattaaccatcacatatggagacagtaaaaagatcagtgattgccagaggtcacagaggagggggatatgaagcacagatttttagggcagtgaaactattctgtatgatatgataatggtgatgcatgtcattatacatttgtccaaacccataaaatatacaacccaaagagggagccttaatataaaatctcaactttgggtgataatgatgtcaatgtaagttcatcaattgtaacaaatatactgctctggtacaggatattcatagtcagggaggctgtgcagatgtggggtacaggaatatataggaaccctatacttcctgctcaattttgctctgaacctgaaactgatctttgggagaaaaaagtttatgagaaaaagaagcagcagttagagcatcctattttattctaatttatcaattaaattctaagctgaatatttggctttatgtatctagttcaaatatatttgccttgtctccttatatattaaagcagacctctatttgttgttaataccatcaggggaaaatgaatcataaagtcctaactaaggtacaaatttaaactatagttaggcatcaaatctaatggtcaaagagatatttaaacaaagttaaaataattaagtttacagattccacaaatatagatattaaaatatattcctatctatacatacttaccattggtaagcaaataatagaaggtatcatagagtagcagttctcaaactactttttgatctcaagttctctttacattcttaaaaatgattgagaactttaaagagctgttgtttatgtgggttatatatgtccatatttactgtattaaaatttaagatagaaaaatgttagacatgtgtttgcttaatttaaacccattacatgttactgtaaaagttatttttataaataatgactactttttttccaaaaaattagagaaaagtggcatttttaacattttataaatctcttattatctggcttaaggagagcactggattctcatattctgcctctgcattcaggctgttgtgatatgttgttatacctaagatatgaagaaaattaactgtcatacgaattcatagttgaaaaagagaggaccttacaaagctccgggaagggtttcagtaacccctaggtgttctcaaacctcacttggagaattactgccaaatggccttttgcatttcatttgtttgaatgtcatatatttccacacaggcttctgttaacacctgaaattatagccctttacttatttcaagctaaaactcatatttgtcagctcatatcaaaccatgacatttcaataaagtttttaaaagcttttactatagcaactctgatgaaattgatattattatttgaattgatatgaaaacacttgagatttcatttatatccttcatctcaaacgttttggaaaattttgaatataaattgtaccatctggaaaaaatgtaagattggtatatagttattaatccaattttaggtatgcttataacaaggtatatccccttttataaaaataatttaaaagcgagcttaaaacaaaaacaaaacaagcaattacagttttatttatgaactaaatacttgattctaaacttactaccttggaataaaattttaaatatataacctttcatttttattacaaataaaaataatgtaaatcatccagtttggggttttttaatacaatttccaactaaaagaaactagagctgaccaaccaaatgtctgacttcagatctgggtcaggttatacacaagatgagcataggataacttgtcccacaaagccgggaatccattaacaacaaaatgtgtcaaagggacacagaaaccaatatcaaatagctcctttggccaaagatggacaatttaagcatcaaaaaaagtaatggatgcagttgttagaaacatactgaatatataaaaattcatgagttcttaatgatgttccaaaaaggggaggtcaataaaaggaaaaaaaaaatccactggacactattgcaagtagctagcattaagcccttattctaaaattgtccattaaaagaaaataattcaaattttctgatgtatctttcctgattaaactatatatcagaaaaccaaattggtgttgagggaaagttgttttttataataaatatgaaacaacagaattggaaacccaccatttagcaatcttgcatttaataaatgattcaggcaaccatcatcaatggatcaaaccaacagatgaaatgttcatgaggaacttcacaatggagatcagaccgtcactacctcagcctaataatctgtcattacaagtgggactccagacattgtgtgcttcctgatctaatgccatctgaagcactcagcacaactatgaaatgttatcacccaaaaaacatgaatgggatctaatcaagccttaaaactgacttctcacttacaggcttacaaaaaacatgagggttacaggaataagttaaatgacaccacaaagaggctgggcgcagtggctcgcacctataatcccagcactttgggaggtcgaggaaggtggatcacttggggccaggagttcaagaccaccctgggtaacatggtgaaaccctgtctctactaaaaataaacaatgagccaggcatggtggtgcgtgcctataatcccagctactcaggaggctgaggcaggagaatcgcttgaacccgggaagcggaggttacagtgagccaagatggcaccactgcactccagcctggatgacagggtgagaccctgtctcaaaaaaaaagaaaaaaagatgccacaaagaaggaaacaggtaaatctagaatggagtagaatggaggacactctctaggacaattgatgtagtctctacaacaagttaataactggacacacaggagagggaatgggtcaggagaagcctaggttaaaaaaaatacagccatgaaatgtaagatgtgaacctttatttggatcctgattgaaacatcacaactataaagacttgtaagacaatcacggacatttaactatggactggtgttagatgataccaaagaaatattattttattaggtgtaataatggcattgtgattatgtaagaaaatgtccataatttttggagaggcattctgaagtatgttgaagttaaatgacatactctctggaatttactttatacttcaacataaaaaaaaagaaggaagaaaaagagatagcataaataagaaaataaaatggataattattgaatctagatgatgaggggagttctttgtacttttccatggttttcgtatatgtatgaaattttgtataatgaatatttaaaaatataagtgacggccgtagctcagattttctagaaaacagtgcctgagacaagctcacatgttaaaattttcttgggggttgcagtactagaaaagcaataatgaaggaaaagggagaacagaggcagggacagagggaggaagatccatggtggtatgtttccaagctgattatagcatcccagtacatgcagttggttgcttagtcacacaggacatctcaagaaggctgtgtgaaaccactgggtaacaatcctccctcaggaggggaaaggttaaggcactttttttaactggatccttcctgccttctgtctctcattcatcaatgtttgttccataaagcagggcaagcatgtgggggaaaaaaggttgggggcagggaagtgaaaatgggttttatgaagtgactgagatttgtttaatctcacaatgtagaatttaaacaaatcagtgacttttgggtttagtgaagacttacctataattttagcctttttgaactagaataatcattctgcttgactttcttattacatcagtaaataatttattcaggtcaaagccattatttttgattaacagaaatcacagtcacataaatggctacagaaactaaatataggagaagggttctaccacagtgacctgaacatttgcatgcgcccttgcacatctccacaaaggccacatcagcaagacttgactgcagctgatctaagtcatggtggaattctgttgattctcctacaacatgagatcatgagaggcttgttaagagctgacccaaggccatttctcattcacctcccagtttctcattgcctcctgtgttttgaggaggtatgacactttctgcctcattctccctagaatacagcctcaggctgtaaaactgcttagctgaagcatgacattggttcctcaggaacagggtgccctatcatccaggttgtggtcatctggcctcctttgtatcagtgtcaccctgtgcaagggataccagagctggcatctttggctactcttgcttttgctttccaagtaagtaataaactgtctgaatctaaaaatggcaactcattgttttcttactagctgaatctatcacccttgccttaccttgacaaattctaggcaagaaatttttactttccttaatgctaaagaggtcctttactctttcctctttgtattttgctcagcctacaaagttagtagccagtaaacaaactgatatgaaaatatgaaagacttagattcacatttttagaaagagtaactgttctctaagtattttaggataatttttggccaacagttaaaggagccttccttctcctggccttgccttcaaattaattaataggctattcttacaaggcaggtcaagattcagtcctcttaaaaaataaagaccaatcagaaggattttcaacaaagtccctttattttctactcacacttaaacactatagttggtagggttcaaaaagtctgggaaagagggagacgaagcaagatggtgaaatacaaagctccacgaatcgttcccactaacccacaccaagttaacaactatctacatggaaaaaaacaccttcataagaacaagaaatcaggtgagcactcatagtaccttgctttaacttcatagtgctgaaagaggcaacaaagagagaaaaaatagtactgaattgccgatgccaccccctattcctccccgaccccaggagcagcatggtgtggagagtgtccttgggtgctgggggagtgagaacacagcaattgtgcggcgttgaactcggtgctgtcttgttagagcagaaaggaaaccccaaactcagctggtgtccacccacagagagaacatttaaactagccctagccagagggggacttgagtgcctgcaaacctcgccacccagggctacagctgtctgtctccaagtaaacttgaaaggcagtctaggccataaggactacaactcttaggcatatcctagtgctgaagtaggcccaggacagtggactggtggggcatgtgacatactgagacactggataggtagtcaaggaagtgctggcctcacccctctcctaacctcaggctgcacagtttgcagctccaaaagagacaccttcttccacttgaagagaagagagggaagaacaaggagaactttgtcctgcatctacggtacaagctcagccacaacaggatggggcaccagatagacttgcaaggctgcaaggcccctgttccaggccctagttcccagagaacatttctagacacaccctggaccagaagagaatggcttcaggtaacagcccagccacagtgggtagaaaatcaagcaagctctcgaggtccctgattctaggattttactcttgaacagcatttccggacctgtcctgggccagaggggtgtccactaccctgaagggtgagtcccaggccaggcagcattcatgacaagctgacttaagagctgttgggcattaagggaacatcagtggtagtctggcagtactcttcatggcccaggatggcagtggctatagggtaaggctcctctgcctttggaaaggggagggaagagtgggaaggacagcatcttgtggtttgtttaacagctcagccacaatacaatagaacaccaggtagacttctaaggtttttcactctagtctctgactcctagacaatggcacttctgtacccactggtgggctgggggaccttccctccctgaagggaaggacacaggcctggctggctttgccatctggtgatagtagagccccagggtcttcagcaaacataggcagtagccagggggtggttataggaggccttggtcaagtaccagtgctctgctggcttcaggtctaacccggcacggtcttagtggtggtggccacaggggtgtttgtgttactccatccctagctttaggtggcttggaacaaagacagaggctgtttgggagaaagtaagaagaaaggaacaagagtctctgccttgtaatctagagaattctcccagattttgtccaaggccatcaaagcagtactctgtgagtctgcaagaatcatagcattactgggtttggggtgctccctgaagtacatcacaacactcacgtccttgtagatcacaacacccaagtcctttcaaatatctggaaagccttcccaaagatggctataaataagcccagacagtgaagactatagtaaatatccactcttcaatgcccagacaccaaagatcatctactaggatcaacactattcaggaaaacatgacttcatcaaatgaactgaataatgcaccagggatcaatcctagagaaacagagataggttgaagaaactcaaaaacattcaagataacacagagaaggaattcagaataatatcagataaatttaagaaaaagattgaaataactaagaagaatcaagcagaaattctggaactaaaaaatgcaattggcagactaaagaatccatcagagtactttaatagcagaatttgtcggggaatttgccctgatattcacgtaggttcttttctatttttccgaagtgtcagccagtttgagaaataaagggacagagtacaaaagagagaaattgtaaagctgggcatccgggggagacatcacatgtcggtaggttctgtgatgccccacaagccacaaaaaccagcaagtattttttaaggattttcaaaaggggagggagtgtgcgaataggtatgggtgacagacatcaagtacttaacagggtaatagaatgtcccaaggcaagtggaggcagggcgagagcacaggaccacaggaccgaggtgaaattaaaattgctaatgaagtttcaggcaccattgtcattgatagcatcttatcaggagacagggttttgagatcaaccggtctgaccaaaatttattaggtgggaatttcatcttcctaataagcctgggagcgctatgggagactggagcttatttcatctctgcagtttcgaccataagagacaggcacaccttgcgggggctgtttataagcctaaaactccaggcgtgtattctctttctcagggatgttccatgctgagaaaaagaattcagcgatatttctcccatttgcttttgaaagaagagaaatatggctctgttctgcccggctcaccagcggtcagaatttaaggttatctctcttttttcctaaacattgctgttatcttgttcttttttcaaggtgcccagatttcatattgctcaaacacacatgctctacaatttgtgcagttaatgcaattattacatggtcctgaggtgacatacgtcctcctcagctgacaggatcaggggattaaagtaaagacaggcataggaaatcacaagggtattgattggggaagtgataagtgtccatgaaatctttgcaatttatttttagagattgcagtaaagacaggcataagaaattataaaagtattaatttggggaactaataaatgtccataaaatcttcacaatccacattcttctgccatggcttcagccggtccctccttttggggtccctgacttcccgcaacaagaattgatcaagcagaagaaagatttagggagcttgaagacaggctatttgaaaatacagccaaaggagaccaaagaaaaaagaaaaaccaatgaaacatgcctacaggatctagaaaatagcttcaaaagggcaactctaagagttgttgttcttaaagaggaggtagagaagggaatacaggtagaaagcttattcaaagggacaataacagagcccaaacctagataaagataacaacatccatgtacaagaaggtaatagaacactaagcagatttaacccaaagaagactacctcaaggaatttaataatcaaactcccaaaggtcaaggataaagaacaaatcctaaaagactggtggctttgcatggtggctcacatctctaatcccagcactttgggaggccaaggcaggcatatcacttgaggtcaggagttcgagatcagcctggccaatatggtgaaaccctgtgtctactaaaaaaaaaaaaaaattagccaggcgttgtggtgggcacctgtaatcccaggtacttgggaggctaaggcaagaagaatcacttaaaccgaggaagtggaggttgcagtgagccaagatcatgccactgctctccagcctgggtgacagagtaagactctatctcaaaacaaaacaaacacacacacacacacacacaaagcaagagaaaagaaacaaataacatatgacggagctccaatacatctggcagcagacttttcaatggaaaccttgcaggccaggagagagtggcatgacatatttagagtgctgaaggaaaaaaactttaaacctagaataatatattcagtgaaaatatccttcaaacatgaaggagaaataaagacttttctacacaaagaaaagctgagggatttcagcaataccagccctgtcctacaagacaagatgaaatgctaaagagactatttcaatcagaaaggaaagaacattaatgaacaataaataatcacctgaaaatacaaaactcactggtaacaataagtacagacacaaaaaaaaatgttgtaaaactgtaactgtggtatatgaactactcttaccctaagtagttgaagactaaacaatgaaccaatcaaaaataataactataacaacttttcaagacatagtaagtacaataagatataaatagaaacagcaaaaagttaataagtggggaaacaatgttaagtcatagagctttcattagttttctttttgtttgtttatgcaaatagtattaagttgttatcaggttaaacataatgggttataaaatagtattagcaagcctcatagtaacctcaagccaaaaagcatacaatgtatacacaaaagataaacagcaagaaatcatatcaccagagaaaatcaccttcaccagaatacaaataacacaagggcaggagtaagtctttacttatcaaaattaacattgtatgtaatagactaaactttccaatagaaaaacatagagtggccgaatggatgaaaaaacaagacgcattgatctgttgcctacaataaacacaactcagctacaaagacacacatagcctaaaaataaagagatggaaaaagatattctgtgacaatgaaaaccaagaaagaacaggagttgctgtactcatatcaggcaaaggatatttcaagacaaaacctagaagaaacaaaggtcagcatataatgataaaggggtcaattcagcaagaggacataacagttttaaatatatatgcacccaacagtggagcacccagattcataaaggaaatattattaccactaaagagagagatagaccccaaggcaataatagctggagacttttacaccccactttcagcagaaagacagatcttccagataaaaatcaacaaagaaacatcagattaatagacatttacagaccattccatccacgagctgcagatacacattcatttcctcagcacacggatcattctcaaagatagatcctatgttaggtcataaaacaaatattaaaacattcaaaaaattgaaataatatcaagcatcttctctgaccacaatggaataaaactagaaatcaataagaagaattttgaaaactatacaaatacatggaaattagaccatgtgctcctgaatgatgagcaggtcaatgaagaaattaagaagaaaattgaaaagtttcttgaaacaaatgataaaggaaatatgacataccaaaacccatgggacacagcaaaagcagtactaagagggaagtttatttatgttggtgcaaatgtaattgtggtttttgccattaaaagtaattaaaagtaatggcaaaaccacaattatgtttgcaccaacctaataactataagtgcttaaatcataaaacaggaaaacttcaaataagcaatctaaggatgcctcttaaagaactggaaaagcaaaagcaagccaaatccaaaattaggagaagaaaattagtagaagaaaagaaataataaagatcagagtagagataaataaaattgaaatgaaaaaaatacaaaagaccaatgaaataaaaagtaggttttttgaaaagattaacaaaatcgacaaacctttaaccaaactaagaaaaaaagagaaagaaatccaaataaataaaatcagaaatgaaaaaagagacattaaaactgatactacagaaattcaaaggcccattagtggctactatgagcaaccagatgccaatgaattggaaaatatagacaaaatgaacaaattgccagatacatacaacctaccaagactgaaccaggcagcaatccaaaacctgaacagaccaataacaagtaacaagattgaagccataataaaaagtctcccagtaaagaaaagactgagacgtgatggctacactactgaattctatcaaacttttaaataagaactaatgccaatcctactcaaactattctataaaatagaagaggagagaagacttccaacctcattctacaaggccaatattaccctgataccaaaagtagacaaagacacatttaaataaataaataaataagtaagtataagccaatatctgatgaatatcgatgaaaaaattctcaataaattccacgaccaagtggaatttattccagggttgcaaggatggttcaacatgtgcaaatcagccagtgtgatgcatcatatcaacagaatgaaggaaaaaaaccacatgatcatttcaattcatgttgagaaagcatctgataacattcaaaatccctttatgataaaaaccctcaaacaactggggatagaaggaacatgtctcatcataataatagctatatatgacagacccacagcaagcatcaaaatgaataaggaaaaactgaaagcctctcctctaaggtctggaacatgacaaaggtaccctctgtcaacagtgttattcaagttatactggaagtcctagatagaccaatcaaactagagaaagatgtaaaggacattcaaataggaaaggaggaagtcaaattatccttgtttacagatgatattatatttggaaaaacctaaagactccacaagaaaactattagaaatgatcaacaaattcagtgaagtttcaggatataaaatcaacatacaaaaatcagtagcatttctatatgccaacagtgaacaatgtgaaaaacaaatttaaaaagtaatcccatttacaataaccacacataaaattaaatacctgggaattaatttaaccaaagaagtgaaaaatctctataatgaaaatgataaaacaccaattgaagaaattgaagaggacaccaaaaaaatgaagaaatattccatatgcatggatttgaagaatcaatattgttaaaaggcccatactacccaaagaattacagattcaatgcaatccctgtcaaaatatcaatggcattcttcgcagaaatagaaaaaacaatcctaaaatttatatggaaccacaaaatacccaggttagccaaagctctcctgagcaaaaggaacaaaattggaggaatcacattacctgacttcaaattatgctacagagctatagtaaccaaaacagcatggtactggcataaaaacagacacagagaccaatggaacaaaatagagaacctagaaaaaaatccacacatctacagtgaactcgtttttgacaaaggtgccaagaacatacactgaggaaaagacagtctcttcaataaatagcactgggaaaactggatatttaaatacagaagaatgaaatttgacccctatctctcaccgtatacaaaaatcaaactgaaatggattaaagacttaaattgaagacctcaaactacgaaactactgcaagaagacagtggggaaaatcttcaggacattgggttgtgtaaaaatttcttgagccatactccacaagaacaggcagccaaagcaaacatgggcaaaagggatcacatcaagttaaaaagctcctgcacatcaaaggaaatcagcagagtgaagagacaacccacagaatgggaataaatatttgtgaactccccatttgacaagggattagtacccagaatatagaaggacctcaaacaactctataggagaaaaaaaaatctaataattcaatcaaaatatggaccaaagatgtgaatagacatttttctttattttttatttttttacttttttttaaaattatacttcaagttctagggtacatgtgcacaatgtgcaggtttgttacatatgtatacatgtgccatgttggtgtgctgcacccattaactcatcatttacattaggtatatctcttaatgctaaccctcccgactccccccacaccacgacaggccccagtgtgtgatgttccccttcctatgtccaagtgttctcattgttcaattcccacctatgagtgagaacaagcggtgtttggttttctgtccttgcgatagtttgctcagaatgatagtttccagcttcattcatgtccctacaaaggacatgaagtcatcattttttatggctgcatagtattccatggtgtatatgtgccacattttcttaatccagtctatcattgatggacatttgggttggttccaagtctttgctattgtgaatagtgccacaataaacatacgtgtgcatgtgtctttgtagcagtatgatttataatcctttgggtatatacccagtaatgggatggctgggtcaaatggtatttctagttctagatccttgaagaatcgccacactgtcttccacaatgattgaactggtttacagtcccatcaacagtgtaaaagtgttcctatttctccacatcctctccagcacctgttgtttcctgactttttaatgattgccattctaactggtgtgagatggtatatcattgtggttttgatttgcatttctctgatggccagtgatgatgagcattttttcatgtgtctgttggctgcataaatgtgaatagacatttttcaaaagaagacatacaaatagcaaacaggcatatgaaaaggtgctcaacataattaatcatcagagaaatggaaatcaaaactacaatgagatataatatcatcccagtcataatagcttacgtccaaaagacaggcaataagaaatgctggtgaggatatggagaaataggaatccttatacactgtttctaggaatgtaaattagtacaaccactgtggagaacaatttggaagttcctcaaaaaactaaaacttgagctactgtgtgattcagcaatcccactgctgggtatataccaaaaagaaagaaaagcaatacatcaaagagatctctgcactcctatgttggttgcagtactgtttataatagctaagatttggaagcaacttaagtgttcatcagcaagtaatggataaagaaaatgtggtacatataaacaatggaatactattcagtcataaaaaagaatggaatccagtcatttgcaacaatatggatggaagtggagatcatttgtgaagtgaaataagctaggcactgaaagacaaacatcacatgttctcacttatttgtagaatctaaaaatcaaaataattgatctcatggagatagggagtagaaggatggttaccagaggctgggaagtgtagtgggagggttgggggaggtggggatggttaatgggtaccaaaaacattagttagaaagaatgaataaggctgggtgtagtggctcacacctataatcccagcacttttggaggccaaggcgggcagatcacttgaggccaggagttcaagagcagcctggccatcatggcaaaaccctgtctctactaaaaatacaaaaattagccagggtggtggtgcacagctgtaatcccaggtactcaggaggctgaggcatgagaatcacttgaacccaggaggtggaggttgcagtgaactgagattgcatcactcactgtattccagcctggtgacagagggagactctgtctcaaaaaaaaataaaagaaaaagaaaaagagaaagtaccctaaaacttaaaatataataataataaaataaaaaataaaaataaaaaaagaaaaagagaaaagaaaaagaataagacctactatttgatagcacaacagagtgactcttaagtcaataataacaaacaattgtatattttaaagtaacttaaaaagtataattagattgtagctcaaaggataactacttgatgggatggatacaaaaagtttataggaataaataaagcaaattttgaactaacaaaaaaagataggaaaagctagaataaaaaagagaagcatcaaagatcaagctccatagacatgccctactcagattttcacaggtaggtgatctgcctctgtcttttatatacaagatgattgataatgatgttaaccaattacaactttgcctttcttatttggtacactgagaggcagggttcctctcttcttttataagcttataataaagtagaaaacagaaaaataagtgagggcaaaacataaaagctagtgaatatctcatctttttcatttctttatcacaacatatgtagattatctcttggtaatggaaatacataagccttgctaaatgactatcctagtaatagttgaccaaatccttagatccatgaatgaaggaagcagttatgtaggagacccgggcctgcctcacattttgtccagggatttcctggtactctacagtgggggtaaaaaaacgggggggactggttttgattgactttttattgataatcctgagatatctgaaagaattccttaaattatctaatgaattagccagataacaattacaaaccagcaatttatagtaactagtaatgggagaaacaattcaaaataaaaccacacatggtaaaaatttgttgaaataaaaaccaacccaagattcatatcttcatatcttcttaataactataaaaaccaaaaacactgagagagtagatttagctggaataataaacacaaaataatgaagcaatggctaagcctgcacatgatcaaaatatattattgactacagttaacaaattctattttcattcatctgagaatgtctttatttcccactgatttctgaagcaatatattttcatcagatagaattgacagttcttttctttcagtacttgaaaatgttttgttattaatacttccttttcgcctccagatgagaaatctgctctcactcaaattggtgtacccctctataagttatgtgctgtttccctctggatgctttcagtactttatttgtctttactattcaaaagtttaattgaaatgtcttggcatggatttctcctatttggggttcactccatctcctattgtgtccggaattggtgagttcttggtcttactgacttaaagaatgaagccgcggaccctcgcagtgagtgttacagctcttaaggtggcgcgtctggagtttgttccttctgatgttcggatgtgttcggagtttcttccttctggtgggttcatagtctcgctggctcagaagtgaagctgcagaccttcgcggtgagtgttacagctcttaaggcggcgcatctggagttgttccttcctcccggtgggctcctggtctcgctggcttcaggagagaagctgcagaccttcgcggtgagtgttacagctcataaaagcagtgtggacccaaagagtgagcagtagcaagatttattgcaaaaagcgaaagaacaaagtttccacagtgtggaaggggacctgagcgggttgccactgctggcttgggcagcctgcttttattctcttatctggccccacccacattctgctgattggtagagccgagtggtctgttttgacagggcactgattggtgcgtttacaatccctgagctagatacaaaggttctccacgtccccatcagattagttagatacagagtatccacacaaaagttctccaaggccccaccagagcagctagatacagagtgtcaattggtgcactcacaaaccctgagctagacacagagtgctgattggtgtgtttacaaaccttgagctagatacagaatgccaattgatgtatttacaatccctgagctagacataaaggttctccaaggccccaccagagcagctagatacggagtgtcgattggtgcactcacaaaccctgagctagacacagggtgctgattggtgtgtttacaaaccttgagctagatacagaatgccgattggtgtatttacaatccctgagctagacataaaggttctccaaggtcccaccagactcaggagcccagctggcttcacccagtggatctcccaccagggatgcaggtggagctgccagccagtcccgcgccatgcgcttgcactcttcggcccttgggtggtcgatgggactgtgtgctggggagcaggaggtggcgctcatcggggaggctggggctgcacaggagcccacggaggcaggggaaggctcaggcatggcgtgctgcagtcccgaggcctgccccgcgggaaggcagctaaggcccggcgagaaatcgagcgcagcgccggtgggctggcactgctgggggacccagtacaccctccgcagccgctggcccgggtgctaagtccctcattgccccgggccggcagggccggccggctgctccgagtgcgggacccgccaagcccacgcccacccgaaactccagctggcccgcaagtgccacatgcagccccggttcccgctcgtgcctctccctccacacctccctgcaagctgagggagtgggctccggccttggctagcccagaaaggggctcccacagtgcagcggtgggctgaagggctcctcaagtgccgccaaagtgggagcccaggcagaggaggcgcccagagcgagcaagggctgtgaggactgccagcaggctgtcacctctcattatatctataggtttatatcttttgccaaatttaggacatattaacaaattatttcttcaaataccttttcagtctcactctttctcctgtacttctgaaactccaataatgcaaatgctagctcttttgttattgtcccacaggttcctcagtctgttcaattttttgttctagtctattttctctattgttcaggttgggtaaattgttattatcattattattattgtagagacagggtctctgtgtgttgctcatgctggtataaaacttctgggctcaagggattctcctgcctgagcctcccaaagtgctgggattacagacataagccaccacacccagtcaggttggataaattctattgatgtgtcctgaagttcatcaattctatctttagtcatcttgactctactattgaacccatccagcaaattttttatttcattgctttatgttttagttctataatttctatttggttcttttttaacttatttatttgctgagatattttattttttatttgtgtcaagagaatttgtaattgctggttaaaacatttttataataactactttaaaatccatattagatcgttccaacatctgattcatcttgattttagcatctgttgattttcttttctcattcaaattgtgatcttcctggttcttggtatgaggaatgatgttcaattatattctggatattttggatattatagtataagactctggattctatttaatcttttttaatcaggtaggcctcctgttggggtgtagcaagaaggcaggtgattttgtatgtttggtctcccagtgggcccaccaacaccttccagacaaacatgcagtacttattcatcctgtccagatgtctatgggggggcggggtggggggcgggggggagggtattcattttctagtgctgccataacaaaatgcgacagattggatggcttaaaaaacagaaatttgaccaggcgcggtggctcacacctgtaatcccagcactttgggaggctgaggtgggcggatcacaagttcaggagtttgagaccagcctggccaacatagtgaaaccccgtctctactaaaaatataaaacttagcctggcatgatggtgtatgcttgtagtaccagctactcgggaggctgcggcaggagaattgcttgaacccgggaggcagaggttgtggtgagccaatattgcgccactgcactccagcctgggcaacagagtgagatccgtctcaaaaacaaacaaacaaacaaaccaaaaacagaaatttattttctcacagttatggaggctggaagtccaagatcaaggtgttgacagggttggcttcctctgaggcctctctccttggcttacagatggccacccactcaccgtatcctcacatagttgcccctctgggtacacatgccactggtgtctctatgtgtgtccttatctcctcttcttattaggaccccagtcagattggattaagggccaccctaataacctcattttaatttaatatttcttttaggaactatctgtaaatacattcacattctgaggtactggggattagagcttcaacatatgactttaggatgggaaacacaattcagcccacaacatgtgagttggaagttcagctaccccttgccctgttgacaccttcccagtcaaagtgagatattcgctcacacctctaagttcaggtgccactagaaaggtggaagcagatgattgattcacaccattttattacagcaggattggggtagaaattaggttctcaactctctgctgggcctccctgatgccagaggaggagagggagacaagcaaagtgccaactatccctgcctctaccgctttgttctgtctcattgatgccaggtggaagtgaagactcagcaacccactgggccctgcctacatggaggtgtgggggtaagtggagtactgaccagacttgagtcacacgacccagttcagttgttgatgctggatgggagtggagtctcagcttcctattggttaccactgacactagactgaagcataactgtgatgagccctgcatcccaccgtctctttgagtctcactgtgggtgcaagctcagctcattgctgcaccctgccaacacaaggtgagggatagaaaaccagatccctgctcagccaggcaaagccaccctgagtgggatcacagtgctgctgcctgcctccagtgagtggagtaaaaaatcagcctcctgtcctattctactcaaactttgagaaagggagggtgcagttgttacactggtatttgccctgagtagggcaggtatcgccaaaaagttctggctacggggaacgaacaggctcatcttggggctttttgtgtatgtttgttagtggctccaagttgaaagcttctgcaggaccctgtctggaatatatgagaggcaataaggaaatccagggaactcagtgccatgtcattccttgggtccccaggttcctaagtagttcaccttcttcttttcagtgttagagtcttcctgtgcttgtttgttgagttatggccagggtttttttagttgtaagaaagagggtctgggaggaatgaggctacttccatttgcccagaaccagaagtcctccttataaacactttaatagaagaaatgcaaagaagatagggatttttatggaatattccaacataaaatcagcaactgatctaaaacctgaattatcaaaaggaatatcaatttctaaaaccagggcaagctgacaaaataaagctgagctatataaaggtatgtgtgctgtaatactcaacttcaagatgcttttggatgagctcaattcaactaacatcaaaacaaaaggaaataaatttttctacattcggaatatttgtcacaaaacaaagaccaacactatcagatagggcaattcatgttttgtgtgttttaaatttttattttaagaataacttttaaatatttgtaacagctttcaattttttaattgattttatttggtgttagtgatacttttttagttttttctatcatcaggtatagatcatttttacatgttattaaaatacataatctcatcaaatgcagttaatattgtatttttatttttatagaaaacctctgaaacttttagcataattctatcatcaaaaatgacacaccactattattgtggtcacttatcaaaatttgaaaacacaggctcagcacagtgggtcacgtctgtcatcccagcactttgggagacagaggtggctggatcacttgacgtcagaagttcgagaccagcctggccaacatggtgaaaccccgtgtctactaaaaatacaaaaattagccaggcgcgttggtgcgtgtctgtaatcccagctactcaggaggctgaggctggagaatcacttgaacctgggaggtggaggttgcagtgaggcaagatcgtgccactgcactccagcctgggcaacagagcaagactctgtctttaaaaaaaataataaaaacatgtaaatatcacaaaaaaaaataggatgaattctgttttgagaattcccaggaatttgtattttttttaacctgaatcctgaagatatttgtcagggatttagaaacactataaaaggcaaatactgtcccaattaccttattaacaaagactttttctttttcaatgatcaagacttaatcaaaattgtttttatctcttcagtttatatgtccagacttacttggttattacaggcacagtgatgcagtgaaatcatgacctatacctaaacagcctgaaaatattcagcctataaaagaaaagacttaggtgagaatttaatagctgtcctcataaacttcgagagctctcctgaacaagagggattgcatttgttctgtatgacccaagaggaaagaattaggataaatgagatgaagttacaggaaagaaaattttgacttactatatatatccactttctagcaactagagaattctgaaatgagagcagactccctcaagcaatagtgatttcttgtcaaggtaaaaggctggacgaccatttatcggggatattatcaaaaagactcagtgtttgtgattttttttttttggtgtgtatcatctcattttgttctccaagtgacacacatagaaaatgtatttaaatggctatgtatgaatgaaaatagtaaagttcagagggtatattagttaggattctttgtaaattataaagcaatttgagctagcctgagcaaaaacaaaatacagtataagaataaatggtatttcacagaacctaaggccagtgtaatgcagctgtctctagggtcggactgaggccaaagctctctctctctctgtatcttcaccctgtttctctctaacaactgctttgttctctatttctgcagatgtattttctatgcttcccaaccacataatgggtaggagatatttatgccacagatccccaatttacatctctatcattcaagggaccagtccagaatgattgggtgcctaaattattctggactttatgcagccaattaatcacattattctcccttctgaatgctaagccaattaagaaatagccacagtaaaactggatgggataatgtggcttaaacttgaggccaaaatgtacttttctgcaactttcctttgcctttgaattgaattcagccagtccaggcagatatccagattgcatctcaggagatggcctgatctggcggcctgacctgacgagcttatcagatgggaaagacgtccaggaggtgagcacattgcacttgcacatatgcaaaaggagaataaaggatctggtcagacatgtgcaatgaccctttactgaaacctactaattaagtaagtcactccaccaactccctcagggttgagttgctgaaaaacggagataagggcagaaactttcctcataacattttcaaagatattttatacgatggactaaggtaggaatgtgcagatgggaagagaatagccttcccgcaattaccaattcttatttctggagatagggaagttaactcacccactttgaaccagttattcatctacgtccaatcaattatggttttaggagagtctctcgatgcataaacagcatggccaggggacaaccattacagataggacaggcgatttttggtaaaagatggctagacagatacatgaataagtacactcagaatgcatacacttcttcgtttacattataaagttattcttgactcataatatccagctacctcacgttcaaatgcaaatacacacaagtacacacacactcattcacacatgctctgcagtggaggactacccaagtaatgagtggataatccattacattaggaagtgatgttgccttgaggtcactgctcttcctgtgtaaaatttctggatgaggtccatttcctccccgaatccagttttaattttgttctcattttcttaaaatttagagattaaattacaaacgtaaccactctcaatatatctaatatacaacacttggggaaatggccatatagagaaatagcgacggaaagaaagctccacatagtggtcactggtctgtgatttattctgctggacagtggcagtttgaaaagcttgaaagaacaggtgacttatttgggcataattttgactcactcctttggcgtgtttcttgaccctatagtgaactttcagtttgtgttatttcttctttggattgtgtctgaaaatttcctaagaattgactcttctggtatgagtcaactatgggtccctttcaccagatttagtatttttcactgacattttcattcttgtaaaacatttctggttggctctcacatccattttggactccatttgctaaaatccagcaccacaaatcttgttaggtcatgctccaaattgaatagccaggacttgttcactctactcaggcgtatgttctgttttgttcgtttttgaagtaagtctgaaggtttcaccatccatatggtctttaatacatgaattaaaaactataaaattagctgggcgtggtagcaggggcctgtaatcccagccactcaggaggctgaggcaggagaatcctttgaacctgggaggcagaggttgcagtgagccaagatcacaccattgcactccagcctgggtgacaaggaaagattctgtctcaaaaaaaacaaacaaacaaacaaaaactatagcctggccgggtgcagtggatcatgcctgtaatcccagtactttaggaggccaaggtgggaggatcacttgagcccaggagttcaagaccatctgggcaacatagcaagaccccatctctaaaacaacaacaacaaaaaaaactatggcctgatacgaggtagctagcataacagaactccttcctttcttatcagctatggaaatattgtccctattctcctattttagctagtgagaaggactttggaaggatgggggtgggaggtagaagtatggtcagtctttctccactcttctgcttcttccaggatattcccattcctgtttccaggatcttgcgttttcttggtccagacatttatttatcctaactacaaaaaggagagtcaactcagaacttgactactgcaattcacatttccttgatttatttcttcatcagtacctcagcaattgattgattaattgattgagacagtcttgctgtgctcactggagtacagtggcatgatctttgctcactgcaacctccacctcccaggttcaagcaattctcccttccccagcctctcgagtagctggaattacaggtgcctgccaccatgcccagctaatttttgtatttttaagagagacaggctttcgccatgttggccagtttggtcttgaactcctgacctcaagtgatccgcccgccttggcctcccaaagtgctgggattacaggcgtgagccactgcacccggccagcaatctatttagaagctcagattttctctctgtgcttccagtcaagcaaatctaagttggtttttttcttctgcaccttatactgacagctacaaaaaatagatatatactaatattttctaccaaggccccccatggcttggtggagaatgatctgagatgtaagagacaatgagcaggttttcctacttacttcaatattgcagaaagactgtaagtttctatcctaagattggggtggtaggtgggagtgtgaggctcctcccaatctgacacctgccttaacttcactcattttatattttctgattaagaatctgttactccgaaccctatcacaggtagcactttgtatattaaataagattctctgttgccttaagctgtatgcaacagaaactgtatcgagccagcctaagcaagaaaagaatttaagaattcagaagggcactcaggcctaagaaagagatagaaaagttaccagatctttcttcatctctcatatcttcttctctctgcatgtttgctttatttatttattttctctgaagttaggctttctctgtttctctttccacataccaggtaagatcatggtcactcagcagcttccaacttcatatgtcttttctttgagaaaccaagggtagtatgccaaaaccattgttggttttttttcagatatgtccagggagaaaatctggttgaccagtttgtccttatagtgaaccttcatcagtggtgtgtgttcaatatcaaaacatctttctaattataaagaatcttcagttaggtgagcagatatttcatctccccaccttttggttcctaaaacaaagacatgtgacccaagtcccaccaatatgatgtttttgcctggaactttatcaagtgatacacacaatttggaatttttctatggctgtggcaccaatggcagtggcttctggttctggtggcagtagtggcttccagcatctgatgatacagtggtgactgctcggcaaagacagcagtcatgtcctaaccaggttctttctgcagcataattttaaatgtcctgagttatggcctcccttaattattgctcatttctttccaagcccaatcttcagttcttctcattgattctgtgagcgttcctaaactcttctaataatgttttttttcctcaaatataccagaatgattttatgttgtttacaactaagaacttgcctatattctaatgagctaaaccagtgggtaggggccttgtagagcaaacctgattgtcagaggtctacccctgtgaacaggaagaacagttcccagagaagacagaatcagtggacatcccaataagtgtctttttgcattaatattggaaaagttgtccaagaccatagaagagctgaatatcagaactttaagaagaatctgcacatctcactactcaatataggatttattcctttgtcccaaggattaattttaattcttgaattaataatggatggggatacctaaggttattatagaaaggccaacataagcccttcacaatctcaataatttgctatttcaccaaactgaaaaacctatttcaaaaaagaaaaggctgaattcaattaaacaacctggttctttcaaaataactggttacctaattaaaccttactattgccttaaactttgtaaacatatcttaaacactactatgctaagatggggcagaggaatgaattactgataaaattcatagttaattgaaaatgatatcaaaaacattttaatacttttcaccacataataaaataaaaactgtgtgatttgagtttttatctccttttatgggcctgtttaatttctgtaaaggagctttgaaattaagcaaaatagaaagggaaatagtaatttggataatcagtcccaaataaacaagaattgctaattgcatttcttgtacacaactaggagtaaattcaaaaactgaaagtaaattggacatgatgctcagagagtatccttgagcatgagtaactaaaattaaccagaattttaaataaactggggactcctagacttctgaagacatgaatgaggctattagaactctctttctcctactcatccattagcaatgtcgggaacagttcataaaagattaatgtttaaatgcttaagaatatatatttgaataccttgaaaacaccaagcaatgctttttaaattaattgataagtcattttatacttgtgatgtagacttagacttttttgtagtaacaagccagaaaacatctatccttctgagagataatatgtgaaagaattgtagaagaaatgagaaagatgattagtaatcctgtattgcttcttgagacagcaattctctcgtaagtggaaacttaggcaagcatcagtgatgagaaatagatacattttactctttacttcatggttgagaagtgcctgtaattcacctttcaaataagaggcaacatgtatagcataatcccacagtattatgaaattttggaggtgaaagggaccttgatgtatcggtaagctattgctctataacaagccattcccaaaactcagtggtttaaaacatttattattgttcaagcatctacagattagctaagggtaggctgagctcatctggggtgattctgctccatgtgtttctcattctccataaaccacaaacaaaataataataataataataatagtatttttttaagttctcacttgttgaaggcttactatgtgctaaaagcactttaaaatgttatctcctttacttctcacaaaaacattatgaggtaggtactactaatatcctaatttcacagatgaggaaacaaagaaggaatttccccaagctcaagaagctactgtatggtgaacctggagcacacagatgaaggtctacctgacactaaactttatgttcttaatcattctgttatattctgtttcatgaaatttactattccattttcagagagttctaaccactaagaagttattcttatattcagtgaaatgattttctctataacttttaatcactgatcttaatttggcccttgagtacatacaggataaagataataatcataaattaaatgatatagtaaaagtgcctgacaaacagaatgtgttccacaaaaattaatctaagtcagccccacaataggcataacagtcgttaataaaatgttcaaccgggcagggccagaattatttgcagttttacccagttggcacttatcctattatacagaaaactatccaacctaggataaatacaatgtttaagtccagatatactgtgtctataacatttcctttatctatcagcctagtaatcttgtcaaaaaggaaatgagccctagattgaataagcaacagacaattagaatttagagggtagagaggaggtaagggaacattaaataatgctttttaaaattaatcagcatatattttattaataagcaagcaggcaaaacctagtaaatgttgactttctttctatttggaaaaaatttaatttgttcaaaggtaaacttttgtttatattataggtttacctaagctgatgagagaactgagtacataatacctattgaggataataaacttgttaaaagatgattttcaaaatgacaaaatacaaatattaaaagagcatatgtgaaaatttttatttaactcattaattaatgaaggaccctgtaagatattacaagctattcaaaaaagaatagaaacagtcatatgtaggcaagcaggaatgttgaagtaaatgtgctaatatgtgcaaattaatagatcctataggtactaaattgtaatgtttggaatcatcttttctacagagaggaaatcaattatatctctatgataaaattcattagcatgtctatggaaaagaataatttgcattttactgtcagtcaattttttacaacttcctgagttgtaaaatagctcagtcaagggcagtccaaagcacaggttccaacagaatcagataaccttaccttggagagtaagccagacagtgtcagacgttccagaacacccagaattgtgcccattcaaaattcttcactagtcttcctgacaaagtttctagaagaacatcaaggagaaaaactgggggaagtgctgattacatgaaaatgtacactggttgaaacgttttacaattttttaaaaacatattatttgagactctttgagaaaaaagataatcccggaaaatcatgaaattatttttttttaatttttttgtcacatccttcaaataaactgttaatcatgatatacaaggtcagatggaaattgaaaaaaggaaaaattaacgttttttaatataccctcccatttgtctgccaaaattgtatttaaaagtagtgttatataattaatgatattttatattttcagatgattgctaacaagccaaagaaaaaaatttccctgatcgtatttggaattaaaaaaatcattgattgaatgaactagtaatattttatttagcatttccttgtatttagagtggtaagaatttctatgtcagctctgtcctctgcattgacaaatcagaaggtcctgaatcctctttactctgttatgagatcataaaaaagaaattaaaagtcaattgctctccactgaaaatcctagaattgagaatcaaggaataatcttctcttccaaccaaagtccctgtgtgactaaagatcagtgtaattttaaaatgtggcaacttgtatattaaaatgtcatatagaatttttaaaaatcttttattgagattcaaaaatagacaaagaaaatataataatggctaataagcacatagaaagatgttcaacatcactggttattagggaaatgcaaatcaaaatcacaataagacactactttacatccatcaaaatggctattgtttcttaaaaattgaacacactaggcattagtgagtgtcttacttcgttttgtgctgctgtaataaaataccacagactggataatttataaagaacagaaatttattctctcacagttctggaggctgagcagttcatgatcaagggactggcaagttaagaactggtctctctgcttccaagatagtgcctggaatgctgagttctctggagagaagaaacgtggtttcctcaactgacaaacaggcaggagagagagagaacctactcctgcaggcctgttttatagcagcattaatccattcataagggtggagcctcatgacttaaacacctcccatcatgccctatctcccaacactgttgccttggagattaagtttcaacatgagttttggagtggacgaaaacatttaaaccatagcaataaggatgtagaaaaattagaaccatcccatattgctggtaagaatgtaaaatggtgcagccactatggaaaatagtatggcagctcctcaaaaagttaaacatagaattaccacatgatctagcattctatttctaggtatatacctaaaataattaaaagtaggggctcaaacagatgcttgtacagcaatgttcacagcagcattattcacttgtagaatttaagacactctaccccaaaatacttatttaagctgaaagaatttgagaaaacagcagaatcaggaaggtcaccctcactttactccacccttcttttctgaagcaggtcataaaacttaggcaggattttctgaccttcccttgaagcaggtcatagcaccctcatgtgagaggtgccctctctaatacctggataaagcagccaaagacagagacacgaataatctgaacaggcaggccttgctaagtttccccaaattcattactggtagattacacccactatgtccaagtctacttctccacgtctatacatttattcatcaaacttggcataaaagtacacatgtttaatctgcttctttgggtcttcattgccttatgcaggctcccatgtcacataaaacttatattgaataaattcatatgcttttctcttgttgatctgcatttcagccatgaacctgggataagtgaggaaatacttctcttcccctatatcgcagtaggcaacaggtagaaacaacccaaatgtccatcaacaaatgaatggataaactaaatgtggcatatacatataatgaaatattattcagccttaaaaaggaatgaaattttgttacatgctacaacatggatgaaccttgaaaacattgtgttaagtgaaataagccagactcaaagggacaaatattgtgtaatttcacttatatgaagtacctaaaatagtcaaattcatagagacagaaagtagaatagaagttttcagggactgagaggaatagggatagggagttattgattaatggtcatagtgtttctgtctgggatgatgaaagagttttggaaatggagagtggtaatggttgcacaacaatgtaaatgtacataatgccactgaactgtacacttaaaaaaggttaaaatgataaattttatgttatgtatatgttatcgcaatgaggaaaaaaatcactagttggaagtcaagaatgttttaaagctttttcagagctccaagtgttacaggaaagggatcccgatccagatgccaagagagggttcttggatctcaggcaagaaataattcagggcgagtccatagagtaaagtgaaagcaagttttattaagaaagtagaggaataaaagaatggctactccatagacagagcagccccatggctgctggttgcccatttttatgattatttcttgatggtatgctaaacaaagagtggattattcatgcctcccttttttagaccatacagggtaactttcagatgttgccatggtatttgtaaattgtcatggtgctggtgggagtatagcagtgaggacaaccagaggtcactctcattgccatcttggttttggtgggtttttgtgggttttggtgggcttctttactgcaacctgttttatcagcaaggtttttatgacctcaatcctgtgccatcctcctatcttatcctgcgacttagaatgccgtagccatctgggaatgcagtgatgttgcgggaagtcagggaccccgaacagagggaccggctgaagccatggcagaagaacatggattgtgaagatttcatggacatttattagttccccaaattaatacttttataatttcttttgcctgtctttactgcagtcgctgaacataaattgtgaagatttcatggacacttatcacttccccagtcaataccctgtgatttcctatgcttgtctttacttcaatcacttaatcctgtcagctgaggcggatgtatgtagcctcaggaccctgtgataattgcgttaactgcacaaattgtagagcatgtgtgtttgaacaatatgaaatctgggcaccttgaaaaaagaacagggtaacagcaatgttcagagaataagagagataaccttaaattctcaccaccggtgagccaggcggaacagagccatatttctcttctttcaaaagcaaatgggagaaatatcgctgaattctttttctcagcaaggagcatccctgagaaagagaatgcgcccctgagggtgggcctctaaaatggcccccttgggtgtggccatcttctgtggtcgagctgtagggatgaaataagtcccagtctcccatagcgctcccaggcttattaggacgaggaaattcccacctaataaattttggtcagactggttgctctcaaaccatgtctcctgataagatgttatcaatgacaatggtgcccgaaacttcattagcaattttaatttcgccccagtcctgtggtcctgtgatctcgccctgcctccatttgccttgtgatattctattaccttgtgaagcatgtgatctctgtgacccacaccctattcatacactccctcccctttgaaaatcactaataaaacttgctggttttacagctcagggggcatcatggaacctaccgacatgtgatgtctcccctggatgcccagctttaaaatttctctcttttgtactctgtccctttatttctcaaaccggccgacacttagggaaaatagaaaagaacctacgtgaaatattgggggtgaattttgcccaatatctggctgaattttctgcgatacagcacagtatgtttcagccttattttacccagctcctattcaagatggagtttctctggttcacatgcctctgacacaagcactccaaactggtttccatttcaattttctctcattattttatttaattaataggcatttattaagagctttttttgctaaacactgtactaggcacagcaaaaaaattcaaaataataagatctttttttctctgaaatccatcatttagctcttcctaaactgggatttaaggaaagctgtttctttttttatggttttgtttctttttgttgggatgggttgttcataggtgtgctgaaaggaaaaacatttttcctctttgcaaataaatgagtgtttaattattaaacaaagttaaatggatttttttaactgtgaagacttcccataacctttaaaatgctaatgtattttttgaatctacaagactggatttagtaagtggcattcctaagcttatttaatcaagaattctttgtctctcagagcccaattaattaacatctccctttgtactgtggctgcagaagttgagctatgtggtggattctttttatactgggctaaatgtattatacaatctgtaattatggtataaatgtgtattttgttttatccctatgtgttctagaatgtgagtatgattttaaaagcatttttaaatttaaaaatgtagattaaacattagagacaataaagtcattataatttcttacctcaatttaccattttttttctcctttagatagcatttattattctggaaaaagggatattcttgttttggggagaaggatttgctaatggagattttgcagaaaactgtgatgctgactgtgatatgtaacttgtgagcatttttaataagaagaaacatagaatgccagtccttattcttttcttgataaaagaattcctaccgaattgtatccaatcaatagctttaaggacttgtgattttctctctgcctttgaataattgcaaatttttgatgctaattcttactccataagtttaaacgtccctatttttccgattactaaacttatactttaagtcacaacctacaataatatgcagacaatccctgacttacgatggtttgacttatgattttttgacattattatgatgtgaaagtgagatgcattcagtagaaatactgttgtatccatacaaccattctgtttttcacttttagtatacagtattcagtaaattatgtgagacattaaatcctgtattataaaacaggctttgtgttagatgattttgcccaactgtaaactaaagtaagtgttctgcacatgtttaaggtaggctgggctacattgtgatgtttggtaggttagatataataatgcatttttgccttacaatattttcaactgttgaagatttattgggacatatcccacattgtatgaacatctgtattcctgcatcctccatatattccttttttttttttttgagatggagtctcactctgttgcccaggctggagtgcagtggcatgatcttggctcactgcaacctccacctcccctgttcaaatgattctctttcctcagcctcccaagtagctggaattacagatgtgcaccatcacacctggctaatttttgtatttttagtagagacggggttttgccatgttggccaggctggtctcgaactcccaacctcaggtgatccactgacctcagcctcccaaggtgttgggattacaggtgtgagccaccgtacccagccctacatatattcttaattttgtgcttttccttcaaaattaaacacagtagaacaatttaagtaaagctaaagatatagcaaatttgagcctatttcatgattttaatattggtctcagttatattttcattagtagtatcattttcatgtgtctaaagtatcacgtaaaatgcattagaatatttaagtaattgcacaggcattacaaaggaataaaaatgataaaattgccaagatcaaccagctggtcatcaggcagaagcaccccgtgatactgtgaaatacttggttattggtgaaggatgaaagtctagattcagcataggaaagagaattgttatgtgtatatgtacactggatggaggtgctagttgtttgcaagtcaagcattctaaagcctaggactgcctgaactagagcaacaaataacaaagtatcagagttcaaggatttattctgaccggatgattttggaaaccttcctggacaacacattgggctgggttctgaagaataaataggattcccacaaatttttccagactgaggagagaggctaagatgtgcaaatagagggtctatctaggagtgtaattttggagtgcaaagtatagagtgcgtaagggatagtgaagtaaattaaactagaaaaaattattgaggccagatcattagtactaacaaatttagactttattctctaagtaactgagagctgaggaaagtttttgagcagagggcatggtttgtgtttcagaacaattactctggtgggcccatagggagcagatgagactggaatgaggcagggaagctaattaggatgttataattgtctagcaagaaaagatgaagacttgattgactgtcaaggaaacaataaataggagacattttgaaaaaattaactgagcttggtgaataaatcaattagaaatccctttggatgcaagaaacagaatttcttttgaacagagttgaacatacagagccttactttattcaagtagatgcagatagatgcagatagatcaagtagatgcagatgaatctactttattcaagtagattcaagtagatgctgctggtgttggtgcagaggcttgacaatatcagtgacatcatttctcagctctcttggtttttctttcatgttgttgaacaaccgtctcctccacggcctactttaggtgagtgattggctggagctgagtcacatggcagcctctagctacagtagaggctaggaaggtggggaatagtagtgtcttgatcacctgagactgatcatggtctgtaactatgggctgatcacactgtccttttgaaaaaacattattagcatggagtacatgggcattggatattaggtgaacaattaatagagtttgctacagtaactaattggctatcggagtgcagtgggttgaatagtgtccttccaaaattcctgtccacccagaacattagaacactacattatttaaaaatgtgtgttgcagatacaaataaagtaaggatcatggtgagatcatactggattagggtggaacataaatccaaaaagactgtcttataattaccaaagataaacaaagacagatactattaaagtgataaagacaggttttgttttgttttgttttttttgtctttttttttttgagacagagttttgttcttgttgcccaggctggagtgcaatggtgcgatctcggctcactgcaacctctgcctcccaggttcaagtgattctcctgcctcagcctcccaagtagctgggattgcaggcatgcaccaccacacttggctaattttgtatttttagtagagatggggtttctccatttggtcatgctggctggtctagaactcctgacctcaggtgatccacccacctcaccctcccaaagtgctgggattacaggcatgagccaccgcaccctgcctaaagacaggttttaattagtaattaactattgcaaaagggaagagaatccagtataaactgaactcaactttgatttgttttaaagagagaatgagagaataggaaaggggaacggtagggaccagagtcagggagtggaaatttacaaaaagtgagaagacgagtgtcttagtctgttttgtgttgctataacaaaatatcacagaccaggtaatttataaagaaaagaaatttatttagctcatggtcctggaggtgaaaagtccaaaagcatggtgccagcatctggcaagggccttcatgctgaatgataacatggtagaaagtatcacatggtgaaagaaagcaggagagtttgtgtacaacttcaagccgtttaaataatcaacattattccattagtgaaggtggagtatcaatgactaaaataacccccatatggccccaactcccaaaactgttgtattggtattaagtttccaacacatgcactttgggggacacatctaaaccacagcagtgagttggcccatgtaaaatcatctgagtttgctaactggtactggtcaaagttaggctcctaccctcccaaagaggcaaaaagacaggggccctatcttcaggtgttggccagaacaaacaatatgttttttgggcagccttgagctttcccaagcaggaacttaaagagactggagtggtgatactaaggatgggaacttgagctgtcagaaactatactaatgtttgttcagacttttaatgagaatggaggaggaggccaggcatgaaggctcacacctgtaatcccagcactttgggaggccaaggtggatggattgcttgagcccaagagtttgagaccagcatgggcaacatggtgaaaccccatctctaagaaaaatataaaaattagctgggtgtgatgacctgtacctgcggtcccagctactcaggaagctgagaggagaggatcacttgaacctgggagggcagaggttgcagtgagctgagatcgcaccactgcaatccagcctggataccagagtgagacaccatctccaaaaaaaaaaaaaaaaaaaaaaagacagagagagagaaagagagaatggaggaatggaggagggacattgtcgtaagagacaaagttaagaaggctatgtgaaaatgaaggcagagattggagttatgctgctacaaaccaagaaatgtcagaagtcatcagaagctggaagagacaaggaaggatcctcctctagaaactttggaaggagtgtggctctggtgacaccttgatttctaatttctggcctcctgaactgtaagagaataaatttctgctattttaagccactcagcttatgataatttgttatagaagccctaagaatctactacatggggtgaaggagagggggaggtatctaaacataatagcctggaagaggatattgacagggctcagaacatgataccccaaagtatggcgccctgggatgctgagtactttgagctgaaggacattggaagggcctcagaagcaagtctctctaaacatttctcactctcctgtctctcatccttttttctcctccaggtgagtcatagaaatcagaatccctcttccccaaggtgggtcatagaaattagaacccctctcccacaaaacaagccataaaacctggaaagataacaagggccttgctgcattctgggaggaaggaattctacatggagagaccaagaagaatctaaacagacaggtgttactgagtattccccttcagtctattaccattccatcatacccttttggccaataacatttctacatggctgtccattcttcatagaatccaagcataaaaacaattttttccttggtctttgggtcttcatttctaaaggctcctgtgtcaagtaaaaccttttttttttctttgagacggagcttcttgttgcccgggctggagtgcaatggcacgatctcagctcactgcaaactctgcctcccgggttcaagtgattctcctgcctcagcctcccaagtagctgggattacaggtatgcaccaccacacctggctaattttgtatttttagtcaagatggggtttctccacgttggtcaggctggtctcgaactcccgacctcaggtgatccacctgcctcagcctcccaaagtgctgggattacaagtatgagccaccacgcctggaccataaaactttgattaaataagtttgttatccttttatcttgttaatctgtcttttgttataggagtgtcagccatgactcttacaatgggtgagggaaggtatcacacttttctgctcctacaatattaataccatgagtagaacatgttgtctgtgagacatttaggaaatattcatatgaggatgttaggcaagaattgggattatggatttagaattgaggaatgaagtaaggaataaagaaactgcagggaaaagaaaaataaacttcaccaagcaatagttaataacataagataaagtataagttagtatttaattgaccacttgaacacaattctttccctcttatttccaaattctattcctgtgtagcaggaatagaagaaaaagccagcatcattgagggttaatgaatttggcctataagggctaataaatatctacaaacaaactttggaaagagtcattaacaggactttgatttcccatttgccttagtagcaaatttagcagcactttttaaactgcctcatggatgactatctccattagtttttttttttaataagaaaacagtaaacactatgcatggtagtgttgtatcctcagtgcttctaatataatttcttcatatttctagtattacatttatctcactgcattctaattattgttctgtctcccctgctagactgggagcttcttaaaggtaatgcaccatttttattcatatttgtatttcaattacttgacacaatattcagcacttaagcaatttatgtaataactactggatggattgtaataacaataatagttaaggatgcagatctagagctagtttagttgggataaatcctggctttactgcttatttgttttgtgaccttgtgaaattactaaacctctctgtgccccagttttttcatcacaatgtgaaataataataagacctttgtcttggtcaatttgggctgttctaacaaaaatattatgtaccgactggcttaaacaacaaacatctgtttttcgtagttctgtggctgggaagtccaagatcaaggtgccagcatattcagtatatagtgagggctctttttctggttagcagacagcctccttctttctgtatcctcatatggctgagagaaagaaaggtcatctctctggtgtctcttctcataagggcactaatcccgtagtgaaagctccaccctcatgacctaattaccttccagaggatccatcttcaaatatcatcacattaaaattagggttttagcatttgaattttgaggacatacaaacattcagtccatagcaaacctcctcaaacaattgttgtgataattaaataaattaatctatttaaagcacttagaagattgctagacatacagtaagtgctcaatacacacatatatgttattgaattattaaatagaataatgcctctagcattcattactgctgttcaattttgtcttcattgttattttattttatgtcttcctgtgtaattcccttgtggcaatttcataattgctatagctttttttgtttgaccctccacatctcatgttcaaatttgatccccattgttggaggtagggcctaatgaaagctgtttgggtcatgggggtggatccctcacaaatatcttggtaccgtcctctggtaatgagtgagttttaactctattagctcccatgagagctggttgttaaaaagagcctggcacctccccctgcattctctcttgcttcctctctcaccatatgatctctacacatgccagctcccctttgccttccaccatgagtggaggcagcttgaagccttcatcagaaacagatgctggagccatgctttctatacagcctgaagaaccatgagccagtttatttataaattacccagcctcaggtattcctttatagcaacataaatgaactaagacaataatctacaaattcatttacttgattactggcaaattactcccatgagagtgagaacgttttctgtgaagttctctacccattccatgcataacacagcatctacacacagcagagattagtaacagtttgttaaaggagtaaattgatccacttttaccttctgtaaagaccaatttaaatctttcttatattgctaacactgaacctcctggttcaaagttaaaaaaaagataaggcgcagtaacaacagagtttcaggaagatctgggaaagaaagatttcctattattttttatttatttatttatttttgagacagattctcactctgttgcccaggctacagtgcagtggcataatctcggctcactgcaacctctgcctcccggattcaagcgattcttccacctcagcctctcgagtagctgggactacaggcacgtgccaccacacctggctaatttttgtattttttagtagagacggggtttcaccatatcggacaggctggtctcctgaccttattatccacccacctcagcctcccaaagtgctgggattactgacgtgaccccctgcacctggcctatttcctattaattctaggactaactacctgaaaataggataataccttgcatcactacattaatatactcatttttattgtcccctgtttctgagagtaacaacttcaaatctcctaccttctttcctgactttgacttcctataccgtcagctcttcagggcagtcttgacattggaataataataataacatcatgttcttagacaaagactgatccactctcagaaatcaggttaaaggttattttatgtgattcttttttgttttaatatgatttataaagagggagagtcaatgttgaagaatcagctattttaaaattgatccctctactggagtactaaaaagtatttgtgaaatgaacacgaataatctttataacattaaacattgcaaaacccaaatgcaaaatagtcctatttaacataaagtctttcatattgttctgttctgccatccttctatacatttgcccagacaggacagcaacaaggaaagaatatgtaaacactaatcatttctaacttgccatctgtgacagttcactgtgctgaaattagaaaggatggaatcacttttccatttccttaaggtcaccaaggacagacaagctcaggacatactgtatttgtcagaagaaaaagagatgactggtgaggtggcagtgacaaatctgttctaggttcagctcattttactgaagaatgtgtgtccccttctgacatttatcaaaagaaattcaattttataaaaagaaggatgtcaaataatagtacattgctaacactcattttgttgctgtcagaagggcagatgggggcaaaaagggaaaagggtggatggaagagaaagttattccagcaagaaacaaacaaagtcatgctaataatacacttataggcttgaatatatttctgattaaaacacctatttttgagatccatcttagtgcctggctcacactttagaataccagttttcacttcttccagacagaaggaacgacacaaagcaggttgatttgtgggttttgtgtttgtttttggttttgtattttgttattgtttgagtgccattctgctgcaccaggaaggaaagaaagctaatgaaacctggtaaaaccccaggtacaatgacatgcaccctgtgggcatgcaatcaatagttcttatggtgatgatgatgtttttctctggcagaaaagggtattttgggtcaaaaaataacccaaaagttgtgacagaggtaacggaaaaatagaagtcagattaaaatcaaaggaagaaattctaacccaaaagttgtgacagaggtaacggaaaaatagaagtcagattaaaatcaaaggaagaaattctatcaggagactaataatgaagctgacaatatactgtaacaagtaatagtgttttaccatactgcataaaaatattggattaagatacaaattaaatctctttctcagtgagggttttctgcagaacataaacaattaagctgctttctggagaagacaggaaacttgattaacagatccaaaaagacagcatagggaagatgggtttaacactaggaggtgaaacaccaactgttatccaaattgacttttccagaaacgttggataatttcaatcaaggactgaaatatactcttttctttttaagcgtcagtgttctctggacttaaacaagtcaaaggaggttcttattaaataaatgctactggtgcatatgttccagtcacagtctcctgaggtgagtatggagacactacagaaaattgaaccatgaaatagggttttgtgtctctataccaaaatttcaaatatctggaggtgtcctagctcatggtggctaagcaggcagcttgtgggagtacaggaggctacaggagacgccaggagtaaaacgacctattctgagtcctgtagtctctgtaaggtgcctatttgatgcaatctaagacagtcttatttagaatagggacccttagaagctgctaatataagtcaaagaaacaaatacttctgtgcatttttccccacaaataagggattgtcctaaacctctaagcattaaaccaggaatccagtaaaaaccaggcttattgtactccaatccccaactcacgtactgtcttagagattttcagacacaaggtgctaaaagttatatagcatattttaaaatttatctgttatcaagtgcctttcattgaacaaaaaaaaaatcaaattcaatagtacataaacaagatctttctgctccttcttggaagatttttaggagaattaaagtcatagagacaatcatctacatgccattaatattgtcatcttcacatattattaccagtattattaccagcacagctttcaaggtttgaaattttgcattgggctggccttaacatttggacaaatcctttttaaatatagggaataaataataaatttaaaaataaaatacgttaatatgcaattttttttttttgagactgagtctcacactgtcacctgggctggtgtgcagtggcaccatcttgacttactgcaacctccgcctcccaggttcaagcaattctcttgcctcagcctcccaagtagctggattgcaggtgcctgccaccacgcccggctaattttttgtattttttagtagagatggggtttcaccatgttggccaggctagtcttgaacccctgaccttgtgattctcctgcctcggactcccaaagtgctagaattacaggcgtgagacactgtgaccagccaatatgcaaaattttaacgctttaaattagaggtcagcaaacttttttcattaacagagagtaaaatatgttctgctttccattccatacactctcacacaactaatcaactctgctgttgcagtacaaaagcagccatagacaatacaaaaacaaataggggtggctgtgttccgataaaattttctttacaggcctctgcctctgcctctgcctctgcctctgcctctccctctcccctctcccctctcccctctcccctctcccctctcccctctccctctcggtctccctctccctctctttccacggtctccctctgatgccgagccgaagctggactgtactgctgccatctcggctcactgcagcctccctgcctgattctcctgcctcagcctgccgagtgcctgcgattgcgggcgcgcgccaccacgcctgactggttttcgtacttttttggtggagacggggtttcgctgtgttggccgggctggtctccagctcctagccgtgggtggtccgccagccttggcctcccagggtgccgggattgcagacggagtctggttcgctcggtgctcggtggtgcccaggctggagtgcagtggcgtggtctcggctcgctgcagcctccatctcccggccgcctgccttggccgcccagagtgccgagattgcagcctctgcccggcctccaccccgtctgggaggtggggagcgtctctgcctggccgcccatcgtctgggacgtggggagcccctctgcctggctgcccagtctggagggtggggagcatctctgcccggccgccatcccgtctgggaggtggggagcgcctcttcccggcagccatcccatctgggaggtggggagcgtctctgcccggccgcccatcgtctgagatgtggggagcgcctctgccccgccgccccgtctgggatgtgaggagcgcctctgcccggctgcgaccccgtctgggaggtggggagcgtctctgcccagccgccccgtctgagaggtgaggggaccctccgcccggcagccgccccgtctgagaggtgaggagtccctctgcccggcagccaccccgtctgggaagtgaggagtgtctccgcccggcagccgccccgtccaggagggaggtggggggtcagccccccgcccagccagccgccccatccgggagggaggtgggggggtcagccccacgtccgggagggaggtggggggggtcagccccccgcccggccagccgccccgtctgggagggaggtggggtcagccccccgcccggccagccgccccgtccgggaggtgaggggcgcctctgcccagccgcccctactgggaagtgaggagcccctctgccgggccagccaccccgtccgggagggaggtggggggctcagccccccgcccggccagccgaccagtccgggagggaagtggggggatcagcaccccgcccggccagccgccccgtccgggagggaggtgggggggtcagccccccgcccggccagccgccccgtccgggaggtgaggggcgcctctgcccggccacccctactaggaagtgaggagcccctctgcccagccaccacctcgtctgggaggtgtacccaacagctcattgagaacgggccgggatgacaatggcggctttgtggaatagaaaggggggaaaggtggggaaaagattgagaaatcggatggttgccgtgtctgtgtagaaagaagtagacatgggagacttttcattttgttctgtactaagataaattcttctgccttgggatcctgttgatcggtgaccttacccccaaccctgtgctctctgaaacatgtgctgtgtccactcagggttaaatggattaagggcggtgcaagatgtgctttgttaaacagatgcttgaaggcagcatgctcgttaagaatcatcaccactccctaatctcaagtacccagggacacaaacactgcggaaggccgcagggtcctctgcctaggaaaaccagagacctttgttcacttgtttatctgccaaccttccctccactattgtcctatgaccctgccaaatccccctctgcgagaaacacccaagaatgatcaataaaaaaaataaaaattaaaaaaaaaaagttaaaaaaaaaaaattttctttacaataacagcataaaactttggcttcaggtcacagtttgttgacccctacttcatattatcatgtcccccccacccccatttctttcattcaccttctatcacagagtcacagctttgcactcacagtgtagccaagttgtagctacagaccaaacattgtaaagaaatacctccggggaacttgagaataagttaaaacttgtgctaaatcatgagtgaaatatacattgggaaacacagttaacaacccattccccaacctgcttactgggccatctttctaaaaatgcaaatttgatcctgcagctccctagcttaaaaggcttcacctgcaacagaaagccctggctttttagtttttcaccataggcttatttatggctggtcctgctttcttcccctccttatttcttctcatcccttccttctcacattctatgcttcagctacatagaaggacttataatttccagaatgatacctgctcccttgcctttcaacccatacacttatttttttttttcttcttagatggagtttcactcctgtcgcccaggctggagtgcaatggtgcgatctcggctcaccacaacctccatctcccatgttcaagcaattgtccttcctcagcctcctgagtagctgggattacaggtacccgccaccacacctggctaatttttgtagttttagtagagaaggggtctcactatgttggccaggctggtctcgaactcctgatcttagggaatctgcctgccttggcctcccaaagtgctgggattacacgtgtgagccaccatgcccagccaacccatacacttgttactcattctccttgaagcactcttctccacacatccttggccttgccaactccttgaaggctgagcttaggtgtcttaaggacttcaactcccagacacttctgtatacctgcgttataatatttttactgctggctgtgtgtggttgctcacacccgtaatcccagcacttcgggaggccaaggcaagaggattgcttgaagccaggcattcaagacagcctgggcaacatagtgagaccccatctctaccaaaaaattagaacttagctgggcatgtggtacatgcctgtactgccagctacttgggaggctaacatggtagaatcgcttgaacccaggatgtcaaggctgcagtgactcgtgattgcaccactgcactccagcctgggtgacagagcaagatcttgtctaataataataataataatattcttaccactatctacagatgattactggtgcagataaatttaaaattcttcttggccatgtgtggtggctcacacctgtaatctcagcactttgggaggccgaggtgggcggattgcttgagctcaggagttcaagactagcctgggcaacatgattaaaccctgtctctaccaaaaatacaaaaacttagccgggcatggtggcacatgtctgtggtctcagctacctgagaggctgaagtaggagtattgcttgagccctgggtggtagtggggagactggaggttatagtgagctgagattgtactactgcactcctgactccagcctgggtgacagagtgagatttcatctcaaaaaatatataaaaaataaaaaatttaaaatccttgaaagctgaaactgcattttcttgtaagcacatgatatccctcttagggtcctgctcccccatcccctgagcatgggaataaagaaaaaatcttgactccctttaggggaaaattccaggcaccccactatccttgagaaataaataaataacccactaatcaataaggtaataataagcttaaacaatagccacccaagtaatctagagtcataaaatgtttggttccctataaaaactaaagataacatcttgacatatttccctgagttgtttttcagaaacctgtacccccacaagatggaaaatgctgaccactgtcacacagacctcaaataagggagagctaaggactgaactctaatcgttgtcccttgttctaaatgtcttcatgaggggcctggagagggtcatcatgcccatagatcaaaccttaacattcctttcttctgaccccaagtttttagacaaagcattgcttccctaaccaattgtaaatcaaataatctgtgaacctctctatgacttgtaagcccccacttccagatattctgccttttgaggcaaaaccaatgtgtaacctccatgtattgaattacatatgattttgcctgtaacttctgctttcctgaaatgtaccccttcctttaaagacccttgcttgtaagccgtgggagagtttgggtcttaagtgttagctgcccaattctccttgcttaatgccatgccataaatgcctcactttctctcactgcaaatcttggtgtcaatgtttgcctttgctgcaccaggtgggctgaccaaagttgggttggataacacatggtatctggtacattgagaataatccctaatgcttattaaatgaagccatcaattatttaatgtctttaataagcttttggcctttctacttcagaatataactttagttattcccagctatgggcaatttattttcttttgcatattgtctataaatgatacccaaagaactaataggaaaaaaaattattagtcagttaaacaggtaatttaatatcaaaccatagaggaggaaaaataattgtctctctacccttcagagttcgtagctgagactctgaaggttaacaggagaaaaataaataaaagatgaataacgtgtgtacctccagtatacatggaaggcatactcagcgaaatctgaaagagtaaaatctccaggctaaatctcaagagatctcaaaagggttgtttaaacttcaggcttataccatcctttgttgaaacaaaaagagaagtttattgggaaaggctgattatgggagataggaagagtacagtatacaagaacagtttgttatgcaaacttaagtcagtcccttctccattgattaagagtatcttggatttagtcattctcttcctggtactaagagagagagagacacccttacaaataacgattttctttatagacataaatttctcttacaaaagggtaccttctactctagttttcagagcttctcctgtgtctgctgtttcccaaaataattcaattcaaaaaattctatgtcaaagaggcttatttggggtggtgtattctggtcttttacagtcacactttgagatgacgtgttctgaacgccatcaatataaaaatcttcttaacttgatttaaaatttttttcaggttgaaattagacatatagctttatgttgtcattattgttttgtttctttagagtgttaacttaaaaggaagaagctgaggaaaattaatatatgtagagagtttctttgggccaagcttgcagattgcaacacaggagcacagattgaagttgccctgaatataattcaacaagcagtagttacaagtgaaaaaaagtagttaaaggcaaaaaggggagacacagagtgggctgatacaaagttgcttgtcaggaattctcattgtttcatggaaatgacgtggagtagtgattggctatacatttttggctatagtgtgtgggttatagtgtctggtgtggcattattagcttaatttatagctacttgtagcaatagcaagcagtttcaagagattaatatatagctcaaagtgggaaataggacattattgcagtctcattttaatgtctctttgggcctggtaagtactgtcttcttttttttctttttttttttttttcttttttgagacagggtctcactctgtcacccagactggagtgcaatggcaccatctcggctcactgcaacctctacctcccagcctcccaagtagctgggactataggcatgcactaccataccgtgctaaatttttgtatttttttgtagagatgaggtttccccatgttgctcaggctggccttgaactcctgagctcaagcgatctgcctgcctcagcctcccaaagtgctgggattacaggcatgggccatcgcaccaggccaggacctgataattaaaaggcctcagataaaagttcttttctcaagagacaatcttaggaccacttgctgcattatctatcagtattaataaagccactttacatttaccctataagtggaaatattttctcaactaatcacttaacagccaggttttatttgagaagcaattaaacatttatggggtctacagaagatatgaacaaatgctatataaagacatccctaataacagactataggaaaaaaattgtgctttaatgcattatccacatacagcatgtcactctgggttactagattttagcctttcatgatctttgcattttattgcatatttattttatgactctttgcaagttaaaagtgacaaagaccctccccttaggctcctttgaatcttctttttgactaactctcactcttggtctcatccttgccccacctagtctagttttagcaagaatcctcttgaatcaatatggcaaaaatcccctgcccttggcatgtgatcactattgatgactgattaggttcctcttacttcatcctctatatcttttcacagtgggctgccttcagcaagaatcctaagtcagtgtagccataatccccatagtcttgatgtttcctcttagtaattttctatcctctgatctccgccctttaccttggccataaatccccactttttcttgttgtattaagaatgggatttcattctatgctgagatctctttttccctattgcaataattcctgaataaaatttgcttttatcactttaactttctgtctggctgtggtttgctttgacaatagacatgcatattctgtcttacagagtggagttcaatcgacttcccatctcctatgggggaaaaaaaccagttttgcctctatttgtaattccatttctttactccatagaaatgtgtgactttggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaagaaatgtgtgcctttgaattttcctttcaaccaattataatatctacccgccttccttactgaatgagtaaaataaacattttaacacatgcttatttgtatgcccacatgacagtcatgatcttaccttttcttttttctttttttttttttttttttttgagacggagtctcgctctgtcgcccaggctggactgcagtggcgcaatctcagctcactgcaagctccgcctcccgggttcacgccattctcctgcctcagcctcccgagtagctgggactacaggcgcccgccaccacgcccagctaattttttgtatttttttagtagagacagggtttcaccgttttagccaggatggtctcgatctcctgacctcgtgatccgcccgcctcggcctcccaaagtgctgggattacaggcgtgagccaccgcgcccggctgatcttaccttttctagaaaattatcttttaacaattttggaagttccactgaaatgcccagtggatttacctaccaaagccaggtaacctttgcaggcagagaaatgcacttcatgggcagtgtaagcccaggtagatcttttcttggctcacagaattgaatccaagatggcaagaaaaccttgctcactctgtttttctcattctaattctcctctatactaattttacatttttggttttgggttgtttactgtcagtaagttagtccccgttgcaggaagtaatggttgggaattcacttttatgatctgattatttgatgatctctgtaaatgaattaatagttaacagagatctctgctaggtgagagatagcagagaatctagtgggttagtcttttctgtttatctgttttctattttgaactcttgcagaaaccaaattaatgttttaagaaatcaagttcagctgggtgcagtggctcacgcctgtaatgccagcactttgggaggccgagatgggagtatcgcctgaggtcaggaatttgagaccatcctggccaacatggtgaaaccccgtctctactaaaaatacaaaaaaaaaaaaaaaaaaaaatagccgggcatggtggcatgtgcctgtaatcccagctactggggaggctgatgcaggagaatagcttgaacctgggaggcagcggttgcaacgagtggagattgggccactgtactccagcctgggcgacaagaacgaaactctgtttcaaaaaaaaagaaaagaattcaagttcacataatttagataaatttttggcaaatgatacaagcttaatattattggtttaacaaaaaatacctatgtcttctttgatttactagagaatgagaataatataatgtaggtgcttatgctacttgggtatgtttttcctaatcttaaacaggttaatagattgaataagcttgccttacttctacttcatgtttaagatgtttataaatataaatttatatttactcatactgaatcattattgtgataaactttatttcaacaataattatgttttgtgtatgtcagcttcaggacaattttcaaggtctgtaagtaacttaaaaccttggaccaatggtaagttgagttaattaatggagaatcattagatagacagacagtatttcaagatagtaagatagaatactcattactactcataatttcaagtttatatccctttacttcttattttcataagactatctctttgggtctgtactgaatgtgctgctcatttctgccactttggggagtgtataaaaatgatatgtgtggctaaggcaagctgtattgtgtgtattcacaagttctgctagtctgctgcaaaatgctggtgtgacagtgaacaattatccactctccaggtctctctgtgaaatagaagtgtgttactttggctaaaagttataatggatatgtggctttggctatatttaggagccatagtttctgacaaatacagctgtgtatttccattttttgaggaaaagagtaattttgtcccaaaggagtggagtatttttggtctccaaacccccttgtgctcttcaagcttattgagaaccacaaagaaatagaactgcctttgagatttcccaaaggactcccataaagtcacaaagatttgttcttttgccttctaaaaaggcagatgttaaaaataattaggctcatgtaacattattagggctaaaaacaaaaaacttatactgtaaaatatggtgccttgacaagtcttttttttttttttttttttttttggagacaaggtccactctatcacccaggctggagggcagtggcatgatctcagctcactgcagcctgacctgccaggctcaagagatcctcccactccagcctcccaagtagctgggaccataggcacatgccaccatgcccagctaatttttgtatttttttgtagagatggggttttgccatgttgcccaggctgatcttgaactctgagctcaagcatcttcccaacttggcctcccaaagtgctgggattataggcatgacccaccatgcccagcctcttgacatgctttgaactaaaaaaccagcctcagaaacaaagtctctctgactttctcccaccctcaccctctgtcccccaatctcagtcctctgcctctctgaaagcacagggagaggctttctctcaagttcatttatgggactgcaggaagttcctccagacagaatgcaattgtcttaggtcttctccctgtaatctcagaaaacaaagaaggttaacttgctggaatgatgactagattgggcaccatacccaaagcccagacagactttctcccaggctattgtttgttcttctcccctaaaaatcatttacttttcctctaaaattgcatacatcccccactccttctcccctatgaagagagtatttaaacttcaaccatctggcccttctttgagtatcacactttgtgtgactcccgtgcacttgcacgttaataaatttttatgccttttctactgttgatctgtctattgtcattttgttttataggctcaaattcttgaactcccagggagtggaagaaaactttctttcatccctacagtgtgttattattaatgagttacatagaaagagttgtcgaattaaaaaagatacttatgcttccctagattaaatttatatgggtaaaatcatcacaaacattttacaaactaaaatccatatgtgaagttcctagagatttgtcaatgccttcactgcctatgacatggttctatttatcagagttcaggtgtagctctgcctgataatagacaatagacaatagtatacagtagacagtcataatttcagttatttttggcatgccagctttgttaagatataattcacacacaacacaatttaaccatttaaactatacaattcagccaggcatggtggctcatgcctgcaatcccagcactttgggaggctgaggcgggaggattgcttgagatcaggagtttgacatcagcctaggcaatatagggagacctcctctctacaaaaaatttttaaaaatcagccaggcatagtggtacatgcctatagccccagctacttgggaggctgatagggggattgcctgagcctgggagatcaaggctgcaagtgagccatgatcatgctactgcactccagcctgggagacaaatcaaggctttgtctcaaaaatactaataataataataataataattaggtgtataattcaatggttcttagtatattcagttatgcaaccatcaccacaatcaattttagaacatattcttcacttcaaaaagaaatcctgtaaccattaacagtcattctgcatttccccactaaccaccaacccagaattgcctatttgggacatttcgtatagatggaatcatgccatatgtgatcttttatagctggcttctttcccttagcataacattttaaggttcatttatattttaccatgtatcattacttcattccttgttatttgcaaatattattccattgtacaaatataactttttatttatccactcatcaattgataggcatttagattgttttcactctttggttattatgaatgctgatgctataaaaattcatttacaagtttttgtgtaaacatgttttcatttctcttgggtatatacttagaagtagattttctaggtcatatggtaattctatgtttaatcatttttatggcaaccctatgtttaactatcagattgttttccaaagtggctgccccatttttcagtccactagcagtgtatgagggtttcaatatctttataccttaaacaacacttggccaggcacagtggctcatgcctgtaatcccagcactttgggaggctgaggcaggtggatctcttgagcacaggagtttgagaccagcctgggcaacatggcgaaaccacatttctactaaaagtacaaaaagctagccaggtgtggtgtcatgcgcctggagtcccagttacctgggaggctgaggtgggagggtcacctgagctcaggacgttgagctgtgatcacagcactgcactctagcctggatgacagaatgagaccctgtctcaaaaaaaccgaaaaccaaaaaccactacaaccaataacaaaaacacttattatctgtctatttgattacagcatcttaatgggtatgaagtgctatcctatcaccttgagatttacttgttttcttttctccctaatggctaatgatgttaaacatcttttcatgtgtttattggccatttatatatcttctttagagaaatgttaattcgaatactttgcccattttgtacttgggttattttattgagttgtaagacttctttatgtatactaggtacaagttccttataagatgtatgagttgcaaatattttctccagttcgtggattgtctcttcacttttttgatggtgtcctttgaagcatgactgtggtgaagtccacaattttctaatttttcttttgtcaattgtgtttttggtgttacatctagaaaggctttgcctaacccaaggtcacaaagatttataccctacatttcattccaagagttttattgttttagctcttacatttaggactctgatccatttttagttaatttttgtgtatggtttgaggaagaagttcatctttattcttttgcatgtgcatatccagttgtcatatttgagaatgatgctcattttaccaaatatgaccatgttcctataagtaactaaggttgtaaacttcatgaaaccaatgcttgcaatgtcctgttgggtaagctcacctggtacctggcttataggtttccctgccttccaggtaggtttagaaggtcactttctggcaggtccaaaagtcttagcatctttgggggacctggagaagaaagcaatttgtctcatttataggaaatgcaaggaaatctgatgatgagttcttaccttggtttcttagcctcatgatagtaaataatgagaggttttaaaagcccattccgagattgcttataaaaacttccagcaaagcaaatttaaggtctctatggtaaaggaattttcttgctacacctgtatatataatcaggccagatctgtcaatgttgagagaggaggaagggagaaaccagttaggcagcagttagggtgggtcctctgttgaattctttcaaacaaaagaacagcctgaaaaatcaagctgcaggcacagataagggaacttgcacaggggcttgcctaagacatacccaccgctgcacagataagaaaggctacacaggtgacttgcccaaacattcccgcaatggaaaatttcgtcctctgacacatgcacagtgaagggaacaaagcaatatggagtaattcaagctaaaggcctgcatgcacactaggtggatgcaatggggctaccagaaatttgtgccttatggaaataaaatgtccagccctcatcggttcctataaaaggctttgtattcaactttgaaaacagcaatcctctttcaggccccctctctgcagcggagagctttcttttttagcttactaaacttttgctccaacctcacccttggtgtctgcgcttcttaattttcttggtcattacacaaagaacttcctgtgatactttgggcaatgagaaactgctacattgtggtgcactggggagactgtaaccatgtgtatcttactttgtgatcaagaataatctttcgagggttattttttattaaaagaggagagactatacaaaaaaaaattgtgtttcaatggaaaactatggattatctacatacaacacgccttgtgttacctaatctagactttctaatttttcttagagacagggctttgctctgttgcccagactgaagtcaagtggcatgatcatcactcactgcagcttgaactcttgggctcaagtgatcctcccacctcacctcacctaggactacagggatgtgtcactatgcccagctaagtgtttgtttatttgttttgtagatctggggcctctctgtgttgcccaggctggtcgttaactcctggcctcaactcatcctcccacctcagcctcccaaagtgctgggattacggttgtgagcccctgtgcccagccagtcagattttagcctttataatctctgagctattttacaactctttgtaaacggatagactacacattctgtcttgtctgatagggtttcaatgaacttatctcccctctcagggaaaaaatacctttgcctccatttgtaattccattcctttattccatataaatctgtaccttttgacttttcctttgatccagtgtaatatttgcctgcttccctcatcaaataagtaaaatctttcacacatgttcattttttatctgtatgagagtcatgattttacctttatttcaaaagttatcttttaacaatacattacaaagtgggatagagatgaaatcagataagagagaaaaagacccatgaaaatgcataggtttaggatgtacctcatttggactctgcagagacaatgaaacaaagtctcaaagaagttgatttgccgaaagatacaaccaggaaatgggggtgagataagggtgaagggtaaacaataattaatggaaaagaaattaaaatgacacaaaacatgtgaataaatgctcaatcccataatgctctcaaatccttttttaaaaagacctatcatttttcatttaagagagtggtaaagaaatagaagtgtggtactattcagggctggtaagtaggtagcaggaataggcgcatttctgctttgtgaataagggagcaggatacactctttaggaggctatttaataatatttaaatacaagtatcctttaaaccagcatttctacttttagatgtttaattggtgaaatgcttgcacaagtatgtgatgatatatgttcaaggatgttcattttcaatattgttgtaatagaaagcttggaagcaccctagatttccatcaataaaggactgtttcagaactctgtatctagaatggtgcattttttgtttaaaaatatacatatagtggtcatcttagagggatgggactataaaactttgtactccacattttttgttttacatgtttgtattacttttgccatattttttaaaaagtaaaaatatacctataagagaatccaatcttttgaacttggtacagtatcatataaatgaactcattttttcagtgcaccaatggaagcttctcagtggaggtggagagggttgtagaacagcattctgaattggacctccatgaagtagggcatagtcattactcactagtcactaagaacattttctatgggatgtgcacaatatccagacaagaattttaacaagatccacacatgctacttgagccaatgaaacactttacttaatcaattaactaatgaaggttttagggcaaataactacgactgaagaattgatgaactatagaatgtaggtgtatgtgtgtgtcttttgactgtagttcccactgaagagttgccgaatgatgaattaatgctaaatgatccagatacacatcatataaataattacttataaatattattcaaatgaaatttatctactttaaacagctatttgtgcagttaattgattttaaactgcatatacttccaatttcaaaataggctgatttgaagtagagtcttcagtaggggcgtagcatattatgattttaaaaatttaaatcttatgttacactaaaatgctgtaggaaatagatttgatcgggcaaccaaaccgatgtcatgggtcactattcgtaagtaccatggcaaataataatgattaacatttaccacagacttattgcatagaaataatttctgtaagttatgcctccaagcaactcagtgatgtaagtaatgatttatcctggcttaacagaagttaactaaagatacggagggagaaaatgaggccagggagttctctggggcctcttttataagggtacaatcccattcgtgaaaactccatttccattacccagtcctatcccaaagaccttgcctcctaacaccatcacatttcaggtgagaattttgcataggcatttgggaagggaggacaaaaatattcagtccataacaaaattcctcattgaggttgtgtgtattgactagataaaagaaattcaacagtttccatcccaaatttgtttgctatccaatatagatagcttggtttttgttttgagacagagtcttactctgtcacccaggctggagtgcagtggcacaatcatagctcactgcagccttgaccttctgggatcaggtgatcctcccacctcagcctccttagtagctgggactacaggcatgtgccactgtgcatggatcttatttatttatttatttttgtggagacagggttttgctttgttgtccaggctggacttggacttctggcctcaagtgattctcctacgttggcctcccaaaatgttaggattacagatgtgagccactgcacctggcctcataatttctgatttatattcacaataaagctaaaagaggaaacacatgtattgtggaacaaaaagcacacaaagaagctgtttgaatgtctttttaaaatttttacttttcaatgtttttattgatgtgaaatatttgaacatatttataggatacatgtaatattttgttacatgaatagaatctgtaatgatcaagtcaggatatttaggatatccatcaccatcagcattttaccatttccatgtgttgagaatgtttcaagtccttacttctagctattttgaaatgtgtaatacataattgttaaatatagtcacctatatcactataaaatattagaacttattctaactaactgtatgtacccattaacccatcctactttacttccccccacgcacactcacagatagttcccagcctctgataactgtcattctactcactacctccatgaaatcaacatttttatgagcatatgagtacatgtgataatatttgtctttctggtttttgtttttgttttgagacagggtctcaccccgtagcccaggctggagtttagtggcactatcacagctcactgcagcttccaactccctgggctcaggtgatcttcccccctgtacctcctgactagctgggactacaggcacatgccatcatgcctgtctaatttttgtatttttttttgtagagatggggttttgccatgttgtccaggctggtctcaaactcacgggctcaagtgatcagcccaccttggcctcccaaaatgctgggattacaggcatgagccaccacacctggccatatttatctttctgtgtcaggcttatttaacttaacataatgacctccagtttcatccatgttgctgcagatgacattatttcattcttttctatggctgaatagcatcctactgtgtaaatatatgacattttctttatgcattaattcattggtggacacttaagttgattccctatctttgctattgtgaatagtgcagcaataaacacaggggagtatgtatccctttgatatgctgatttcctttcttttggataaatacccagtaatgggatagctggactacaaggtagttctattttcagttttttgagtaatcttcataccattttccataatggctgtactaccttacattcccaccaacagtgtatgagagttttattttctctgcattgtcaccaacatctgttattttttgtattttttatagtcatttttactggggtaagatgatattgtggttttgattagcatttccctgataattagtgattttgagcatttttattatacctgttggccatttgtaggtcttccttggaggaatgtctatttagatccttgcccaacttttaaatggggttgtttgtgtttttgctgttgagttgtttcagttccttgtatattctggatattagtccttgtcagataaataatttgcaaatattttcttccattgaataggttatctctttgctctgttgattgtttactttgctgtgtggagctttgtagtttaatataacttcatttgttaagttttggttttgttgcttgtatttttggggtcttagccataaaatctttgcttaggcaaaagtcctagagtattccccgctatgtttttttctagttgttttatagtttagggtcttacgtttaagtcctcaatccatcttcatttgatttttgaatatggtgagagataggggtttaatttcattcttctgcatataaatatccagttttctcagcaccatttattgaagaggatgtcctttcccccagtgcatgttcctggcacatttgtctaaaatcagctgtctataaatatgtaagtttatttctgggttctctattttgttccgttggtctgtgtttttctttttataccaatatcatgctgatttggctactatggcctgataatatattttaaagtcaggtagtgtggtgcctccagcttggttattttcattcagaattgctttggctatttaggctcttttttggttccatacaaattttaggatttatttttttctatttctgtaaagaatgtcattggcattttgataggaattgctttagtagtatggtcattttacaatattaattcttccaatccatgagcatggaatatctttacgtttgtttgtgacctttgcaatttctttcactggtgttttgtagttttccttgtagagatctttcacctccttggttaaatttattcctagtttttttgtttttgtttttgtttttgttttgtcattgtacatgggatttctttattatttttcagctaattcattattgacattataaggtatatagaaatgctactgatttttgtatgttgattttgttttctgaaactttactgaatttgtttatttgctctaggagtcttttgaaggaatctatagggttttctagatatagaattatgttgtcagtgaacagagataatttggtttcctctttttctatttggatgccttttatttctatctcttatttgattgctctggcgaagactcccagtagtatgttgcatagaaatggtaaaagtgggcatcctcgcttgttttagttcttaggggaaagggttttagtttttccccatcagtgtgttaactgtgggtttgtcatacatggtctttattatgttgaggtatgttccttctgtgcagagtttgttgagtgttgtttatcatgaagggatgttgaattttatcaaatgctttttctgcatctattaggtgatcatgtagtttttgtcttttgttctgctgaggtgatatatcacatttactgtttacatatgtagaaccatgcttgcaatcctggggtaaattccacttgattgtggtatattatctttttgaggtgctgctagatttggtttgctaatattttgttgaggatttctatgtctacgttcattagtttattgacctgtcattttctttctgtgttgtgtttttgtttggctttgttaccaaggtaatactggttttacagaatgagttagggcaaattcccacctcttctcttttttagaatagtttgaggagaattgaaattagttcttctttataagtttggtagaattatgcagtaaagccattatgttttcagcttttctttgttgggagacttttaaatttgttttcaatctcattacactttattgatctgttcaggttttctatttcttcctgatttgatcttagtaggttgcatgtttccagggatttatccattttctctaggttttgcagtttgttagtgtgtagttgttcataatagtatctgatgatcttttgtatttctgtggttatcagttgtaatgcctcctttttatttctaattttatttgggtcttctctctttcttcactggtctagctagtggtctgccaatattatttatcttttcaaaaaacccactttttgtttgctgatttttttgtatatttttagtcccataggttttagtatgctatgtttccattttcatttgtttcaagaaatttttggcttctttctttccttccttccttccttccttccttccttctttctttcttttttctttttttgagacactctcactctgttacgcaggctggagtggagtggcacaatctcggctcactgcaacctccgcctaccaggttcaaccaattctcatgtctcagccccccgagtagctgaaactaaagtcatgtatcaccacatctgcctaatttttgtatttttagtagagatggggtttcaccatgttggccaggctggtctcgaactcctggtctcaagtgacctgcccacctcaacctcccaaagtgctgggattacaggcacgagccaccatgcccagcctgatttgcttcttaatttctttgttaacccaatggtcattcaggagcatattgtttaatttcatgtatttgtacagtttccagaaaccctcttgttttttatttctagttttatttcattgtggtcagagaagatacatgatatgatttcaatgtttaaacatttgttgaggcttgttttgtattctaacatatgggctatctttgaaaatattccatgtgctgatgaatgtgtactctgtagctgtcagatgaaaagctctgtaaatgtctgttaggtccatttgatctaaaatatgcagtttaaacccaatattcctttgttgatattctgtgtagataatctgtcagttgctgacaatggggtattgaagtccccaaccattattatattggagcctattcctcactttagagctaataatatctgttttacatttccaggtgctcttgtgttgggtgcatatatatttagacttattacatcctcttgcccaggcacggtggctcacacctgtaaccccagagctttgggaggccaaggcaagaggatcactcaagactaggagttacagactagcctcagtaacatagtgagaccccatcttacacaaaattttaaaaaattagccaagtacggggcatgtgcctgagggtgaagtgagaggattgcttgagcccaggaggttgaggctggagtgagccatgattgtgccattcccttccagcttgagtgacagagcaacagagcgaggctctgtctcaaaataaaaaaagagagaaaaaagatttttatatcctcttaatgaattgatatctttatcattatataattaccttttgtctctttttgctgtttttcacttaaagtctgttttatatgctataaatatagcacattctgcttatttttggtttctgtttgtggaatattttttccatccctttgcttttagtctatatatgtcttcacacgtgaaataagtttcttgtagataagacatagttaagtcatgttctcttacccattcatccagtctatatcttttaggtggaaattttaatttgtttacattcaaggtaactgctgatatgtgaggacttattcctgtcattctgttaattgttctctggttgttttgtatatcctttgttattttcttcctctcttattttttatctttatggtttggtgattttatgtagttgtaacatttgagtcctttctctttctcgtgtgtgttttctctattcattagttttatactttcatgtgttttcatgatagtagatatggtccttttgcttccaagcacagaactcctttatgcatttcttgtaggtctggtctagtagagatgaattgcctcagcttttccttgtctgggaaagtctttatctttttcttcatttatgaaggataatttagctgggtatagtattcttgagtagccatttttttcacttagcactttgaatatatcattccgctctcttttggcctgtcatgtttctgctgagaagtcaatttttagtctggtgaggattctcttatatgtgactaggtactgttctcttgctgttttaaaattctttctttgtctttgacttttaacagtttggctacaatatgacaggaaaaagcctttttttggattgtatctgtttggggatctttgagcttcctgtatttggatgtctaaatctcttgctagaactgggaaattttcagctaatattttgttaaataggcatttctatggcattaacttctccttgccttctgggacacaaaacatttggatattttgtcacttatgatgtcccatatatcagatagcctttcctcattctcttgtattcttttttttttttgtctgattggattatttcaaaagacctctcttcaagtttttcaagtttcttctgcttgatctagtctatcattgaagctcttgattatatttttaaattttatttattgaattcttcagttccaggatttgtttagttcttttttatagtgtctatctctttggtgaatttcccattcatatagtgaattatttttctgatttgatttctttgtattgttcatctccattcttttgtatctcactgagcttctttaatgttatttttaatttctcaagcatttcataaatttctcaagcatttcataaattactattttttgaaatctgttgttggaaaattattatgttcctttggaggtttcatatttccttgttttttcatgtttcctatttcctttttttttttagatggagtcttgctcttgctgcccaggttggagcacagtggtgcgatctctgctcattgcaacctccgcctctcgggttcaagcaattctccttcctcagcctccccagtagctggaattacaggtgcccaccaccacacctggataatttttttgtatttttagtacagacagggtttcaccatgctgtccaggctggtctctaactcctgacctcaggtgatccacccgccttggcctcccaaagtgctgggatcacaggcgtaagccaccacgcccagcctcctatttcctttcattgacatttgcacatcaggtgtaacagtctcttcttctatttttggattggcttttgcatggggaagactttttcctgtaggtgaatctatggtgttggttgggtagggcacttttgctttgattctgggtgtgtgcagtagtgcaggctcataggagttcctcggctataaactcagtcagtggtgtttgtgattttctcagtagcttgggctctggttgttaatggaagctgtggtgaggtttttctggggacaggacaaccctcaggcttccaggtggcacttgctggccggtcttgcttccttctttctttctttctttctttctttctttctttctttctttctttctttctttctttctttccttccttccttcttttcttttttctttctttctttccttctttctttctttctctttctttatctttctttctcttcctctttctctctttccttccttccctttcttccttccttcctttctttttctttctttcttatttctttttttttttttttgtctgtgatggtctaagcaggccattccctaggtccccaggtggcacatgcagttgtgtgctggtggtggtggtgatggaaggctgggcaggcccatcttcaggaccccacgaggagttcccagatgccagtagttatgaatgaggcagggagatgcccaggcctccagagagcatgcttggttgctggttgctggttttctaggcctgttgttaggccctttgcttgtgtgcatgtgttcccagggcaactgttggggtggtgtggccccaggctcccaggtggtgtgtttggggcactgaggggccaagcctggtaagatgggtctgtttttaggtgtcctgttggcccacttaagtgttggctttagtgggtggggcagggcaggcccccaggcctctggaaggtatgatagggtgccagcagtggcaggtgttctgaggctattattaggccccctgctggtttgcatcctcacctgggtgactgataggatgggctaacccctgggtccccaggtggaaggtttgggaacgggggggtgtggttccagtctgggtgggcctatccttaagctccccattgttgcgtatggccacaggctgtggtgagcattgtgggtcgatccccaattcttgggcagtgtgctcaggcagggatagtagcagtggcagtgggcagtaaaaacccatcctgaaggcatatgcaagtgtgcagtagccctgctagggatgggggtgctatttgtggtagccatcccaggaaggtggggttcagactctggacagtatgtactttggctcccagtaacagcagtggctgaagcagctggcaaggatagcccggactccaggcataagcaagtgcatggcagccctgctgctggggagagcattagggttgctgtttgtgaccacagcttaaggtagatggatttcagactctggggtgtaagcactttggctccctcctccctggtgtgctgcacctctctctccccagtgtataggacactgtacgggctagattgctggggatcctgctgttctactggttccaactggcatctcacctctgtagcccttctggtggatgtggggaaatgtcactgggactccagggaggtggagatgcaggagctgtggggcactgggacaggatgtagcttggtggaagttgggctctcaaaatggtgtcatgctgcagctgcctgggagttaggagacggggtggtgtgagacccactatgagctccctctctggagcaaaactctctcatggactctagggagctcctcatgccagtctcagggcctgcagggcttgaggaactctcccatggctagtattacaggaatctgtggtaaggatgtggaccactggggatcttgcacttcccctttccttgcactgaggagcctctctgagctcccagctgatcctggctgggctgtcggtttcacctctggctccttcagtgcctcaggtgtttcttgtcactttgttaaattctagctttctctcttagatgttctgttccaagtgtgagtatctactcaccattttggttctttgtggaggagctgagtgtcttgtgcctctagtcagtcatctcaaaacgtcactgctcagacttcttttttttttttcttaaatagagacaggatcttgctatgttgcccaggcaagttggtcttgaactcctgggttcaagcaatcctcccacctcagcctcccgcagtgctgggataacaggcatgagccaccacacctggcccaaacttctcgagagtagtagtgtttgacttttgtcttctgtggtgtaattattctctaatagcttgggattgaactctgacatgataaacagtgagtgtatgctactgagagaccaaaaagattggaatagttcacaaagggatataggagactctatttcccaggaggtcctgaacaaagatttacccacttagagtaagtataggcagggatacccttgaagctagaacactaagaggtggcacttatatgactctattcttgagaaaatttattttttccccctcgtggttggttataacatcgaaatagttaaatgaaacttgctctgagttgttatttgtctgccaccctcccctttagagaaactgatttctgaataatttctcttgtacatgcattttaaaggtgtgtaattaactggtaacaggttgttaggtagctgatgaggtgtgaagtagccactaatttgttttctttatttacaactttccctgctcttgaagatgacagcatgatgtttttcattccctgcttacttcaccagattgaaaagtgatttgtgaagccatttttaatccctcaaattccattaaaaaggaatctccaagggagtcttaatcaagacataatagacactaaaatgtgatcacacaacagcacttctaatatggccctatttcaactataatgttaagcgtttgcctccagtttactgaactcagccctaacactgacctacaacttctgaaatgaaataacctctatgcagttggcaattactttattgtaaatgtttgcagctaacatactttattgctttagaatttaacatataccccaaagggataattcgttaccaaattattatagtattatcagtaaaatagtttgctttccccttcaaattgccttttcccctacttaataatatatataatttaaatcagtttaagaaattaaaatggaaacataatgaaatgagaatcattaaaaacaccacactagaatactgaaaatgaagctgaaacagaaatggctaaatgtaaaatttgtatgtaaccaaaaggggtaatttgaaaccagggagcatattgagttattggatgagtttgatgaaaataaaaactctgtccttgaagttttaaaaatattaccaaaagtaagctacagaatatgtaaagaatatatcatggagaactccccttcacccttgaatagacagttaaccaacatgcaacaaagcacagatgttagatacgtggcaacattttcctttctacctgtcagagcctacattaatacttccatcgagaacattgtggcctccaggatactattttcaaatgtagatatgtctcagagcatcaatgctacaagttgctatggtgatcacttttgtatgataataaccaatgctcactgagtttttgatttatggcaggcactgttttaagtgctttatagtattaactcctttaatcttcacaacaatcctataaatctcattaggactctaagaatcctattaggattcttattttatagacaagggaactgaggcccaattttacagttaaaagtaatttggctaaggttacatagtgttggagaaattaaaaacaaaatctcttcccaatctctcagcaaagaaagaagagaaaggtaacagttttattattgaataagcactaaaccagaatgtgatgcccatcacaggcaatatgctaagagattgcaaagacagaaagaaatctcagccttttccatagccaagcagataccagatacaacccattacatacatgttttcttttctcttttttttttttttttttttttgagatgaagtctcgctctgtcatccaggctggagtgcagtgacatgatctcggctcactgcaacttctgccccctgggttcaagtgattgttctgcctcagcgtctcaagtagctgggactacaggctcccatcaccacactcagcgaatttttgtatttttagtagagatggggtttcaccatgttggccaggctggtctcgaactcctgacctcaagtgatccacccgccttggcctcccaaagtgccaggattacaggcatgagccaccatgtccggctacatatatgttttcaagataaataattatagtaagaggtctgtcagcactatttgtcacacatagttatcctcattttacttgatattttgtggtgttagctaattggctttatccagaagaaaaaacaagcatctcatctctttataataggaggtagttttgcagcttggagcaaggtatctaccaaagttaggctcctaccttcccacagaagacaggggtactatctcctctgatgtttacatttcaaagagatggctcctaggtcttaaaagtgacaaaaggcctatcattttcaaatggaattttatacatttcaaagagaggaggaagtccttacaattagaagggtttttgttttgttttgttttgataaatgctttaagaagaaggagaggatgaaaagtctcttcctttattttcatttttttctttcttttctctctctgtgtgtgtttgtgtgtgtgtgtgtgtgttttgtttttttgagacagggtcatactctgtcacccaggctgaagtacagtggcacaatcatggctcacagcagcctcgaacccctcagattcaagtgattctcccacctcaggctcccgagtagctgggactacaggtgcatgcctccacacccagctaatttttgtatttttcatagagacagggtctcactatgttgcccaggctgatcttgaactcctggcttcaagcaatctgcctgcctcagcctcccaaagtgttgggattacaggcgtgagcccctgcatctggccttatttttaatttgcatttgtccttacaacagataataagtagtggagttaggatttaagatagtctagctttaatttttttttttttttgagacagagtcttgctctgtcacccaggctggacgcagtggcatgatctcacctccacctcctgggttcaagcaattctcctgcctctcagcctcccgaatagctgggaccacatgcacgtgccaccatacctggccaacttttgtatttttagtagagacggggtttcaccatgttggccaggatggtctcgaactcctgacctcaagtgttccacccatcttggcctcccaaagtgctgggattacagacatgagccaccactcccagccactttaaagcctttttaagaatcctatactatgccatctttgtaagcttcctacttggaagccattgaacagaggcaatatactgaggaaattaatatattcactcaacacttacttaatgagcacctactatgtaccaggcactttgctagttattaaggatataattatgaataaaacagacaacagttttgccctcatggaacttagggtctaggtggagagactcatattaaacaaatagttcttcaaggttatcaaacaaaattatgaaaactgagaagaatgaaaagtataaagagttttgagagcatattaaagagagaatgtcaactagtccaggtggtcttgagggctatttaagttcaaaataggagttttgatgaagaagaaaggaagataacaaaaggataatttgaggtataaaggaaaacaaaaaaaatctcaggacccctaaacttcttattgcaaaagaggttaagctgcgaggctgagttaggcaacaccctcttccaaatgaacagctgttactaacatgcatcagccagatccccatggaaagataaaaggcctcaagcatctatgaagggctgcccccacacatcattcataagttctttgccggtctcctataaacaaggacatgccaatttaacttaaggtcttcctaaaattaaagtctgttcagttccacactgatagtgtagtacaagtttatcttcccaggtgcagaacaaagacaagactcatttctccacctagccagtgatgcctgcataactgaatcttcctttactccctttttctcttcaaaccttcaccttatcttatgtaaaatgtagattgaccaggcactaaccaaagtcccccgggaatgtaaccattcgcccgacctcctacctgcccctcttcctacactccttcccaactttaagaaaatgtataaatacgaaaactcttgagagtctctttggaaaaaacagccacagatgtgtctgtggcttgtgtttttcccagacgtgcttaaagctggcttaataaaccttgatgattgagatttgtgcctcattttggttgtcccagctttggggtattagattgggaggaataggattaaaaagtaggaatgctaccaggcacagtgactcgtgcctgtaatcccagcactttgggaggctgaggcaggcagatcatgaggtcaggagtttgagaccagcctgaccaacatggtaaaaccctgtctctactaaaaatacaaaaattagccaggtgtggtggtgtgtgcctgtagtcccagctactggggaggccgaggcaggataatcgcttgaacctgggaggtggaggttgcagtgagctgagatcataccaccgcactccagcctgggtgacagagcaagactccatcaaaaaaaaaaaaaaaaacaaaaaagtaatgccacactttgaacacttattctgccggactgaaataatatcatttgatagcacacatagaggtggaaaaggaatgatccttttcctccccatcataaagcatcatggctgatgccccagtttgggtgctcagaaacagatgccccaaaatatgagactcccccatctcaaaaaaacaaagttgggcactgttgattaatattttaaatgcttactcattatttttctagtttattcctttaatattttatttcattttttatttacacaagtagttcatagatatacaatttacacaaggtgctacagattgaatgtttgtgcccccctccattcatatgttgaaatcctagcccacaaggtgatggcattaggaggtggggcatttgggaggtgaataggtcatgagggtggagccctcatgaataagattagtgtccctataaaagaggccaggagaaatccttcaccccttccatcatgtgaggacacagtgagaagacatccatctttgaaacaggaagaatgcatttcacagacattgaatctactgataatgttgatcttggattacccagccttcagaactgtgaagaataaatttctgttatttataagactcagtgcccttataaaaagtccccacagggacaaagacaatagtgttctttatttatttagtagagacagggtctcactatgttgcctaggctggtcttgaactcctggcttcaagagatcctcctgccttggcctcccaaaatgctaagattacaggcacgagccacaccttgccaacagtgatatattttatcttacttttttccccactctattcaggaacttctctgtgattccagatgttcaaagtatttcatcacagctttatttgtcttaaatccagatgtctttcgttaaatgaaaaaatgagcaaccaccaacaagctgagattatcttcttccaatgagcaatgagtcagaactgggctggactttcagtgatccttttaattttattttgtttaaatgctattgggagtaaacccatgaatgcactgtgaccccagaaaggcatgaagggcaggagaggaagaattagctatgagcaaatggggaaggcaggcagtgagctgctttgcattaaaattctaaaagttggttgtggcaggggacaagtgcccggagagaaagagaatgtaagggaagtgagccaaataataatttctctcaaacctagcaaaaatttgactgagatttatgagagtttaaagccctccctctatgcttactccatgtctctttatataatttttttttctttttggtttatgtcccccttcccccttggatttaagctaaatttagactttctttaggattaaaacaagcttaataaaagttcttggagcaggatttttggagtgagagtttaaaggattaattcacctgtcacgtgactgctatatagaggaggatcacagaaatgtaatcacgagtttgcatttattattgtcaaaccaggaagaccccttgcctgaaccgttatataatactttctaaactataattttcaaaaagggacatttatgactcttgccaaatataaaatatagacatgtcacacatttccttttttttcctttaactcattaattaatcagagaactattaagatactgaaaacagttcagaccaggtgcaatgacttacgcctgtaatcccaacactttgggaggccgaggtgggcagatcacttgaggtcaggagtttgagaccagcctgaccaacatggtaaaaccctgtatcccatctctattaaaaatacaaaaattagctgagcagggtggcacttgcctgtagtcccagctacttaggaggctgaggcaggagaagcacttgagcctgggaggcggaagttgcagtgagccaagatcacaccactgtactacaaccagggcaacagagtgagactctgtctaaaaaaacaaaaaacaaacaaacaaaaaaacccaaaaaattcaaataaaaatttgaataacaggtatgtgtgtatgtaggataccaaaaatgctgaaatgaacttgttaataggtgcatactggttaatattttataggtcttaaaatgtcatgtttggggattatctcttctaaaagttagaaatcaattgcaactctaccagacaaaaatttttatttgcatttttttttcttagacagagtctcattctgtcgcccaggatggagtgcagtggtgtgatctcggctcactgcagcctctgcctcctgggttcaagcgattctcctgcctcagcctcctgaatagctgggactacaggcgcgcgccaccatgcctggctaatttgttttgtatttttagtgcagatggggtttcaccatgttggccaggatggtcttaatctcctgacttcgtgatctgcccaccttggcctcccaaagtgtatttgcatttttttttttttttttttgagacagagtatcgctctgtcacccaggctggagtgctttggtgcgatcttggctcactgcaacctccacctcccgggttcaaatgattctcctgcctcagcctcctgagcagctgggactacaggcacgtgccaccacgcccagctaatttttgtatttttagtagagacggggtttcaccaggttgaccaagatggtctcgatctcttgacttcgtgatccgcccacctcggccttccaaagtgctgggattacaggtgtgagccaccacacccggccatgtgtatttgcatttttatggaaaaaatattttgtattactacagaaaagaaacatttgggt

SEQ ID NO: 857 - DNA, 4146 bp, Homo sapiens
aattgaccacttgaacacaattctttccctcttatttccaaattctattcctgtgtagcaggaatagaagaaaaagccagcatcattgagggttaatgaatttggcctataagggctaataaatatctacaaacaaactttggaaagagtcattaacaggactttgatttcccatttgccttagtagcaaatttagcagcactttttaaactgcctcatggatgactatctccattagtttttttttttaataagaaaacagtaaacactatgcatggtagtgttgtatcctcagtgcttctaatataatttcttcatatttctagtattacatttatctcactgcattctaattattgttctgtctcccctgctagactgggagcttcttaaaggtaatgcaccatttttattcatatttgtatttcaattacttgacacaatattcagcacttaagcaatttatgtaataactactggatggattgtaataacaataatagttaaggatgcagatctagagctagtttagttgggataaatcctggctttactgcttatttgttttgtgaccttgtgaaattactaaacctctctgtgccccagttttttcatcacaatgtgaaataataataagacctttgtcttggtcaatttgggctgttctaacaaaaatattatgtaccgactggcttaaacaacaaacatctgtttttcgtagttctgtggctgggaagtccaagatcaaggtgccagcatattcagtatatagtgagggctctttttctggttagcagacagcctccttctttctgtatcctcatatggctgagagaaagaaaggtcatctctctggtgtctcttctcataagggcactaatcccgtagtgaaagctccaccctcatgacctaattaccttccagaggatccatcttcaaatatcatcacattaaaattagggttttagcatttgaattttgaggacatacaaacattcagtccatagcaaacctcctcaaacaattgttgtgataattaaataaattaatctatttaaagcacttagaagattgctagacatacagtaagtgctcaatacacacatatatgttattgaattattaaatagaataatgcctctagcattcattactgctgttcaattttgtcttcattgttattttattttatgtcttcctgtgtaattcccttgtggcaatttcataattgctatagctttttttgtttgaccctccacatctcatgttcaaatttgatccccattgttggaggtagggcctaatgaaagctgtttgggtcatgggggtggatccctcacaaatatcttggtaccgtcctctggtaatgagtgagttttaactctattagctcccatgagagctggttgttaaaaagagcctggcacctccccctgcattctctcttgcttcctctctcaccatatgatctctacacatgccagctcccctttgccttccaccatgagtggaggcagcttgaagccttcatcagaaacagatgctggagccatgctttctatacagcctgaagaaccatgagccagtttatttataaattacccagcctcaggtattcctttatagcaacataaatgaactaagacaataatctacaaattcatttacttgattactggcaaattactcccatgagagtgagaacgttttctgtgaagttctctacccattccatgcataacacagcatctacacacagcagagattagtaacagtttgttaaaggagtaaattgatccacttttaccttctgtaaagaccaatttaaatctttcttatattgctaacactgaacctcctggttcaaagttaaaaaaaagataaggcgcagtaacaacagagtttcaggaagatctgggaaagaaagatttcctattattttttatttatttatttatttttgagacagattctcactctgttgcccaggctacagtgcagtggcataatctcggctcactgcaacctctgcctcccggattcaagcgattcttccacctcagcctctcgagtagctgggactacaggcacgtgccaccacacctggctaatttttgtattttttagtagagacggggtttcaccatatcggacaggctggtctcctgaccttattatccacccacctcagcctcccaaagtgctgggattactgacgtgaccccctgcacctggcctatttcctattaattctaggactaactacctgaaaataggataataccttgcatcactacattaatatactcatttttattgtcccctgtttctgagagtaacaacttcaaatctcctaccttctttcctgactttgacttcctataccgtcagctcttcagggcagtcttgacattggaataataataataacatcatgttcttagacaaagactgatccactctcagaaatcaggttaaaggttattttatgtgattcttttttgttttaatatgatttataaagagggagagtcaatgttgaagaatcagctattttaaaattgatccctctactggagtactaaaaagtatttgtgaaatgaacacgaataatctttataacattaaacattgcaaaacccaaatgcaaaatagtcctatttaacataaagtctttcatattgttctgttctgccatccttctatacatttgcccagacaggacagcaacaaggaaagaatatgtaaacactaatcatttctaacttgccatctgtgacagttcactgtgctgaaattagaaaggatggaatcacttttccatttccttaaggtcaccaaggacagacaagctcaggacatactgtatttgtcagaagaaaaagagatgactggtgaggtggcagtgacaaatctgttctaggttcagctcattttactgaagaatgtgtgtccccttctgacatttatcaaaagaaattcaattttataaaaagaaggatgtcaaataatagtacattgctaacactcattttgttgctgtcagaagggcagatgggggcaaaaagggaaaagggtggatggaagagaaagttattccagcaagaaacaaacaaagtcatgctaataatacacttataggcttgaatatatttctgattaaaacacctatttttgagatccatcttagtgcctggctcacactttagaataccagttttcacttcttccagacagaaggaacgacacaaagcaggttgatttgtgggttttgtgtttgtttttggttttgtattttgttattgtttgagtgccattctgctgcaccaggaaggaaagaaagctaatgaaacctggtaaaaccccaggtacaatgacatgcaccctgtgggcatgcaatcaatagttcttatggtgatgatgatgtttttctctggcagaaaagggtattttgggtcaaaaaataacccaaaagttgtgacagaggtaacggaaaaatagaagtcagattaaaatcaaaggaagaaattctaacccaaaagttgtgacagaggtaacggaaaaatagaagtcagattaaaatcaaaggaagaaattctatcaggagactaataatgaagctgacaatatactgtaacaagtaatagtgttttaccatactgcataaaaatattggattaagatacaaattaaatctctttctcagtgagggttttctgcagaacataaacaattaagctgctttctggagaagacaggaaacttgattaacagatccaaaaagacagcatagggaagatgggtttaacactaggaggtgaaacaccaactgttatccaaattgacttttccagaaacgttggataatttcaatcaaggactgaaatatactcttttctttttaagcgtcagtgttctctggacttaaacaagtcaaaggaggttcttattaaataaatgctactggtgcatatgttccagtcacagtctcctgaggtgagtatggagacactacagaaaattgaaccatgaaatagggttttgtgtctctataccaaaatttcaaatatctggaggtgtcctagctcatggtggctaagcaggcagcttgtgggagtacaggaggctacaggagacgccaggagt

SEQ ID NO: 858 - DNA, 475312 bp, Homo sapiens
aaagaaaaaaatgctctctctagtctgcataaactggctgaagttttgatctgatgtgacaattcctctaaatatggctccagatctgcccttagaatcatataatactgtgagtaacaacacaggtcagaacggctctcggtcatattcctggctcaactactcaatagcagagtgactttaagcaagttctgagtcttattttcctaacccgtacaagcagttattattaccctatgggctgctgtgtggatcaacttacataatgaactcaaagttcctacaacatgggtgtaccaggtcactctggttaaccacagctccttgtgaagcagtgattcatactttccagcatgtatcacatgctgcaatcaaactggaatccataactattccctaaacacgccctgataatttctgctttgattcatgctacttctacaaatgatgcctttttccaccataactgcctaccaaaatcttatccttctttcaatacttttgcaaatgctacttcctttatgaagcatttttcccaattctcctctgttattaggactcgttcattctggaactctgttcttccatcatacttatatctggccttagagttataatgcccttgtcatatctttctctttctttagattctaagttcccaaaaataatgtaaacttcttcaatatttaccaaaaactaccaattgaattgaatgtttgagtggagaatatatgcattttcagagatatatacaaacaggtagagatctggaaaactgtttcagctcccaatgtcctccctcaatatggactaaattccactgaacttgatagctatgtcagtcactacattttcgaactgcatttcctagtggggctgttataatttgtgtccatttttttttcattaatttacatgtatttgtgaagtaggtttcaagaaagggattgaaataaacacatttttattctgccaccattttacaaaaaaacctgcctcatttccgaataaataaatacagcctacatataatgtatattaactcaaatatttcaattctctcatttaagtatgcgagtatttctatttaaagttctttgattctaaaactaagagtaactggacaacctgtcagttccctgtaatttccttttgcaccttcacacactgtcagcaatacaaccacagttaattaaaatatgtacgtggaacatgtaaaatagcatcaaatatgaaatatgtaaaagttgaaaacactaaaagaagccaaaactaaaaatgattctccttaacacattaaaaacagtactatgtctgaatagaaaaagaaaagccaatggtaatcactaaagttattctcctgtaacaatgttaacctatataatttgatttgagtaagaagtttacagaatgttagtctgatataacaaaccaattagaagaagcataagctttatctttcactatcattctgttttttggtgaaggagctttgagcagtaaataatttactatcaaaagcagcaaactctgctaaagttaaaattacaatcttatgagtgcatgtgcattagggatcatgttaaaaccatcaacctcatttcagtagatgtcttatctcacataaagtatgctgctagacataaagcatcagtggtttacctctaaatgatccagtccctccaggaaactgggtgtagttttaataaaattgaactcataagtttttattacatttataatgaatgcttttcagttttataggctctttgaaggagcaatttagtttctctattaaaacatgactttatatccttcacaactctcaggtttcaattttatgttgctaccactctcaatataaatgaagatattgaagttttaataaaggtatagagttatttttattgtacatatgaaatgtgagtttacaaaattacagggaaaagtacagcatattaaaatttctttctattcttacttttctgtatcctttctgccacacaaaactaaccaaaggtgatataacatatttaggtattaataaagcaggattcatgatattgtcttttcttagaataaagcataatctaatctttcaaaaatgtcttattagcacagtcgaaagtgtaatactgtttaatttaacttgttggatctttaatcaatctctttattacatctagtggaactatataaaattttcaaacatattggctttatttacaccatcaaagtttgcccaacagtagggattattacaaatgaacaacagaacattttgtttgtattttgtttgtctactttcccaactaaagaacctggtatatactgggttctattttggaagcttacatttaaaaattgaggaaggtattatttctgcccgtgaagaactcactatctgctggaaaaaaaagaaacagacacatataccattataatacactgttatatggctgtaataaataatagacataataaatatctatatccataatagataatttagagcaataatgggaccactgaggaaaagcaatcaactctgccctggcagagaaacagttcatggagatttcacctagaacttgaggaataaaaggaattccacaaacagataaaagacaaaaaggcattacaaacaataggaagaacccattaacataactgccaatagtatttagtactcctgcaagaactaatattgtcattgttgcttattttattcaataacaatttgaacaaaattatagtactatagtgaaaaaccaaagagcttttccttgtggaaaattcttttggaaaattcttttagattaagtcttctataaagacaaaatcagatcctactcatacaatcctgattcccatcttggcttgtttggatgtttagaaacaattcttatctgttctaagaaacacatatgaaaaagcttgtatcaaacacatatgcttggagggtctgaagacatcttttaaacacaaacaattcattaaatggaaatgcaaagcatgcctacatcctactactatataatgaaaatcgatgtgttatcaccaaccaacatttaacgtatcaaatccaaaaaaaaaaaaaactgcgtcaatttcaggaatgtaatctttatacagttttttgagaattataatataactgctatggtctgaatgttggtgtccacccaaaattcctatgttgaaacctaatccccactgcaatagtattaagaggtggagcctctgggcacagtggctcacacctgtagtcccaacactttgggaggctgaggggggcagactgcttgagcctaggagttcaagatcagcctgggcaatctggtgaaaactcatctctaaaaaaaatacaaaaaatttgctaggcatggtggcatgtacctatagtcccagctactcagtaagtgaggtgggaagatcgcttgagcctgggagacaggggttgcagtgagctgagattgcgccactgcactccagccttggcaacagagcaagaccctgtctcaaaaaaaaaaaaaggaaaaaaaaagagagatgaggtttctaagagctgattaggttgtgagggctccgccctcatgaatgagattagtgcccttataaaagaggctaaagagcttgtttgccccttccatcatgtgggaacacagcaagaaaacactggctatgtggaataagcccaaaccagaaactgaatatactggcatcttgatcttggacttcccagtctccagaactgtgagaaataaagttctgttgtttttaagctacccagtgcttgttaaagcagcccaaatagatattaaccaagccacatgcaaaactagacattaatttcaaagcccatcttttgaaaagtagcttctccatttgactaaacaggttcctagtgttgtaataaataacatcatttgacccatcattcaaagcgtaattgtcacttgagagacaattaaaagttaaatgaagaatttctgtttcctttgatatcaggttataaatttccatgacacccactcttggcagaaaaagtcagtgtaattaaaatccattaatggaacttaaatttgtctggaaaaggaagctgttaactggagtgctggcccctaagtccaccatgctaacaattctctgataacaagtttcaagaatcaaaaataactgtactcacgcactcatagcttcctgtcatgtagaattcattgttatggaagtgtcttctttctcccatggaggcctatcatttaaactgatctactccaaataaacccaacggggcaaagatgagtgtcctcacagttagtttcactcgtgaacccagccagcaattcaagtgcctccactttgttctaggttgctgcactctaatgatcgacagtacagaggatatgtagaattgactcttcacagagactggctaaaacagtgctaaaatataacatcaaaggaaaatattatccaagcaaaaaaggagtttggggaaatgaactacttctctttagaaatgagataaagaaataataagcaactttacactatgaactctatctagttgacccaataatgattgattagtagagtagaaacagagatgagtgtgaaggggatgttaggaatttgtagagacctagcctcttgaaatccattttggaaaatgatggacagaaacaatcaagcaaataaagaaatccataggtgaccaccatattgagagaccaagtttaatatagatggcttgagtattgatctcttgccctaaactataaacattaatggttatggggaagtaatctaccctctgtaaataggccattggccatccaaaaatgagaagtgactattacaacctcccaaactagtactatctattcagacacagatgcaagtaaaaagaagaagggtgatattcaaagggatgatagttcatttgagatgaattaattcttgaaacaaatgctaacataaaaagaagtcagtcaccttaataggcaagacggttttttttcttttaccatattcattcaataaacatttattgagggcatcctatataccaggtgctgatcttggcactgggatacagcaaaaaacaaaacagataccagtccctgttctcatggagtttttattctaatgaaggaaacaaacagaaaaaaaaatcaagaaaaatatatagtatgtcagatggcaacaagcgttttgaagaaaatgaaggcaagatagatacagattattggggaaggtgttactttaaataaggcagtcagaaaatataaggcataggtttttaaaacaataaaaaagaaataatgtttgggaaagagtagcctagggtaatattacattattatactggttctttttttttttttttttcaattaaaactgaaggaccaaagaaacccaaggaattagattcatgatgctacttgttctgcttctatcaccatcaaacattaggtaaaataattcttctttgccttcaccttgtccattttctggaggaagggacataggtttgatacaacaaatcaaaaaaacaaaaaagatcctcggggtatttatgcagtataataaagagcaaagcaatgtaattccaaaaagatagctctcaaatatttgaaaaaaaatcactaaatcctaaaacttctcttggaaacaatttccatgtctcaagaccattacattggttacccttgtaagaattttcttaggaatagtttaaaatggttactttgataatacaaaagatctcacactatagaactgctgaatggactcacaaatcacttatacttttaaagtctaaccatcccaatgtacactcagaaaggaaataaatctgacattcaaaaaatattcttttaccttttatagtatctacattttaaaatattattctaaaataatatcattcctctagtggatgtgaaattatcttgttctgtccaacaatgtttcaacgactgagacaaatcctgctgtgattagttttgaaaatactttcacaagcccacatcgctcactgatgcaaatgtctcatgagaggcatctacctttaaaatgcaatttgggatctgcttctgttaaaagtaaattacaatatgaactacaagggcataaaacaacaacaaaaaaatctcattttagtttataataaaacctagagcatatcatcacctctgcaagacaacatatatgaaaaaatatctgattaaaatttaatatgctgtacagttttccaagcatactaagtattaaataatgccagttgatctatattatgtgtattagcacataagcataaagtagctatatatgatattataatgatctaccagctctcttttcccataaaaattctgtactatactttgtgattttgaataaaaataaatttttaaaaaaataaaacttcttggctaccacctatatacttgaggtactttcacatttaaataacatgttgagtactttcatataagaaatgatttaatctttacaagagcttatgttttgctatcccccatttaaagataaagaagctaagccttagagaagttaactgacctactgaagatcacagagtaagtgtctacaattcaaactgcttttattgatgtagtcattacttaaacattgttgggagtatattgggatgtaaagtgtgacaatatagtaatcagaatgaattctttttcatcaatatatcaaacttcatacactatcttagtccattcctcctgctataacaaaatatcagactgggtaatttataaggaacagaaatttacttcttacagttctggaggctgagaagtccaagaccaaggtgccagcattcagtgtctggtgagggccttcttgctgtatcctcacattgcaggaggggcaaaaagtacacaagggacaacactgtgtcttcacatggcagaggtggaaagccaaaaacaaaacaaaacaggcctaagaccctcctttccacctcttttataaggtcactaatcccattcatgagagctctagccttatgacttaatcacttcctaaaggctccacctcttaatactatcacattggtgattaagtttcaacatatgaattctgggggacatattcagcccatcacatacatcaataagtgaagcccttcacagtgtttttacttggtttgttgtgtatttctttcaaggaaattatcactgctacagttgtccaaagaacttctctatggagattgtcacagagccaatttcctaactcctcaggaaaatcagttccattgaacgtcacaggaccttatacagattaaaggtctcttgctaaccaaatatatatttttctccctccttccaactttacctctttgaatttttgaattcaagaattaaatttgtaaactatccatatcagtaaaaaaaaacattaaataaaaattaataataacaaaaaatataggagatttacacacttaaaaaaaagattaaattatgaactataggccatgccatcttgctcccattctgctctctcccagttgctgctctagagctgagtctaatcctatactgagttccacagaggagcccatgggaacaagctgaggctgttgatgaggggggccttatttgattcatatcaggagtcagactagctggggcgagttcatttgtgacctgcttgcattaagtgccaatacataataacatagaagaaactggctggaagcctttatgcatcatctacaagtacaatcactttaagtagaggaccgcctgcacagctccaaacccaagtgcacacaattaaaacgtgctacaaaacacagtgttaaatctctaaagacatcccaatgataccaaatctgtttttctaatggcacacaagactgctttaaaacacctcaaaccctatcttattcttacacagctgtgattttaaagaatctataacctccttcagatctcactattagtaaagaccagaggtttttcattacgtctcccttagaacactagatagtgcttgctttaacttaagcttatttcctctccatccacccagaggaaacaaacaaaaacatgtttcttttaatatccctttataccagtaagtcccctttagctttccagcactaagatacattaagtccagaattgctaagcaattttcaagcctttcaattagttcccccaaatcagcatctcgaactacatttcaagtctacatttatatgcattttggtgtatagcgaccgagtaagtgactgtgctcttcagatttttttttaattcttagtttttgtgggtacatagtagctgtacacatttatggggtacatgagatattttgataaagacatacaatatacaatgtatcaaaataataacataaggataaatggaattacctcaagcatttatcatttatgttataaacaatccaattatactctttcagttattttaaatgtacagttgaattattattaactacagtcactctattgtgctatcaacaagtagatcttattcattctttcttaagatttttaaagtgagaatatatacttagaagcttattttcatctcccaagcaagagaacaataaaaccaaacagaacaaaactaataacaaacaataagcctcatcaggggagatgattttccttaggtgttactcttaggctccagatgagcacacccagcatacatttcaaataagtggataaaaaaaagaccagaaattgccatttatcacgcttcaactctttctgaataaaaaataagttttacaaaaaacatttttaagatttttaaggaaatttattcaatgatttaaccttggaagtgtctctccttttggaatatattgtacaatagaaaattttccagagtctccattttaaaatcagcattaagatactgccctggttagaaatgtacttaaagcatcattatcaatagaatataccttggaaaggatacagagtgatagccaagcacttgacttttggaaataggctgtcttggttaagtagctcagccactaataatctttgtgcctcagtttcctcatagaaactaacctatttcatggggtcatgagaagatttgagattatagccataaagcacttactgcaattcctagaataatgtaagagctcaattaatgttagtcattattatgctgacttctaagaaactgcttactctttcattcccagacttcaaatacatctttaaaaatgtaaaaaccaccaattaattcctagcaaagatagaggcttgctttctttctttctttttcgttttatttttggtttttttttttttttttttttttgagacagaatcttgctctgtcatcaggctggagtgcagtggcacaatccctcactgcaacctcagccttccgggttcaagcgattctactgcctcagcctcctgagtagctgggactacaggtgcgcgccgccatgtccagctaattttcatatttttagtagagacaaggtttcaccatgttggccaggatagtctcaatctcctgatctcgtgatctgccctcctcagcctcccaaagtgctgggattacaggcatgagccaccacacccagctcaaagatagaggttttctattctaaaatattaattttactctaccagcctttttgtttgtctacaaaattagcttttctttctttgttacaagagctaccaatagttaatccatcctcgctgtaccctatcattatattgcccatcatttcacacatttgtcttcctcctactgctctcagttcaaaagaccccctaccaaacaaactattattagcttccaggattccacttttactgttttttcagtcttcagtcaggacctaatggactcaaacagagtctactataccgtttatatattgcttgtattactcaggtttggttttaaaggctcatagcaaaatgttcattttgaccatatccaatatgttgctattttaacaacattctctcaggtgcataatcattcaaaaaagaacaacaaagtgaaaatttcattgatacaattattttatttactatttgtaataggccaagaaaagggaacggtgaaagcaagaagatttttacccataacatacagagcttactgttgattagaattccaaaatcaaagcaagcccttaattaatagaccctttaaattattttattttgtggctgaattaccacactgatacttactcatttaattatgccctggcccagagaactgacatttttactggcaggttatgaaatgtttgttaaagctatgaagtctaattataaaagccttctttcagaggttcacaaaggatggagaagaactagaaaattatctccctggtaccaaaggaagagttataaaacaaatgaaaacaaatagagtgaaatcacatgaatgatacatgtgtaggtagtttagagtacacacggatgggaggctgggcatagaatacacagcagaaaatgcaaggattggtctggtgcaatcctttgggtctttatagaaaatgctatgatttacttttttttcttcaatggggttggctgtgactgaagtttcatgattgctaatatgttatcattactcaaataattagacttgggagcaatagatttttaaaattagctatctcaaagaaagtgtcattataatcatctaattatcctttgaggtaacttatgtacacatgctgtaaacgttcaatatcttactcccatgggtgctgcctccatgtttatagtttaaaactgatagcattataagaatctgtgatgacaacttagagagcacaatttgtttatttcttcagaaatctgaaagtaatgttcagaaagtaagaactcacagccgagcacggtggctcacgcctgtaatcccagcactttgggaggctgaggcgggtggatcacgatcacgaggtcagcagatcaagatcattctggctaacacagtgaaactccctctctaataaaaatataaaaaattagccacgcatggtggcacgcacctgtagtttcagctacttgcgaggctgaggcaggagaatcgcttgaacccaggagacggaggttgcagtgagctgagatcatgccactgcactccagcctcggcgacagagcgagactccttctcaaaaaaaaaaaaaaaaaaaagtaaaaactcactaattacggattaaactcaaaaattaatatgtagtttcagctaaggtggtaaaactcatatttacatttaatttattcacatatcaatacagtatttctctagcctaaatgccaccaaacatttagctatattcaatcaacaagattgcttagccagataaataattaccacctttatcagaataagatgccctcctataataatcagcctgtaggagcaaatgactttttcaaaaacataattgtgttaaataagtctctaaagagactgatcactctagcaacaacacagaacagtatttgaactataaaataactcttctttgttactctttattacatatacaagtatatcatcaagaaactgcccagaaagaggtgggcaggacacttacaggtgggcctgaaggttcgggtcagtaaaagaaaaatgactcagatattcttgatctctaggcctcatcttgcccacttctaggcctacctatgctatatgcctattagccctgttccagttcatgggagggaagtacagtactcttcctgtcccctcagagtccaagcaaggtgttctttgccgagagtgaataatcaatctcttctccgtgtcctctccttttagctgagcctttgcttcagagtagctccttgtatctccttttggttgagtaactcctttccaaatagctccatttggtaggagactttgttttttgctttcttgactctctgcttcaccttaattaaaattaccccagcctcagcaattccctaggaagagacccctgataggaagattagtagagaattaattgattagttggcatatttgtcttaataattagaaagttcatcttttttaaagaagatcacacatccaacataattatgtggctatctttattcatcagcttaaagttttcaagctgggtttatttcacgtgtaaacttacaattgcaaaaactaacaaaattcctcaaaactactcttgctatttctaggtagaagtcttttcaactaggcagataggtgcctcattattcttagaaaactctaaggactacctgcacttattttataacccaattaatgtatcttctcactaccattggaaagaaatatttctcttttcttatgcttgatatatttttaagtatgatacattttgaagtgtgtttccttttctagttttactacctggttaatagaaaaaaaaatactacatctgcctacacttatattcttaatcataagactgccctgaagggaaggtattcaaaaaaaacaaaaactgctcttaataccatgatattagtatattgaaataagaaccatgattaagaaatattaatatacaaagagtaatctttttctgagagtgagaactggaacaaaatgagaacaaaattactcaaaatgagaaataatacttgaacttgaaattcttgtgttgtgtcccccagcagtgtagataaggataaggcctttggctttacctggacctaccctggataaaaggggaaagagaaataaaataagaaatttaatttaagcaaaaatgttcttcttcttcctaaaaaataatatattcagtcagttgctctatctaccaagtcatttaataaatatgtattgagtcagtatataaaactttgtgaaatcccataaagtacaagaagaaatacaagaaaactataaatacttcaaggaaatactacagagagtactacaagagttcagaagaaggaaaccacatatgattagcctgcatagatgtgaatgcctttcagataggccccaaaacataaattggattttcaccaaaggagttaacgtggagggcatcctgaatagctgggaggaaatgactctatgcggaactacaaaagcaaagtgtggaaagaagaaagcaatggcttattcagagaaagagagacgaaaatgaagaaaaaaaaggaaagacataagaaagacactttgagtttaaagcatgccgcaattcaatgggaggagtaggaaataggctggaatccgaattgaaccaggtcaaaacattgttgaatatcaaacccaatctatttaatctgtaagaaacaaggaccctgagaaagattctgaccaagggtatgtgatcggaaacttgacagataaatgtagtatacttgtaaagccatactgtgaaaaacttggggattatttgaacacaaattatcacctggaaaaagacagaaaacaaggcagaagactgtgcaaagaggttggaatattcaaaacttcagattagaagacggaaatcctggccgggagcagtggctcacgcctgtaatcccaacactttgggaggccgaggcaggcagatcgagaccatcctggctaacacggtgaaaccccgtctctactaaaaaaataccaaaaaaattagccgggcatcgtggcaggcgcctgtagtcccagctactccggaggctgaggcaggagaatggcatgaacccaggaggcggagcttgcagtgagccaaaatcgggccactgcactccagcctgggagacagagcaagactccgtctcaaaaacaaaaaaaagaagattgaaatcctgtttaatgttgctcttctctttctatactataaacgaaactaaggtaatcattaaatcatcctaagcatttgtattgccattttgacagtcttcatcttgatctattaaaccagatctctctgtctctctctctgtctctatctctatctctctctctctctctttctcaactttctgggggaattataaggaagagtcagggaaccctaatctggaagatttattttataaaataatagttcatagattttcctttaaagagcaaacaactttttccttcaaagagcaaacaataattacggccggatgcagtgcctcacgcctgtaatccaagcagtttggaaagcagaggcaggtggattgctagagtccaggagttcatgaccagcctaggcaatgtggcaaaagcctgtctctacaaaaaacacacaaaaaatagccaggtgtggtggtgcacacctgtggtcccagatgttcaggaggatgaagtgacagaatcacttaggccagggaggcggaggctgcagtgagctgagatcacaccactgcactccagcctaggcaacagagtgggaccctgtccactaccacccaaaaaaaagggggggtggcaaacaataattattgccaccatcataaaaatataaatgttttcatatacataatggatgaataaaatgatgttaaaaactcaatttaaaaaataattgttacacacagtggggtctggttgaaaaagaagagcaattctaaaggtaaaggataataacatgttagatttgtggattccatggggcttctgctatttatgtctgcccactgcatttcccatctcctgctctgtccttgtgtggactaccggtctcattccatgtgctctggtagagttctcaatcctcatgacggcagcccatctagagcagaggctgccatgacaccagcttcagtggaggatgtgtttccaggactgcgctctccacagagctggcaggagctggaagcagccagaagccccgcccttccaggcacagctgcagccacccaagtggcggctccaaacccaggcatttctacactcttggaggccaggaaaggccccctgtctctgcaggctcagaggtgcctgctgtcactgcctcgcctctccttgctccctgcacttgctccgatcttggagtggagttgaggcctagcccgggtgctgtcacaatcaggctgagtgtgcacacaataagggcagcactgacataccagcaccctgctgcctcagccccctccaggctttgggtgccaatgagcatgggagggaggctgagtggggcctgaaggcagcttggtgctggcctgcaggcaccccacagcacaaacagcctgggtgccatgaactgtggcaggaggcagacgcgctcctgagtggaagggggtgggtccctagcaaggccccaccttcaagctggggagggcctgaagccctccaggggccaggctgctggtcgtgcaaaccagaatgggaacttgtggtaccttccagccctgcctatggccacccttggacaaactggtgcacacttcctcccctctgaggcccacaagaaccccagactcacccagactcaagaaatcgatggaaccactagctgtagggaggagttacccattccaggctctcctctctgctgagagctaaagagatgacagtatgaccagttgtggagaggagctacccacaccagagtctcctatctaatgagcgctgaacatttgaaggaatgacctgcctgcggagagctatccaacgtgggtctcctcggagctgttctgttgctcaataaagttcctctttgccttgttcatgtgacagtcctacaaatgtaccccctgtatctaagataaaaggtgatttaaaaaaataagacccaagtcacatgaatagtgaagagctataagtattcatacatttctaatgtaaaatatatgatggttaactttggtaaacttgagggtagaaatatatttttaatacacaataaatcaattaaataggcaggtaatgattttatcttgaaaaaaattataaaacttcatcatctgttcccttttactatccagtcccttccaagggtatcttctcttgcttatttagaaaatctgtgtgaaacactcaaaacaaatttcatgtttatatcttactaaaattagagaaataaaatcaatcactttgagtccttctatgctttaattaaatgtatcctcttagcaaatttgtttttaatccagtgaatgaatgacaaagtaatttttcttctttttttttttttttttttttttttttgagacagggtctctcactctgtcacccaggctggagtgcagtggcatgatctctgctcactacaacctccgcctcctgggttcaagtgattctcctgcctcggcctccctagtagctggaattacaggcacctgccaccaaatctgtttttttttttttttttttttttaatgtagtagagacagggtttcaacacgttggccaggctggtctcaaacttctgacctcaggtgatccacctgcctcagcctcccaaagtgcagggattacaggtgtgagccaccatgcctggccaattttttttcaaatttatgttaaatctcacctaaataaaatatatgatattaagaatgttcagcatcttgttcaacatttaaacaaactctagtacatactgtgtagattatccagagctccataaccatgtaaaaaaaaaaaagagagagagatagagattaaagtagaacattcaaaatacagccacaggccagatctggctcaaagacttgttttgtttgacacataccagcgcagcaaaattgttttctgatgaaatgcttacatgtataaatgaaaaacttcacagaaaaactccaaacttaagtctcctccttagaaagaaaaacaaaaatcaaaaaccagttcttgcaaaactatgccctcattcccacatatcaccgcaatctacatactttaaactgtgaattcagataccagtttgccatagtacccatcactccttatatttaccattggttaaaagtgtcaatggttgcaaccacacagagacattatatatgtacaagaaaaaaacaaaaacaaaaatagaagtactctttcctaagcactgtaagtactttccagatcatctacatgagccattctattcattggtgagcctcccatgcatacttatgatcatacccttctgcctgaagaagtgtcttactcagaatcaaaaagttgctaagtaacagtattacactcgaatctgaatctgacccaaaatccaatgtttttccagcttctgcacagttaatacagctagcaaataagtaacaattatttttcccaaacaagaatcatgaagatattctagcctatttgaatatagctacttttatattacaagatcaaatttactacacataacaggcaaaacatggaaggcacccatttagtctaatttcaaaaaagatatacattctctccttcctgaattttgtcttatttctttcaataataaaagaaaggttagatacaaaaagtatcagatcacccacaaataggcacttaaaaaagaaaagtatgtcaatcattgggtaagctttagaaggaaactgtggcaaaacattaattttctcctctttcagaaacttctttgctcaaattctactttcattctttctaatataaacctgaggctggctcttacacaaaactgttgaagtcattcttttgttccttcttcatttctcatctgtaaatgtgctcatcaacttgtcaaccaggctgttagaatttgtatttaatcttcacattccctctcagctaaaattttctcccattctttaatcatttcctatcttgattactataatttctcttttattgtcctcttgaaattcatacttgttaagtcatgtatggccagaatatatactaaaataacatttccttccaactgtctttctcttcacaaatacatcttcattctctcttggaaaattccaatttgcctttggatcattccagatacctcaccgtaattatcttctctgtcactagagtatggagtcacatacatcaccaattttgtcatctcactttcctttgaggaggtcccaagtagatattcattgagatagtctcttctcaagagcactgttttaaaatgttccctgtcaagctggatagcaagaaacagatgaaggattaactatatcagtattttatttctttcctagaaaaagagggaatagttcaagatacattccacatcttaaacttgctttgaattttagttttggaatatatttttatcacaaattgtcaatttatgactgcataaatttatggcgtacaaagtgatgttatgatttatgaatacaatgtagaataataaagtcaagcttgttaacacatccatcacctcaaatatttccattgttttgtggagagaacatctgaaatttattctcttagcaattttaaaatgtacagtactctattattaattatattcaccacactgtgcaatagaactaaaaagaaataccatattcctcctgtctacctgaattttgtacccttaaagtggaattttcaaataaatggtttctcagattctaacatttttggcaaaagatgagacatccaattatatcatatgaggcactaacaaatgcaaatagactacccatataatcaaaagaataacatttaaggcaataagcccttcaacttcagaaggcttggctttatgactatattcagtcaatcacataaccattttgaagtcttgcagtggataaaataacacctttgaagggtgggggaaaagaaaaagagacattttatcaaatgcatgcaagtgattttgcccatataaatacttgaaataaaaccctaaatggcacattttaattttccctttggaattttctggaaaaaaaattgccagtgtaaattcttatcaaagacattcctcatcttctgatctctctctctctccctccgtctctctctctctctctctctctctctctcacacacacacacacacacacacacacacacacaatatgcagtggagttaaaatgttcctggttaggaatatttttctctgttctgcaatctgtagtaattctttatcttaaagctagctctccttttggtgttagaatggtggccaggagcctagcagaatagaaggagaatcaattcaagaaactctcccagtgagaataaaggaagacctgtccagggaggcaccagcactactcctaatatcagtccgcttaagtgggtacctgacccttttcacatgaaacaagaagtggtaagaaagatggtgttcaccttagactaataaagcccactcatggagcttggattagggtcagcttctcctgaagcatttagcctacagcagagcagagtagctacatgaagaaactaggatatactgtaagcaaaggaataaagggatatcaatgctgagtacagctaataacgtccgttgagtcagaaagagaattgtgacagaattatccaatctcctttactttatcttttataaacaataacaaaactagtatattttatattctgattagaagcaaattacaatagtttcaggtaatcctttacctcaaaattatgatactaaacaataatcaatatgaatgaaattctaatacaaggaagaaaaactgcctgacatgaaataactatcaatcatcttccctatatattctagaaatcttatttttaatataaaaattaagtttagtatttttggcaagattagatctctactatgaattgaaagtcttcggtatctctctggaggtgggtgttagaatcaacaggagcagtattttcatgttcttcacttttcttttcaaaataatgagctacggaaaatgctattgcctttttgtgctttcataagaagtaaaaatcaaaggattctatgatggacagaaaatttgaatcctaaggaaaataataaaatcttctctctttattcactctttccctatatatgaattgtttagcttagcatttatggtcttagtaaacaaatagcaaaatataaacaagtgtcccaagtatctgctctgttctgaagttttcttatgcaagacatcaccagacctggtaaaccaaggttttacaagtcttaccaatttctgtgcacttccttttaaacttttcaattcttataaatgtcatatttcttatgaaaattaatgtcttcctcctgaaagagctgcaaataaagaatgcatgtacctatgctattatgttgtatcgcctacatttaataaaacacaagtggaaactttcaccatattttcaaaagttttatcagttttttttttcccattacaatgttaaagagaaatgcaccaataaaccccaggcaacgtaaataaaacgttccccatatgatcttaaaagaaatcacagaaatatccaaggctatacactcagctagatctaaaatattttcgttaacctaaagacagttgtgaaagtctcgagatgggagaactccaattaacctagttcattaccaataaggctttaattcagtcaggtactaaaatagttgttttttctgattaattatttcaggctgaccagttataggccagggctacgtacatcaatgtcactcacttggttagaaatgacatcagtggaaattactttccccatgaacagttctgatatctgagcccctgactacagccagttattacaaaagtataataaatcttgaaaatcaagggcctgcctcttctaatacaaaataataaatacttttcttaaaatcccagagttctgcttaaaatatgaaataacaaatacatccacaacttagaatatctatacaagatcaaaattcatctatgttgagccactaaaacttgtgaaggagtgaaaacagggcatgaaatagaggtattaagctagaaagaaaaagactacgtggctaacaaaatcaactattgatgtatgttatactatttgggtttagctgtttagctgttaaccatcacaagttatttttacatggaaatttctaacttactctactttgaaatgccaaattactaaaaaattttaaaagcctctttttgaaatctagaataatgacccaaatacagtaaagtcataactttttttctttgtttgaggcactatttctaaaagtgtaatcctaagaccacctgtgatgatcaatatgctgatgttcagactgttcccaagacctaataaaccagaatctctggaaataaggcctaggaccctaaattttaaacaaataatgcaggtattaatatttctgcattggtttgagctattgtatttgccagtggataaattttaagtaaacagggctagctaaacataaaaattagctctaatgatatcataaaattaattcacatattattcaaattaagtgagtctctatttttgcttacatattttattatgatttcttaggatgcattatcttatgaaataatgaaatcacatctaatttaatatggctgtctttttgccttagctgtcagtattctatgatctcaaatcactgtttggttgaatcaaattcaactgcaataattaaacagtaccactaatttttttggtctataaaacaagaaattaatcatgtttttttacctttgttaacctgtttctattgtgtttaatctgaaaagctttttcaataaattaatggaagtaaatgaggtatccataagcaagaaagtgatcttagagtagtgatagaatgattcaagcaatgggaatattattttaacttcttttatcagaagccaataagtagctagtggaaaaagaaatttcacaaaataaatttggaacctaattctcagactacgaatttatgctcacactatttctccaagctccactatagaattatgtcacttatctactaggttagtgcaaaagtaattgcaatgtttgccatttgaaacctaatattacatttttccaggtactgttaaagaacaaaccacttaccacaccctattcccaccatattaaaacagcataggctcacaaaggaaaaaaatgaaatcagtttcaaagtcagagctgagcttctacttataattcctttacatgtattataaagtaaaatattttataggtattatacgatataaaagatgaagaataaaacattgtttggttaccagacaaaaaaataaatcctataaagcaagttcagattttaaaacaaatcagatggtgtttctgaatatgtaaaataaatttctttaaaagatttggaggcataaaagctagatttaattgcagatttaaaagatggtttaatatcagaaaatttattatattaaatgcaagaaaaataattgttaaattaaatattcatttgagataaaaagttttctgtattactcaggcttctccagagaaacatgatggatggatggatggatggatggatggatggatggatggatggatacagagggagagagagagaagacagacagagactgatagatatacacacacatatatttactgtaaggtataggctcaagtgatcatggaagtaaagtcccataattttccaactgaaagctggagcctcaggaaagacagtgatgtagtctgaagacctgagaaccagagagccaatggtatagattccagtatgagtctgaaggcctgagaaccaggggaaccgagggcaagagatgagtgctacagttcaacggttaggcagagaatgaactcagctttcctccatctttttgttctattcaggccctcaatagattggatgatgtccacccacattggaaagggccatttgcttactgagttcaccattttaaacgctaatctcttcgagaaacaccttcacagaaacaacctaaaataatgtttaaccagatatctgagcatcctgttgcctagtcaagttgacacataaaattaaccaccacaccttcacaaacaaggagtaaaggaagcatctctacccaaatacagagtaatgtagagtatctcttaagagcttacagcatatatcacaaactaaaattttagtcacattaccattaacataaaaacaaaaagatatatatctattccgctgcttctctcatactgctctagagataatagtcaatatcacaagactacttgaaaaattttaaaaatatgtattagaaagcattacccatatctgtacgttatgactgccaaaatagaaaattttaatggattctgtagcaaattattagaagatttcaaaagtagcttgttttaagactagcaaacaaaaactacagacttcctatagacaagtaacaagcatttcaatactgaaacagagagagagagagcaagagagagagagataacgtgagcctatacacactagcaacaataaaaacatacggtacacaggggaaaatgtgtataatcacattacggggaaaattataaaaccttagctctatgtaatgaaaagtaattccatgttcacatgtgggaaaaaaatataaatacagcaaatttgtggcaattaatagatcaatttgaagtcattccatagagtttttcatagaagttgatagtgtaatcttgaaattcatatataaggccaaagagccaagaataacaatgataactatgaaaagatagtacaaggtagaaaaacgtctcctgccagatactgaaactatcattattagaatagcatagcattaggccaaagacacgcagctagactaaaacgacagaacaaagagcagagaaacagatccatgccagcatggacatgaaatatcaaagagatggcatcacagtcagcagggggatgatgggggaaaagtaaatccctacccaagactaattacaaagtaaatggggatttacttttttcttgtcttcccccaccgatgtataatgccaccactaattcctgattataatgccacctcaatttctgacaggtaagacctaactgtgaaaagcaagatgtgtagatatattagaggtataatgccgcctctaattcctgatctgtaatcctacctcaattcctgattgattagacctaatgtgaaaagtaaaatatagaaaaatatatctttataacacaagagtaagaaaattcctaaacaagaaaaatacctatgcctaacaaaacaaaaaaactctgccacatagaaattaaaatttttgtacaaaaaaaacacatgagcaaaattaagataagccacagacgagatattttcaagacttatgacaaacagatgattattatccagaatataaaaggacacctacacatcaacagtattttttttttaaagcttaatgaccaaaaagaaaaatgagtaggatagaaacaaacatttcacagagggaaaatagtcaatatgcatatgaaaagatgttcagcctcagtagtaatcagggagatgtgcaataaaacttcaaggagatgatatttggatatattaaaatttacaatcgaacaataccaagttttatgaggtgagctgaaaatgaaacattcttatataagaacgtcagtgagtaaggaatgtataagtgtataaaatagcaaaactacttttgaaaataagctgacaatatttagtaaattaaagaaatgtataccaaagacctggcaattccacttctagttatatgccctaaaaaatctgttgtccatgtggatagggaagtatacataacaatgtcctgatatcggtacatatagcaagaattgaaaagaacctacacagccatcaatagtacaacagatacatgaattatggcatactcactaaaaaatactacacattgtatacctacatcagagttacatatataaatatgaatgatctcaaaagcaacattgaagaaaaaaactgttgcaaaatgacatagaatgataccaaattttatacactattaaaacatgaaaaacactatatatatttatcaatacaaatatatgtatcaaaatataaaaatatgcattatggaaaaatgatcagtaaattcagaatgataattaactcttggtagtgatggacacagcctcacgacaaggtatacagtaagttttaattatttttgtaatattttttctttaagaaaggcagagctagaaaaatgttaaaatacgataaaactggatgctgcaaacatggatatatgttattattctctatcatttgcagtgttttaaaaatattttctaacaaattaagaaaaattattttttaaagtctaattaagcacaatgaactctaggaagtgttcaatcctcttggccagaaaggaataccacaaagaaataaaataatgtttaattaattgttataatatgcaaccatctttgctattgtaaactcttcaaaaccctttttcattaattcacaccacgtatgtcagccttttgtattactaatcctagcatatgattatagattagtcagtctactttgtaacatgcttaattacccagcaaatctccattctctgtattgttttgccttatattggctatagggtatatttaactgtttcctgcagttcttcttgcagctgaaaatttcatacctgggttggctgatatttattaagtttaaaagaaagtaaccttcatggttacaacagaattgtgagcagtatcaggccttcgctgagaccatagctcctatgtgtagcttccatttcttcagttacacaatatttttatctaagtcaacagcctgtgcaggcatcttatgatatgaaatgataagagaaaccagctacatagactagggaaaaaatatggaatgccttttaaattgttacaagaaaagaaagaacactatacacaagaggaaactgaatatagaaaacagagcatctcaattctgttctgccactcactgtgtggccttagaccttaggcaacccacttccccctctctcaacctgggtttactcgtggagataatgacactgccctgcaaatctcacaggactggtgtgatggccaaaagagatgatgcatgaggaagtgctttgtgaactgaaatgcatttcagaaccacaagtgagaatgtcattattctgaccctttcagaactaaagagtatactggtaaaatgaatatactaaaattctttgaaacaaatagattaaggaaaattaacttaatggcctcagcaaatgatggtttgtacatgtgtgagtctatctgtcacaggaaaatttccatgaaaatataaacacctgctaatgacattttagagaggaaccctgttaaaagtagaagtatctaaggaagttgaagaaaggtgttttaaataccatcttccaaaattactcaagtagtaaactaaatgatgattgcaatttgtgtgcaaagactaaggtagatacttggtgacagagggtgacaagatgcagaatactgtgtgttgctgttttctttaaagcagtggctcttaaagtgaactcaatggactcctgagatccatgagaacctttcaggagttcatgagggcaaaattattttcataatgatattaaaatgttatttaccctttttgatatgttaatattttcacagatgatatgaaagcactggtgggagaactgctagcagcttagcataaatcaaagccttggcaccaaactttactgagtcattgtactcttcactgccatgcactgtcattaaagcaagcaaagtctgttttatttaagaatgtcttcgatgaaggagtaaaaatcttagttccattatatctcaaattaaatgtgttttattattctgtgtggtgaaatggcaaatacacataaagcactcactgcaactagagtacaatggttgtttaaggaacagcactcctggttgtttccgttgcaagctgaactagccacttttttccaccaaacactttttacttaaagggacaactgacagataagctattattatttagacttggatttttggcagacattttcacaaaaatggacaaagttaatctgtcacttcaaggaaaacaactgacagtattcattaccaatgataacattaaagctttcaagcaaaaagtagaagtttgaaaaacttacatctgtcactgtgacagttataagaaagccttatattgccactgtaagagcttactaatatcatgacttttctgatgcagcagtagtaatattaataaatgggatttgtttatgctgtataataaaatgcataaacatttggaagatatataacccaatgaatctatattttccaaatgaccaatacatgcatgggtaaaagatttattcaaggtgcaagataaaccaatggattttggagtgagaaaatacaaaaagttcattgatatggcatcagattccacactgtaaatagtctataggaaagtactacttattgagttttggtataatatcaatataatatcaaagaagaatgtcacaattatccatcaaaagtgctataaaatactcatcccttttccagtcaaaatggtgagatagagccaaaaaaaaaaaaaaaaaagaatgggtggttaagtggagtgatggagtgcaaagtaaattatccaattccatcacatggttccttaagaagacttgtgcacattacaatacatattctgacttgcatgttgtttcagtgtgattttgcttccaaaagataagacttgttaagtgttcttatgccctcaggctactatagtcactttatatatccccctaactggggataagcatctcccctcctgtacccctttatcatccttaggcagtggctggtagggatggaagtatgaacatctacctcatttaatttgggtttgaacagacaaataattcatactccagagctctcatgaaggtttagactaaagctatccttgaaaagactttgcctaaaatcatacctcttcttccccattccctttttttcccattctgtcactccctaattgattactcctttttttgttttgttttgttttctgagacagggtcttgctctgttaccgaggctgaagtatggcacaatcacggctcactgcagtctcgacctcccagattcaaccaatcctcctttctcagcctcctcggtagcttggactacagccatgtgccaccatgcccagctacattttattttactattttatttttttattttacagacaaggtctcactatgttgcccacgctggtcttgaacttctggctcaagcgatcctcctgcctcagcctcccaaagtaccaggattacagatgtgagccaccatgcctggctgtttctcactttcttaataaattacttgcaaacaaatcctcatctcaatgtctgcttctggggaattaaacctctgagagctagcaacaggtcattctactgcttgatcattgcgctctttgattttctgctaaatgatgatcaattcaactaccacagtaatgggggagacaatgtaaaatttctctttatagcaacataattatagctaattgtgaagtgaaataagaaataaattttaactctggcaacaataacaacaaaaacaaagtgttgattatgatctttgattcatttccccaaaaagggcattatcaggtacagtatctttgagtctacaataattgtaacatgctttttggtaaactgactagaaggaaatggaagtaatatagcaataatacgaagggacagaatggagagagctacatagaaaatacatgagcaaatttattgttcaagataataatcagtggagaagacaagactggaaatgccagtaaaaaggggaagtgattggtggattcatatccctgatgaaataggaggaaacaagataaagaaagaaggcaatggataagagaaagaatgaaaacaaataaattgctcaggtgaataagaaggggtgggttgaagctgcgtaaggggctttcaatggttccagatatcattctctggcattggtagcacagaatgctgcacttgccacacaccaccacctggtttcaccttgcaaacagccatacagtgctccatttacacccacacacatttctcacactattctgcattcttccattaccactacttttttatctccttctccattttctatatttcatttgctacccgaagtattactttaagagattcccaaacttcttcttccaatcaatacatgttcccagaaatcaataaggaaagatggaagtagaatatattataggatatctccctgttttcttttaagcttcgactataaggattagttatttttacagcacccaagagaaaacactagtcacaggaagcagttccatatgaaaccagatctatctaaaactgcctttgccagtcccaaaggacaatgttgaaaaggaatcccaagaaataaatgtgtctacaaaattcagagcctataaagacaaaaactgaggagaaacacttaataaagctactcccatactctgcataagccagaaataaaccactcctaatatggcaaccacacaataaacatctaatgctcagaatgtttgtcaaaagtatgttggtcaaatgtactatctttcaacatttaacattttatcaataaagaattcctagaaacagaattctggcatctacaaaaaatatatatatcacatagtaacccattttaaagttaatccagagtggtatttataacattttgagtaaatcaataccttggaatgatatttcaaaaaccacttctactattaatctgttgtctcattagttgtatttgttacagaacctaatatgacaagttttgatttcgacagcatgtagtgatttcagaaccgattccattgaaacctagccataggccacagaaatctatcagaaataatgtcaggattgacttcagatgggccaaccaagaattccctcattaagagattatctgctgttgaaatacgtttatgttcatgtttaaaacaaacatttctgaaacacaaaataattctactcctctatattcaagaaaaggtactaaccacaagacaatagcatataaataaaagccacaaacctgaaaggctgtcaaggtggggacaggagcacttggaacacaggctggaatacaacatgtgtctggctcaagtacttaacttgataaagtcaagtctatttctatcaatttgtattaggagatgaataggttctcattaaaaaaaaatgagactcaaaaagaaaaacttttattaaaaaaaatcaaaggtgtcaaatctggaaatacctcccaaaagccaggaaacactgagttctaagcacaagaaccaagacagcttcctgatggtccttgagaccagatggccaagaccagtacagacccacaggtcccatctctcaagtgtgtgttagaagtgcaagaagactggggaactagtctgcagaagtatccattccgagaaactgaccatacataaagtttggtgagttttgtatgaaatttcctctattgggcaatggcagcatttatgcctctgaaactttgtcaaaaatgcataaatattctatagttatttgcagaagaactacatttaaatatagcatatcctatggctatccatcttcttggagttaacaaagggtccccaccatcttaggtgaaaggtattttacaatgttataaaaaaaaattaatggatatatgtaaaaacaaaggtaaaataatttatacctttcaaaaatgaccaagaagtaacagttaaacatggtgcaaagaggtaattcaataaacactagcaatgcgtgtgtgtgtgtgtgtgtgtgtgtgtgtgtgtgtgtgtgtatcagcccgaaacctcagaattgctagtttttttaaccacttactattaatgtcatactcaacccggattttacataccaacaatttaccaacacactaacagtttacaaaacatccagttctacgcggttgcctttattacaaagtaacttctttccacactgatgacagatataatcaaatagaaacacaaattaattcttaatatttttataatacttttttaaaactactgatttaataaccctcaatttccctttgaaaggaaataccgagagtatttaatgtatcctgaccatgaaacagaaacttaggatagtaagtgatacgtatgtatccattgatacaatctgtatcatgatacatgataaaagtatgtgaaatgattttatcagtttcaggtatgcaaatcacaatcaggtgatcaaggtaattgcttttccttagggttgaaattatccctggtttctgataggaaaagtactgtggaatgtgctaaagtggttccaaaggttgccacaccaactcaccctactcacattcccaccgtctccttccatctttctagggttgattgtgtggtttaagtgattgtgtggtttaagtgcttaacttaccattgggagaaacctcaacaatggataaaattagatttagtgaagaatttccaggacatttgactaaaagagaaaaggaattatcgtatatattaaaataattcatatcattagtacacaccacacttttccatttcagaggcaaatgtttgataaagttcaattagaatcattttttcacttagttggaaaatgattctaaactctgcccaaatatgtgggaatgttacattggagaaatgctcagaaaaaagcccaagtgtaaagaacggaagattatgtaagctttggtaaaaatctctgtgttacattttctcagctcttaaatgtaattccaaaaaagaccctggacagtgtggtatgggctagcatatggtttattttcagctttatggaacaacagggatttgcaagctttgataaattcccaactataaccacagaagatctcttcggatttcaccaaatagaaaacaaacaataatgagttgctggggtgacagggtctttatttgttatgatggcatagaaaaagaaatgcgtgcctagggcatttgttttaatcatgaaaatggggaagttagtgctcagcattcttcattgctgggtcattcttacagccaatttaattaatgtgaagaacagcttcttgtcttgtaaataattcatttcttcacttcacaagtatttactgaggtctgataccaattcaaacactagcaaggtcttccatactttagatcacacaggaatttgaggaataaagagattcaaaagggaagaaatgcagaaagaagtgcaacaagatgaaatacttagtttactcctaattttaagacagttactatgttcataaaagtgttttatgtgtaatttcaaaaaaactttaaataatcaaatcccatagtttatcctgaaagaaaataaacatgggaaaatgtcagctttgtctgatagaaaactttaggcttaggtggtggtatacatttatttattcattccaccaaatatttttccaccaaatatttattgactaccatacaggtggcaggctcagtgccaagctatgcagattttaaactgaaagctgctctcatggagctttcagtttactgagagtgtatgagagcaagaaacagtaatcaaacactaatgagtgtgcaattacaaactgagatatgatctaaagaaaggaagcacagatatgggaatatttgtaacaaaggtacatgtcttaggcttagggttactgaggaaggtggatgatgaaaaacttctttgaagaagaaatgctggaattgataactaatgaatgggtgcaaattaatgggaagggagtgacatctgacaaaggcaacaaaatgtacagaagccctatgatgtaggtaaataagtagtggctgtgtgtgtgtgtgtgtgtgtgtgtgtgtgtacatataaacaaaaagaaagcttttataatactgaaaccaataaattttcagatgtcctatcagcaatcagattacttaatctatctgcctttgcaagtacttaacaactgacaagaaagtgaaacatggatctgtctccatttctcaaatgcaggaggtaaattattatgatattttacaccatcatctatttgctgctactacaattaatgcattagtgcttaacaaacttaatactttttatgaaatgaaaatcataatatcaaaaccccatcttgcacaactgtagccttcactcttaacagccacaggtcttctttgattttcccaaaaaggcaagctctatccccactaaaggtatttacctagactttctcccaaatcttaacaagaaaaaataattcctaatcacgcaccggatctcagcttaatgttacttctccaatgaggtcctccctgcttgctcattctaaagtaggttgctgcctggttttttttcccctctcataccagttgtcaacttagtgtgtttatttgtttactctgtctttcacaatgtaaatcccatgagataaaatattcatgactattttatctaccaagagcaacacatatgttaggggcttagtaaatattttttgactgaaagtgaatgaataaatgatgactgagtactgaagtaacataaagtcagagaactatgaataaatatgtattataatcttcataaaaaactctataagtgtaggcaattcgaatataactgaaacactcttctgagattttctcagggaatatcatatgatacaactgtcaagtataataatttttttctataaaaatcaccgccaaatttcagtgcactatctaggaagtcaatctgaatcttaagacaattcaaactggaaaacaggaaaggagttctcaagtataaaagccctattaaacaaaattactttcatacatagagacttagtatcactcataatttaaaagaaatgtttaataaatgtgtactagattaataaatatttagtatttctgtattttctccacaattttaagtgtagaaaagtcacatgaatttacatatgattcttcaacacaattattgtttttatgaactttaaagaaaagtcaggatatagaatttttcccaaaaaatttataatattctcccagaagcagcttagactcatgtatagaatgaagaatattcaattaggagaataaagaattcacaaacaccaataaaaatagcccacaaatcacacagacattaataattagttcactatattgattcattttggagggttttttttttttttttaagaaaaacatttaggtatgtgtgaactcaggagtcataacctgcaatgaacccaactctgtaacacaacacagataccacagatggactgcaaaggccagtcctgaggttagctagatctgacatggaaattttcaattttctgaaccaataaattcttttgttaacttcttttttgttagcccaagttacattagatttttgacccctgaaatcaaaagagaattaaccaataacaaatactaagaactcttcactcttcacactctgagtcatcacttccttctccattccatcgcataggatgttttcagaatgacagtattaaaatgaaaatgtgattagatcattcactctacagtttctccttgtttacaagataaatattaaccctatagcttatctctgctacctttacctccccacctaccattctaattcatacacactgtaagccaacaattctgaacatttacccattctctgtgtctgcaatccccttctcagagtcagctcctctggaaaggagttaccttcctcctcaggcagcattaatactggtacgatgtactcccaatgcatcttgcttcgatctcactgtattgcaatttctgctttgccaggctaccacctacccctactagactataaactgcttcaggtcagaattcctccatattcccagtgaaaacactgaacctaactcatcttagatgctcaataaatgtctgctagatgaatgtacactttatccaatgaacgtagattacattcaatgcatgcacataagttagccactttttaaaatgagtaatccctttacagcatgattaataaatacaatctctaaaataatagtttattagtaaaaatggccttatataattgatggttaaatactttttgtatataaataaatgtgatctcatttttaaaatgtcacatttcactccctgaaataaagacctcaaattgctttttgtaataatgtaaggttcaaaatactctctaacatttaaaaggaaatcagaatttgaggaaatagtcatataaaatcagtggtaattgacaaactgactatataataatttcactgagatgatttctggtattaaatgaatgaaaaagataatcgtaacacagaaaggttattcaaaaacttgactaagaaaaaaagtcaccaataattattttattcagggagtaaatgttattaattgccaaaatacgaattttaaatttgagaagtacagatttgtaagtatatatttgtttgaatagtatcagattggccttttattggcttattggtatttagtgccagcacttacaatgtgaactcagcaacagaagataattcttatgaaatcaacattcaacttacatgaaataacttaaaaacttaccaacaatagtctaatgattatatacctttaccaaacaatgtctaatgaaagtccaaatgtaaaaatttaaaaattaaaattatagaatataatttttacacatcaattgttttgtagcaccatctcgcaaagtaaatatcatgtttattctgtagctaaaatttctccccacaagcagaaattgtttggaatatacaaaaagacaacccattaacaagtaactttaagtaatgtagttggatggtcattataatacaaatggtgctataaatttccctttaagtattgttttagctacatcccacaaatcttgatgtgttttcattttcattcagttcagttcagtatttccttaattcttcttttatttctttcttaacctatgggttatttagaggagagtcatttaattgacaaatatgtggagattttctacaagtctttctgttatagatacctaatttaatttcattaaactcagataatattctttgtatgatacagatgccagttacaccagattcatagggttgttcaggtcttctatgtctgtatctatttctgtctactctgtccatcaattactaagaaggaatatttaaatctccaacaaaaactggatttgtgtcttgctccttgaagttctttcagattttgcttcaagtattttgatgctgttattaggtacataaatgctgggttttatgccttcttaatgaactaacccttctatcattatgagataatctcttttttccctggatatatacaatcatgattggatttgaatctacccttttgctacttgttttctactgcttttatctgccctcagcctcttttctctctttttctgcctcccttggattaactgcatattttatattattccactttatctgctttcttgacttattagctataattcttttaactgttgttttagtggttggttcacagtttatacctttaatttatcatgaactgtcttcaggtaatattataccacatcatatatagtataagaaatttacatcagtattcttacatttccccctctcccagcctttgcactactactattataattttacttctatatatgtcacgaagtccacaatatatttttattattttttacttaaacagtcaaataactttaaaagagtctgtaaggggagaaaattaccattttcagtgttctttattcctttatatagtccaggtttctaactgataacatttttcttctgtctgaagaactttttttagcatatctttcagtacaggtctgccagtgactaattttttcatctttacttcatctaaacaagtttttatttcatctttatttttgaaagatattttcactaggtataaaattccacattgatggccttggacagtggctcacgcctgtaataccagcactttgggaggctgaggcaggcagatcacctgaggtcaggagttcaaggccagcctgaccaacatggagaaacccagtctctactaaaaatactaaattagccgagcgtggtggtgggcacctgtaatccccgctactcgggaggctgagacaggagaatcgcttgaacttgggaagtggaggtcgcggtgagctgagatcatgccattgcattccagcctgggtaacaagagcgaaactccgtctaaaaaaaaaaaaaaattccacattgataatttctctctttctatagtttaaaaatgttattctactgcctctgtgttgcactgtttccaaagcaaagactcttaaccatctttgttactctgtacctgatacgtctcttttttttggccttcttttaagattttctcattatcactggtattagtttgattataatatgcctctgtatcatcttcttgtgcttggggtttttttagtttcttctgagtttatagtttttatcaattttctttcccaccattttttcaaatatttcagtctaaaactctcccactttcctcctcttcagcaacttgaataacatgaatactgaggcacttgaaattgtcctacagttcactgattgtctcttttttaaattagccattattctctctgtggttcattttgggtagtttctattgttatgatgtcacctcattaatttctttctttgtagactaaactgtcacagatccatccagcaaatttttttcatcttaggtcctgtaacattcatctctagaatatagatttaagtctttttcacatcttccatttctgtgcttaatgtcttcaatctttcctctccttttttgaacaaattaaatgtgacaataactattttaatgctttgtctactatttctctcatttgtgtttttttttaactgattgatgttctcctcattttgtgtcatggtttcctgtgtctttgcattaaaagtaatatttttactagcttccaaacatgattttcaccttttggggtgctacatattcttgtgtcctgaggaacatccttgagctttgtttgagaaaacagttaagttacttgggaacagcaaatcctatagaagttggcttttaaactttgttaggcaaaactggcacagcctttaatctaggggtgaatatgctccactactaggcaatattcttctggttattctatctgatgcttcgtgaattatgaggttttccactctggctgatatgggaacatgaataattcccagccctgtataaattctgaaaactattccctgtgttcttttgaggtgattatttctccagctttttgtaggttccccacatactgatgggtcctcagctgagggctgtacgaggaccttctgcatatctatatagttttctctctgtgcatcttctctccagtcagtactctgtcctgcaaactctagccacctggacttccccagactcccaactctgtctcgtcaaccctagactaccaacattcacctgggttctcctccctgtgctgggccctggaaaaacctctcaaggcaatcagctggtacaatcaaagggcttacctcatttgttgccattcttaaaggatcactgtcctgaactgtctgatatttaatgtctgaagactccctttcatacggtgtatctggtcttttttgtttgtttctggtaggaaggcaaatcatgttcctgtaaccccatctaggctgaaacattctaatacaattaaatggccattctctgggaatagaaagtaagaacttacaacagtgacgtttccataacacggaatatataataattttcaaatggacaaaaaagaacaaataatacccaaaagaagaaacttaaatatcctagttgatggaataaatatttccacacccagatataatgtctcacacatagaaggctcaaaataaatactaaattcataattccttgctttgaagctaattaaaattagaaaagataattcagtaaaaggaagaagaaaacaatgctatcctgtgccttagatactgagtaattaattcaatttgatgtcctataagaataattcataaaattgtgtattgtgtcctgttttgatttactggaagattacaaactagcatgccatattcacatgtattttaccttcatctgaaataagttaaataagaatgattttataatttgtttctttcaaaaagttattttttggcaatatttaacatagtataactaagataaactatatattaccttgttaatattaatggttaatattaattttaataaccatatatttaggcaagatttaaaaactacaaaatagaagaaattaagcaaaaataatttaaaataaagcattactatgactataatatttacctataatcatagaaattacaccttataaatgtatataatctgtttctttaaaaaaaaaaactttaggacaatttctaccatcattcggagggttcaattagtccaatctgctgtttaagatctagaggctttattcagagaataatgcaaggtcagtcaccttagctcatgagctctaaagtaaaatagccttcaagataaataacacctctataaattacttatgctccctaagctttactttcctgatctgtaaaatggtgataatggtatctatccaataaagtagctgtaataataaaagaatgcacaaagagcacctaacatagtatttggcactaagctggctattattttattaagtttaatgttatgctgcctagaagtaaagcccttatgtgaagaagatggactccaaagctgcattgtcttatatcctattctcaaacattaaggtcagtcttctggtatgtcaagctgtaatttctgaggctgccattagtattgcttatggaaacataagaccaagtaaggacacataaagttggagtaatcagaaaacaatcctgtaccataaggaagaagacaggctggaagtctggaaatagatgatgtattacagggtagagaaggtgaaaagccaaggattcaccctatggaacctgtaaggttttaaatctcggctccaccagtttatttatgtttgactttgggcaagttacttgaccctatctgtaaagtgaagacaatagtaataattactacatatattgttaagtttcactgacaatacgatgtatcactcactcactaactgttaatattataaaagccaggaagattggagagttacaaaagcatcaaatacaaggttatagagatggattttttattaagggaaggagcagattccagggtcaatttaatataattctgtctctcttttaagacccaatcacaaataatgaaaaagaaaggttttagagtgataaaagacccctcaaaaggtaaaatatccatgcatgaggatagctgttatgacataagctgaagtgaaagctgatctaacacacacttgttacatagaaaaatagttctaatattttttgataatttggaatagggtgtggaaaagtaaaagttttgcagtcagacagacctagcttgagtagcttgagttcaattttgccacttagtagttgtttgaccttgaataagttcattatatcctctgaaccctaattttcacaactgtaagacaggcataacaacaactgcctttcagaatgatactgaaaattaaatgataaagtatgtaatgttcttgccataattgcaataatagtagctttcactttcactatttcaccaatagtgaaaaccattcccaaagaaacaggaacctttccaatatctctgccccactctgaataggacattgtttttgttgtaacagaccatctttctcatatgtaaatctgaactaattccaggtctctgtcaatttgaataatgagttcaaatccacatcctgttcaacattagttaatttgttatccaaactatcgctatgagtaactactactttactttccctgaaatcacctctttctcttattttccttacacatatgtcacatataatattctttatgatcaagcctcaaaagccagcattccatctcctaggccctaatttcaacaaagtctattcaaacgaattaacaacaaaccattgttaattttcacaaactttcgataaaatttgaatttaatgctctcatacttaatgacaagacaaagataaaatgtgcacgaattataaacacctccttggttcaatctatcatatttaccaaaatttggaaaacaaaaataacactctctaaaggcaagggttcttaatttaggtctagttgattatgatagaaaacagacaaccacatgatgcagaatatcaacctgataagaccaattctttgtaatctctttatctctgatgatcctttatgcaatccagaaaacttaatcttctcccacattttcaactgcctgtgttttactgccaactctgatcaatttggcaaaaagatgagagcagcaatcactggaaaaaatgtagggggaaaaatgagccaaatcaactgattttgtttcaatagactatttaatctgcccaatgagcaagcctaagtgttcttgctaaaggtaattaagtggtattttgtaattcctgttgttctttttaaaaggtcttgttttaaaagtgttttaaaggtgttctataatgaaacactttttgtccttaaggaaacaccttttgtccctaaggaataaggtagaaatagatgctaaagtaataatttggcattaccaccttattgtcacaataatggatgttttgacattgacaatagatttcctcatttgtacaatcaaaattcaatttgaatagagttttagtagcagctcttaaggaaacaaagggtatcaataatatagaatgtttccttaaggatgtatagctactgctatgtttccatttcttctagtcaaaaatcaatgtcacactaggctataatgaatggctgcttgccagctgcacttaaactgacagaaactcatcattcctttaaaaactgttcttctaaaaagagtaatttaataacttgacttatttaagtttgattcagacatacaatctaaccatggcttagaaggcattttacacataagaaaaaataggctgtctttattagtgttagagatgtttacaacacagtcaatttttaaaggaagaacagaaactgcagtcaattattagatacatattcacacctgttgtctgtcatgtttcaaaccccttcggtgtgagatgtagtcaaggcaaataaaacgaagaagaaccagctgcaaaaactgattttgttctcatatggtaattaaaaggaaaaagtgtaccatgtgttgtatctacgacagtcccattacttcatgttagggacagtcccattttcttttaacagatttttgttgcggtcaagtatgttataaaggctagcacttgtaggtctaggctattgacctaatttatattggtagtctgcccaattacctttgctaaatttctccctgaagcatactagtctggtgtcagaaaaattaaacattttcattttcattcccactctaacccccatacttaagtcacacttaatgtgatttttttaacatcacactagacatcagacctagtcaggccatgtcttagaaagacaggtgctataaacaccaaatgcttttaaaatgcaaaccacagagcatctaaaactacaggtggtacagttataataaatgaacactcagaacacatgtaaatgctacactgtcatggccgtatccttctcggaaaacctttaagataacagtaacttagttactgttcgaatggtaaatattgtattatgtttcaattgtgcttaatttacgtttaaatcttactttcaaaaaactattaatttaaaatgcttctgaatattatcaataagattacatatatttaaagcatctgaaaatacactccaagtcactatggatgtgactcgtttgaggaatatataatataaaataatttgaagttaaaatagatctttacccaaaaaaggtcactttaaaaacacattcaccactgtcttctatgtattgaacataaagtatgatttgctttgtaaaaattttattcttgtacaacaacaagaaatacgcaaagatgaaaatacatatgctctggaactagacagagacagatgcaaattctggctctagagcttacaaaaacaagaccaaataaaatgcttaacaaaattaatgccaacctaacctacttggcaaggacaaccctacacatgaaatgattcttactgatacaatgtaactgccacacagaattgtttgactcaagaaaacaaaatgcaacttgttatggcatttgtagttaagtaccaagggtctagccaaatgtatattgtgctgtaacttttatacataagtataaattgtatatatatattatataagtataaagtgtgtatatatattttatatatacacttttccaccaaggaagaaattaccagattttctctgtctctggatgatttatagaactgagtaacttgaaacaaaatgaagtaaatacattacagtgggaaaaaaaagtttttacagtcaatgaaaagagatatttgcaggtattgctacggtatttgcagcctgtagcaaaacatgttgttaaagtttaaaatgtcctaacattatacgtgaaaaatatgattcacctgacccaaccatggaaaatgcctttaaccaatatgtgaaataggttttctttctagattatgaagaattattcactgagttttgcatcatagaagtgatttttttaatgaaggttaaaatgaaaacaataattcagaaaatagaatattagtttcccttaccataaacttttcctgaatatgctttaggaaaatagagatagcaaaaacaaagcagaacaaggacaggtgtgtgttgctcagtgatcagtcagttcagtcataaatcagtcccttttagacgccgattttaatgtaaagcagaagtatatcagctaggagaaaatccaatctcttccaacgttatttatgacaaagcactcctaactgaagtccaatttgtttgtggaattgcagtcattttgattcaactaaacaataaatgaatctgcctttcatagctccaactccagagcacaaaagagaactacatcacaacacttcacgatccaggggcgcagttaaaggaacagtgggaaagcagtttttggagtggggaaaaaaatccaatgagctacaaaatacaattcattcacctgaaccacccacgtactttttgcatcggctgtatttcacctagtgagctattcatagcacacaaacgagcttgctgggagctttattacaatccttcttcattctgaaggcctcgtgcatcactgaatgctggacatctcagatgaccactctaaatactcctccaattcaaccaaagcctatggcacaactagatcatgataatgattaaaaaagagaaattctgggaggctaaaaacacaaacaacagagaatttgtctataaatttataaatattcctcaactaattaagattttggactccgacatactattttctttcataatgactctatttagaaacaattattgtccaattgttctctaactcactggtatttcttaatttgttacatttactaagttgtattttaccagggaagaaaaaggagatcttaaaatatttttttctgtcatatcacaaatctctttttgtgcacttttcttgtgaaccacatgtctgaaggtgaaaaatattgttactaaaacaaaattcttattatttttatgccaactaaagagtagttgttttgagaagaaacaacaggaatttttaaatgtatggcatgacgttgccttgctcaccagccattcaatcattcccaagatacatattctgaatgtgaagtatttattatatattgaattataaaatatttattatgctaaaagagttctcaataaatactaattctctatctaaaactcttgtagaattaaaaactatgacataactgaggcatgttgacaggaatgtacacagtactagtaaattcccaagctgttgaaattttatattcttgcatggactagtaatttccacaataggttttccagtccttcatgttttacatatataattttaaaagttatatgcttatagaagtaaagtgttcaactctatatttcttgttgctttattttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtgtaaggtgtaaggaaaggatccagtttcagctttctacatatggctagccagttttcccagcaccgtttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtgcttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccggttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctctttttttgttgtgtctctgcccggctttggtatcagaatgatgctggcctcataaaatgagatagggaggattccctctttttctattgattggaatagtttcagaaggaatggtaccagttcctccatgtacctctggtagaattcggctgtgaatccatctggtcctggactctttttggttggtaaactattgattattgccacaatttcagagcctgttattggtctattcagagattcaacttcttcccggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatggatttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcaacatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggtgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgagatgtcagtgtgcccctgctggggggtgcctcccagttaggctgctcgggggtcaggagtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggtgcccctcccccagcctcgttgccgccttgcagtttgatctcagactgctgtgctagcaatcagcgagattccgtgggcgtaggaccctccgagccaggtgtgggatatagtctcgtggtgcgccgtttcttaagccggtctgaaaagcgcaatattcgggtgggagtgacccgattttccaggtgcatccatcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcaccgtcttctgcgtcgctcacgctgggagctgtagaccggagctgttcctattcggccatcttggctcctccccctcttgttgctttaactaaatatttacaaactgcttataaggaaagaaaactatccatttagaagagaaagtcatatttgtaattcatcacataaacagaactaaaggcaaaaaacacatgattatctcaacagacccagaaaaggcctttggtaaaattcaacatcccttcatgttaaaaactctcaataaactaggtattgaaagagcatacctcaaaataaccagagccatatatgataaatccacagccaatatgatactgaatgggcaaaagttagaagcatttcctttgaaaacaagacaaggatgacctctttcaacattcccgttcaacacagtattggaagttctggccagggcaatcaggcaagagaaagaaataaaggatattcaaacaggaagagaagaagtcaaattatctttgtttgcagatgacataatcctgtatctagaaaaccccaccgtctcagcccaaaagctccttaagctgataagcaatttcagcaaagtctcaggatacaaaatcaatgtgcaaaaatcgctaacgttcctatacaccaacaacagaaaagcggagtggtgaattatgaatgaactcccattcacaattcctacaaagagaataaaatacctaggaatacagctaacaagaaaagtgaaggacctcttcaaggagaactacaaaccactgctccaagaaatcaaaggacacaaataaatggaaaaacattccatgctcatggataggaagaatcaataccaagaaaatggccatactccccaaagtaatttatagattcaatgttgttcccactaaacgaccattgacgtttttcacagaattagaagaaactattttaaaattcatatgaaacccaaaaggagcctgaatagccacaacaatcctaagcaaaaagaacaaagctggaggtatcacactacctgacttcaaactatacaaggctacacagtaaccaaaacggcatgatactggtacaaaaacagagacatagaccaatggaacagaatagggaactcacaaataagactgcacgtctacaaccatctgattttttacaaacctgacaaaaacaagcaatggggaaaggattccctatttaataaatggtgctgggaaaactggctagccatatgcagaaaattaaaactggaccccttccttataccttatacaaaaggtaactcaagatggattaaagacttaaatgtaaaacccaaaattataaaaaccctagaagaaaatctaggctattatcattcaggacataggcaaaggcaaagagtttatgacaaaaacaccaaaagccacagcaacaaaagcataaattgacaaatgggatctaatcatctacagaacttctgcatagcaaaagaaactattatcagactgaacagacaacctatagaatgagagaaaatttctgcaatctatccatccgacaaaggtctaatattcagagtctacaagaaacaaacaaatttacaggaaacaaacaaccccatttaaaagttggcaaaggacatgaacagacacttctcaaaagaagacattcatagagccagtaaacatatgaaaaaagctcaacatcactcatcattagagaaataaaaatcaaaatcacaatgagataccatcttactccagtcagaatggtgattattaaaaagtcaagaaacaacaaatgatggccagattgcagagaaaacacttttacactgtttatgggggtgtaaattatttcaaccattgtgaaaaatagtgtggcaattcctcaaagacctagaggcagaaataccatttgtaccatttgacccagcaatcccattactgggtatatacccaaaggattataaatcattctattataaagatacttgcgcacatatgttccatgcagcactattcacaacagcaaaaacatggcatcagcccaaatgcccatcaatgacagactggataaagaaaatgtggtacatggaatactatgcagccataaaaaggaaaaacataatttcctttgcagggacatggatggagctggaagcagttatccttagcaaactaacacaggaacagaaaaccaaacaccacgtgttcttatttataaatgggagctgaatgatgagaacacatgaacacagggaggggaataccacgaactggggcccattgatgaggatgggggagggagagtatcagaagaatagctaatggatgctgggcctaatacctgggtgatgggtttatctgtgcagcaaaccatcatggcacacatttatctatgtaacaaactgcacaccccccagaactaaaaataaaagttgagggggaaaaaaacataatgtcattgtgtcacctctatcttcacgagttttattccctaatattaaacttgtctaaaggtttacctaataaactctctcctgaaaaaaaattctcatgtcactgaaaattgacatgaacagaaaaaaagaaacagattttgctttaaccaagtaaaaagaaagcatttctctgaatattaccaaatcatcacttctcaaaataggtcatttgggagcataaaaaaaaaaaagtccccttcttttcaaagttcacatgcaggataccttcccttttgagtgatttcaaatgatgcatggagtattcagctgatggtatgtatgaaatgtaggcatcatcaaccaacaagcggaaacaaactcaaagtgtatgtacgtagcatgcacatgcaagcacccacacaaatgtttaagtgtgtattggagtaatctattagaaatatgccaatggaaaaagttctgaattaggcagtataaaacgagacctggaaaatggattcaacagatacaaattattatggcagataaacaagtaccctaaatattgtcataagtataatttaaatagctgtcatatgattggagaagagaaagtctactggacaatgtgattggaaaaaggaaatgtgacaaggaataatttggaatgggaagcagaggagaaaaagaataccagcctctgatgaataatacgtggctccaagactgcattaggtttgaagccaacactaaatcggggtccttgagcatttaaattaaaattctatttttgagaacttgtgaagaatctacttaaggttagtaacactggcataatatgcaaataattatgcaaacatatcttttgatattgtttcagaggcatgaacttgattttcaagacccaaacattagaaaatgacattttctattgcatattctaaaaccttagagttttactcaacattacatttaaaagttacatggttccaaaactgacaatgtcatttataagagtaatgtaatttataagaactatgactctgtttgtatctatatcaaattatttgtttaaaagtaaaaatggcattagagttataaaatgttcatagattttaccaatattgcctacgcttcttctaatttctacaagtgtttccaactttatcataaatataaaatatggtgagaaatgaaatatggaaaagacttattgtaagccaataaaatttaacatgataaaggtctcacctggagtatttaagggggagaacatctgttattcctccattaaaattaaatatttctccaaacacaaactactaaaacttcagtgttatcagagaattatatcaatgatgaacacaaaaaatgtccataatggctatttactgggtgaatactcacaggtgcagtgttaagtgtacagcagagcaaaagacagtagctgccaggactcaaggagctgacatttgggagggatgtgcatgcctcagaagagtgagcattagggagggctgtcagggaagaggtagaggatctgtaaaccagacaaaccagggtgggaaggaatttcaggtaacatgacatacaaggctcagaggtgaaaggaggctgcatatgattctatttggctgtgaagactgccagaaaataaaagtcttgagagggaggcaaggctgagctcatgaaaagtaacaccaatggtctgaggaggaaattcctctaagtgttttaatcaggagagtataaggtgtgtgttgcagaaagaacatgcaaactaattgaggtcaagatttgctaccaaatcacaaaatatgtatcaatatgtgttaaggctctcaaagactgccacatagaacttgatctaaagtcagagaattatttaggccaaagtcaaacgcctacaaaaagccaggcaagtaatgaaagtaactgaagagccccagaaaaccatggccaggaagaggtgtgaggccagcgtggcatgatctaacatttaaacaaatccagatatcagaattcttaggtgaaacatactgattgttcaataacgacaactatataaatgtgctttttcaaagcactgaagtgccaaacataatatttatggaaattatctaactccacatagtgcaaggccatttaaaaccaattcactaagaaataaaatttgtgcatcaagttacctcttatttgagctaagcatttttttccccaaaacaccctcgctgaatgagatttctgagtgataaaggctttaaaaactctgctttggtggctatgaatgatagagaaaagacttaaaatgtaaagttgcttgtctgtttcttgtcttttgttttgttttgttttgttttgttcttactgatttcaaagtaaaatgaatgatcctaagcactctggaatgatcctaaaaactctggaatgatcctaaaagtctttgaatatatgcaaatctgcaaaggggaaagtttacaaatatgagcaataacaaatatggaacatttttgttttcacctatcaatctctcatctgttaaacagaaatgaacacaaaaatgctatttcatggatgaaaactctctgaaataggatatttcgctacctaatattgtactcaaagtgctgttttaaatctggggcagactgtcagaatatctgatacctagtttattgggtaattgatgaacccaatgtattaacattttataagtaaaaagaaaaaaatcaagtcacatatatgtgcttatttagcatgtatagttgtccctctgtatacatgagagattggttccaggaccacccacatataactaaatctgcacaacataagtcccagagtcgtcctgcagaaccctcatataaaaaaagtcagccctctgtaacacaagttttgtatccctcaaatccatgtctagttgaaaacaaagccacatataactgtgcagttccaacctgtgttgttcaaaggtcaactgtatattgtttctgggaaaaatcttcagctctttatcaacattaacttttgcatagcaaacatatatgtaactctcaaatgtaattaacataatgcagaaaaatgtttaattatccacgatcctataaccaaatataactactttaaatttttaatctataatctacatgaatacatcaaggttttctatactgatgaaactgccagttaaatagcaattccacctccaccccaatcccactattttaacaacccccaccgatacatattttaaagcatatcttcccacagaaatcaaactgtgcaccaatccttggagacaaatatctcttctaagaatgactgcaaatatcataattaaagaaaactaacaaacttgaagttcaaattgaatgtgttcttttccatgaggatagaatgcattctcaaatacatcacaagcacaacattgacagctgcaatttgaaaatttcacagtataaaatatgtgaaacaaaagaatggtgggagaggtagtgagagaaaggagggtgatgatcatccattttacaaaaacatgctccacttaaaatgattcattatagtatttttttttacagagaagctccacctagtaacaagtggaagtttttgttaattatacactataataagagaatgaattagactataattattatagtttaaaattttaaactttcatatgcatgtatcattttaccctaataaaatcctgtaagttacacattatgtcacaagtttacagaagaggaaaatgaagttcaggaaaggtgactgggccatccaggatctgaaagataaaagagctagggatagatgagtcaggacttgaactgaggtctactctttccaaatctcatgctttagttaacacaagctttcttggaacactcagagtacagtgtcctttaataactattgtccaaaccaaaagctttataattctttccaagaaaaggttatctatctatacaatgcttctaaccagataataactcccacatagtagttttgtctgtattctattgttcaaagctgtaattaccaaggaatgtttctggaaacaacaaatgctttttaaaaaacttttcaaagatatttaatgagcagtttattccaaacaataaatcataattatctctcaaaaaattaaaatgaagcatagagatttatactatacattgtatattatttctttgggaagtatttttatttaaaacaaaagattagttgtttgatttagatagtattctagcaagcccattttaaaaaaatgttctttttccttgttttaaagtgctatgctaattaggtttattcatacaaaaacatttatttaccaaagttacacagttacaaaatggcatacataaaggttaaactttgttttgcttttaaaccaaacagatttcaagttctagatctgcaaatgatgtacatatgaactataacaattttttatttgaaaaataatgtttaaatctaacattattttctacatataacactgataactgtggttcactgtgtaagataatacatgtcattttcttcttctaattcaatttggaaaccaactccaaatgaatagaatatgtcagtgaaatatctcattgaagaaggattaacacagtaaactgtactccacatttacaaataagcagtttcattgttaaaagatgcttgcagcttctcattctcaccacagattttcactatatgtccattgttcatagaggaccatgctgcctagagagaaaagttcttttaaatcgagtaaaagggtttttctgtaccacaggataatcataagattgagtaccccaaagggaatcaaggtggctcttcaataatttaactctctgccctgaactgacacattaaattatcatatactgtgaattcacaccctctgagaaaaaacattttcacaatacctgaattgtattgactctaaaagacaaaaaacgcaaaggcaagaagcagtttcaggtacttgactaaataacatctgggtagataatcaactccagagatctttctaaagatgatgagtccatcatttttctaagtaagcaccttaaactacctacaataaataaaagtagagtagacctacacaattatattccagccaaatgccacagcccaagtttttctctttcacatttatcaggttatgatcttaatataatctaaccagaagataacaacaagttttctcagattctaaaagagaaaaatccaacaaaggcttaacttggttggtagtgtttcacacagaactcataataattccaactgacagctgtcatactaaaagagccatcttaataaaaatgaataatatgaaatagtccatattacatattaataggggtgttattcaattactgtgttttaactgaaaattagtccaaaagcctatcattctgtaggacagactgattcaggtcacccgttactaaattaaacattttccgctttcaatgcatctcattaaacatgcaattgcaagtttaaataactccatgctttcatttacacaatcacccattttgttattgtttatagcaacctaatttggcacataataattcaggcagcattggatttgtattagactgaagtattaatttttaatataattgcattctttagtccaacaaaagctagttcagtagggattttactcatgtgagtcttccattattatacaaggcaaattcttccaagattttgcacctttctttgccctactgattcgtttctctataaattaaaaactcattataagcttaaactagcttatttgcttaaacaacacagtgaatgattacactggtacaaaatatacggcctatacatcttttaaacacctttttctttttcttttttttaattactatactttaagttctagggtacatgtgcataaagtgcaggtttgttacataggtatacatgtgccagttgctttgctgcacccagcaactcgtaatttacattaggtatttctcctaacactatccctcccccagccccccagcccccaacaggcctcggtgtgtgatgttcccctccctgtgtctatgtgttttcattgttcaactccacttatgagtgagaacacatggttaaaacacctttctctaaaggatatttgatttaataattaagcaaggcatgttttcctagcacaatgatatgtaattactaaaccccacaacttaacacaaaggttaataaagaaactcttgaaacatcaacaaaataatgataactaagagttgttccattatgcttcctgctaccacaaatctcaatgatgaagatatttggagcaatacattaaaagattagttaacatgtcacccctcatgtgtgggtgatcacagagtacaatgtacatacttgagaagaaaaaaaggtgaattgattgaaaacaagaagatcaagggtaaaatataaaatatgttcacaaggtagtagggccttaatcactaattaccatccatattgttcatgcatatttatatatcttctacacgatggctaatatatattaataccatttaaaatactggttttatgaagaaaagcattttttaattttactttttttatttttttgaaaaagaatcttgctctgtcgcccaggctggaatgcaatggcatgattgcagctcctggcaccctccaccttccaggttcaagcaattctcacacctcagcctcccaagtagctggaattacaggtacctgcaaccacacctggctacatttgtatttttagtagagatggggttgcgccatgttggccaggctggtctcaaactcctgacctcaagcgatctgcccgccttgacttcctaaagtgctgggcttataggtgtgagccaccgtgcctagccagaaaaacatatttttgaaataaatatgttaaaactacacttttcagtacttatacttaagtactgaatgaccactaaatgaggaaataaaataattaattatagccatgcataactttggcaatttaatcattatgtgaagtgtacttacacaaacctagatggtatagcctaccacacatgtaggctataaggtatagcctattgctcctaggctacaaacctgtacaacatgtgactgtactgaatactgtaagcaactgtgacacaataagtatttgcatagctaaacatatctaacatgtctaaacatagaaaaggtaaagtaaaaatctggtataaacgatttaaaatggtaccctgtataaagtgtataagctccaagaatggagcttacaggcctggaagttgctctgggtcaatcagtgagtgagtggtgagtgaacctgaaggcctaggactttactgcactactgttgactttataaacactgtacatttaggctacacaaaatttattttaaattttttcttcaataataaattaggctgggcatggtggctcatgactgtaatcccaaaactttgggaagccaaggcaagaggatcactcgaggccaggaattttagaccagcctgggtaacatagcttaagtttaattttaattaaaaaatttattaaaattagccgagagtggtggcacatgcctgtagtcctagctactcaggatgctgaggcaggggatctcttgaggccaggagttcaaggatgcagtgggctataatgacactactacactgcagcctgggaggcaaagtgaccctgtccctaaaaaataattttaaaacaataataataataataataaattaagcttaacttaccgcatatttttataacttttaaaatcttaaattttttgacttttgtaataacacagcttaaaacaagcacattatatagctgcagagaaatacttttctttaaacctttataagtcattttctattttaaaaaaatattttcttttttaaaaaatgttttaaatattttccttaaaaactaagacacaaacacacaaattagcctaggcctgcacagggtcaggatcatcaatatcactgtcttctacctccacatcttgtcccactggaaggtcttcaggggcaaaaacatgcatggagctgtcatctcctatcataacaaagccttcttctggaatacctactgaaggacctgcctaaggctgttttactattaacttttgttgttgtttaagtagaagaactacactctaaaatgattaaaagtatagcatagtaaatacataagccagtaacagttatttgttatcatgatcaaggattacgtaatgtacaaaattgtttgggctagacttttatacaactggcagcacagtaggtttgtttacaccagcatcgccacaaacacacgagtagtgcattgtgctacaatgctatgacagctatgacttcactaggcaataggaatatttcagctccattttaatcttacgggaccaccatcatacatgcagctcattgttaactgaaacatcattatgtggctcatgactgtatgtaaactgtaatttgaattctacaaaagtgggattaaggtacattgtccccttggccagttcactacagagcagaatatggtacaaggtaattcatttttagacctaatcaagagagatgatgttaactaaaacaacaaagtagattcaaaattttgggatggcacctataaggtaatgtgaaggtctctacctatattttcatgacaatattcttatacacttcagaattctattttgcaaaacaatttaatcatactgggttgtggtactttagaaaatatgtaagaataagtcattttcatgtgaaatatgaggaagaaactttctctaaaggagtatacaatcgaaacaggtattaaaaattacagacataaaattatactataaatacgtgacaatagagaattttttattgtcttatcaagcttcccatttgtgaatttaataaaaacagaccagcttaaattaaatcagtagataaatgataattttaaaatggcaattcttactattcttgattacagcgtaaatacatgaggataaaaaaacatgatgtttgaaatgagggatatttggaatcaggaatgaaaattccaggaagccaagcactatgaatctcagtaaaaaagatgcccttctctagttaacacgtaattctcagtataatgtaacaagttcataggtcaagaaacttccattaacttctttaaattcatctatttaataacatgacaagcatttaattatggctaatttctccaccgcctttaagtataggataaagatgaacaagtctcctgaaagttctctcatcatagtttagctctctgaggtaaatgaacctcataatattccccgtatattcaccaacacctccccacaacatgatttccctccctgaccagagcccactgaaatactgacttagttgttgttctttgtgtatagtacaaatgaaattggtgaaaactaattaaggaattattcttctttgtcttgtatgaccaagtcagaaatattttttaaaaagctattaccagtctaaattccctttactctctgattcagggcttcattcattcagcacattgtgaagatctactatgaactaaattaccaatgtcttgaacagaactcaggaaggctggtgtctagtgaataagacatatactttctagaataagtataacataacatgtaaatgatatagcagacagaggtactggtttctacaggagaattcttaatccagactaaagaaaataaagtgaaacatcaggaaatcgttttaggctaaatcatcaaggagctagttattcagatgattcagataggccatttcaggcataaaaattcagaaacaaaatgcattaagaccttcgggggaaagacaaatatgtataagtgagaaagggactgcattgaggtcagaaaggtaagcaacgacttgggtgtcatgctaagaaatatgattttaccctgaaggttatggggatagactgaagaatataaagctggagagagagatatgaccagatttggcttttaaaaagatcatgttggaaacaatataccagtagtctgttaggagatgacagtggaaatttaagtgagaaatgatgaggtcctcagccaaggtagtggtagtagggatgcaaaaacaagaattcaatcaataaatacacagtagaacctactatggctgggtatcattcaaggcactaagaataaaacagtaaacaaaaatctcatcccacaggaacttatattctaatggcacaaacaatctataaacaagataaataaataatataatagtatttcagatagggataagtataaaagagaaaaatgctggaaagaggaagaggatatatcagggagtgggattgaaatcttatacagagtagccagggagggttagtaaaggcctgaatgctagtaaaggcctgaatgaagtgaatgagccggctatgagaagatctaagtccagagcatttccataatagagaagagcaagtacagaagccctgcagcagtgctgtgcttgtatgagtgggagaaaagaaatgggagtgggggttgaagagaaggcagttgactatgtctacaccccttgtcctctggacttctaagtaaatacactaacagtatttatccaagaggcagaaacaatctctgaaatacccgtagcaagatgtccctagctaatgattcctatagtaaacagaacgcaagatttatgaggtatatctccctagataatattttcaacagatagaactgtctagagtattaaatggagatgtttcataatttaaatattcctgctatgtgaagtaatcccatgaacatcatatggagacttcatctgctctgagccagagaatcctgtccaatgtggaaaggaccttggaagctgccctggatatcctggacctctctctcatttgtctaagctgttagaatgcctgtatctttgacattaattaatagagtttgatactgggcaagatctctaatgcatgtttatcagatttgacagtctgatcctgtatgtttgctcagagaggaagagcccagtgtggctgctatattgtgaatgggaggagaatcataaaaaaaatgatttcagaggcttaacgagtagtcagataatatagtcccctgtaagacactgtaaggcctttgacttctgctctgagagaggcgggaaaatattgaagggtttggagtagataagtgacatggtaattgttactggtatcttcaacaaatactataaggtgccaaggacagaaataaggagactagttaggaagctgtaataagtaggttaaagatgttggtggctgggagaggtaaagttagtgagaagtacctgtattctgcatatattctgaagaaagaaccaaaaggatttcccaacagattggatataaaatatgaaaacaacaaaagaaagaggactcaaggataacctcaagttttatgccctgagcatgtgcaaggataaaacagctatttgttgaaatgaggagaaccatgggaaacagcttaaataggaatgaggaggagttcttctttggatatactgggtttcaaatctaagtaaatatcgaaatgctgatgagaaggggaccattggatatatgagtctggatatataggaaagaagtctgggatagacagataaatttgggagtcatcagcatatcaatggtatttttaaaccacaagcctggatgaaatcactagagagtcactgttactagggaagaggtccatgaactgatacctagggtgctctaattattagagatcagtaaaaggaagaggagtaagcaaagatgactgagtagcgactagggaaattagtgaaacactaggagcacatggctttactggaagccaggggaagaaagcatttcaaggaagaaagaatgatcatctgtgcctttttaacagtaaagaaaaacgaggattaaaatttgtccattggattttgcaacatgcaggttgctggtgaccttaataagagatatttaaaaggcaaaacacatccccattttagatatctaaaaataattcctaaggttctggctaggataaatgggtaggtgataggctgcagatggacttagtgagtacagttataatactccatactcagcttcaaagtatgaggaaaaacacccaattacatttctaactaatgaagtgttaacacttaaaatgaaatttaaacacattaacacagaaaatcagggggaaaagtctcacatcatacagtttactatttttaacctgtctcttcttaaaatgagatcatgaacatcacctgacaagggcacgggcccatttacaaacaaaattttcttggattaaagggcctcctctgtttaagaggagagatccagatttaggtctataagcttgcccaacagtgtcaaatcctctgggtacagaagatatttccaaatcagacatttctgctggaaacagcagatgggaattttgttttattttatacatacccttttggcaaatatatctctgaaaaacttgccctgcagaaactaattgtctaagcaagattttctttttttttaggttttcgcccaacaggaatcaaatctgtgaatagagaatttaaggctggatagcagcactatttttgacttgattacaaagcagaaacagagaagaccaggcactgactggctagttgcagggaagattagacggtgagattggcatccagggaaaatgcacggccaactgggaggctgccccactaccttaatgccagggatactagatatggaaacagccaaccatttccagactctgttgaagaagcagttttctcatattggtaaatgtggctcagggtggataaagggctaaatctcccagaagtgaagttttggtacccacagttgtacagcatgatatgctgtagggcaggaaccaatgggaaaggacgctgatatactgaattccccctattaaattccaatcctttgttaccttcatctttacctgcatctttgttacctgcatcttgcaaataagcaagagttaactgtttaaagcaagcaagcaagcttgtttacagatcattgaaaacaattatcaacttgatgagcttcaaagagctgtgggataatttagtactaatctaaagagatagacaacatttctaaaatgttgcttattttagcagaaaacagtttaaggcagattccttcccacatggttcagctgacagccagctgcccacataaattcacgtgagtacattctctccaactgtctctgaacatagaataggctatattactaaaagcctttttctgttggaaatgtattctattaaacactttttctcctaagcctcagctgcactttcatgagcagtatattgaacccaaatcaaaatctctactttgtgttgagatctctgattctcaatggaatctgataaatatcaatttgatttaacaaaccattttggagcagtgataatttgtcaggagctgtactaatgaaaatatgctttagagaccaattcttatcatcaaggattgaaggatggggtgagcaaggacaaaggaatcagaaaaaaatttcatggaagggacattatttgagatggactgtgaaacatggctagggtttcaaagggtagaagaacattcctaaaagaaaacacaatgtgcaaagacccagaagggcagaagcactgagtctgcacaggcccaagaaaggtctgcttagaaattgctcaagatttcagagtagcagagtgagatgatccaggtttgattttttgaaaattagactaggggcaggataatgaaagctctaaaaatatgagaaagaaagagaaagaaaacaagcatttgtggtcaagaaaagaaggggtttctgtttttattcagggaaatttaaaggaaaatagatttttgtaggcattacaggattaaagtctacatgactgggttaatgactgattacccaagtcagtgaggccttccctaaccaatctatcctaaaatcacagcagcctgctctcacacatgggggcatgcctcttttagagttgatttttgaaatagcacttaccacaacctaacatactttaaacatgtttaaacatatattaaagcatattttacttacttagtttattgtctgtcttccttgaatataatgtaatatttatgagaacagtgactgctgtatctctacaaacataagtaataactaattcactaaatgcataaacacatgaatgaatataaaaatgactgaaatctaacactgtcattaaaagaaaccagggagccaggcacggtggctcacacctgtaatcccagcactttgagaggctgaggtgggtggatcacttgaggtcaggagttgaagaccagcctggccaacatggtgaaaccctgtccctattaaaaatacagtaattagccaggcatggtggcatatgcctgtaatcccagctactggggtggctgagacaggagaatcgcttgaacccaggagacagaggttgcagcgagccaagatcgcactattgcactccagccttggcaacagagcaagactatgtctcccaaaaaaaaaaaaaaaaaagggatctaggttctatctccagctctggcactaagaacatcagtttaggcaagttacttttcttccataaagtgcatttccctcatctataaaattgaggcctaactgaacttacatacacccactgtaaaattagactaagtccccagttaaatagctaagactacggcattttcctgccagacatgtgaaattgccacatttttgtcatgccactgccctcttatacacatagttaaaatcacttagccagaaagaacttatgatgcaatagacatgcttccatttaaaggaatgtttacaaacagcagctctcctatttcttgaatcaagctcagcatgagcaaggtcacagcctcattcagatgaagaaagcaaagtcaaggcccgggtgtctttgatcaatttctctaccctagctttcccatgatccagaaagtttgtttccccaaaggccgcccttaactgattcaataccatgttttctggatgattttgatcataagtttggtctgaggatcacaactacaaattcaattcttccatatgtccaaaattccctttagtgctaacgtgctatatttccataaatttttatagaaacttaccaagctgtggggttgataatctttctttcttcttaatacaaatgcatcatcagaatacgcatggtctcaaacataccttttctgaggcattaaaaaaacatagtgatttaggggaattttaggtaatttgaatgggtaataaaaaacaattgtaaagtcctttgaaaatgtaaaattactaagatttattcaatgtcattatttaaacataccctaatttgttattatttaacatttgtttcccagttggtcagttatggctgatgagctgcagggtgatgggaacttcatgccatctgtttcattgctaggagcgctagtctccccaggtcacttactgtgattataaacatggcctcaaaggaaacagtgactccatgccctaagaggccagaagctcagattttcttctcccaattctctcaccgatttactgggcaacttctaaggaggacattcttaaccttgaattatcttttgacccaatctttaatagacttaataggggtaatattttttttcttttttgagctttcagattatattaactttttttctatatactattctccaggggtaatattacttctcatccataaaggtgtttgctggattaattaaaatattattccaggatagaccacaaattgaaatgtggaacaatgatcattccttcatgtctatgagttcatgagtcattgtataaaaatagtgtcggttcattctctgtatcattacagagtatctttttcaaagaagaagtagtaaattctggcccattcatgcctgtatgctatctatttaagtatggtaattcaagacattttttaattggcactaattataaataataaccccagcttcacaaaacaaacagaggaagcagtcactgatacatttactttagaattagacaaaagtctctgtccccaattttctcactcatcaacacagcaccaccatgatgttttaaattctaccattagagatttatctctctatgtgttatatattattccccccaagacattctcttttaaaaagctgatatccctaaaaggagtaggatattaggatgcaaccaatcaataacattgtgtgaagtctcacagggtggaaggaactcaagagtattagatgttttgtggatagcagagatagaaaagggaggcaggagttgtcttaagacaaacttcacctagctcatggttttgcccaggaacaggcttcagctatgtggtggcagcaataggaaaacaatgccaaagaggtaaacttgctgggtttcaaaaattttgtttttgtcgtttatctaataaaaaaaaaaaaaaaaaaaaaggagccagaagcgaaaactacattcccagggtagagatatgagttaaacttcacatttctctttttttttttttttttttttttttttttttttttttttttgagaccaagtcttgctctgttgcccagactggaatgcagtggcatgaacggggctcactaaagcctcaacctcctgtgctcaaacaatcctcctcccaccagcctttccaatagctgggaccacaggcgagcaccaccatgcctggctaattttaatttttctattttatgtagaaatgcaacctcaccctgttgccctagctggtctaaaacccctgggctcaagcaatcctcctatctcagccttccaatacctgggattacaggtatgagccactgcacctggccaaacttcagatttctatacaaactattatcttttctggtccttggtaaattggaggcatctgcaaatattgtccattttttattacttctaaagtaggtggagcaaggtccagttactgcatagggcacaaaagtaaggacaatacagggagagagggctcaggctctgcctatgctacttctgcctacaactgccagtgtctgagatccatacctagtcatgagttgacagggcactggcagggcagagtttgtggcgataagaggcttcactgtaaaattttttatcaaaagcagcatctgctcatttaagaaacacttttatctgattcatttccttgtcccaacaaataccagtctttttcatattattatattgtctcatcatgctaagacactatataaataagcattaataaatgcaatccatatagaaagacattattcatatggaaagactgaacaaatgatagaatttttaagccaaatcaagtatatatcatcttgaaagacatgcaagtatgcaaataaatgtaaaataaagtggcaagtacaaaaattatatgtgtttgctatatactatggactctccagaaacagtgccacttttttcatcttataattaaaaaataaaaagacatattcactgacaagtattattaaacacactatgaatacagtattttcttctgtatgtatatgatgttaaatgcaagttttaattaatggtagtatgtattacagttttttttaaaaaaaaacaatgttcacatcatgaaagaagatgtaacaaattatgaaattatgttatcaaaatatggaattatgtgtttaaatccagttaagccccagtatcctatctaaaagaagacctatcaaatgcaaactcaccacacagaaatgctatcctaaagtatatcatcaaaatccactcagaaattttcctggagttgcaccatttttggctacctatacctgctctaaggagaagctcttatcatgttctgatttgagaatacctctttcaatattggctaactcttcttgtctttcaagattcagggcaggcatcactctttggtactgcatgttattatattaacctatacaaaccctattcctattgtaccatctttgtgtgtgtgcatgcatgtgtgtctgtgtgtgtgtgtgtgtgtgtgtgtgtgtgtgtgtgtgtatcctccccactgatttgaaaatcaccgattttcttttcctagtgcctacaatgtagctgccctaattaaatgggggaagagaaagctggcttgccttttatttaaaaaaataaaaaactatttcattcaaagaaaatgtgtcaagtgaatgtactgtagcacagattccattacttgaaagttatcattacctgtctcccattatgataaacttcagtagtgccttaaagaaaccttttcaactgatctgcttttcattttttaataatgttcagtattattcttgaacatagtgacagaatgcaatcctaggactgaagagtctaaatgtattctatttgtcatgagtattgtatttagtgacttgaattcttttttatgtagatgtagtccatcagttatcttatatatttatcagagttcactataaagaaaaaaatttctttaaaaatatgatgcagaagagaagaaactttatgctattatgtgagcaaattagctgtcaaaaccaactttaaaaggcttaccaaatagcatcctaccctttggaaagtagttgccaaggtaaagagtttaatcaaagtaatttctacatgatgcctatatttcaataatttatgaacggtacgtttgaactgaaaagacctccatctaataaaaacacaagtatttatttgtttttattttcttactcatagaattttttctttattcctctaggaatatataacaattggattttgtttatgccaactaacatggcatctctaaaatgagcacttatcttacatgaacaatttttcaaaatcttagtgtaaagtacagtctcaggaccacataactcccgctaagactattatatactccattaacatactgatatggtttggctgtgtccccacccaaatctcatcttgaactgtagttcccataatcaccacatgccatgggagggacccaatgggaggtaatttaatcacggggacagttaccctcatgctgttcttatgatagtgagtgagttctcatgagatctaatggttttataaggggtttttcccccttttgcttggcacttctccttcctgttgccatatgaggaaggacgtgtttgcttccctttccatcatgattgtaagtttcctgaggcctccccagccatgctgaacggtgaatcaattaaacctcttcctttataatttacccagtcttgggcagtcctttatagtactgtgagaatggattaatatacacacccaatggaagaatggacaaaagctgaataacataaaattcatcacaaattaagactgcttttggagtaaaataatgtaaattacacttatgccctcatgctgtatttcactgctttggccagtggttctcaagcttcagtgtacatcagaaccacagggaaggcttattaacacagattgttgggcctcacattcagagtttctgatatagagtaggtcaaggttggggcctaagtaagtccatgtctaaattccaaacatccaagtgatgctgatgttgctggtcacgggaccacattttgacaatcagtggcccaggtaactacatccacacagatgcctgccatgactccaaatccacctctcaggatcaggcttatctatccaattgaccatctggatatcttggagagtccctaagtacaaatgccctacattacctaaaacctatctcagaaaaaaatgacaccaccatgaagcaagttgctcaagttgttcaagcttagaagtcattcttaactactttctctctctggtcacattctattcctacacatgtttccaacctgtctacttcatctctattaccacactaatctaaaccagagtcatctcatgcttggaccacagcaacagcctcctaatcagataaatacaaacactccatttctactttttccccacccgatctgttttctgtaatgcagacagaataactgttataaaacataaacatgatgacattaaaattctccaatgacttcttatatcttttagacaaagtctaaaatccttaatgtggcttcccataacctccaagataaagcccttactatatctcttcaggattatcttgtgtaaactctcccacctaactatgctggccttcaaccacttctcattttatcctccctcagggcttttgctcatgctaatgtctataaacagtctccaccttgcttttttagcaaactcctcatttcttggatctcagcttaaatggcatgtctaatacaaacctttcctgattccccaaaataaataaatcactactatattctcaaaaggcactgtacactgctactttagtatgattaaacacactgaaaattacttggtcatactacaactatttacctcactagctaagctccacaaggaaccattctgtcttgttcaacattttaatctcaaggcctgtacagtgcttcacacatagtaagtgtcccaaactaggcactgattggctgatacatagactattataaaaatttttatgtgttaatagagaagaggagcaaacaaaagtagaaaagagctgaccaagttcacagaaatgtccagccatgggcttattcccacaggacatccccaaccttttcaattgggctcacctagcccttttctttgggcccacacacctcagactctaggaccaaaattggcaattggcagaaagatagagatttcaaagtcagcttttcatttacccagtaagatcacctcagattataatacagaagtacatagcaagagtacagaaattagctaactgatctagatgttggaggaggtgacaatggagtcttgatagagtataaagaacattacaaatggaagaaacacctagatcaaagtccagaaattaaaaatagctcagcatcctgtaatctcagcactttggaaggtggaggcgggcaaaccacttgaggtcaggagttcaagaccagcctggccaacatggtgaaaccccatctctactaaaatacaaaaattcactgggcatggtggcgggcatctgtaatcccagctacttgggaggctgaggcaggggaatcgcttgtacccaggaggcggaggttgcagtgagccgagatcatgccaatgcattccagcctgggcatcagaataagactccatctcaaaaaaaaaatatatacatacctcagcaatgccgaaacattactggaacactgaggtataaagcccaaagcagtggaaattttgggctgcacgagaaagacagggatcagatcatgggtagccttatttgacataataaggaggttaccatgagctcatagcctaacaggaaaaatatggaaaactagacatcatacataataataaactctaaaataaaggaagtggccggatatagaacaacagttatcctgccatgggtatggggtcatcatgaacaaagcatacaaacttctaccttgaggatgcagggaggtgcacgtgcaatattgtgagattcagagataggggacattcattccacctgatgaaggaacacttcccgagggagcaaggtctgaaggggtcttaagttctggatatacagaggttacggttaggaacattcaaggctcaagcaaaatcatagccaaaaccacaaatattacatggaatatttctggaattaataattatgtttggctggagcatagtggcataaagggaaggaatgaaaaggatataaataaaagtaggtttgatcttaatactgagaggatgcaaataccaaagtcatcagtttgatttataacaaactccattttttattaagaactatatatacttcttaaattttatggaaactaataacttgcctacagtttcttcagtcaacatataattttcaaagtctttcatgggaagaaaatgtgcttccctaacctattctttatttactctgccaatgacacccaaaattattacttccatctgggttttaattacacctgtttttcccagggggaaaaaatcaatgtaaatccaaataaaatatagtagatagttctaaaatgtaattagtgataataatcaagcaattcctacaggaaaaatttacaagtctctgatctggtaggatcaccttttcaaaatgggaagtcatcattacataatatgaaacattaaaacttccattaaaaggaaggctaaaatgagtcttaaataagatgcactcatattaagaatctttttacagtaactgaagagaatcttaattattttactttacttgagcctctctaaaaaccttattgccagtaatttgggctgacgaatgtagtcaatacagaagagcctcaattttaacacttctccctcaaagcctgtccctcttgtggttttctgataggctattgttagattcatttacagtaaaataattaccagctccctaagcaagacacatagcaggttatctattgtcccttagaggactgttggactgttcttaacaagcatactaaattacaatagcagctttattgcaattaacaaacagacatgaatcaccaatccagttatatctcaaaagagagaagggttttctgaagtatactgctgtggttgttttctgaacaactgttttgtaatcctaaattcaaagacccgtatttaagcaaacaggcacatgtcccaggagcaggcaacacagatagaatagtttttcttgttattcccaacagaaagagtaatagtataatgatttagagaattaacagagtgcagacatgaaaagataccagcattccccatcagtacgtaaagcactcacgcttgatcatttacagctctgtctgcttgacatcttccagtctctgatcccaaagcagtagcaccaaggcgcaactctgcttcttcatttacattgacattctaatctcgagatgtgtcagaattaaagttggcaagtttccagactatttgaattctttcatgttgagaaaaatgcaattgcactgtgcatattcataggaatcccatggaggctcccagaggatctgctcacagagacaaggaatacaggtcagtgcctgtaagtcaatgagaccacattgcccactcataagaggtggagggacgctaatgagataagagacttggcccaaatgcttctctacaaataacagcaaagcactctcacacaaacatttctaccaacaaactcaaatatttccgaggagaattagcttgttaaaaagaaagtttatgttctgaattgaattcctaatggttttgaaccagaattactgttcccccaactagcatttctatacttgggctacttcctacaagtaattcacactccaaaaacagttgtgggggactggtgaaggaaagacagtaattatactgaaaatgtaataatacaaaattcacttctaacaaatcagatacaacttattcagtgtgggaggtgtgcatgagttattcacaaggtaacacaattaagttttaacatacaattttatagggattgcactgaatcggtagatttaatgataatgattcttccaatctgtgagaatggaatgtttttccgtttgtttgtgttatctatgatttctttcatcagtgttttgtagttctacatatagagatctttcacttccttgattaaatatattcctaggcattttttaatagctattgtaaatgggattgtcttcttgacttggtcctcagctagattgttattggtataaagaaatgctgctgattcctgtatattaattttgtatcctgaaactttactgaatccattgatcaattctaagagttgttcagtggagtctgccgggttttctaggtataagatcatatcatcagcaaacagggataatttgacttcctcatttccaatttagatgcctcttatttcttaatactttcaacttttccccattaagtataatgtcagctgtgggtttgtcttatattttctttattatgttgagatatgtccttctaaggcctagtcttttgaggatatttatcatgaaggggtgctgaattttactgaaggaaatttttgcatctattgagacgatcatatggtttttgtccttaattctgtgtctgtaatgtatcagatttaccaatttacatatatcgaagcatccttgcatccttgagataaatcccacatgatcatggtatattaatctctttgatgtgctgttgtgttctatttgctagtattttgttgaggattttgtgtctatggtcatcagagattttggtctgcagttttcttttattgttgtctccttatctggctttgggatgaggttgatgctggcctcatagagtaagttaggaagaattccctccccctcaattttctggaatagttccaagaggattggtattagttcttctttattatttggtagaattcagctgtgatcccatctgatcctgggcttttaccaatgtcatttttcacagaattagaaaaaaaaaatcctaatattcatgtggaaccgaaaaaaaaaaaaaaagccaaagtaatcctaaggggaaaaaaagctagctgcatcacactacctgacttcaaattatattacaaggctatagcaaccaacagagtatgggactgatattaaaatagataccaagatgaatggaacagaatagagaacccagaaatgaagccacatacctacaaccagctgattttcaacaaagtcaacaaaaatatacactggggaaaatgccaccttatttaataaatggtgctggaaaaaatgaatagccacatgcagaagaatgactggacccatacctcctttcaccatccacaaaaattaagatggattaaacacctaaatgtaagatctgaaactatgaaaatcctagaagaaaacttgggaaaaactcttccggacattggcctaggcaaatactttatgaccaagttctcaaaagcaaaagcgacaaaactaaaaatagacaaataggatttaattaaactaaaaagcttctgcacaacaaaaggaacaatcaacagagtaaacagacagtctatagaatgggaaaaaatatttgcatttgacaaagggctaatatccagaacctacaacgaactcaaacaactctacaagataaaaaaaaaattaaaaagtgagcaaaggaatgaacattttccaaaagacgtacaagcagccaacaaacacacacaaaaaaatgctcaaaatcactaatcatcagagaaatgcaaattaaacccacaatgagataccattttacaccagtcagaatgactattaaaaagtctaaaaacactgtaattctggctattcaggtggctgaggcacaagaactgtttgaacccaagaggcggaggttgcagtgagccgagattactccaccacactccagcctgagacagacagggaccttgtctcatttaaaaaaaaaaaaaaaaaagtctgaaaacaacagatgttggcaaagatgcagcagaaaagggaacgcttgtaggaatttcagtacaacctttatggaaaacagaatggagattactcaaagaactaaaaatagaactactattccatccagcaatcccactactgggtatctacccaaagagaaagaaatcattatataaaaatggtaactgtaatttgtgtgtttattgcagcactattcacaatagcaaagctatggaatcgacctaagtgcccatcagcagaagactggataaagaaaatgtagtatatgtaacactacattatgctattcagccataaaaaagaataaaatcatgtcttttgcagaaacatgggtggaactgaaggccattatccttagtgaaataacttagaaagtcaaataccacatgttctcacttataagtgggagctaaacaatgggtacatatggaccgtggagtaaaagacactgaagactatgaaaggtgagaggatgggagaggggtgagggctaaaaagccacctgttgagtacaatactcaatatttgggtgatgggtacactgaaagcccagacttcaccactacacaacacatacatgtaaaaaacttgcacttgtatccccaaatatacaaacaaataatttctttgaaaagttttaacatacacatttacagtgcttctcaacaatttctgccctatggtatatagagaaaattatactctttatatgagacatgagtaaacatggtttgtatgtgcagctggagtgaactagcctgggggctccagccactctcaaactcttcatctcttctccactcccaacaattgtttttgtaaaatgacacacttttattgtcaaaaaaacacagtcagatcagatagttttaaaaatgaatgtcaccatttagagataaccattgtcaatgcttcactaaaacatcattccagtttctctctacacatatacagacacatcagttgcacaccccagttgtgaaactcagtaataaggcatgatttacacatatttgtattaacgctccaactgaagactttttcatctttaagccctgaaagtgagaaaggaaaacctaataaagtatgatcttttgttaataacatgttttataattttctagctcatatatattgttcttgctctaccttccccacatacacaagtaatctagttttctgtgatcaaaactatttccttgaaatctacacccaacttgtacccagaaattagatttaaaactctacctctaatccaacttttaagatatcttgttcttaacagaattagaaatattcattttaatggtttctaagtcatcagttctatgagaatgaaatattttcccaatccttaagacatgaaacatgaaaaaaaaaatttcaaccacccaaataatccataaaaatcaattaacctaagtagtctattgagagcaggtcctctgtgcagttttgataatcacagacattgaaaaacattattgtatttgattttactttttatctcccaataacaaatcttatacagcagaggctattttatggaagtgataaggtttacgccagattttcaaaattgggtaaaatgtataaaacagaagaataaaagcaaagttggaactaatgtggtcttagcctgattcaaaaagctcactgtaatgggttgaatagtgaacccccaaaatgatatgccgaagtgccaacttccagaaactgtaaatatgaccttatttggaaaaagcttttttgtaattaacttaggatcttgagataagagtactgtgaattaagatgggccctaatccaaagacaagtccgttgaagagaaggagaaacaaacagaaagacagagaagaccatgtgaagactgaggcagcaactaaaaagctatttctactagccaaaggatgccatcttgagatcctaagtgaattacgaaaaccctttttctaaatattattgtctcaattttacagttttgtcatctatgaaactaaggcaagatttctctgacttgatatcacataggaagggacaaagcaaagatctgaactcaggaagtcgggtgcaaaaacatgtgcttttaattactatattataacctcttttgcttgaagaacaaagtggaccttggggtgtaaaggaaaataaacagacatataaagaggccaggttacagagacttcaaaatacaaaggattttgtccatgatgcagcatatagagaacaaacatttcgggcttttaatgcattgcccagttcattgcattgactccatctccaacctctatcttgacctatccagttttctccatctttaatgctgactaacccactagtgtcaaccttcttagtagtctcctacttctactcttgcctattcaaactattctccacaaataagccaggatttatctatcttttaaaaacaagtcaactcactcctcttaacaccatcaatgacttcacaggactcttgaaacaaaataaaactccttgccatactctagcaaggccctaaatgatctggctttcccttcgacatcgtctcattattctcatccatcattatgttttagctgtcacagcctcctttctgttttacaagcatgccaagctcttccctattcccgggacgtcacatttgttgttccctctgcatgaagtccttttttcccagttcctgcatggctcattcacatccttcaggtctcagctcacataacatctcctcagatgtcttcactcttcacctacctaaggtggtctcttaagttatcccaagattgtatttattactaccaaagcccttatcacagtgtgagaatatcctttatatacttgtttactgcctatcacaacacagaacagaaggcccaaggaggcagaaactttgtccagcttgttcaccacagaaccactgtacctaaaacagtggttggtacacatcaaacattttagaaaacattagtggcaagcaaaaaaaggaaatgtcatgatgaactggtcttccgagaaacttggtctaggaagtaacgtacaggatgacttcccaaaagcacagactaaagaaacagacaaattaggcgcctcttactaaaaacttagtaataagtgtttaaaggcttggataagaactgattgagtaagaacaacaaagaaaggagtgaaattggccgggtgcggtggctcaggcctgtaatcccaggactttgggaggccgaggcaggcagatcacgaggtcaggagatcgagaccatcctgtctaacacggtgaaaccctgtctctactaaaaatacaaaaaaattagccaggcgtggtggcaggcgcctgtagtcccagctacttgggaggctgaggtaggagaatggcgtgaacccagtaggcagagcttgctgtgagtggagatcacgccactgcactccagcctgggcaacagagcgagactctgagaaaagaaagaaagaaggaaagagagagaaagagagaaagagagaaagagagaaagagagaaagagagaaagacagaaagacagaaagacagaaagaaagaaagaaagaaagaaagaaagaaagaaagaaagaaagaaagaaagaaagaaaaagaaagaaagaaagaaagaaagaaagaagagagagagagaaagagagagagaaagaaagagaaggaaagaaagaaggaaggaaggaaggaaagaaagaaagacagaaagaaaggactgaaatttagaaacttgcagaagataaaggcaataaaatttagtaaccccttaaatacataggatacagagactaaaaaatgtggcaagtcaagaaactgtcacaaacctcacagcttaggttacatggaagacttccatagcatttgaagtctatactttatatacttcataatttaacctttattttatccaacaggaccaaacactaagtacccaacagagacacttgggaggcatagtaaacttcacagaggtgccatcacccaagctgacccaaaaaataaccagttatttttgtcaaaactaagaagacattaaattattacatccacgtttatcagaaaatgtaccaacattctgtacaccagcattatataaatgggggtactctgttataagtcaaggataggaaatgacatcaagtggcaccaaaaacaaacaaatttgatttcatacagtgaagagacagatcagtcagagcagtaaacagctcttctctaaaggtgacagggtactggaaagagaccacaggaatggtaggacaactaaggttgtttttatagaaatcatgaaatgttgttaagctatagcaataaatgtagcataattgttgctaagttatttagtattattttctttttttaaaatacattcaagtgtaccatgaaaaatttcagtattcaaagctgtgtccaaaagagaaaataattgggaattgctgaccttcaatatttcaagcattgtgctaggtagtggacaaataaacattaataaaacatagcctcataaagcttataagactaattggctatgatggaaaacaagcacacacataaaaaaattatagaaagaagcgtgacagatcaacttctggcatgacagtatgaggatctccactgttctggtctcccgtgaaactggttaaacaaattttttaaggcaaatgatcttcagagcagacagcaaatgaagaaatatctgttcttacaaaaatggaaattcggtaagaaagggaagagtatggtatttgaaccaagactgctcccttactccccattcccagttcagaaataaagagggaacttttgtaatgataaaagagccaatcaatcaggaagttatagaaatgataaacatatatgcagccaataatgatgcacttaaatatttgaaataaaaactgacagaaatgaagggagaaacagatgattcaacaataatagttggaaatttaaataactctttttttgattttttttttctttttaagacagggtctctctgtcacctaggctagagatcagtggtacaatctcagctcactgaagcctcaacctcccaggctcaggcaatcctcccacctcaacctcccaagtagctgggaccacaggcgtgagccacaatgctaagctaatttttgtgtgttttatagagactgggtttcaccatgttggccaggctggtctcaaattcttgggctaatatgattcaccccctcggcctccctaagtgctgggattataggcatgagacaccatggcctggccaataactcactttcaacattgcatagaaccactaactagacagaagatcaacaaggaaacaggagacttgaacaatactataaacaactaatctaacagacatcagtagaatactccatccacaacacctgaatatacattattttcaagcacatgtggaacactgctccaggacagatcatattctaggccataaaaaaacctcaatgaattaaaaggataaaaataatatatgttctctgatcacaatagaataaaattagacatcaataacaggaaaaatgtggaaaaatcataaataggtagaaattaacctactcctatgtaaccaatgggtcaaagaagaaatcaaaaggggaatcagaagaaaaacaattacagaacattgtggtaaatgcaagaatgggagctagcaaggagctaaatgtgcatatagagttgacactaattctacctaggaaaatgcaagaaagaagaaaactacagaacagaggaagtaacatttaggcaggtcttgaaagatgaatatgaatttatgtggcaaagacagggagaaagaaaatgaaaaacatggaagcagcttcccaaagcagggaggtgttgaagtgaatgataaaatctgaaatgatgagcagttaggagtggctagcatgtagggtatgtggtaggagaatggcagtcgaggaagacgagctggaaaaagaggttagggccagattgttaataaacaagaacactactccaaggggcctgggctttactttgggtaacaagacatcattaaagttgtaaaaagagacatgattggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaagagacatgatcagatttgcatttcatatcatattctatgtcacagtactcatgtatattaccattttctcctcagtatatataacaaaagtttttcaagacaggtaaaataccctgtagttctcatggctctgccacagttacgggctcaatgctgggaacactgcagccatctaaaaaaaacagttactttttcactgcactaatagtacaaaacttctagatatattttgctcataaactgaagaactgttcttttgtttgcaaattcagttagccttgctgactattcaatataactgaaaaaaatcataacttgtgtttccatagcttttaatgtcactgaaagaagccttaacatcctcttctccttcattactacattactacagccacccattgtggcagttagacaaacgaagccagcatttggagagagggagtaggactgagaaattggccaagaaaaaaaaaatgtatttagttcatggaaaggaaacttgaagggaaatccatgattcttagaagtggaagagtttagggaggaatgtttgggaaaaccgtagtgctgacaatgactttgcttaagggtagcaagagtgaagaggaaagacaggtcagtagagttcagaatgactataagcccggggctttaaaaatttcacaaataagaaaggttgcaggcactgagagcaaaaagaaaactggatgaagtgttgccatagaggaaagaaatccagagtgaaatctctagctcagctatgacaatgtactctgtgagcaatgaaagttcaaggggtttttggaatactacaaaactatccatctttatggtggacaaaaagttgcaaatacaggaaaacacactcactctaccaggcattggagaaagtagaacaaaatgcagatctggccacctaggagctcaaatctaatgaaaagggagaaatgcaaattaatatgtgccatcagtgaaacaaggactgatgaggctgtttgtctacagccatgagccacagggtggagtgactgtgctgagggtaaggaagagcttctcagatgaatgagaggatcatggagaatggaaaggagtttgcaccgacagcatcacataataaaggccttgcaaagagaggatatagcttaccctatgacatgaaacagtgtggcatatgaggaggaaatgaaggaacacaaggcaggaaaggccatcaggatgcaattacagagggcttttagtacaatgtaacagcctaacaaacgacctcaaaatcgtatgatcatctaagcaggacaccctgtgaggaaaacaaaaacaaaaataatcagaaatcatcatttacaaaataattagcaatgtttccttgggaaagacctgattgaacagagaaaagcctttaaaatgatcagaaaatgaagggaagaggcaacactaaagttttcaagtttggactgaagtctatgaaatcatgatatcattaagggcgtattctctaaatttcagaacactagcttaaaggggaatcattgaaacttaagggagaaaaaaagcaattcagaatcatacaagaattacataaatgctcatgcaattcaattttcagtgctaagaacagacttccccaaagcagtattcccctggtcaaatcctctagaccctcaccaatcagaattcatttctccctcctcaagacttccacagcatatgatagcacttaacacagtctttcttgtgtctctccaactgtaagtcaatttcctgaggctagagaccacacttaattcatatttgtatacccaacagtatctagattcaataaatgcatatttatgtactgcaaaatattcacagggatactattaaatacaaagtaatgtgcttaatacttctgcatgataaagaatgagagacaacaataaccctgaaagtcctcatatctggtaggggggttatgtatgaaaaccagtcactataatccaaaaccaaggaagaaggttcaatcaaagcttacacttgtaggttgttatgttgtttttcattcattacctacaggattccaaaaggatttttgatagcttacagaagtacatacagtataacactaaaaagactaattattgagaaggcacacataaagaaaaaataataagagaagaagatggagtcaggacagttcacgaaaagtttaacagaagtacagttagagatgcacttggcatcaaaaccaacagttagaagattctcagcaacagttgctcaggagaagtttagctattcctgacactgggacaggacagttaagaactttctcctatggttgttcataagacaaagactatgtaatatatggaccatctccttaagcattccaccacgatcaacgcaataatgacttaactgagattgcgtattaatgaccctcaatctgtcaatgattacaccacactaccactcagtaaaagcaattctcaaagggccaaaactctacgatgatgtggcttgaattaaaagaaaaggtctactccctagcagaatgaacggattacatattcctcagaaatattatgcaaatattatcatagagaccgttttgataaggacaaagtggcatagagtttgagattgtggtctccgagaaaaaacaggaatataaatattctctgttgtcaattaagggcatattgaacttagagaattagcagattaacaaccaggtttgcattacttcatgaaaacaaaacagcagcatgtggagagtaccccactcctaagcaaaggaaggccatgatttctctcagaaaatggtcatggatcctctttaacacacccatcagtgggtgactgaggtcccagagatgtagagcctagtcagaatgatttagggatacacactttccaaggcaggcattcccaatcaccatgctgtaaaagaaaacatttgataagacacccttagaataattcaaattaggcaatgtttcaagataaactggctgcaaaatgtgctctccctagagaagtgagatgacttgctccatggggttgttactatgaaccataaaatatcagaggatctctgcaattgattttagagaaggtgctatgaaaccattcttacagccaataattagatatcagaaacaatgttctttaaagcccacctcaatcctgtctgtggtaataaattaatgataccagcataagaaacaaccttacttttctctacatgggaagaaaaataagaaggagcatatatcctgctcacttaagtgtgccaagccattacgatacaaaatgaatctctaaacgtacatattcctgctttacctgctcagaagtatttactaagcaatcaggaaaacatctgcaaaccctgattttgactgtggtattaagcatcataactgctacgtaaagccaccataaaggcttttgtattaaacaccataactgatttgtaaaggcaccatggatggagggcaaaggatggcactaatatcatggatacagatgtaacttacagtcttttgttccacaaaatcaagaatccacaccaaaaaaaaaaaataaacaaacaaaatatactttaaattggcaatatttttctcaaggtattgagtatgaaaatggctacgtcggcttgctagttttgttcaaagttgttatgaaattaaaaactgccatacattctgattcgggcccagagttggagggaattgatgattatccaataaaaaatgtatataagtctaattacagagaactagaaatgtaaagccaaaaagacagccctttgaaatagccctcaagcagtttcacagacaggagaacttccacggactcccttctgcatgatggatagttggaccaacagaaagaaatattggagtctataaagtttgcagcatttaatcttgcttcataaagctggaaaatataatctatccaaattccaatcaaagagaatctgggtttccataagctcaataatgaaatgccttgcataggtaaacatcaaaaattaccaacattacatttctaagagtcacatgacgattctcttgtaatttattacagattttttttggctggttttcgttcttactgttgtttccaatgcactaagatatatgttaaacaatgtgctatgagagtttcaaagacagcagagatcacattcaattgtagatatgcagccataagcaggaataaagatgtggtcaaagggaagagatattctatgaaagaaattcgtatttggtggatttaggttatttgttaataaaattaactcaagatggattaaagacttaaacctaagacctaaaaccataaaaaccctagaagaaaatctaggcaatgccattcaggacacaggaatgggaaaagacttcatgactaaaacaccaaaagcaatggcaacaaaagccaaaactggcaaatgggatctgattaaactaaagagcttctgcacagaaaaagaatgaacaggcaacctacagaatgggagaaaaattttgcaatctatccatctgacaaagggctaatatccagaatctacaaagaacttaaacaaatttaccagaaaaaacaaccccatcaaaaagtgggcgaagggtatgaacagacacttctcaaaagaagacatttatgcagccaacaaacatgaaaaaaagttcatcatcactggtcgttagagaaatgaaaatgaaaaccacaatgagataccatctcactccagttagaatggcaatcaataaaaagtcaggaaacaacagatgctggagaggatgtggagaaataggaacgcttttacactgttggtgggagtgtaaattagttcaactattgtggaacacagtgtggcgactcctcaaagatgtagaaccagaaataccatttgacccagccatcccattactaggcatatacccaaaagattgtaaatcattctactagaaagacacaggcacacatatgtttattgcggcactgttgacaatagcaaagacttggaaccaacccaaatgcccatcaatgatagactggataaagaaaatgtggcacatatacaccatgaaatactatgcagccataaaaaaggatgagttcgtgtcctttgcaaggacatggatgacactggaaaccatcattctcagcaaactaacacaacaacagaaaaccaaacaccacatgttctcactcataagtgggagctgatcaatgagaacacatggacacaggaaggggaacatcacacatgggggcttgtcagggggttggggggctagggaagggacagcattaggataaatacctaatgtagatgatgggttgatgtgtgcaacaaaccaccatggtatgtgtacacctaggtaacaaacctgcacattctgcatatgtaccccagaacttaaagtataattaaaaaaaaaaaaagcctggaaagacaagttggtggcaaattctgaatgatcttgaatgctatggtaagatttagtgcttaatttgtaaggtaatcgttatcatgatgaactgaacctggacctgaaattataatgagcaaattatctcaagttattctttctgtcgcttcaaagggatatataaatcaaaaggccaattctgaaaattttaggaaagagatccaagctattttgtagacccagaaataaactttatacctactgttctattttgttttgttttgttttgttttttaagatggagtctcactctgccacccaggctggagtgcagtggcgcgatctcggctctgcctccccagctcaaacttttctccagcctcagtatacctactgttcttatgcttggttgttgtgttttaagccttctgtgacctcacggaaattttgatgttgacacagctccaggttttacataaatttaaaggccatttgaattggaatttgattaatgaacataaaacctagtagtgaagttaacactctcttaacatccccaccacaaaagcaaagccttgaattgagtctcactctattcaaatcactcacattcttattgcaaatttcaaacctacttattatctggtagtgtcttctccccagtctgccactgcacatagaaaagaaggacatagtttaattgcttcccatgctcacagcagtaagtccacatcattcttaattttgttttataagagtttttcttcaaatacaaacatcatgctattgatccaccattaggtatcatgtgcattaagtggatttcctgggagtggggctgttgaatcctttcatactccattgcctatcaccctttacaaaaatccctcactgtgcaacacataatatgaggaataagaaaaattaggagaaatattctaaatatatagaagaaggtaaatagactgcctatatacttggtaaattctgatcatatttgtatattcgttggaatgttttaaatgccttcagatgtaattttaaaatataatctgtgtttatttaagcatgattgacttctttttaaaaaaaaaaaaaatgaatgatttaaatcctacagaccctacttatgtcagaggtcagcaaccttgtagaagtagtgtgtgccaagctgccagttcctatttctgtcaagcaagggagaaaagaagcagaagcccaaaataggcaactgagaaatatctgtgatacacagatatgtgaggcctttctgatgaatctattgcaaattgaacttttgaccctgtataaatcccctttttgtgcttcatgttttctgattgcacttatcactatttaatactctgtctctctttctctctctctctcactatatatatatatacaaacacacacacacacacacacacacacacacatatatatatatctaattttctatccacctcccaactagaatgcaagctccaaaacagtagagatttttgtctgctttatattcactatacctagaataatgcctggcacctagcaggatttctgtaaatatttgtgggaggaaagaaggaagtgtgttcaaataaagatcctatagaagttcttcatgtgcatttcataccttactatgtgactttaattagaaaccactccctcccttaaaatccaaatgaggccagctgcttaagaaatggatatcatttctagataaaaagaggcagtggaaagacacagatagtatcttgcaatttggggtgattcaatcagaaaagatcttttgagggaaaaaaaaagttcaacaagaaacaccaagaagcctttgcagaagaccagtggttgcagcagcagctcccatcatctaaatgtcttctttttcaaagggcagggccctcctgggcgatggcccacaaacatctcacagagtccctaaggagttctaccaaactgaatgagtctcctaattacaacattaaaatacctaccatccagtcttacttttgacagatgtccttgtacttttacagagcttagagtgaaagcatctaaaaaaatgtttacctttaacctggtataaggagtaatgtaccttttttcttccttcagtttaaaatccattccaccaaaacctggccgtctacacacaaaatataatgatggttatcaggggccacaggaaaaggatgagaaaaatggtgattaaagggtacaaaatttcagttagagggaataagccttagtgatctgatgcaaaatggtgactataataaataataatgcattgcatatttcaaaattactaaaaaggtagatttcaaatgttttcaccacaaaaaaatgacaagtatattagaggaaggatttgttaattaacagatttaatcattccacattgtaaacatgtatcaaaacataatattgtacccataaatatgtacagttatctgtccattgaaaataaaactaaaacaaaacaaaaaggctttgctaaaggaatctccacaagcttccaaggatatttgaaaagttctacctaaatcactactgtggtgatttaagctctttcttgcctgtccccctgcagtgaagaaagaacagctgctcatcatcactcatataatatctcttcacacacagtgaaaccaagaaaacaaccatattcaaaaatgcctgtcaaaagacaatcgtcctgggaaccactcatggcctctgtgtctatgatttcactgaacttgaagactgtaattaagtccctattcagacttcacttctctaggctaaataaacccaatcctttagactttcatcacatagcagatttctcaaaccttttaataatttctgttggattcctctggattctctccaaattctacataataaaatcatgaccagggcttcaggagaaaaagggaattgcctggcagcctcttaatgttatcctcttacatttgtacagtttgtttttcctccctatgtgaattaccctgcacacatttctacagagctatattcagtagatgtaaatgtactcagtttacatgtactagttcttccaacttgccatgattttttttttgaagtgtaatcctctttttgttttccagagtactggcatcctagcctggttcaaagaaattgacatattatgtgtcactaatgaaaaggaaaaacatcaggctaaagactgtcatctagagagtattattcagaatctacttccacaaacttcccagggtgggccaggtgggtttagatttcaactctgccatttactagtttcaggactgtggcaaatattgaacattttttggagaataataatgcctacttcccagggttatcatgaaaaatgaattgagttaataatggaaagaatatggcagagtgatacgtgctctgcataatactatatatattcattattttatcttctttatggaacaaccattataaccactttgaactactttcacagcacaatggtaaaggccaagagagctcattcctctatagaatgaaactcaatatgaaggatgaaaggctggtcaaaataataagtcaaaagacttaactcttagcatatacctcaccatcctgcttttcagtcagagcagcagcaaggacatgagatataagcaatggtgtacacctaagaagtgcagggaaactcaaaaaatgataacccagtatgagcaaaataaacttagaaaccaaacccctgaattcggctctttccccagtgtattgattgagcattagaccaaaagactgatcaggtataaatttagtattttattttagaaaagaatagcttactgctccaaagataatcaaaatattaatccttttcactttttgtgagagcaatttttgattctaatgtttttaaaaggcatataggtttcaatataaagaagctacatattatttcaaatgaaaaacaagatgaaaatcctaagtagaacagggcaaaaaattaataatgtatttttttcaacgactttcctgacatttgacctcttggtggggagtctacgcagctagcaaaccaaatacgtacctccttcacaaaactactataaaaatataactactgtttgacaaagcacttacggatatgcttcaaaattgctgattgacaaggatataatattatctgtagttttaaaatatttttaacaatgtggttcaaaaaactttccatgtattagattctatgtaatgtaatcttagcagagagaagtcacattcacaacgtgaataaataagaggagagctaacatgcaatttcttccatacaccaggtgctctgctaaacaccttatacaccttatctcatttaatcctcagaacactttaccacaagtgaatggggaaattgaagcttagagaaggtaaataactgttcagtgtaacaaattaagaatgatactcaggaatacataaatcaagatatagatttcaacccaaccctattctgatcatgcaatcaagttagtaggtcatcactagcatttattttaataggatattaatagaacagagaaagaccataaatagtaaaacagaataaacttctttgaaagtcactgctctaaaccactgctatattagaagcaactaaacatcaaagaaacattaatcttaaaagcattcaagaatattcagagatcatttacccttaccatttcactttacagatgaagaaacttaaagtttgggttattttctttacccatagtcatatggctagttggtggcaaaatcagaacaagagcccagggctaacaaaagtatattgatttgagagatgtattataaggcataatttactttgagttaaacagatttttctcaataattacaccaggaacatgggcataaacctaaactgtctcaggaaaaccagaatgagcagtatatagctctagaaattaaccaaaacttgtcaaacaaaagtaaacatggtgagaaaaatgatcgttcaatggaagttttttcaaaacaatgtagttttaatttacatacagagctataagtaaaaataacccttatatctaggctgtaattctttttccgtgttttaatgtttacataatttaaacacgaatctatcagtgaaacaagaagaaaagattataaattttgagcaaccgtggcaacaaaaccatcaggaccttgtcaatgactcacaatgatttcctagtattttccagtgttgataccaaaactggcaaggacagattcaaactaaattgctgatactgtgaaataatgctcaccagatgcaagcgccatgtaatgcaagtgacagtttctataaatataattcataactaatattaattttcaaaggacttagcaaaaactaaaaaaagaaatattttattttcatatgtaattttctcagtcagtatttcagagtgaagattagtatgggtatttcttaccccagctaagtataatgtagcaataaatggacttttcaataactgagaagaaaactaatattttagcctatgaaatcattatgtaaatttaactggcttatactgcagcccttatgacttgaaacatctgttcgatacaagttttctgataatatgtgaagtttcaaactgcatattacagcattttgcagcatatttgtaacatgatggttttgtcctttactagataggagactttcaaggtgtgacctgtaacaaggtactgaagttactacttacttcaccatctgctcatatgtattttcatctaaaattacatagcattcataactatattagaaaactgtcttcacacaatttggcacttaattttatgtgttgatatattgcctgaggtccccaatgcagtatcatgataaacaaggaccacagataagaaccaaaaaggagataaaagggtggtaagttggcaaaacacatatgacaaagcttaagtactgaaattgtggtacagccctaaagccttcacacatagactgtatactcatagtttagacacaagttgaacagattaagagtgcaggtttccctttccacaaaagattagaataagtaaaatggaaaagagtcacaagactgtcacagagaagcatgcagcaaacaatacacatgaaatatgaattgggaagccagtgaaaaagaaggagaaatcttattatacggttattcataagaagtccaaataaagccaacaaaactctctggctgttctagcaggcgtataaatgtgtgcaaccattgtactaccattttacatacacaagtaaaatttatatatatataaaaccacctagagatacttttccacatatcacatggagctatgtataatgaaattttgtcagtgttatttatgatagtaatccaaagtaacaatcacttggaggttcgataataaaaatgtggcatatcaacaaaaattaactctaaatggattttatacccaaatataaaacctaccactataaaactttcggaacacatagaagaaaattttcatgaattctgagtaggaaaggatttattagaaagaatgttaaaaaaaaaaaaaaaagcactaaaaatgaaagaaacaaattgctacactgaaattcataaaaatgaaaagcttctactcttaaaaatacatcatttaaaaatgaaaaaggccatctatataataggagaaaatatttgcaataagtatatctgacaagggagtaatatcaagatgtgaagaactcataactttataagaccaataaaccatcgttaaaatgggcaaaataatctgaacagatacttcacaaaagaagatggtcaataagcatttgaaaagatgctcacatcctaattcatctgaaaagcaaaaactgaaaccacagtgaaataccaatacatgaaattaaaacgactaaagttaaaaactgataatactagacacaaacagacatttcgccagagaggatataaaaatggcaaataagcacacacaaagatgttcaacatcactagataattaggaaatcgaaattaaaactaaaatgaggtatctttacacaactgttagaatagctttaaaaaatggtaatcccaatgctggtaaggatatgaagaaattatataaatcatacatttgctggtaggaatataaaatggtacagccaccccagagaatagttagaaattttctttaaaaaaaaatagaaaacaaaatttaacatacacttagtacacacttagcactcacaatactaggcatttatcccagagaaatgggaactgtccacaagaaagcatgcccatagatattcataacagactttttttgtaataatcaaaagttaaaaacaatccaaatgtcttttactggctgaatggttaaataaactgtgttatagccatactactcagcaatgaaatgcaaaaaactagaactctcaatacatgtaacacaacaccttggatggatatcaaaggcattgcactgagtgaaaaagccaacttcaaaaggttatattctatatgatttcacttatataatattctctaaatggcaaaattatggagatgaagaacagattagtggttgccaagggcccacaaaagtggagaggaaatggagaaaagggagccaaaagggatgcataagaatataaagggctagaatgaggaatctttgggataacaggaaagttctgcatcttgattatggtggtgtttgcatgaatctacaaatgtgacaaattccataggactatatatacatgtacactgaaatgaatccatataaaactagtgaaatctgaataaggtctgtggattgtaccaacatctcttccctgcttttgatacagttctaaaattacacaagatgttatcactggagaaaactgggtaaaagaaacacaggacctttcagcattatttttgcaactatgactctatttcaaaataaaaagcttaaaaataaaagactgacaatattccaagtgttgtcaagaatgtgaaggaactcaaactcttatttgttactggtgagactgtcacacaatcactttataaaacattttggcagttttagaaataaagttattatatacttatcacaagactcaggaattccattcctacgtatttaccaagagaaaagaaaacatgacaacacaatgacttgtgcataaatgtatataccagctttaatgatactagtcaaaaactagaaacaacgaaaatatccataaacaggtgaatggataaacaagttgtggtatattcccacaaagaaaaattgcacagaaataaaaagaaatgaactagtcattcaaacaacagcataaatgagtctcaaaaacaagctgaacaaaagaaaccagactcaaaaagtgtatactgtataagtccatttatacaaaatctagtttaggaaaaatgaatccactgtgacaaaaagatcagtgatttcatgcagccagaagcaggatttactggtaaggggtaccagggtactccttcacatcttggggtgaagggaatattctatatattgattgtgatgttggttacaaaaatgtattcatttgtcaaaactcactatacatttaaaatgacattatcttattatatatattataacttaataaagttgaaaatgtggcgtatgcttaaaacagaatatcaagtagcaattaaagattatgaattttatgtacacatggcaacatggaaaaggaggaaagaaccaagcaggatttatagcacaatacttcagcattaatggagagggagcttattatactggtcaaggaggtgtggactctagaaccagacagcctcagctgaaatcctggctccacacttatgagttacatacccttgggcaaattacttaatctttctgtgccaagagggatagcagtacttgccacacagggttcttgggaggatccgataaattaatgttgctaaaagcttaaaacagtgtctgggatttgaaaaatgctatgtaagtatttgttaaaaatatataataaaacagctgggccaagcacggtggctctcgcctgtaatcccagcactttgggagactgaagtgggtggatcacctaaggtcaggagttcaagaccaggctggccaacatggtgaaaccccatctctactaaaaacacacaaaaaaaatttagctgggcatggtggcaggtgcctgtagttccaggtactcaggaggctgagacaagagaatcgcttgaaccagggaggcataggttacagtgagccaagatcgtgccactgcactccagcagcctgggtgacagagcgagactctgcctcaaaaaaaaaaaaaagcagccgatctttttttcaaggatatacatatatctaaataaggtgatggagaggaaactgtaaggacatatattaaatactttacatacatattcaatgcaagaagaagaatgcaggcagtatgaaagaaaagtaataaactaaaataaaggggttaatattgatcagtaatgagtgtctgttataagcaaacatagtctgtgcacttgaagtcataaatgggagaaagtacagtcaaaaggcacaactatcaggactaactttatttaaggacaagcctacatacctcactatttgtcttgaattaccagaaccataaataactggtgtacaatgtcattgagacttaagaaaaagagacaaaggcaaagacagaaggcaccaagacagggtacagttaaaaacacacacagacaaatgccaaatacatttgagaaagagtttccatcatgttcataagtaggatattataacaagtcttggacagctgtcattatgcataaataatgtaccacaaaattgaaagctacatgaacatagaaccggccagaataccaaacagtggtggtacacaccagttatcactaaatagctgttaatctcattcaataaccatcactgaatgcctactatatgctaggtgttctagtaagctcatcaaataaataatcttcaaaatgcaacatagaattcagtggccattagaaaaatcaaacaagagtttgtcattttcagaagcaaatacaaaactattattagtggggttttcccagataattctttaaaggtagctgaagcagaaaaaaaaaaaaaaaaagaaatgcgtgattatctacttaaaaaggacacaaagtggatcttttgaaaaataaaatattaaacttattaatgagataacagtttactgtagtttctgatcataagcaacatgcacacaaaagaggaatctcatgtgtgaatttgtcttttttttttaataggaaggattctgcagctaccatgcaaagatacttgcatatggtctgtttacacatagaatttattgtctagccagggcccattttaaaaagaaaagagaacaaaaggactaacggcaatatacaagcacaaatgaacaagggctgcatccttgctgacgaaattgcagtaactacaagtaaggaaagtaattatttcaacaggtatctgaaataaaagctggatagaccctagagaagtggagtggaattacagtaaaacttattttgaaggaaaaaatattaagacatctatagacatataagtatctctgacattctcagttaagaggttcttagttgagtaagtgatactggtcctctgggatcaggtcacagacttacagagtcaaatgcctgtaacaagtatcacacacaacctaaaacactcctggataacatcctgtacttttaagtgcagagatttgtttgcagctttgctgaggtcctcaattctgtttgcatagcagacccacctgaagatctttctaaaagtacagacacggaccccaccagttaaatcaaaatcactagggctggaagtcatatgttgtctactaatcagccaaaataatgagtaaagggtttttctttaattaaattttttttattttgagataattgtagattcacatgcagttgtaagaaataatacatagagatcccatgtactctctagccacattgtcatagtagtgacatcttgcaaaaatatgatgcaaaatcacaaccatgatattaacattaacacagtcaaaatataaaacaattccatcaccacaaggatgccttctgttgtcctttcatagacacaaccaaactccttccgcacccatccccaactccaagtcctgactccgggcaaccatttcataattttgtcatgtcaagaatcttatataaaggtattcacttgtgacctatgtgcattagttttctttgatgcagaaaaattccctggagattcagccagattatttcatgtatcatacctttccattgctgagtaggattctaggtatatatgtgtacaattaatttcaccactgacagttgcagaacattcaggatgttgccagtttgggcccaccaataaagttgctacaaacattcatgtacaggtttttgttggaacataagttttcatcactctcagataaatacacaagagtgcaattgctgggtcgtatggtaattgcatgtttaggttcataggaaactgccacactgttttttttccagagtggctgtacaattttgtgtatcctatcagcaatattatgagtgatccagtttcctcacatcctcaccagcacttgatgttgttactttcttattttagtcattctgataggtgtgtagtaataacttattgtgattttaatttacatctctctaatgcctaatgatgttgtacgtcttttcattgtacttatttgtcatctgtatatcttctttggtaaaaagtttcttcttgtcttttgttcatttcctaattgaattgtttattttttgcagttaggttttaagagttatttatatattctagacactgggggtttgtttgttttgtttttttttttggcaggagatatggtttgcaaatattttctccaagcctgcagctttgtctttccattctctcttaacaagagtcttacacagaacaaataaggcccaatttatcaatctttccttctatggatcatgctttcagtgtcaagtctaagaactgattgcctagccctagatcctaaagattttaacctatttttttctaaaagttgtatactttcatattttgtatttaagccaatgatccattttgagctaatttttgtagaaggtatgaggtttaggtcaaggttcattattttacctgtgaatgtccagtttctccagcatcatttgttgaaatttctaaccttcctccattgaactatttggctcctttgtcaaaaattaagttggccacatctgtgtaggctatttctgtgtttcatatactatgccattgatctatgtgtctatccctccaccaataacacattgtcttgaatactatagctatacagtaggtcttatcaaaatggtttttaaatgtaaattacgccatgtcagtttcatgctttaaaaaaaaaaaaaaaaaaaaaaaaaaaaaaccttaagaattccctgccacaattagaatgatatcctgactccttatccaggctcacagagctgtacatgactagattcaccagcctctcaggtcacacctcacactgcacaggcccaggtcagtacccattagcatcaccagtctttttgttctctgagtacatcttagtaacttcactggaatgcccttgccccagatttctacaaggttagttctctgtcatcagttctcaactaaaatgttacctcctaaaaaaatacttccttgactatccaagctatacaaacacccaagtttaatcctctacatatcagttagcactacctgaaaattttatcatttatttacctgttgtattgtctccctgacctcctgaaccaaaatataagtttcatatgaacaggatccttgtctgccttgttcagcagaccagcacatagaatagtgcttgacgtccctatttatgaagtgtggcatgaataataataagtacagcaataacaaaaacacatctatacatagcacttgtctaaaagctctttcgataactctgtgtgtgtgtgtgcaggcacatgcgggctcattcagtcttcatgataaccctaggaggtgctattactgttcccattatataaataaaagaaattgaagcacggagaggttaaataaccaaatcaaggttacacatctactaaaagagcattagtcatcacacaaaaaaagtaatgaaataaagaatttgtttttctctttggcttatcttatggagattatgacaattaccaaaatctttattacctagaatcttttatttggtgacttatagtttaagttccaaagaaaaatattgccatataaggaaagggtatgacatagaatacacctgaaagagagttttcttaatatgactcgtttgtgagataatttctggggctaccacatccctggttttacactagagtccagtgacctgaacctccaatactgaagtcactaaattttcttcacaaaataactgtatcctactagcatcaagacagcacattacactgccatcttgcctccatccttgaaattttagaaagcaaaatatggcctcatacaaatatcatttggaattctgaaactgcaaagatacccaggactcaaatgtttaaaaacccaaatgcatttctaagtatacattttcccccttagattgccttgttctgctctaagtatcctcaaagtgctttgattttttttctctaagtgagctatagaaatctgaaaagttaaaatagcatgtattctttacagatcatttcatcattgtatcaactagtaagtattagcaatttataacgtatgaatatgttctcactctttccttaaagagaaaatcacacagacatcagaacaatgaatctctggctgaataaatttaaaagttcagtctcataaagcaaattttttgtttgtttacatatactcacagtttggaagcaatcaatcttgattatttatttctgcaatgcttttacttacctctataagtgctttgggatttgatttctatgatcatgactatgcaaagttagggcatcctatattttattttgtgggactcctttcatatttgtgaagaaataacttaaggttgattctcccattctttaaaactacacctgatccatatgtcagaaataataatggcaaaaacaaggcaatttttcaaaactgagttgacagtttttgaatattaagcttcccaaagatatgggcttcacacatttctctgtacaatttttaaaaaggaaacacaaaaatcaatctcaccacctttactagggttcttcagggatttcataaatgctttttggtgagacctcatcatttaatgtgcaataaaagaaaaaaaggtgtgatggaaggaacagagttgagggaacaactactaaaaccacaaacctcccaaacgaactttactctgaacagaataaaataccctattgaatactctaaccatcagttgtataggaaaagaaaaaaaacataaaaattatctcatacattaatggaaagtttattgcatcagaaagaaaatgaatttccatatactgttaatttcatacactaaaatgaattgaagaaactaattattcataacgaatattggcctttgggaaacactgcttcctaaaaggatttaatggtcaaagcttgtgtgaattattatcatgaattaaactaatgaaaggatgaagatattgttaacagaagttctgaaatgctaaccttgccatttctgtcatgagatgagaaatcaatgtccaaataacatgtgcagttaaagctttaacaggaaataagtgccacagaatctacagaaagaggtttttcctatctctcaacaaaaaatatatgaatggaggtaaggtggagaaaggggacaatagtaaaaatcatgccccaaatggaaatgaaattagcaccctgagaatgaattgagaagagtaaaaattaacgttcagccatttgtagaatattgtgagcccataggtgtgtatatatataaaatgtgtatatatacatatatataacgtgtgtatatatatgtgtgtgtgtacatatgtatagtgtgtatataaaacacatatatgggtgtatatacatatataatgtatgggtgtatatacatacataatgtatgggtgtttatacatacacatatataatgtgtgtgtgtgtgtgtgtgtgtgtgtgtgtgtgtgtgtgtgtgtgtggtgtatcctgtaaagaggaaattaaaccatctgaattatcagtgcccaaaatcaagatgacccacatgttactttaaaaaatatataattagaagggaaatttaagaaagtttaaaccttacctttcctattttcctcaacaaacaaaaagaaacaacaaccaacacattcaaaaaaattgatctacttgacactgatcaaaggaaagtctcggaaataagaatttgaaagtataatctacctaagagagagggctctttgttggagaaagtggctccagatttcagattttagttgatgacaggaagtgaaataagaaaactctttgacaagtgtatgaatagagaaactttgtcttgtttttttgatgaggtaggttgttttcttttgatttgctatgaaatggcatctccagagtcttgcaagggttaagaagagtgggaagctgggtaggaaaaaaaaatccaagaagagtacgagcagagttggagagagggctaaattattagaaaaggaatggcactttgtttagcaacccagaatagcagtagtgtgaagctcagtgggatcagctggcttcagggctttacaaagaaatccatttccctgagtgctaaatattttttttgagatggagtctcactttgtcacccaggctggagtgcagtggcgcgatctcagctcactgcaacctccgcctcccaagttcaagtgattctcccgcctcagcctcctgagtggctgggactaatggcaaattaataaattagcactctgatttatatatcagtaataccagaggctgcagtgcagtggcacgatctcagctcactgcaacctccgcctcccaagttcaagtgattctcccgcctcagcctcctgagtggctgggactaatggcaaattaataaattagcactctgatttatatatcagtaataccagataacatatatttatgaatttgtttggtgagtctatcctggaaaggctaataaactttaaaataatgaagaatcagctttcaggtcctgtgaagctaagaaccatatcctagaacctggtcttagaaccaacacactccctgtgagaatgtcactaacctggatgagttctccattctattgttctctatctgcattgctttacacaaaaagtggttgataattaggtaaactagcttctgaggaaaagtggtggaggccagaatagggcaagggaatggatggctgctgataccttctagaaactatcacaaatttttataataaatctctaaatatcatgaaatgtaaaaaagatggcccaaatttgcaaggatcactttgatatctttgtttaaataaaatttatatcaaaatgtgtgcaatgactatcttttcctcttcttcattctattttacatttctaaattttccaaagtacatatatacaattttaatcatcaaaaaaatttataaattcacagaagatttttagagcagtgaaactaccctatatactctagcagtggatacatgttattacaaacttgtccaaagccatagaatgtacaacatcaacagtgaatgctaatgtaaaatgtgaaatttgggtgatgatgtgtcaatgtcaattcaactgtaacaaatgtaccagtttggtgggggatactgataaatggggaagtctatgaatgtatgggaacaggagtaggtacatagaaaatctctgtatgttccgttcaatttctctgtgaaactaaaacttctctaaaaattatgtctatttaaaaaattctagcataaatctgtctttatttatttggtatctatgtcaacaaattttcagaaatatttaaaggcctttcatttttatatatgagatcacattgattatcactggactctgtgtgtgtgtgtgtgtgtgtgtgtgtgtgtgtgtgtgtgtgtgtgtgtccagttttaaagcagaaaaggggttactgactgggaagctgtaatgatgagatctcttgataaagtaatgcagtgtaagcaatctttagagactctttcaatttgatgatgttttctgacttttatcctttgggctgaatcaagaaaaataaaacaatttacaaaactaagactctgctacccacagcaaatgggggaggcagggaagactatattgattgtcaatatatagcaacattatattttttaaatttatccttatgaaaattatctctcattattaaaagagcttctctgatgtttaaagaactggttaactatattctatatagatatatattacattctaattatattctatatatatttttctatctattttctttatatagtccttagtttatcatttctgtccattttctacacaaataagatgggaacctcaaaaaaggaaataagcacctctattatacaatcttaaattgggttagaaaacttagtaccttacttttggatcctaaaaaatattttattgatatattccagaatttaagatcttaattttcttatatatttgctctaaatggcacttgaaataagaaactaaagagtgattaatatttggccaatgttacatgaatgttactatttatcttgttattcttattttaacagtatttaccaatactgtcgagtcactaagttttgatttttggttccactccttctagtttcacttatgcattttagtcctgatctttgcactaaacatgcttatgtgtaccatattctgtaataaaatataactaggcaaaaactatgattatctacctcgcagtaggtaaaaatatagaaggttccagagtgatacttctcaaaattatatctgctatatataacatataaactttgcataaaaacaatataccattataaaatataattacatacattttatatatatagtatttattaaatcgagaaaatattttcaagttactatgttccccataagttttaccatattcataatttacagtttgtttttattccttgagagaattttttttcttacttggaactatttcctatttgttccaattgtgtttccaacttccttagaaatggccatagcaatacaatttttattgatatactagctcatggggcattgtttcttgttgttaggtgtaaatccagtaataataaaaataagttccataaatacaaaacagtaaaattcaaccaaaatcaggcctgatattaaggggatttgaatacatatacagaatataattgaacactttaagcaattctacaaattttaagaaatagagatatagattgagattttcacaaactaaaacaattatagtgatatagttcaactcagtctcttaacttacaactatgcttgtgcgtatctgtccaaattcaattgtatttctggcctataagattatttgcttcaatcaaccaacatagagaaaaaaatcccaggctaaaaagtaaatataatgtctacactggcagtaccctatctcacagatatattgtgacaaaatcttactattaatatctgtaaatattatacacctttcatgaaaatatgaaagctaaataaatatataagggtaaacaaataaaatctaaaggtaaagttttatttggtgcatttgagaaaaatacaaaagaaaaggaaactttgggtcttattggtgatgtaggaatctggagattgaagacgtaggcagtggggatagtgcaggagtgaaaaaacaagcagttacaaaaaattatttaaacttgccatcttaatgtaatatgctttgagtcggcctttatttctatgtatggagaacaaaaagtttctaggcagaaaaatattataaaattgatagtacagacagtgaactactacaatttaaaaacatctgactctttctggccaatcttactttaatggtatcatcatacaaaagaaagaaaattacatggaacaaatgagaaaaaaaagtacctttgtcataaactttcaaatataacattataataaaaaattctcaggagaaattttgggggaaaaaaagatgtattcttcaataataatttaacttggcctaaattcatgagaatatcctccagttttgcaaactgccttcaatttgctgagaaccattcttttatgccagcttaaaataagcaaagattacacaagtaccatgtgccaccttaaataaggaaagggaaaaaagtacaatatggtatttaaacagctgtgtgaagatactggttaaaacaagaatcatttttcagctgagcttgtaatgcttcattttgctaaatttaaactagtgcatcattaacttaaccactgatttgtagaataaagtacagaaccgcacctgcatataatccaataaacacaataatttttcaaatggttgtgaaattgtcataatttgggatcaagatttgagagaaggaagaaaaaataagaagacattatttcacagatgtactggagaaaatacaattgttttcattatttgcagttttatttgagtgagctgacaaatgtacaacaaacagtacacgtggaaacacactagtaagaattctatgccaggcaattagtgaagatgattgcaagaaatcaattttttggaaataaacaaaaattttaaatgttatatggccagtttggatgagtattataagtaaatgagctcaaaccagttaacgaaatggaagaaaacagagtgtgtgctcaaaataattttgctcccaaaggtccataaggaaccatttagtatatcagaagtattcatttactatgtggtatctccctggtcaaagaattgatactttttcacatagattcactcagtcttgtctttccactatgttagaggttttaaaccccaccgaaaagttcaatagatacaatatagggaatatgattcatgtatttggatgaaaaaaagatcatatgcttattttcactaacaattagctaaaagtttaaatttccctttattaagaatgcagacaacaaatcacagtagtatttgttgtacttgtgaccgacagaaataatatatattttgaaatattgttacactcatcactaactccaaaattatagtacctgttagaagtaatgccgcatcccattactattactattcatgtattactattttagagattttaaaatattttgatggcactatttcaatttagtttatttcctttacaatcctatgcatttattttgtgcattaataacattctggccgggcacggtggctcacacctgtaatcccagcactttgggaggccaaggcgggtggatcacctgaggttaggagttcaagaccatcctggccaacatggggaaatcccaactctactaaaaatacaaaaactagctgggcatggtggtgtgtgcctgtaatcccagctactcgcggggctgaggcaggagaatcgcttgaacccgggaggtggaggttgcagtgagtcgagatcaccactgcactcaagcctgggcaacagagcgagactccatctcaaaaaaaaaaaaaatctaagacttttgagttcacatgcttaatttttttttttttaattctgagactggatccacgaacttcgccagattggaaaaggggtccatggcacaaaaagtattaagaacctctcattttcaatttggcacataagataagggaaacgtagggagacaagaaactctatagcttaaaattaacttttatgttaaagttttgtttctgttggtctttatttttaattctggaagagcaatcatcctaaattaagccaatcaaatacatattgctttaagcactaattaacaccttcttcttctaccttttattagttctaagaaatgttctttggtttaaaattttccactaataatggaaaaagtatgaaatttcttatccttatttaaccattttaaaattaactccaatatgtactacattatgacagagcagattttacatcgccctgacagtaaagtatactgcattcttggtcagatgaatgtaatgagcttcttgtaatcctggctaattgatataggaatgggggaaggatttgcaagatcaatagccgtataccaagtgccagagacaagaatgactggctctagtaaaaaagaacacatctagaagagtatctccaatcagaattgcaacctgattaaatttaaaacagagcattatggtttctaacgcctattctcctttgcgcaaggcaagtaggtgagtaaaatgagtatgtgctaaaaatctcttttaaaatttttaagtatttaatagcagcggtaatctctgacatttctctagtgaatttactgcttttgatttgctctcctggatgggagaacagttccagggctttccacttgtccccttctaccacaatatccttcattccatggttcagaaagccaatatggacattctgcaagctacagaggatatctagtcaaggtaagcattgaagaactggacaatgatcacaaggtagataaacaaactccctggaactacagtaagagtaattcaagttacaaagaaagaaaaaggaaaagaacatgagagaagggaaagaaagaaggaaggaaagaaggaaggaagaaaggcaggcaggcagggagggagggatcatttggtccccataaggtcacactttgacaagaacaatggtcaagcattttgggtctcccctccctgccaaggattagtgtcaagtaagagccatgtatggtaatccctgaaataactaagaatttccctttccacaatgtacaatcatcctggtaaatgactgagatcacactggggacaacttgaagaaagatttttggtatgtatttgtagcaatactcatgctttatcttcagagggatacagttgccctcatttcatttaagggctgtggctctgtgaactggctccggtctagaaactgagtgagaggccatgatgttgtatcagggtgaggaaatgagttttctgctcacgacatcaattatgtttctgtaccctagagtctgtattttagtgatatttcagccaccatcaaaaattaaaagtttggtgtcacaatagtctgattgtcactctggctcttccacccattatcgcaattgtactcactttgcttccagtgattacactgggacactcagcctctgccactccagaattccatcattccattaaaatgagagagtctattttgaaagtagcacctaatatcacatccaaggcaatcagaatacagccttcccagatttcttcaaggacactgatgttcccttcaccaatgcatttctcaatatttccatgaggaaagcatttgtgggtcacacatgataaacccactgcaacattcctatctccctaaggctttgggatattttcatgcaagactgaagtcactatggccattacagactcttcaagaagagggaatttaatctccttagagaaagaagaagaggttggttccacaataaagcactggggaaactgcagatgaagcatagaggaaactggagttcaaggctctgagatttaggtgagttcactcacataaatatattcatttcaattatcatgatccatgtctaccattcatgtcttatcttccatataagaaagctagtgaggctgtgaattcaacttgtactgtgattctataattctcagaactgaagtttggttcttattttcagctgcatcattactgcaatgataaaagacaagacaatttgtgttggcagtgggagtggggaggggatcatagatctctgtttacgtgactatccttgaactgagagaagtcctgaacccataatttcctttctataaaccttctagtgtagtcaaaaacagccaacaggagtcattattcaatccataacagtcaattacaacttccatttgatttcccaaaactttgactttagtaaacacttcatttctgataagaaaggtgatacattaagtaactgagctgaccctgcatggaacggcaattttccactggcaatgatatactattgtgttcaattgcagtatggtcagataaccaatctcaaattctcatctttgaaattctgtctcctaaaaccactcctggttattgttcactaaagaaagcagaaactactatagacatttccagaataggaaatttaataccagaaactgattatacagttgttgaaggggttagaaaaaaaaggaagaaataaatacttgaaggcacaaaacaaaaacagggtttcaaaccaaagtgagggtgctaccccactaggctggagcccacaagcctgcagtaattgctgagctcctggaaaaacttctacaggtgccactgggaatgctctgttattgctcaacagagcctatactgtccagcagcaggagtactgctactgctattcaagatgccaacactaatgcttctggaactcacagccaccagaggtcaccttcagtatcctcttctgcatgctgaagtacaccatccaataaaaggaaataaatagctgcttcttctctcctaccttacaatctttcaagattgccttgctttggctgtacctaatagaaaacttgctagcaatggaatctggcatgtgtggttcacaggttttatatctttgcagtagagtgtggaagggcagatatatagataagagataacagcactaactgtcacaaaaccaaacaataatggaaaaacagaatgtgatgcattttatcttctaaccatttataaaataaattaaatatatgttttatggtataataataactgtaaagaaaaccaaatactacacaagcactcaaaatgccattctcaatctaatcttaactttcttaataatcaacaaatacttactgtgtctatgttcctgacattgtgacaaatcccagagttacagatgtaaaatcaactataggagtttttactctcgtcaggaaatagaatcagaggaaacagacaaaatacagtaaataataactagactatgtgtatcaggtatacaggagagccaactacaacagccaagaagggtcatagatggtgtataatttggatatttgtccaatccaaatttcatgttgaactgcaatccccagcactggaggtggggcctggtgggaggtgtttggatcccaggggtgtatgtttaatggcttggtgctgtctttgtgatagtgagttctcgcaagatctagtcatttgaaagagtgtggcactttctgccctccactctctgtctagctcctgcttttgctgtgtgaagtgcctgttcccgctttgccttccaccatgagtaaaagctccctgaggcctccctagaagcagatgctgctatgcttcctgtacatcctgaagaactgagccaattaaacctctcatcttataaattgcccagtttcaggtatttctctatagcaatgtgagaatagcctaatacaggcggcttcagggaagtgacttggggaaaaactagggcttctaaagaatacaagaaaaaataatatttcagatcagaaaaacagcatgtatggaggcatacagacctgacaaagcataagatgtcctggaaagtagaattgtatataatttgaaatatagcaaatgaggagataatcaggaatatgccgaagaaaaggttagacaggcaaaaggtgagcaaagtatgattctattaatatattgctcatacaattgattgaatgatgttgcatttgaaattttttaatttaaattttagaaagataattgccagaggaatggaggattgactagagtgaataagatgaggaaaataagatcatttagaaagctgttctagtataggataataaaactgaagtaatgcaataactactgaagtaatacaataaactgaagtaattcccacttgtctaggaaaaagctagttctcctcctccttctctatgcaagttccccagcttctaatcaatctatcagttaagcccactttaataactattaatatgttttcaatgtccattttaataactgtgttttctacaagattaaagaaataaaattatcctatagatttttctaaacaaatagtggagacctatggaatataattgcaagggtagtaaaaatgtaacttaaattaagctgtgaaatatattctattttttgtctgctattttgtcatgactgtttgacagaaaatctacccttttaatatgccaaattcacacatattaattaggagaactagaagttaaccaaagtaaatcgggaggaaaatattttaaaagtatacgtgcatatctcacccaaagaaaaattccgatttaattctcacttcttttaaggtggccctcccccagaatatcgttgactttttaaaacatatcataaggcaaacatttgtgacgctatcacagtccatcttatacaaccaaccaggaaaaatatcctctttaatcaaaatcagtaattttgcgttaagcttcttttattgatatgaaaaatttgggcagtcctgcagagagaagtccaaataacacaggaaactagccctgacaggtggtaagacaataggaagaaactagtatttcctcaggatcttgcttatacatatggtacttatgatactttactaaaaagtatttatctgaatccttcagtagcctatgagtcccttaatggcaggaaatgactgaaaaaaaaaacaaataaataaagtgaagacagaaacgacatggatttctaaaaatatttctgatgcttctgcatttcttaaaaatttacgtggatattttccaggatggacaattatctgtgcacacaatgcaatttgctcttccaaatcctttctaccacagcttcagacttaagctctatttaatgtaaaccaatcatagtaataccttcctcaccgccacgtagtctttcagtaatgaatgagactacgtccatttaagcaaacaacacacaaggaaacatttcctagtggcttcttaaaaaaaaaaaaaaggcttcatttttcaactaataaaaaggtgagtattacagataataactacataggaatgtaaaaaaaaacttactctggctatggaagtctgaaaagacttcatgtaagagataaggcttaaaccacacctgaacaacaggaaagtacagttatgcatcacttaatgatggaaacacattctgagaaaagcatataggcaatttcataattgtgcgaacatcacagggtatacttacacaaacatagatggtatggccgactacccctagcttatggctcctagactacaatcctgtacagcatgtaactgcactgaattccataggcaattgtagcacaatgatatttgtgtatctaaacataaaaaaggtacagtaaaaacatggtattatcctcttatgggaagaccatcaaaaacacagtctatcactgacattatgcagtggcacatggctgtatctgagagtagacaggaattacaactgggtggatggtataaagaaaggcataagaagcataaagagtggaggatgttagatgtattcaaagcacaagccagccaccccaagtaaaagactcatagacaaagaaagaacatgcaggaaacaaaagtcgaaaaaagggcctgaaaaccagaatatatttcattatgttaagagccaacaaagtaaaattcttagttatgatctaaatgtatgatttagggatgaatacatagttagggagaaaagaaaaattatttagccatgaataaattaatccaggttcttattcatcaagattccattttgaagagggctgccgcttaggaacactcaagctacgagggccataaatttaacacacacatttctttatgaaggagtagagagaataaacaaattttttaaaaagtaaagggagaaaagggaaaataaagtaatatgcaaggacatccgatagtcaaaatgtattatctcataaatttatatgcttcagtaaaaaaattatcatatttacaatcaaaaaaggccatttgtaaagaatctcacatatattatctctgtcaaatctcacaacaacccaatgagagagatattgttggctccttttttttttctttttttttttttttttttttttgagatggagtctcgctatgtcgccagactggagtgcagtggcgagatctcggctcactgcaagctccgcctcccgagttcaagtgattctcctgcctcagtctctcaagtagctgggattacaggcacgtgcaaccacgcccaactaatttttgtatttttagtagagacggggtttcaccatgttggccagaatggtctcgatctcctgacctcgtgatccgcccgcctcagcctcccaaagtgctgggattgcaggcatgatttttggctcgtttgtacagacatgaaagtgtctcaacgtggttaagtgagtttggaagagccagattattatccaggcctctgactttacatcctgtacccactcaggcctacctcatttcattcaagagataagtacaacacaaagttcaacaacatctgaagccattctgaactagaaataaatgaagattctaattgtcagtatatcattattcagacataatgtagaaacaaaggattttgccaagcttaatatggtttggctgaatgcaagatttatatattaagatccaacattatatgggcaaagaaatactacctgactctctggaaattgaggtttatcaatcagactccctagatattcagtattttgaagatataataatactgaatcagagacagaaaaaaactagtaataaaatactcaaaggtctaaaaattaaaggcaaattttcttagcaaagagtacatggcattctatttaaaaatcaacaatttgtcttcattccccagatcataaacccaaggagaccattataaggctgctacaaacaatctgtcagtttgatttcacttggttagtgagggtgttgattttgttgttgaactgcttaagaaaaatttaagatgcttaaagaaagttctttaaacatattaataataagcttttcaaagtctgtgaatttaatatttcattatttccttgaacctgttagagttaagtgaaactttgaaaattccaggaaaggttcaataaaatttgttatagattctacatggtctcattttcctttacttaagaaaaaataccaaataggctgttatattttgaaatctacattttttcaatctgccctttaatgagcaccaattatggtaaataaatattaacagaatataaccacttacttataatgcaatccttataatgttatatttatccaagccatgaaggattagggaagtaaaaactacactagcttatgatttagcagttttattttccaatataggtcagaatctaaaaagttaaagagtgaaggagggccacggggcctttaaggagcccaaatatcagtgtaaatgaaagggtgattgattctctcctcaaagcagatggcgtcctttccccagatgcctggttaatacagatgtggaagccaatggagaactcaggttccttacaaagaacagaaaaggggttgagcacacaaacaattcaagagttcaagggctggtggtgaaatctggtagtaacagattgcagacacatacagatgtctaaaggaaacagcaaaaggaagatctgggaagcaactccccaggaaaagattttaccatagaaatcatcatcatcattaagaagcctcagatcagatgtaacctatagcagatctgaacatgactaaaccctagacaaaagtaattaattccaaaacagtggtatggatcaattcaaatgagaaattgattttctagttctgaggtgcaatggcaaacttgtaagtcaaatgatatcctagaagacagcactttttaaagacaataccttaccaagccacttgaagacggaataactataccataatgaagaaaaatttctattacttaatagattcttttaaaaatattttagatactaaattaggactattacataattggtattatctatatttcaactatggaagtaacagttcttcatttcaattaacaagctaatatactgtctattcatcatgattcgaccattagccagactttgctgaataattctaagattagcctgccatttagccacaagttagccaactatatagataagtgaactattttgctatcattaccttaaatgttgtccacacatcacaatgaccaataagaaaacatccctgtcctaccatcctggtaatcagaaaatcaccatgtggcttaatgtaaggctaagtaagcgttaccaaatatgtctgtaggagggcaagtctgagggcacgattacactttcaagactttgtgaggaatcatttgtaatcttgtcacactcaaaaaaagtgctgagagcattcttttttcaccctcacatcatccagagaactgttcagcaatataaagctgtgaccttgatgttctatatagcttaaagaccatagttaaagtcctcataagcactaaaagtcatctctgcacaggaagtagaatatccttctacactaatgtgctacatattatagatttctccaatatgttccaaatataatataatgttatttccaaaaccgtaaaaaaaattcatagtttagcagatctaagtagaactccttttggctggtgagatggtgggaagagattagggtagaaagtggaagaagcagagtcataagagaatagtaatcagtgaactaccaaaattttcatcattcaaaatttttacaaatcaaaattttagctttaaatcaattttatatgtttggtttcaaagatcagccctcaataacaaccctataatctgttttaatacagaaggctatattctatagcgataagttctattttagaaaagaagcaatttaaacctaagtttttttagaatgttagcataacatatagtatgaaacaggaaacaaacagattaaaggaagaccagaacattggctgaaaatacaccttcagggcccatttccaggtaatgcccaaggcctcctaggggataactaatagttaatatttcggctgccacattccatgggaggtcgtaacaatgactttatataaaaattatttctatttttctcttttatttttaacttagtactattaactggagctctttcttcccttgttaactattcattactgtatatttctgtgcattaaaaccactttaaaaaaaatcttcatccccacatcagcctccatcgtgggaagatatatatacacagaaagagaggaaaagtcattgatccccagccataagtcaagtgaggcttcaacaatagatcatacccaggctgcacactgttaggtcacagaacatgtggtcacactgtcctaccaagacagaagctaattctatgaaatcccaaactacaccttcttgtgtttctccattcacctcagtcaatggcttcaccaccatccatccaccttcttactcaaatcagaagctgaggagccactctgcctcttcccattcttacagtccaaattcttgttcactcatgcaactattcatttctctctcacttcctcagcatttgcttcagcccatataatttctgacctaggtgattttatcagtttcctaactggtttccctttctctggcctacaacccataaattctaaaacacaatctgaataatctttctaaaacattttaggaacaacccactaccctcagatcaagtccaaactctttaacactgtttacaaggcccttgataatctgactggttgctgctcacactgaactcttaccactcccactgtggtacccaacaatgccaaacaatttgaaattactcagttactcatattctctcagtactaggcaccaccattcctcatccagaacactaaagcaattgagtttgattcaggtgtaatcctcaagaaaacattgttagacttctccagtttctccaggtgacacatctgtgtgctctgaaagcaccctatgcttatagttatcataccatacagtactgtttactttgttcttcctcccccaatcactgattattagatccttaaagtacaagcaacttattcatatttgtatcataatgactagaatagtacttggaacaaaggagacactcactaaatgtttgctgaattaatgaataaagatataaatgaaaggcggtatgtgttccatgttttcttcaagaaaatatggccaccaaaatgtgtatgaactaagtattctccaatctgcccaatggaaaaataaataaataacagctaagagtttgtcataaatttcagggcaatcctaatgaatctaggaaagtcaattgatcaagaggctacatcatggccttttgatttgacttacccttatttgctcctacgataataccaaaaaagcatctgtccatacagtgagaatgtaagtcaacacacaattggctcagggtaagcagattacaactctattaaaataaaagaattataatcaaaatcctgcttccgtatatgatttaatcattgcacactgattaaataaatgacaataattataaagaaaaatctccatccattttgagtgctcctgagaagctagagactactcagatctctgatttgaggtaatattctcaatgtctcaaattaaatgcaaatattctcatggaaaaaaaactacaacaatctttttttttctctaaattattaatatttatctttgaggttgagattctcaggtttttgtagtacatcatgggagtgatataaaaggagtccttaactgcaaatcaaaattttagccttaaatccaaagcttgctttactatatagctatgctctaaatcaccaaattcagaaatcctttaaaatagacacttgaatgtggtttcaatgtaagcactctcttagcagactcactcttcaaagtccaaaatgaaagaaaaattatatgctcagcagtttatttaattaaaaggaatggaactacagagtgataagtatagaaaagttcagcatgtcttttcaaaggactgtaaaaaaaacttccaacactttacttatattcttgcccttgtgactaagttatggacaatgaaacaccttgagttatgatacaaatccttaaacctaaaatgccatatgttaaaactcaaattatgttaaagcccataactattttaaaaccctgtgtataatgtgatctactgcattcacagtacttaaagtactttcatttttgaacttttataatttctgcaagagaaaacaatgccaagagacatccctacagtaattaatgtaagataacagctttgaatttacagttattggtaatttaattagtcttgaacatagccactataagacttgataactactaaacaattattaatgaataaaaggctggcccccagattcttttatgccagacccatggaaatagtatgtgccagataaatagattctcaataaatatttattgaggtcgaattgaccccatgactggttagatgcagaattttagttcacatcatatagacattctgaaactgaatttaacacaagcataatatcagcataatattatactgaattgtacagacagaaccatgagtcactttctgctccaaatcaatgaaatgttgaagtagaaggaacagcataagaattctccattatgtagctaagtttgaaacaatggtagagaaatctccaggtcccaaaaaatgaaaaagaaattcgatatctgggtggtagaaggaactgaattttaaaaaaaattagaaatatactaatattagtaatattaatactaatatacaaatacatttaatagtggtgttctcagatcacgacgcaaaatctccccaagaaacctactaataatgaataataatttacatgagaaaaagaccttttcacctgcaaattaaaaagcaggttaacatttatgggtcatggtaaaagcacttctccaaagaaaatccatagcattaaatacttacatattttttaaagaaataaaatgaggaatgcatctatattttatatcaaagcctacgtctcccagctttgttcatagcattaaatacttacataattttttttttacaaaagtaaataaaatggtgaatgcacctttgttttacacggacggctgcatctcccacatttgcaaactcttcactgtaataaactctctttcttcaaaatgaaaaaaagaaagcaaataaaatgacttaaacatttaatttgaaaagctagaaaaagactgacaacagaaaacaaaagcagaaggaaattaataaaaataaaaatgaagtcagaaaaacagcaaaattaataaacagatcaaaaagctggttctttcaggcaacctacagaacaggagaaaatttctgcaatctactcatctgacaaagggctaatatccagaatctacaatgaactcaaacaaatttacaagaagaaaacaaaaaaccccatcaaaaagtgggcaaaggatatgaacagacacttctcaaaagaagtcatttatgcagccaaaaggcacatgaaaaaatgctcatcatcaccagccatcagagaaatgcaaatcaaaaccccaatgagataccatctcacaccagttagaatgacaatcattaaaaagtcaggaaacaaaagctgctggagaagatatggagaaataggaacacttttacactgttggtaggactgtaaactagttcaaccattgtggaagtcagtgtggcgattcctcagggatctagaactagaaataccatttcacccagccatcccattactgggtatatacccaaaggactataaaacatgcttctataaagacacatccacgcatatgtttattgcggcactattcacaacagcaaagatttggaaccaactcaaatgtccaacaatgatagactggataaagaaaatgtggcacatatacaccatggaatactatgcagccataaaaaatgatgagttcatgtcctttgtagggacatggatgaagctggaaaccatcattctcagcaaactgtcacaaggacaaaaaaccaaacactgcatgttctcactcacaggtgggaaatgaacaatgagaacacagggacacaggaaggggaacatcacacaccgggacctgttgtggggtggtgggagtggggagggatagcattaggagatacacctaatgttaaatgatgagttaatgggtgcagaacaccaacatggcacatgtatacatatgtaattaacctgcacattgtgcacatataccctaaaacttaaagtacaataaaataaaaaaagctggttctttgaaacactcaacaaaatagaaaaattactagccaacctaataaataaaaaggtgggggagattagggtgaaagcccaaaaacacaaagtgaaaaataacaaagaagaaatagtcatcaaaagagatgaactgaaagagaaaatgaagcacaaagaggaaaagaaatctattgtatatgcaaataaatctgaaacataggtaaaataaaatttcatttggcaaaactgaccataatagagagagaatgcattaaggaaatgcctaaaaagggaagtaaaactaattagtcaactacagaccataattcatcagaggttccttaaattaagttgaggcaagtcactctttttcaagttgagaaaagatgctataaaacatgaaggcatgtttgagaaaaccagtaaatatttttaacaatagttcctagagtcaaataaaaaattcattcaaaatcatgtgtaatataatgtttaagtgtaatatattcaaatgagaaattccaatactatattccctaacaaagggaaaaaaataaattatagctaaaaaataaatattcaatatcaaccaatatcaacaacaatctgtttattgacaaaatgtatttttagtttttaaaaaacaataaaaggtaaataaactaaaattcaaagtgcaaacaataacacaccaaagattttttttgaatactgaaaatctaggggaacaactgctcaacatttggttgcttcacaatctgttaatttttttaatcaaatatgactaagataagtctgccacatccataaaaacattaactgaaattaatatgcaaattatggtgcctgtgtgggatgccatttcattaatttcaattcactgacataattgtgttctctgaatttatgagatttgcaaatgccatctcatagagaatgcaatgttcagtgaatgttattttactagcataaaacccaataataggttaatccacaaaaaagaaatataagattttagttacaaaataatatatgttttcatagctgtatattctttgagctaattcttagagctttttaaaataatgtttaacttttaatataacactgattaatggtagcaatcttggaaagttcaaaaaggtatataaaatgagaaccttttaaagattagctatctttaaattataaataataacagtatttggtatattttgcttcaatcttcttgtatgcagataagtacaaatgtgaaagcgcgcaaaataaatataatgttttaattccattttttccacttaatatagctatagatattttaccatattagtaaatgaattccaaaatataattttaaatgaatgtatattaagatcatcatgtggacctaccaaaatatttttaatctttccattattttttggagtttaggtttttttagtgttttaatagtataaatccttctgtaatcgagcccttcatgtaattatttgtgtctctgattatttccttaacaaaaaaatccttgaagtgaaattcctgaatcaaaggatgtaaattttaatatatcatctaaatacctttcaaaaatattgaaactttacattccgaccacgagtatataacttctattcccttgaccccttttccatactacattctatcttttggcatcatcagtgtagtagatcaaaatggcatctcacagttgattcatttgcatttctttattagagaggttgaacccctcatgaaattttactgtagtaataatgttctggaattttaatttaaattataatgtagttttgcctataactgaattgtgagcaacattgctatttataatttattactgcttgaagttgcatactgtaaaacatgctgtgtttaaattatgtacagtatttttttatggttagatttcataaaatctcctaaaccaaacctgagtaaatttctgctctctttacttgctattactttcaggtctataaagatataaagaaaattacacttaatcgaattttatatattttaggtattttgaaggcaattagttcatcataatacctcaattgagatataaattatgcatttataagactgagattgccaaataaaaattaagatgcttagcaaataatgaatttgattaaatttttaaaattttctcaaaactacaaaaaagtttttgatcaataccaaagattataattgaaatatctttccatctcagatattaaagttacaataattccaaaattatgggcatgcattctccctccataagtgaaagctgtacaatgcctcaattctcagttgtctcttaaacaattccattcagaaatcttcttcagctgctaacatattcctcattaagattcctacttctcataaacatttctccaaagaagacataaaaatggccaataggaatatgcaaagatggtcaagatcactaatcatcagaaatatgcaatgaaaaccgcaaggatatatcaattcacacctgctaggatggctgttaccaaacaaacaacaacaaaagaaaaacaagtacagggaacactggaaaaactggaacccttatgcactgttggtgggaaatgcaacagctctggaagcagtatggaggttccacccaaattataaaaagaactaccatttcttggagcaatcccattttcaggtattatccaaaataaattttggtttttggtatttcaaaataactgaaatcaggatctcaaagaagtatttgtattcccatgttcactgcagcactattcacaatagccaagatatggaatcaacctaagtgtccatcaatagatgaaaggataaggaaaacgtagtacatttacatactctagaatattattcagcttctaaaaagaagggaatcctggcatatggatggggaaaaaggggaatcctgccagcatagataaacctggaaaacactgtgctacatgaaataggccagtcacagaagcgcaaatactgcatacattctacttatatgaagtatctaaaatagtttaattcataaaggcaaaaagggaatggtggtggtcaggggcttgggagagggaaaaatgagaagttgctgtccaactggtataaagtttcagttaagcaagataataattcttaaaattcatgtaagagaaaatattatcaaaatagaatgcctcatttaacctgctttatgagtgttcactcacatagatcattatatataaaaagtgtcactgtaactaaataatttctacaatttcattaacatgtactcaactccctttgctgcatgtctctatcatagctgttcctgcgaggtactgtaacccaccattcattcatccatgtacttcttacacttcaaaagactgaactatttcttttgtagcacttggcatgagcaaatacataatatattaataaataaaaataaatataggaaaattcagctcacaaatgtgctatttgtgcatgaaaaggaaaaatatttttaactattttcagaaataagttagaggctagaaagtaatcttatggtatattaataatttaaaagtcatcatcaaatcctgtggtttggccaaaataaatgcagaagtagaaagaaagagagccataaattgcttaaggtcagaaatgcaagctgaaaacatagtgtacataatacaagaaattcttaattctccagatttctatgtgtcaaaaggctcctgatttcagtgtggaaatgagggttttaactacatacctgaatcacctgtttggaaaataggtacgtatagtagatatataatatataagaatacatatgagaataaagtattataaagcagcataaccacccacatttcaccatcttttcatcattaaactaaaaaatatttttacaaaaccacatgacctctcagtcataatagaactaatgaaactacaaagatccaatcttactcagagaacttgtacgatttttgaaaacagcaccattaaaacagctctctcagagtattctcctataagctcttaaaagttattttgaaaactgtcaatacagctggggttcttttccacccagtggcaggttacaaaggaatattaaagatgtttcaaaaactgatataattcaggaaaaataatttaaacaatatgactgcaattatgacatattacaatgaaatacatggcagctagaactaaataggagcccacagaatgatacttagaaatgcatttacatggttactgagttttccccagtagaaaagcaactatcccttcttgctccttattggtacaaaaattatttcagggcccacaaattctaaaagcattacaaagtttgaagaatataaagtaaatggcaattataaaaagtaagggtttatattttacaagccccaatacagcaaggcttagaattagttataaaaactagaggtgtgttacgtcttagagtaggtaacagctggatactgtgtagaataaatgctcatgcccatgggtgggatgttcataatgctgaagggcaagagagagagatgtatagcttgagaagtgatgtggataattgcttgtcattaaacagcagagtaattgctgcagcaaattcccatgtaactattccacatgaaacttcaacgtgcccttggacttactaaacatacatagttttctcagataaaaagacagcagtcaatgatgcaccacacttaaaaagatcattattttattatttagtctcacaaaaaaacattgggaccctaaccattaataacacagagaaaaaaaaagccattgatttttacattagtaagaccttggtaagatctcagaatctactttttcctaacctgctcagactaggtgtctcataaagcctacaataatttaaaagatcgtcacatcttttgaaaagctttcatgtacaatcatgttattcagtattcaaattcataataagccaagatacgaaacatttaagttgctgcaggatgttgagcgctattaagaatgcattaatagagaggattctaggcagctgaagctgtggcagaggtataaatttgaaagtaccaaaatatcctgaaaagaaacagaaacaggaagaggaaaaaaaagagaaggagaagaattaaaactacacaccctatctcaacataactagaaaacaaggaaactccaaacttcaaagtacttgtaaatataaatataaacatcaagacctacctacctctctcatgtgctcctgccagtagccttcatggagaccaagagcagttcaggagaaactacacaaacgagagcagagaggagttaagggcaggttgaaccatgatttaaaaccactgctagaaacagaaagaaactcagcccttggccctatatatactgaaaagtgaacagttagctcagaacactgataacagaaaggagacttgaaaacgcacatgggacatgacaagccaccttgcaaaggcgtcactttggagagaaaagacagctaaaacaacaggagaggtttctttggaaactatacattagagagagaaaaaggggagaacatttcgaattacataaaacaaaagaaaatttaaaaattggaaggcatatgccatttgaaaaccatgccatccagtaaagaaacaatactttgcttacaataacaggagagggtgctcttgaactagaaatgttaagccatcccaacatacagataaacaaaaacctagcataaaaagaaaattgaaaataaggacccaaacaattaaggtgataaaaaattccaccctctcacacaaacaaatggcaagacactggcaagaacagtggcaaaacagaagaaaaccataacactcaaaactaataaatatccataaattctgcaattaggtagatttaaaaaacaaccttgaaataagaattaaaaactaagtagagaaatgaatgaccagaaaattttaaaaggaaaaaataaaacaccaattgattgaacacagaaagaaaagagaagaaaaatacaaaatcacatcagaaatggaacgtaaattacaagatgcccaaggaaaaacagatttgaaagaaaatgcaataagagacactggaaaaatagtagaaaatcaactaaatgaataaaatgaaatagagaaaaaagtaaaaagggtcaaagagaaagtggctgaaatggaagacaggaaaaagaagatacaatttatatataaatggaatttctgaagaagactttttaaaataaaatatgactaataatgaaattctaaccaagaaagtattcaaacacaaacaaccacaacttatatactgaaagggcccactagccacggggtggggggaaaaaaaaaacttgtaacaatcaactcagagacatattttagtaaaagtagtagacattcaagataaaggaaaaatcctcagggaatccaggcaaatgaattcaaacaacatacacaagtaaaagaattagactggcaatagatttatcaaaaataagattcatatccaacaagaggttagtatacaaaatgtacataaagctcaaatgactcaatagcaagaaaaccaaaaatccaatttaaaaatggtcaagatatctgaataaaaatttctcaaaagaagacatacaaatgtccagcagacatatgaaaaaatgttcaacatcgctaatcattagagaaatgcaaattaaagaccacaatgagatatcatcttacacttatcagaatggctattatcaaaaagacaaaagttaacaaatattgacaaggatgtggagaaaagggaatccttgtatactgttggtgcgaatatatattagtatatcgattatgaaaaactgtatggaagttcctcaaaaaactaaaaatagaattagcatatgacccagcaatcccacttctgggtgtttacctaaaagatttgaaatcagtttgttgaagaaatgtctgcattccatgtttattgcagcactattcaccatcgctaagttatggaatcaacctaagtgcccatcaatggatgaatggataaacaaaatgtggtaaatatacacagtgaaattctattcagcccttaaaaagaaggattctgtcatttgtagcagcatgtgtgaaaatggagaacattatgctaagtgaaataaataaggcaaacaaagacaaatatcacgttctcacttatatgtgaaatctacaataacctaactcatagaagcagagagtaggatggtggttaaagcagttcaggcagtaaggaatggggaaatgataaccaaagggtataaaatctcaggagaaatatgctttttttagttctattgcacagcatgatgattatagtcaataatagagtactgcacatcttaaaattgctaagagagtaacattcaaatgttctcaccacaaaaaaaggtatttgaggtattgaatatgttgttaactaacttgatttaattattccacattgtattcatggatcatacatcactttatactccataaatttatacaattataaattatcaatttacaatttttaaaaagattcaaagcaagataccaatggggcagcatttccataaggctccaggaaataaagggaaatccaaggatttgtatatagccaagctgccttcgagtatccaagctataaaaaaagtttttaacatgcaagaattcaaggaattctggatccatgagttcttaaggaatctactagaagatgaccttaacccaacttgttattaactgggaaagttaagcaaaaaaactaatagtatacatatatatatttatttgtaggtataagacacacgggaaaatacatcatgtgctatatgctatatattatgtgctgttttctcaaagtagaaataatgccacaaaaacaataagacaaaaaggctgttttataggcatgaggcaggaactaaagaatatcaataacagccgaataaccagatgttaaaaggtcataatgtttaaatggggaataaggacgttagtaaagaaataagtataaacacatcatctagaccaaaataaaaccttcctagaaaaaaaaacttcaaaaatcgaatagtaaaaaaggttactagagaaagaagccaagcaaatataatatagcgtgcataatatttataatatgacaaaattaaaatcaaaacatcagtcttttcaataattgtgcaggcacttaacctaccaactgaaagaaaatcatataaaatcaaatgcaagccaaaaagcattaaatgtaacaaagaaggacacgttttaacgctaaagccaaaatcacaataaagacatattaaatataaatatctatgtaccaaataatatagtacctttttgtaaaacaaaaactataagagatgccagaagtcccaaaaagaacactaataataggagattttaacatactacttagaacaaggcagatcaataaacatgtaaaatgaaaatttaaaaacacctacaatataactaataaggtagattttatgaatatatgtcaaactttacaccctaaaaataaacttttctctcaaatgcatgtggagcatcacaaaaactgatcatatattaggtgataaggaaaatatcagtatgttctataaaatagtaatgctataagaaatattttctaaccaaaattaaaataaaactagaaattatttaagcactttttaaaaaaggctccttgcgatggttaatactgtcaacttgattggattaaatgaaatcagtctactactccacaatggaggtaagggatatctggaatacaggagatcccttagggtgtctcttagtattaccatgccctctgattaaggtcaatgggaaactacaacagcccaatccagtcagggctacaaatagcccagaccctccaggaatgaaggtttgtgtcactccaccaggaaaaaaacaagacctgctgaggtgcttgctgaaggcaaagggaatacagaatgggtagtagaagaaggtagtcatcaataccagcacgtgaccagttgcacaaacaaggactgtaattgtaatgagtatttcctccttcttttgttaagaacatgtttgtgcatgtatatatttgtacaagaaaatatcttcattttatttcctttttcctttaaatgtgacataagattcattgacttgctatcagcatttaagtgttgttaaccttacataatagcatttgggttggggatttgtgcattcctggttgtacgaaggatagttttattatgttaggcataattatgatattattgtctttatttgaagactatgatttcaggaaatgtatatgggttcaagttgacaaggggtcgacttgtgatggtaaatattgagtggattgtaatattgattggattgaaggatgcaaagctccctaggtgtgtctgtgagggtgctaccaaaggagattaacatttgagagacaaaggagagacagacccaccctcaatcttagtgggcaccatctaattaatcagctgacagtgtagccagaataaaagcaggcagaacatgaaaagactagactggcatagtctcccagcctacatctttctcccgtgctgggtccttcctgcccttgaacattggactccaagttcttcacctttgtaattcggactggcttccttgctccgcagcttgcagatggcctattgtgggacctcaccttgtgatcatgtgagtcaatacaccttaataaactccgctttatatacacatctaacttattagttctctccctctagaaaaccctgatacactcttcaacctgtatatcttcttctagaaaaaaaccttttcttaaacaactcttaggtgaaggggtaaatacaagctaaaagtagaaaatatattttaaacaattataagcacactacatatcaaaaatttttatttttattgatgtaaaatatacatatgtaatttatcatctataccatttttaagtgtataatttggtggtaataaatacatattatatatatatatatttccccccttcatctcctcctcccctcttccacttcccagcctctggtaactacaaatctactctctgtgttcttgacagtcacttttttagctcccacatgaatgtgaacatgttatatttgcctttctgtgcttggcttatttcacttaacaaaacggccttctgtttcatccacgttgctgtacatgataggatttcattcttttttatggcagaataatattccactgggtatatataccacattttctttatgcatgcatcagttgattggcacttaggttgatcaagtatttttaaagcaatggtcagagaaaaattcatagccttaacatttctatcaatgaaattttaaaaataaaaaagaattaaattcccagctcataaaggcattcagggtaataagctaatttgtataacatggcatttcatacatgcatgactaaagaaacagtccccaggtatgctctaggttctcatccttttttcaacttggtcctggcagtgcaaaagacttccagggaatttagctccctagaagttgatggcactgattgcccaagtatgtaagataataccagactactaaaattattgttttttaaaccttcacttgtatttcttccatttccctcacttttcctaacgtctctcagtacacagaaaaaaacaagagaaaggttgattcggggtaatatcagtcaggtaacgatggaattcagaaatttgagacacatctcttctttcttgaggcatatcactcttatactgttaatcattccacagagagctctaacaagaagctttcattggtctttgaatctgtagcaggagcagtttataggccaagtcccataagctcagctgagattcacacttaccgatgctcttctggaatctaaaccttaacactggcataagaagcagaggagacagaaaaagagacctaaaaaaacttttctttatagaaaagatacaaactagagctaggtttcagcctccctcaccttctctttggaacagatcttacatatttaaaaccatatttgatgaaatggatgcatccctttaaatagtaacagatatgaggatgactaccaaatatctctctgttattataagcctggagagtcccaaaaaagtcagccagacaacatgaaatgtaaaatgtctaaagagtggaaatataacaaagctaaatggcaaatggacagggaggaaatatctacagcacaaagatgaaaggttaatattatatagaacaactcaaaataaaaataggtaaaagttatcaacgtgaaatttacaggtgaaataaacatgagaacatgaagatatctccaagatcactaataacttaagaaatacgagaaagtttattgaaatgctgtttatagcagcagtaagtagaaacagcctaaatgtccatcagtaagaaaattactaaaaagactaggaaatacacatatcaaagaacacaacaggacactttaaaagaatgagtttgagctacataaacaacatggaaagttctctaacatttattgtgacatgatgacatttattgtaaatcgtttaaaggtgtgtaatatgcacaagtttgatccttcttataaaacagcaggaaagtatatatttctacatgtatgtatataatttcatggaaatacacaggaataaagttatctgggatgatatacatcaaatgaataataattacctatggggtaggaattgctcttggctaaaaagggtaagaacgttcttgtactttgtacatcaatagatacttacttgatgtttaaattgttttgtcaaaaaaatggtttcaagtatacttaatttcatcttaagtttttgttgttgtttgagaagggatctcactgtgtcatccaggctggagggcagaggcacaatgttggctcactgcagcctcaaactcccaggaagaaatcctcctgcctcagccccccaactagctgagactacaggtgtgtgccgccaggccggctattttttttttttttaagttttttgtagagacagggtcccactatgttgcccaggctggtcttgaactcctgagctcaagcaacccacccacctcagcctcccaaagtgctgggattacaggtgtgagccaccacaccaggccttattttaaagtgaatggaagataaagaaataaaaatattatgtgtttaaaatgttttagatacttttagttatgatgacacttctcaacctaacttgtagtctcaaccatatttttatatgttttatctatctttgatttggggtggatctctcaatactatctttcagcttaaaaattatctctaacagtaaattttctagagtttatcttgtctacagtagtgttttaatttcaattacatttttcaattccacagtttctaataagttctctttcatattcatgcattcatgtttcattctgcctattttgttatataatttcttgctctttctcaatgaaagttctctcttcaattatcttcataataaagcacacttattttatagtattgatcagatctttctgctaaattaattttacccaaaatgaattcatgtttacattattgattaatcaagttgcctttctcagaagtagacttttttttttttttagaattttggtactcagtcttatttatactgaataaggtaaagtggcttaacagaaactagtcttgataaggtaaaccaaataagtgaaaatagtgccaaacacagattcataagcatcatatatatttaatgtcaattgttccaatcttttctcaactccaactttaaattttaatcaagttaatgaaaagcaagcctacattgttattatttaagtctgaatattcggccttcagaaattctgcaaaactttcttggttcagtaagatttctatattaagataaaaaatctatctaatgcaacgaacatccacagctgtcagctaaatgaaatgtctgggttttctttttttaaaaaaagcagagaattataaaaagtaatacactaaatagtttattttaacttagaaacacaaatagatattgatttgcctatcttttaaagttatttgaagatataaaaattatttaagaatagccaataatagaaattatgccataatcaccccattaattactttttttctatcttccatggctcccagcacatattttgcagtatctaactgaaggtattaattaagttatttggatggaaggatggatggatggatggatggatggatggatggatggatggatggatgaaatggaccaatgaatgggcagatggatggacagttgaatgggcaggtaggctgacaaataaaagaatcaaccattcagcaagatgagccaagtctgacctcaaattagttaaacctagagtgtcttagttacccaaggtaaacagagaaactaagtaccatacatgggcagatgtatggacagttgaatgggcaggtaggctgacaaataaatgaatcaaccattcagcaaggtgaaccaagtctgacctcaaattagttaaacctagagtgtcttagttacccaaggcaaacagaaaaactaagtaccatacattcaggattagattttccttcttttccatcaacattagcagaagcaaaaccagcaacagcatcaacaaacattcactaaaaatctgtcatgtgaaggcctctatgaggtttaccagagatacaaagaaataaaaaggactgcctctgcacataatccagttggagagttaaaacacacataaaaggatagattacgattcagggcaacttgtgaaaggtggcaagtaggtgagacagagaacagagtgagacaaaggaagaaggcaagggcagaagcacagtgaaagcacttcatggaggaggcaggacctcaactatggtagagaagagaaagttctgcagtcaaatgcacagtggcagagatgataactgtagggcaaagatgagatcagtttaacagaggagagtgtttgtaggaaagatgtgtagaagttatgtgtgattaaagaatagaagcaaactgtgaaggaaagaaatgctattgctattttttttctccttagcacgttcctccccccctttttttgctatgaatctcaatattttagataagaacattaaagttcaaccatctacccccacccctgtcattctagttacagtaaattgttattgcataaatggggactaggtattctcaataataaactacattggtaaaaataattaatggatatgccataaatcaaacaatcatatataataagtacacttaatagtacaagtttatgaaaaataaattgctttacctacttgggagttagtttaggatcttatagcacaaaaagcacacatgaaggaaataaaaattgttgatccttatctagcatcatttagccagacactgtagtatatgcctctgattatcatttcactaacacttactatatactctgtgaggtattattgtcttgtgaataaagaaatctaggtttgtaatttttatccattaatgagaaagaactagcaatagaaagaattagcaggaattccacattcttgtccctttgccccaatattgcatgcatgtgcacatgcttaagatttgcagttggcaacaagcttcaccaaaaataaattctgtcaatacaactatttatcctgagtctcaagaatattgtcccaggagtcaataactaccttttttcttgatcccagtacactacaagtgagctcctctggattttatttgtacaaacgattcttccttcaaactaaattactgtaaaaacacttaccacaaaggaaattgctaacaaaatcattatctacctcagtacaaactaatgttattactttcaggaaacagaagcaactgaattatataatagaaatattagtttaaaaggtcactggatgtcagaatgtatcattttgcagaagcctcttgagactattcatcagaaattataatgcttagaacatcaaattcaatgccatgattcagcagatctctctcctccctggttcatttagcaccagccatgaagctaagtaaagggaagatagttattctctctgaaaagagagagtatttctctctgaaataattccttccacttgcaattaagaagaattaaaaaaaaagagaggcccatgtaagttgttctttattaatatacacctaataccctacataaatatatagaacatacaccttgacattagctctaggaagaaccagcttagccctacaccgcattttacagatgaagcaactaagacacagtgaagtaaagagtttaaccaatcaaaattgcagaaatagtgactgaaaaaactggaagtaaggaggagtaattaaacaaactacaccactcctctcaactagataaaaactattcagtacaattgaacatgaaacaaagatacaaaagctagtaatgttttcagtcctctatctcattcaaagacttcaactcaactttttattctgtacctatacttgcatagtaaaagaattttggtgaaaattgactagttagccttctgtaatatatcaaaataccttccaaacaccatactgaaaggaactgaggctaaaatagcattcaaaagccatatcaaataaggatgctatgttccaaaacacatggtttaagaactgcacatagccccccagagtgctagttgggattctcaggcaaattatagttgtcaaagaaatatcaattctttgtagatcactgatactaccattctatatacagaatactctagaaacaattcactgtaacatattaaacataatcaagaaactctagtacatgtggaaaaaatagaaaaaaaaagttattgggtatcaaatgaactgaaatccgaaagttcctttttcctgacttcaagttttgtagcatacacagtgcaaaaagaatcattattattgggcaacaaatatatctatagtaattcaatatgatccctgaatatttgacattttttgttctgttacagacttctttgtacttcaaagagatgacagcctgataatacatccattcaactttttcctatgtcaaaggaaaagctgggataaacagaaaaatataaaagatgttattctagttgttcttaaaaaacaaagtaattatatcctatttagattctttaagaattaagactgtgtatgttttcagccaatatgatccctatttcctcaaaacacatctctaatgtccaccatactttcaaatatagaacataatagaaccactttggagaattctttagctgtatctcctagggcagaacatgtatgtacatatcctaggtcccaggaagtccactcctagatttataccaaagagaaattcacaaatgtacaggaaagttcaagcatttgtaatagccaaaaactggaaacaacccaaatgtctattaacaagaggatggaaacataaatcatagaacagtcttacaaaggaatactacatagcaaaaaaacattgaacttctgttataaatagcaggaatgaacctcacctgcacaatggtcagtgaaagaagtcaggcacaaaagagtacttactataagtacgcttttgattaatacacacttctggcaaatctaacctatggagacaaaagtcatctgggtaaagacaggaaggtcacatgagggaggaaatgttctttatcgatattgatcagtgtgataattacatggaccaatactctggaaaagttcatcaagctgtactttcaagatgtgtgcacatttctgtttgtatgatatacttcaatttttaattttcaccaaaaatattaagtatatgttagaatttttcaaagattacattctgcagcaatgaattcagcagagcaatattgagaataattggattctagtaataattcgtctactaatcagctgtgtaatcaatctttaatacaacctaacctctcagtgataattctggtagccaatacatcacacagaaaagttctcaagatattaaatcaattttattcatttaacaaatatttactatgagccactgttctaggcacctgtctcttgcattctaatggagggaaacagaaaatactcagcaaacataatgaatgaatatatgaataaatgatgtaaactgcaatcaatgtttaaaaaaacatagttacatacatatgaatttgtacgtgtatatatacaccaaatgagactttcaatccagtcttaacacacctaaacatatataaatacagaaaggaaactggcttgaaataactatttcattatgatctaaattaaaaccattcccatggtaaatgctcctgcataaatctttataaataattagccttgataacatatgaaatatttaaacatatccttgaaaccacagaggatagagctagaaccaaaaaggcagatttttcaaaggaagaaattagttcaatattgctatggtctgaacgtgtcttccaaaaagcaagttttagaaacttaatcccaatgcaacagggttgaaaggtgaggcctaatgggaggtgtttaggtcatgcaggctccacctttatgcggagattcacactaattacaaaagagtttgaggctgtgtgtttgatctctcaccctcttttgacttctttttgctcttccaccacaagatgaaacagcaagatggccctcaccagatgccagctgctcaatcttagacttcccagactctagaaccatgagccaataaatttctattcattataaattacccagtctcaggtaggctgttatagcggcacaaaacaggccaagacaggtatttaagaaagaactttaagtaaccaaaatattttaaaagacaatattaaaagagagatttgatactggattgtagaggagaaataacttttgtatttgggaggaaggttagatttgacttatagaaaacttccagaacttaaatttgtcaattgggagttttcaatatatactaaaatattatatttttataaaatcttttttgcatatatacaaaatacaaagaacaaaggttggctgggcacagtggctcacgcctgtaatcccagcaccttgggaggccgaggtgagcagatcaagaggtcaggagatcgagaccatcctggtcaacatggtgaaaccctgtctctactaaaaatacaaaaattagctgggcgtggtggcacgtgcctgtaatcccagctactcaggaggctgaggtaggagaatcccttgaaccagggagttggaggttgcagtgagccgagatctcaacactgcactccagtctggcgacagagtgagactccatctcaaaaaaaaagaataaaggtcatatacaattttacactggtaataaactgacatttgaatttctctgtattatcttattgatcttaaaaatgctattataattacgcaaatataattatatataattttctgttcattattcaacgagcattgtctagaagtattttaaatatgtcaactttcactgtaattctagctagcttaaaatttttgtagtagtaagtattcactctttcaaagatacacgaatctctaaaaagttatatgatttctttaaaatttaacacccttctaacataaaagttatgcaaaaccccagcaaactaccaaaacaaaccatgtatatgctaaactcaaattgcctaaaaatttaaataacagaataaagtagcaataagattcagtgaggacctgtttataccactccctggtagtttcaaacagtctcattgattaaacctaaccaagctgaaaatccttgcaactacctattatgcatactagacttttgcagaatattatcaacaaatatttattgagtggttgtatccctttccaatctattattcacactacaattacaaggatctttgttaaatgttaattgtatcaagtcatgcctcttctaaaaatcataaatggccccctgtctaccacaacattatatctaagttcttaaaatggctcttggagtattataacatgccctgctcacttctgtgacttttcctttctctagtctctctgaactaaactcttcaactacagggatccaacttcaactcctcttctgagcttttcagattctggctctaatcacaagctatcacctctgcctaccacactatatcctgtcctttctaacttccactcggccttcactattcagctgagacatgacattcacccagaatcctttcctggctcccggcgcacccagtgcttcactccttcagcaaccacatagtgtgtaatgtcccgtcttctccactatcagcaagagagggaccatttctctgtgtccctgctctatatacaatggcacttagtaaactcagtatctttttaatacatgagtgaaagatatcaatgccagccccatgctgagtccttgagacataacatagaataaaaatgtatttcctgcacagagaatttgatggtctaggtgttcatttacatttgaaaaggcagggtgaaacagaaagtaaccttgtgatcaccataaactcttcaagctttattttcctcttctgtaaagtgaggaaccttcaccaccccattttgtggtacaaccatcatttactgatcaaaacagaaaactgatcgtggtcattgtttcttctctctccctgaaacgctatttcccatacaacccaaaaagtctcggtatgaacctgcaaagggatattttgaatctgaccacttatctccattttttctatactcacagtaatccacttcccctctcttagacctctaaatgcattatttccattcttgccccatccaatttattttaatatagagctgtcaaactataaatagaagtcactttacttaaaatctctctcaatgacttcctaccatcctattaatgatctgatttctactgacctctccaaacatacctccaccagctttgtcctagtaaagctccagccacatggcctcctccagatcttgcaacatgccaagttttttccacctcagaacctttatacatgctgttcattctggctagcacattcttcccttcactttgtgtatgcctgcttccttttcttccttcagtttcaatgtaatacctcttgaaatagactttccttggacaccatatctaaactgaactctcaatctgtattcctgtttttctctattacccattcactgatctttccttctttgttcttcagcatattcccaatagatagagccatgtctggcatacagtagaaagactaaaaatgatttaggaaggaagcaaaaaggcagggaagctgtctataggtgtaatatatgcagactattttgatgtgaacacaaggttcttattttctctaaatttcaccttcaacagcctaacacccatcagtagagatggataaatgccttctgttttgaacactaccgttcatacataagttacctgagattaagtcatgtattaacatgtatcaatatagctgagtttttaaaagtagatcgctgttaccttaggaaggacaaacaggagaatggaggaaaagaagataaaacactggagaattttaataagagagaacaagtcgacaaagttctgaaaatgaagtggcacctaaaggcaccaggaagaggccacagtgataaatctctggaggagaatatgaggcaaaacaacatttaagtcccagaaacccagggactcaactcgggtataacagtagtaaaactgacagggcagaggtagtagtaaagataaaccctgagtaactcacatacagttttccttagagttttattgaacagatttattaagaatgaaaactggaaatttcatataatatcacataaaacattatccacattttaagattcaataaattcctttatcactcctgggcaaatctaatattactaaatgtgtaatattactaatttgaggtcaagtaaaaattccaagtagacagatttttacatcaaactattttagttgtgcttcattagaaagctcaacatgatcaggttcatttcctcttggtcacctgaggcacaatttgctacccaccactctgcaataagcagctgtttgcaataagccctatgttgcacacattggactgtctcctggggtttacaggatgttgattcctaaaggccagatttaacactttggggaaatataaaagacagcatgcaaatacagaagaagaaataatgtatggtatttgattatttgaggactgcaacatattacaggaattggttaccacagaaactgtgatctgtaaatggtccaggtggaatatgcttgaaaataacatgatatgcaaaaactgagttgactcatagaacatcagaggaggctagtgcaatggagattatctagtgggattctggctagtggctaacaagtctagctctgtattcaaagtactaatgtcccatttgacaatcctgactggtgaacatcaggcctccaccaaaatagctgctatactgtccaggtcattttaaggcagctctgttatggaattcttcatattgagtgaaaaacctacctaaactctttaatatacacccatgtggctatgctccttagagccaagagaataaactgaattcatcttccacatctccacaaatacttggaagcagctattgcatatcctcttgcctcagttttcttgtcttcagattaaatagctatagcttattcaatttcaaccattactgcaagacataacattgggttatttcaattacctaaccactctcttctaaatatgttgtcattgctatatttcaatgatcaaagacaaatacactaagtcaacgataagaaccatcatatgtagtaagtgctttgtatgtcttatttcagtaaagcctaatatggaagacattataatcaccaacttataaatgaagatactgaggattacagaaatagaaatacttgctagaggctatattgggagtaacaaagtcaggaattgaacccatgttgactccactatgccctaacccttgtcctgggctatttcaggagagacctaagcagagcagaggagagaagggggtaagagacactactgagcatctgttagatccagaatctgttattcaatatgtaagctgactcatatattcaaactatctatgcaatcaacataccaactacatttttctccaagtagtttggatggagccttccaaatgatccaggaaaaagtgtgaacttacctcacacttacaggcccactgagttttttaagtgataaaatttatactttcactatggtattttaaaagatccctctggaagtatacatggacagataaacagaaagccacactagagactgagagcttatagctctgaggtgagccaagacaagaagctgactagattacaggtgtgtagatggaacaatatttatgaattcaagagagatttttaaaagcagaactgacagtacttggtgatgctttagatttgtaagctgtggtatagcagtgacttagaatgtggctctggtcagactctgggctttaaattccagctacaccactttaatttgtgtgaatgaagctatactttggtttctgtaactgtgacataggcacaagagcacctaactcatagagatgctggcaaaattaactgtgataatagatggcagagggtttaaaaagtctctgtctcataagaaatgttcactaatcactaatgtgattgataaggagaagaaggaaaaaaaagaagagaggtgggaaaaggcagtctagaacgactgccaagtctctgcttaggtgaatgaataaactcagagagaacagaggcagaaaggctggcttgaggaagaagaattttgttctgaatgtgatgggcttgaggtatgtgacaggcatacagatagcaatagattgaagaatatggagtgtcagcagggtagtctagccttttaaagaagcttggttaagaaggaaagcagagaggatgtaagggccagaggagggaagtgacttatttttatgggtacacaagcaagttagagtttgaaagagaaatgccagaagacagggaggggttgaaggtaaaaacgattaagaagtggacgaaaccagtctccaagggacaaggtcaggaattaaactcatgttttgctccaaagcccctaccctaactcctgacctgactacttgagcagaaaccaagccagggcagaagagagaatggataaccagagaaacaggctaagagcacaagaataagcttcaagcaggactaagaggaacagtaggaaagagggaaggatggctacagagaggaagcctctctccggtgttcatatttcccaatcacctgagatcagctccaaggaggttggggagtagagggttgggcttgagtatgattatcagatttagaatatatgaaaaaaacaggagagaaagggacaaaagaaaagccattcctgcaatgagcttctactcaatctttcaaggcccaattccattgtgtgtcatctgtgacatagttccccacctttcctctttcataaatgaaatttatctctcacagaaaattttattttaaaaagttctatcaagactggattaagaaaatgtggcacatatacaccatggaatactatgcagccataaaaaaaaggatgagttcatgtcctttgtagggacatggatgcagctggaaaccatcactctgagcaaactatcgcaaggacagaaaaccaaatactgcatgttctcactcataggtgggaactgaacaatgagaacacttggacacagggtggggaacatcacacactggagcctgtcgtggggtggggggaggggggagggatagcattaggagatagacctaatgtaaatgatgagttgatgggtgcagcacaccaacatggcacatgtatacatacgtaacaaacctgcacattgtgcacatgtaccctagaacttaaagtataataaaaaaaaagttctatcaaagtatttatgaagatgaaatacttctaaagtgcttatataaaatctttatatgagaagattttatcttcataaatacgtctctccaactaggtcacattttgtttaatgctaaattctcatccactccctaaaacacagtagatgttcatgttttcttaaaaagactgagccagttttcggtccatctaactatactctaatacacttccttctccatttcagtatgttagaaaccaaatgatgcagtttttgagaataacaaataaagaaaacctgcaaaattgtcctaatagcaaacagttaacatgagtctgccctacgaataagatcattgcttccaaacgtttttaaaatactcccaatggtattattagtatcatttatagaactagacttgtgtgatagtctttagaaactgttaagatagcattaaaatatatctcataggtccctcgatgctctcctggtacaaaatgaacctgtgccatttacatattagctgactctgacatccaagggttctggtatctgaaagcaatgaatatgacttcttctgtccatcttatgtgtatctcataagctcctaaggactttcctggaaagattttagactagcaaagaaatattttcttcatcaaaaatcctttcaagtatttatttccttcccaagtagactgagttctgtgtgtactggttaatactttataagcttcagcttgcatgcagaacacatcagaggctgttttatttccagacatagttttcctgaaattttaattgtttgccatgaggaaaaaaatgatttcagagctcaaactacattacctacgaggagtctcccagagctctaattaccagaatcagaacataggattgctacttcaattccatttttcactaaaatattggcaaaataacaaattaaataaaattatggctaatgttaataacaataaattatttaacaaatatgaaggagcacctatgttgagcagctgctatgttaggcattgggatggtaaccaaaatgcatgaaacattgtttccactcccccaagaattttacaggcaagtgggatgcaatatacctcactatggaaaaaaaagtgagacagcaaaaaatagttttaaatttttgagcaaagtttaaccaaatgcaacccagttaatttacatcaggtgcctttctctttaaatttcaaatgataaaagtcagcttctccctctaaacttcaataaggcaaataaatatttcttggctttcatgaagccctaggagccttaactatgcaacagttcattcactaagaatgcctgtagaggaagaagggtagtcaggtggtaccagcaaggggagtagaatgaagtccctgctttaaagagagacaagagctagataaaacagccactgaaagaaaggaaaggaaggggaggccaaagaaaatacatggcttctcttagtagggccaaatcatgaggcccaatccagccttctagcttgacttcctctcctattgtctctcaggagccctctccctgttctagtcaaaataaatgtctcttctctgatgtagaataagagtccccgacccacacccaatatcatggctctcatctactgcatgtgagctcattactttatttatcaaaacaaagatggtccttttttttttttttgagacggagtttagctcttattgcctagactggagtgcagtggtgcgatctcagctcactgcaacctccatcttctgctttcaagggattctcctgcctcaccctcccaagtagcttggattacacgtgcacgccaccatgccaggctaatttttgtatttttagtagagagggggtttcaccatgttggccaggctggtctcgaaatcctgacctcgtgatccacctgcctcagcctcccaaagtgctgggattataggcgtgagccaccacacctggcccagatgttcccttcttaaaaggaatcctgatgttaactattaaaataataaactatattacatatcatcaagcttgcatatatacatatatatatatatatatagttggacttatctttattttttaaatattagtgtatattattataaattgttaggctatgaactcattgaacagggccatcttagtgtccccagatcctaaagcagtacacagtaggtgttcaacacactgtaatgttacaatattccttcctcagataggggggtctaggcatataataattatctgcattttatatgatcattcttcataaataatcatagccacaatagcagcttttatctgaagtcgtgtattgattcagagaaggtttcagcttgacctcaccatagaatatcaacttttcacttcctttctatagagtattttatactataggaaaagagactctaacacctcttccaaaaataatccataacatttaatagtttattcatagtcaccatgaggactttgacctctcatcttttgtatctatttttaattgtgttagaggccacattaccctaatttccttacaaagtttccacttagaccaaaaccgtgaatactgtaattgttggggatgatgaattagatgaaaaatagactatgcattttcaatcattgcatttagtattattagggtagatggccaactattacacagtaagagatgaaagtacaatgcaaattgatgaagaaatcataatcttaaaattttcaacaacaggctggtattgattttgatgtgaaagtaaaaagcttacttaatacattttttgctcaattcgctattgcgtgtacactgggaaaaatatcttgcattctataccaacccattaaatcaaaatgaatgaggggagcatttttattttatttatttatttatttatttttgagacggagtcttgctctgtcacccaggctggagtgcagtggcgcaatctctgctcaccgcaacctccgcctcctgggttcaagcgattctcctgcctcagcctctcgagtagctgagattacagacgcgtgccaccacgcccagctaatttttgtatttttagtagagacggggtttcaccatgttgaccaggctggtcttgaactcctgacctcgtgatctgcccacctcagcctcccaaagttctgggattacaggtgtgagccaccgcacccggcccatcttttttacttacactgcactgtgtaactcccaattcctgatgatagccagctacaggagcaattcatcaccaacatcattttatcatcaagttctttcatatctgataaaacctattcctttctgacatatgtaaatttcaaatgagtgctacagataaaaattgttaaataagtggctataatgtgattccaaaaacaaaaggcacccactcactgtactttgttatctaattacatgatcattctgttaaacttcaagcaatgtatttgaaataagaaagtgcagacatattgtccatctcaatttcataaatgttgtatcatatatccaatgcatatcactttaaattttttcaacctgcatatttcaagacagctgctacacagtactttaatttttcctgtttgatatattaacatgcagctgaatctgatttggttacaacttctcagtgaaaaagatgttcatctacttaaacatcagtttcaacagaatggcacttgacagagaatatttcctttttctgtactactttttccagttgcattttatatcagtatgcttcccattaacacaacaaatatatacataaaaccaagacatatgtgtaaaaggtataaatgcagtcaattagccagatgtttggaatcatggacacaaacatcagaagcattataaaacctacaggaatggtaatgcttgacaggatatgggagaagtattttttaagaaaaccttataaacatagtacaaagatgacaaagacacaattatagcccactgcagccctgaactcctgggttcaagcaatcccctggcttagcctcccaagtagctgggtaatgcaggtacatgccaccatgcacaactaactttttttttttttttttttttgatagagatggggtatcactgtgttgaccaggctgatctaaaactcctggccttgagtaatcattgtgcctcaaccttctaaagtactgagattataggcatgagccactgtgcctggtcatactgttttctgcaatagaacttacctcctctctctcatgcttctgtagcaccaagtatcagaaaacataatctagtcatttctagataagcttacatcattctgattttcctcagtaatttctgcatatgctcatcttaagaattcatgacttctcatccttctcttccctaaggtgagggttacgtggtgagggaagttcacacagcagccgcatggtatcggtgagaggcattggacctgtagcactctgatttggcacctgtcaagtctctagtcacagcatttgtgtgatcgggttttcagtgaactatctgtagtcttagtagactctaatcatgtattccatactaccattcctggcttcttctcaacattactgtgaggtcctttaaagcactggtcttgcatccagctcccttgttctgcccaaaagtgcatgaagtctcaactgccttcctgggcccataggagcctgctaactatcttctacctgctttatctacagacttctctcatatagttaaccatctccatctaagtgataccatgtcattcaatatgggacacacccatgacattgttgcttcacaaaattccagaagaagcaggctgtgcagccattccaactctgccaccagcacactatcatcagacaggggccttagataacgcttgccatcccctggctttcacctggagagtgaagcacaaatctccaatgctcaaatcttcaactaaagggagcttctatcattatccctggtctcaggctgtagaggaaagaaaggcagaacacagggctgccatgtctcctgaaccttgtttcaactccccttctaaccaaggcaacacttatttaataatgtgatgagatcatctcactctttggctaatttctttccaatctgttgttaaaagttaaaataaaaataaatttatgcactgatatcttcagagctttattttaaaaactcaaaacccttttctatttcatatagctcagctgcttgaaatacactatcttgtgtgtcaagattattaagccaactagaagtttcaggagcctacttagaactcagaaaaaagaaacttaacttttctttattgcattaacactcttctctgaaaaaacattgtaatggcaataaggttccgtccagttcagtgggaaaagggctatgggtattgaaaacatatacagactacatatatacataaatatacacatacacaaaaaaggactttctcagaatatacaacttaatatatcaaaagactatctttatacatttttatgatagacaccataaacatagtcagctatatatgttacataagttatgaatagaaaacactggttttatccacatatttcttctttctccttcttctgtgtcttctgaaaacatttgaaatatcaaccatagctgcctacatagggtcctctgacagaatattaggtgataaaatggtataaggagacatataattgaagtggtaagaccagatattactcagagagaatgtaaaatcaataaagagtagaacatcaagctttatatttaggaaaaatggggacagaataactctgataccaaaaaatgaaaaaagacatcaggaaaaaactacagaaccttatttataaatataggtacaaattttccaaataaaatcttgataaatccagctgaatagttaaaaatatgaccaaataagatttaatccaggaatgtaagacaggtaaatttaaagatacctattaaggtaacatatttaccacattaacagataaatagagaacatatatattaccatctttattgatacctagtatcaaaggccaaagtacttgaaaatctaatttccacctaaggtaaacaaacagcaaccgacaacgaaaataaagctcttgaccaactggaaatagacaggaaaaatcttatttgataacatatgaggagcctaagggaaatattacattaaatgataaatatcagaaggatgcccatgaaagtcaagagggacgagaggttctagtcaacaaagaaaaaaaattgagatgtataaggctttaaaaaaaaaagaaagaaaatgtgttattttgaataatatgactacctagaaacacacagacaataaacttaaaaatataaataagaatattctgaaatatggttggaatcaagatcaacattaatggccttcttatacacagaaataagcaactggaagacttattggaaagaatattttttaacaataacaaaaaaatatggaaaacctagaaataaacctaagaaggaatgtgcaaagtttatatgaagacaactataaaatttaaccaaaggaaatacaagaagttctgaaaaatgaagatacgccattcattcgacaaaaagttaaatccctaccctatcctggaccctaatctcaatagaataaacacagctatataggtactagaataaaatattagagaataaagagaaagtgaaggatctgaaaaggatactactggggaaacgtactaatgaatttagtttttcccaaggtaatctttagcagcagcatccatgaataacttttatgaatgtccaatttataatacagtactctaaaactgacagtttttattgaatataaagaacaatggttgcctgtgaaaagtgaaattaaattttcttcttaaaagttcctttattttttacaatgtacatcgaattttttaaaaatcaaaatgaataaatttttaaaagttaaaaatataatgtacataataatactaatgcatgacatcagtttggtgaaatatttttcttatataaattaattatgaaaattagcaatttatacactataaatctttaaccagatactgtataaataaaaagtgttattactcttcaaaacttcttcaatgtaaattgtaatattgggctttattacttaatgtatagaatctgtgtatatcctcttaattagtaatttcagatattttttcaaaatttctcttcttcagttattctcataaatacccaccagttttaagagcaattttgaaaacttctactcaaaacagaaaaacaataaaaaaacagggaaaaaatagaatagaaaaaccttctggtcactcataagatgtacagaaatgttgttcatgagtaatcttttaaatgttcacctctatatcaaatgtaatttattttctactctctgagcaatgatccaaacatatttgaagctatttttttaactaaggagaacatacaattagtctattttgattttgcttcatatttcaaaggtttgtgtttaagctttattaatagtgctctttaagttattttcctcccaataggtctttaattacatgtatctgaaaatacaaagtctaattctgttagaaaacttaatgattcttaaaatatttgctttcatgagtatatgattatctgaaaaacaaactccaaagggcaataattaagcgacatggggttccacataggcagaatttagaaaattaaactaattttctattttatttaatttaaacattaaatttaaatttagaaaattaaacatacaccatatatatatacacagaaaacttcatattgaataaaatacaatcagctataaagtagattaacagactcagattccttttaggctagtaaatttgactcattcaacatgttcagatgcagttggcccactgtatccatgggttcctcatctgtggattcaagcaaccaaggattgaaaatattcaaaaaaaaatttgcatctcttaacatgtatagactttttgttcttgtcattatcccccaaacaatatagtataataactatttatatagtatttacattctattaggaaatatatgtaatctagaggtgactttaagtataagaaaggatctacataggttataagcaaatactacactatgttatatcagggatttgagcatcctcggattctggtatcaagggaggtcctagaccagtccctcacagatacagaggaatgactgcaaccccttattcaacgttaaatcccaattgtacgctttttagtgtagcactgaaaagttttagaagaattctcatataaacaatgctataaagttaactttccagataaactgaaataaaactggtttttaaaaaaagaaagaattgacaattttatagttatttttattcataagattttaaaagcatatataggctgggctcagtggctcatgcctgtaatccctgcactttgggaggctgaggtaggcggatcacctaaggtcaagagttcaagactagcctggccaacacggtgaaaccctatctccactaaaaatacaaaaattagccaggcgttgtggtgggtgcctgtaattccaactactcaggaggctgaggcaggagaagcgcttgaaccaggaggttgcagtgagcccgagatggtgccattgcactccagcctgggcaacaagagtgaaactctgtctcaaaaaaaaagcacatatatgcaagctacaagattactatcaactggtacagtactttataaactacaaactcatctttgccctaggattaatcactaaccacttcaagaaggaatgtggacacagactggcccactgtagcatttaaagttttttggctaaatacacacatctgtgttgttcttttcaaaccgtcaagatataaaactcatttaaaacctatttttaaataccatgcagcaatgatcccttagaggcagcaactttagatgatgcttaaacaatgaattttttttccaacaataacaattttctttaaattcatttacaaaacctcaccacacagcatgaggtatactttcctggtaagcaactataaagtagaattaactatcctcaaatgaccatgaaattaagtcagccatatcagattaagatgaccataaatgcagttaaaaccatgctaatttacatagccccctaaccatgtttaattgccacattaaaaacccttcagatgctggtctgtccttttacaacttagaacagtgtcacctgaattaacttgttttgtctgaatgttgcactttgttttttcatttatatagctgggaacattcatgagctctagttattatgtctaaatatttttattaaacagaataaaataatcaaatctatcaaactggttttaatgaagtaagcaatgcatttttaaaaggaagtactctcttagccctaagcaacatgagtcatcatgaagaaattatatatatatatacttatccatttctatctggtacttttaaccatgtggggcatgccaatcttcccatgagcatggaaactgaaagtaacccaagggcactagccagctttggaattactgctataatgcctcctacaccacacccatcacactcccatactctgatttctgcaagccacagcaagccaaggttttcaccctagggcattctggactcttttgataccctatctcagagtagaaacccaatctttgtactgggctgtcaaccattcactttttagattcagagtacataatcatttggcttgtttttgctataccctctgggtgcctcacactctagaatgaactatttgatttgctgacatctagtatgtttagatttcccttcctttctggactactctttcacgtttcctcacctaccccacagcctcagatgcattatcttactaccctctattctcagctcctcaatgaccaggatataaccaggaactgaggataaatcatttattccacttgttacttaggcaaccccgaaacgttaatgaaagcatcttttgccatcatgtattatatagaatcttcagtaagcagcaatgcataacaagacaaaagtgactgattctgacctacctaaggaaaaaaaatcacattatcttgtgattatcttggcttcttccctaacacaataatctttggttaccataatgcctaagctcaattagaagtcagaaaccccaaagtatccacaccaggcagcaaagcaagaataatcaagattgacatatttcaacacacatatagttgcactgaaaggctcccttaaccaattcaccagacaaccccacccccaaaagaattatgcatgggtgaaatttctatagtttttgcactaaaagtaaagtcttcccatggctgccagaaatcaccaatatgaccgttctcattgttgatcttatgctgttatagcaaccaagggagacaactggaaatgggagaaagtctcttttagactgatgaaaattaacaagggacagaaatcaagatagtaaaggaaggagaaggtgctgtgatttagccagagataatcattgtcgacatactattatatttcattttagatctttttcctaggtgtgcagattagtgtactcaactccatttcagttgtgttctttcatgcacgctaagttagatagctagaacaaaagctaagctagaaagctaaagtttatttcctagacttcctgacagttagatgttggcacatcacctagctcttgccaagccgatacactggcattactttggaaggcaaggttaacacggtgagacagaggctggctgctgttgcctctgctgtttttactggcaaggtcagtgatacaaaaatttgatttttctgcaacgtagatctgaatgtccaaactctactttcatgaaaacaaaagctagggccagggcatccatgtgaggtggcctcctaattctccaggtttttgtttgtttgtttgttttaatgagacagagtctctctctgtcacccaggctggagtgcagtggcataatctcagctcactgcaacttccacctcccaggttcaacagattctcctgcctcagcctcctgagtagctgggattataggcacccgccaccactcctggctaatttttgtatttttagtagagacggggtttcaccatattggcccatctggtctggaactcctgaccccaagtaacccacctgcctcagcctcccaaagtgctggaattacagacgtaagtcaccgtgcccggcctctccaggttcataaacaccacagaaattgcagcttccttagccacctataaaatgagcagccactactccaagcagaaacatgctcattggttgttaagcaagaaataaactttcattgtgtttgaaccattatgcattttttaatctctttgttacataagctagtggttaccctaactgataaagagtccaataaatatttattgaatgaatgttaaagaagaggaaataaatgcaagaagtaggtggagggagggtgggaaagatggtgaaagataaatagatggttaaggatcttgattttttaaagaattaatgggataaatgttctcttggagtacagaattatttcatactattataattactaaattaataataacctatttgaatttcttttctattggtttttcagtataacatctgttcacaattcctatcctgttgaaatttatactctaatccactccataaattttaaaaaatggttttggtttctgattacaatttcgccataatgtgattacaatttcgccataatgtcattacaaatccaaaagtaagggaaagtcctccataatacatggagctaaaatcaaatacagacatcaacataatacatatgcaaaaactagatttccattttattacatgcatactaattattaaaatgtaacacttttgataatattttaaagcagtgtccccatagtgtgctctgaagacgccactctgatggtccccatgaaccttgcagggggtccataaggcctccctttcccaagtacatacctgtgtgagggaagattgttttcatacatactccaaatcaaataacattacacaacatattgaatgcaaaagcagatatgagaatccacctgtttgtattcggccagatattgaagagatttatgaaaatctaaaacaggcctggggcacagtggctcttgcctgtaatcccagcacttttggaagctgaggtagaaggattgcttgaacccaggagtttgagaccagcctgggcaacatagcaagacctcatctctacaaaaaataaaaaaattagtcaagcatggtggcacatatctatagtcccagatacttgggatgctgaggcaggagaatcacttgagcccaggaagtcaaggctgcagtgagctatgattatgctgctgcactatagcctgggcgacagagcgataccttgtttcaaaaaaacaaagaacaaagcaaaagtaaaatagtgccctcttctcactaaatatttttgttttgaaatatatagttatttttcataaaactgtcgtatttatgttgatacataataaatatttttatttttaaatgatgaatatatattttaaattttctcaatcttaatttccaatatgctaaatattgatgaaactaacccacagaacagaagctctttagggtcctaaatttttaagagtttaatgaaccataaataaactagtgaaatcctgtaacaatgccaggattccttttattaatagtaaacaataaactatatttaaatatagccaattttctatatgtacaaaatgctaggcagccttcctattgctgtagtagaaataacatggcattgaacacatgggtttaaataccagtttcataacttattaactgtgtgggcatctgttccctattattctcactgctaccattacaacaaactcaacgttatgcatatcaaaactaaaattgttgcattttgcaagcattcttgaagatttaattgtgcaggattatagagagtaatttatatataattatatacacttactaattcaattatctgggagtatattttagctaactcactattcagagttatactttctatagtagcagttgcagcataactgagtattcttaaagcaagcaattaataaactccaacataaaatttttccttgccaaattatatctgtcttgttctatcgaaactcaacaaaacatttacttgttcaagggactatgttgatccaaagatttcccttcaggaaaatgctggtgctgcctagggatactagtagctttccataaaaaaagtgttcaactaagagagctgtccaggccactcatctttgataacagaagttcagctttatcataacctgtatgtcaggcatccaaaacctaggaaactactcttcattactaacaagataataacctttcagtaggtattatctcaattctttttctcatctacattttacaaaatggtttgttgaagaaagttaggttctaaaaaggaagctctaaaacaatagtcttcattttttttctctcatattcctaaaagaattttctaaaaatacacaacatacattttcagttgacatgtaaaaattttcatcatgaatttaaatgattgcaaaggctataatttctagcatgttacaaatactgccatttttatataaaactgttataccagtcttttaagagtaccaaagaaatctaacttccacagtaatctgatatacaccagcaaccattttatcaaaaaaaaattcaagagttagaaaatttatacacacttttttgcttaaactcatttccagttatctccccataggattttaccctaatgtaatcgtttttatttctaaaagtttttaactgatcctctatcatacttctcttcaataaaaatgtaccttaaaattgaacttttaaattgtgtttaattttctaaaactgtaatgttcaaactaagaaatatatggaaatgtatttcttaatgagaagggctagatttttttcttttttaaaatagtttataggcctctgaatgaatgttactcattgctagtataaggtttcacatacattttttttctattttttattttctctgtttatgaaagaactgaaactgttcactaagtagatgagaaggatgttttgttatggcaatgttactaaatccttcaaaatcacatagcttattaaaaatatttgatgtgtgaaaactatcagctgttaactcaattacatctcccttaagtctgttgaaaccgaagaattagaaaccatatgagttgcaaaaggattttttaccttgagtttaggtcattcactttttcaataccaataccaataccaatacttctagctaatcctctgctatcatgatgcaagggaattttccatcctggagaagtgtacaatgagaagatctgggaggggcgagaagtctgccttgcttgttgtaacatgagtcaagagcaattctgaaaggggagttaggaaaggaaaagctgctttcactgtctttcacaggaggaccaattttaggacagactatggaaactgaggacttagattccttcaaaatcaactatgtgcaaccttggcaaacaatcatatacaaatttgaagacctcaaatctaagggacactattccttcactactccaagtgttttaaatcccttctctctgtctctttttttcatacacacatgaatgcaagccaaagcccattcacagaaaacaatcatataaggcacatctttgcatttattataaaattattgttggtgccacaataatcacaatactgaataagctctaaatccttgctactcaaagtatggacttcaggacaagagcataaagcatcataaccctgttagaaatgtggaatttggggccccattccaaacatactgaatcagaatctaattttaacaaaatctccaagtgatccctatgcagacaaaagtttgagaagcacggacctaagaagcagagaaataatttttaaaaatgtagtttgtaaaaaacatacctcttgtagaaataatatttcctcctttttgatcataataaagtaaccctcatgtttccatttttgtcaatcttactagcaccagccagtgtatttcctaagaccgttaaggcttgaagtaaaaaatatattggaaatgtatctcttcctcattatcctggatttctggagtgttagtctagctgatttgtctgcctacggtctttccccccttcaatccatcctctgcacagctgcaagagtagaatttatataacaaatctaatcataggactctcctgttttaaaaccttcaaggtatctccaaattaaaatacaagcatataaggacaagattacctgatccctattgacctctctagcctcatctcccaaccacctcccattttctcctgtacttactcttttagctccctgtacacaccacgtggttttatgcattacctttccatcatgttgtcccttaccagaatatccattccctatttattgcctagctgattatcacctgtgcctaaaggttcgattcagtaatcttcttttccagaaaactttcatgtaagatccccccccacacacacacatctacccctttatacacatacaatgggcaaaggttattttctttgtactgtcacagcacttaccattttgtatttaaataatatatttatatctctgtttctctatatagacagtaacctcttctaaggactaacaaaattaacagcacaaagcaggtgctaaacattaaaagtcaaattgaataaaacaaaacgtgattgttaatcataagaattgtaatagccagctcttataattagcatattcacttctctattcatatgcttttagtgttcttatgtcatctgctagttatcattttacttttattttggtttaaaaaaaatctacctcaattcttttttttgcaactaggcagagtatacatacgtatatagagcacagctctgtgactttggtgaaattacataatgtgtcttagtcacagttcctttattaataaaatggtaattacaggatcatattcagtaggtaggattaaatgaggatgctatagtcccagctactcggcaggctgagacacaagaatcacctgagccctggaggcagaggttgcagtgagtcaagattgcgccactgcactccagcttgggctacagagtgagactcggtctcaaaaaaaaaaaaaaaaggattcatgtgaaatattttatataaactataaacattggccaggcacggtgactcactcctgtaatcccagcactttgggacgccaaggcaggcgaatcacttgaggtcaggagatcaagaacagcctgggcaacatggtgaaaccccacctctattaaaaatacaaaaatcagccaggtgtggtggcaggcgctgtaatcccagctaccagggaggctgaggcaggagaatcgcttgaacccaggaggtggaggttgcagtgagccaagatcataccacttcactccaacctgggcgacagagtgagactctgtcaaaaaaaaaaaaaatctataaacattatatacataagtaataaaaattgcttattttattaaaatcatccattataacaaaaagtacagtggttagaactctaaacaacaggaaataccttaagaaataagataaactttaaataagaaggtcttaacctttctgctgctgaacttttaaaattgaattcagtataaaattaataccccgcagtggcctttgcacaatcctatatctccttagtttcctgtacttcacgaaagatgtaggagaaataagtgattatttgaaactgttcaggttttgaaacacaatctgctatcatgaatatttcatttcttgaaaatattttcatgcttatccttttcaataatgccacatcataatgctttatttcatctgcctgtgacagacatcattactaatcctatatagctgcttgtttcacgccacgctagagcagctattgaatttcctacaacatggcagccagtcctgacattcatatgaagaatactatgataaatatataaaggactataaataaggcaacaagaattaaaacatcataggttctgaaggtggcatcttgacttaattgaaagaaactcaatacataaccaaagctgaaggatgaaaaggagaaacaattaccaactagtttataaaccacaatttaatcaacttacagggcaaataaacctagcactcagatcttgttgaaaccgatttttatgaaacttggttttatgaaacttggtttttaatgccattcctcaccaaaaagaatcatggcttctggagaaatggctagcttcagggctagatagagaaggtacacaattatcctggagcaccttgctatgccaaaaagtaaggaaatgctcaaaaatgattttttaaaacctatcacaaagacttagaattataaaccaccagtaaaaaaattttctaataaaaagtagaaggaaatgaggaagaagggatgactggtagagcaggatgctgaagactgactagtaaatgaagaggaaatactggcactggtacatcatcattttgcaaccatgacaataaagcctggtccaggcaagaattattagtagatgctaaatcaagaagagaaatttacatgcacggtctctgagtatctccccatggattgctcattaatagcaaggggataagtagtaactaaaaaatagagaaactagacagtaccttgaccagataaatactgagagcttccagatgcgatgcctggaaaaggaaaatcatttatataatatcctggctaggaatgcaaaatctgaacttaactcatgagaaaacatcaaacagacctcaaatgagaagcattctattaaaaaaagaaagaaaaaaaaaaaaagaaagagcaagggcgctgtattcttcaaatatatcagtgttataaaagacaaaaaagcaagctgaagaattgttatagattaaagattaaaagagattaaagagacctgaaaaccaagtacaatacacggctccatgctggatcctgtactggagagaaacaaaaagcaaatgtttataaactacattactaggtacactgacaaaattcaaatatgaatggtaagttaggtaatggcaatatattaatgttaaatttactgacactggatattatactgtgattatataaataaaatgccttaatcttaggaaattgcattgcgatatttagaggtaaaggaaggcaataatatctgaaactttcggaagattctaaaaaaagaagaatatatacatatattcattctctctatacatatgcattctctctatatattatttcataaatacattcattgtctctgtatatatgtatacacacacgtatatatgtggagaggagagacagggagagagatcacatgataaaaccaatgggacaaaatactagcatgttaacacttgctaagtcctagctttagaagaatataggtattctttgtaccatctttgcaactttgatgtaagtttaaaatcatttccaaatacaaagcttgaggggaaaaaaagcaggcaaaagataaacacaaaattcaggtactgtgagagagaggaataggagagaggaggaacgcacagaagaatatgctgacagtgttctcggtgacacttgtggctgttcctcttattgttatgctttataactacctacatgctacatatattcctgtgtgggtaaaatattacgttaggaaatattacatcagaaagaagaataaagaaaaaaataatgttctgtaaattgttttaataatttcttcaaaactacaataagaatacgaagagccctcacaatgcaagcacaaaaggacatacgctaataggtatttccggagtaacaatcattaatttgtttttattcctactgggttaaaagcataatactatatttaggtccagttagttagttaccttcattcttcctcaatttggtagtacttgtttctctcagcaaaaaggctttttttttttaacacaacatgtagtacagttaacaagagttaatacacagaattatagctaacatttattgcttactaaatgccaggcactatgctaataagtacttgatattcattatatctttcaattttcacagttacttgagcaatatatatcctattattttccctcttttcgcatggggaaaaaacagaaatagaaaggttaagtaacctgtccaaagccacacagctagtgtgagtccaaatttgaacccagagactctcattctagacctcatacttgtaaacaacatgctccactgcacttgaacctgagattctgatctcaaatagttcttacattgaaaacagaggtaaaatgcccatatagtactttaaaaccagtggataagcaatagatgatagctattatttccattcactgagcaacaaacgctgtacataaaataaagactatcttagatttgaattctcctcttcgtttttccttttgaccactcattaaaaaaaggaaaaggtattattaagtaattaagatgccaccagagacaaaaggatagaaaaacttttaaaatattctcaatctatacacactagataatccacattttataaatattgaatatgcttatatggaaaatgctggttatattggatataggaaaaaagagttttccagcacaatagaattatcaggtgtattaagtggatatgtcattttacggcagcccagcatccagcccttttcctgacatcacccctacttcttttgggggaattttctctactatgcagtcctggtggaagcataaatccaaatacatgttctccattatggaaaccaaagatgtcttttaaaggctacttccagaaaactctctgctcagtccaatggtatagggaagtgaacatataacccaagttcagtcagtcagacacattctctcaagacttagtgtattaagcagaatcaatgcacataccaaagacgtggttagagtttatttacgccagcaacacagcctaacatttttgttgctgttgttcctgaaagttcttgctaccaagaccttccagatctgcctaattcttatctgtttcaagcataactctttagtctcccttcaatcctgtgagcttttcccatcccagataccagatatgtctaacaaactccttttttgcttttaagtcaatctgtttcctttactggcaacaagagtaacaacaacgacaaatctgtaaaataaaatataaaagcataaggggataaaattatataatcttatttagcagttctttgggtgacttttattcttttccaatggtttagtatactggaaaaagtactggccaaagtatttaaagagctaaaatctagtccaggctttccatcagctggcttcaacatctgaagtgtgaattcattctggtcctcattttttttaaatatgtaaaggaaaatggtttgaacttcaagttttgttatattcataaaatattatgttttatagaaaggaccaaagatttcaatgacaataccaataatacagaccttcttttaagaaattagcacatgaatgactgttacagtatttcctattcttttttaataatagttttcatagaaataaaatgttacagtagtttttcaatgacaaacaggaatcaaatactttcagaccatttccctaaagggatgacattacatatcttagaagatttagtggtaagaaaaaaattggtttgaaatattactctcagtaaatagcattacgtttgtaagatctacaggcaaaacaatgcatcttctataggtttttacattttgtaataccacaacattctcctgaaatgtaattcccttcatgttttcaaatgttttgctacagttgtataaaattcattggtataattactaaggaatatattcataatagtactaggatttcaattttcatgaaagggctaaaattactcgtgtcaaagtcaggcaaaattttgcaaactggcattaatcatggattggtgagagtctaaaaagccagtaggaaatcatagaataaggtcagaaggagttttaatgttgaaaccaatatatcaatagaaaagtattgctatcaattctttaaaaattaaaaaacaaagccattttcaaaagccaatcaagattaacatcattaaatcacatctccaagaataataattatttaattttaacacttatcaagcattaactgtatgcttgatttaaaaagcaatgagactttgttcttctcataaaagttttatctccctagacctaggcttagatatactatttgttaccacctctcacagcaattcaaaacacagaacaactatcatggcagtcattatgctaaattctagatggtaaagaggaagatgaattagtccttggtcttaagcactcaccgccatgaaatcaactcaatataatgtgatccatgctagaaaacaatggtatttagtataatctgttaaggaagcaattaattctgtttagggacagaggaaaacctataaagaaaaggtgacatattaaaattttataaaaaatatcaaaaactcttatccagacaaaggacttcattgtcggtcagatctgagtttaaaccccaactctaacctgtgttgtcatgtgaaactgagcaagttgtttggaaacctagaatctaggcctagttctgctgctcttaaaccatgccctcaggcaacatttaacatctctcagccccaatttcaatggagagagtcagtgagtcattctctatgatccttaatttcccctccagtaataacatgaatctacaccttatagtaaattagagaaattcctattgatattgaatgtgttcatttagcaaatacctctagaatatccaactaagtactactgggcttagcaagtggaatacatcattgaacaaaataagcaaaaatctctgttttcagggagattacacagaaaacgtctatggaaaaacttttaaaatactttattgcacccttgttcaaacgtaacttccctgtgcagttgacatagacgttaaaaatagttaacacttgaaaatttccaaataaccataaatattaacacagagaaagaaatctagatagtgatgaagcataattagtagcactaccatcaaaatcccgtttctctaaattcacactgagtcagtgagctttagtggcttgacaaaaaggcagcatgttaacgagattcccctaaaccagtttagtatatagccatattttttttctcatttaaattattccatagtttcttaagaactatgatacaaccaggtaagttttatttaaagataaataaaatctgcacatggtgagaaaatattaacacaaaaacctattatctcacttctttttcagacattccacttccatacctggtgtttttcagcctcattttaggctattttattatataagatttttatttgagttatatatcatcactgtttgaaaactgatttattattcaatagtcaagtgcaagacatccattcttaggcatctccaaagcagaaacacagtcagagtatgccaggtgatggaggggctacagaaaggatacatgatgaggtaaggaagaacagaatatagctgccctcaaaatacatagcaacttgaggagagtcgtggcaagtcttacaatcttccatgcttggactcttcttcactaatctactaatttctctgtacgacttttcccattctctcgtggtgatgtcttcttcatggctgctacagtatcctagattctgcagcctgccttctctcaaaatgtctgcatacttttgcatctttctattaattgcatccctttcttagaaaagaagatcttactggggttgtggtgactttccagtatggactataaagtcctcttgttcagcccccttaatggctgtgtgcttttgactgcctttggataatggggtcacaagatttttaaaaaacaaaatcttgttagcatatgcctaaggcatccatcaaaagaggactatagcataggagtaccagaaagtttctaagaaagacatgcaagtactttctgtggactgttcaccatgtaacgatacagtatcaccatagagactgtatgtacagagactgaacttaaaagtcactcccacaatgttaaggcattgcattaaaggcacaaaagtaaagtaaacactggcaaatatatatagcatatactaaaaatttaaaattctaaaaggtgtgaagaggtgggtgtagtcatatgtttatgtaatttaaataggctcagcttaggcaactattctttgaagcaaaacaaaacaaacatacaaataaaatattgtgaaaacactgtttttaaagctgagctggtcagcatcaaacacgcacttcaaagtagtgagtcttaagtttcataactggtattcttcaaactgtgaaactcagaatatattgacaaatggccacaattttgggtaagagaacaatcaccttgacaaacattttccaaagtttcagtattccaattttgtcaaggagaaacagccaggattacacaactgccagtctgaggttctgtgccaacatcatgcataaaaattgcaagcaatgaccaaacaaaatataaaatacaaaggacaaatgcttgaggaaatggataccccattttatatgatgtgattattatacattgcatacccgtatcaaaacatctcatgtatcccataaatatatacacttactatatatccacaaaaattaaaataaaaaatttgaaaaaaatacaaaacacaacaaagaaaactttggaataatacttcctttaagctgaatacttctataaaatactggagccacatgaaagaaaagaatacgtatctcttgttctccttccttctgtcagtgggcacatgataaatattccttcaccctccacctgccacccaccagatcccactggctactatcacacaaccacaaaatgagccaccttacaaggaagcagataccaaggaaggcagagaagagagatggagctgactgcctgtaaacattcaaatgatcacttgactttgtcacttcttctgatgagttctgttcttttttttttaacataagcaaattctgtttcataaaataaaggaaatgatgagcatggtacaggatggcagataagaaagggtatttaatctatctctttccctcctagtctacccaaaaggccatgaacataatgtatgagcaaggatgataagaaacactagttttgcactagcaaaacaaaacagggacagaataatatgagcagtcataattcctcatcagtttcatttttctatttcaagtgctgtagatcattgatcatgttcttgcaaatacccataaagtctacacattgaagatgaacaattagggtaaaagtgaacataaaacattgatgtaatctgttctgttacccactggaggaaggaacctataaaattatccaaagttttaattacggaggattaagagacttgcccctacaatatcttccaatgttttcattattgaggattaagaaactttccccaaaacactttaaagtagcattaagtggtgaaaaaaaaaaaactgtagagagaaagagatcacatgcctcccacagggtagttgttaaatgagtatttcttaaatttaactgaaaatatataaaaggaaagaaaaaaataagttttctatgaaaaggaaaaagaattcgagatgatcaaaaaggttaacatactggaagacagtgtggcatctgaggaataaaggttggtatcatctactgggcagaattgttttgaaaactggatgagatgtttgcaaatatactcagcaaatgtcacacagtaaatacattgaaattgagaaaaaacactgaataaaagagagaaacctgcttttcactgctactaagtaaggtgaagtggaaaagaggccatgcagttaggatcctctttcttggtcctttcatgatccaggagctgctgcttgtaaagctgctctggggcagacatttcaatttgtctgttttcttgacaacttcagttataagctttgctaatgtttataagttcccattggagaaaaattggttagtgaggattatgaactgaaggaaaatgccttcaaggatgggttggtaagattaggataaattctaatattatacaaaaatagtaagattatactctacatattttataccaaatttatttctcctgtgctgagtacagtaactcataaatcccactcactctgtccccaagcatgaatgaagaacacgagaaaatacatcagggatttaaatgaatgcatttttaagttaaggaactcatatttgacaagaatggcttatgttttaggaaatactattttgaatcaaatcgaagttgaggtgggtttttttcccctacttttttaatcgtggaggaaaaaaaaagccaaacatcaatttctaatggtaggtttgctctgacccttcccattttactctgcagcaaagacctcattcagttcctgaaaaaagccaagccttcatcatggtcacttcagattatataatgggagctgctctgaactatccaagcacaaagcaggtctccaaaaattgctcacatgctaaagcttgatattgtcaggtgtctataaatgcatactgaataatgtaaattggtaacctgctgacaatgcatttgcataaatcaagtcaatattcatgtaataaaatcaccactgagccttttatctttcctagtactgatcattctgtagctagtaaagtcctagactaggctggtaacttaaagttaatgaatggaaagactggcatcctagaagaacaactaagaaaaacctaatagaacttagtgatgagaagctagttctcaagaggaaaaaaaccaaaattaggaaaaagaaaatgacaagactcaacaattccacaaagtgagcttttcaaagtccattctttctcccacattattattgtccttatgtctaacaagtactctgatgaacaacatatcataaggctccttgcatttttcacagtataaaggggaaaaagccatatagctcttacaaagttaaacccaaaagacagtcagaccctgagagtcaaacaagtaaaatggctttggccttaaatcaaaagctaatagggcctgaccacataagtctgaccctttaatagtattctctcctagcttggcaacccaagtgagaaaacaaagtgttgaggttatctaagcctgtgtgaagacactggatgctgcattcaatgttagctacagctatcacattgctgagggaaagttacattaaatcagggaaaaaactattgtcactaagtctagacttttgttttcagagacaagaaaatgtgaaatttaagcatcaaatatgatatcacgatgtatcaagaagacttgaatatttttggtaaatatttacagttcctaccacagttttagctccttcatagcggggggtcttatactttagtgttgtctcccactatttaggaggtgctcagaaagagagtcttcactgattattaactcagcagaactctcaggatgtaaactatagactaaaagtactcacacactgatgccgtatttgccaaacattaaaaggaacaggcttgttgagtgttgctacaaagagtagaggcaggtcaaaagacaaaaactaccaggaaacagatgaaaagccatctaaagtaataataatagtagtcttatgagacagtaaaatatctgccaccaaaaaaaaaagtggtttttaatccaatccacttgcttaaattatgatgtcaaggtctggtactcaactggctcgttcataatatctgagtgaagcctggaaatgtgcattttcaacaaacacagttctcatgtaggtagaaaacaacatgtaatcctggctaagcaactgtaccttagcaaacctgtgaacagatttcctgagtttggtaaaagcgacttttttttttcaagatggagtcttgctctttcacccaggatggagtgcagtggtgccaactcagctcactgcaacctccacttcccgggtcaagcaattctcctgcctcagcctcccgagtagctaggattacaggtgtgcgccaccatgcctgactagttttatatttctagtagagatggggattcaccatgttggccaggctcatcttgaactcttcacctcaagtgattcatctgccttggcctcccaaagtgctaggcttacaggcatgagccaccaggcccggccaaaagtgacatttttgaactgagggtcatgtgaaatttaagtctttgtctctatgagattatgtagttgggtaaaataaagtaacaaccagagcaaaaacaataacaatagtaatacaagaaacctaaaaacatatattacttgagacatgttatagtaccatttttaaagaactcaggctctggatttaaaatgacctggattcaaatcctacacaatttactagctctgtgaccttgaacaaataacttaccttctctcagtcccaatttcttacaacagttagctaacagagaaattatgtagagtaacactgtgttacataacgcacactcaaaattataaacaatgaagagtaatggtacaaatatctaaacaaatctgacaagttttttggtaaaaaaaataaattccaaaagtaaaaaagccccataatctcattaacttaaaatacatatgtggccaataaacacataaaaagatgttccacatcattagttatcagggaaatgcaaatcaaaaccacgagatactacctcacatctactaggatggctacaatcaaagaaatagataataacagtgttgatgaagatacggaggaagtgaaccccatacactgctggtgagaatgtgaaatggagcagcagcttccgaaaacagtttggcatttcctcaaatgcttaaacacagagttaccatataatccatcaattctactcctagctatatatatatgagaattgaaaacagttattcaaaaatttgcaaacaaatgttcataaaagcattattcataatagctaaaaggtggaaacaatctaaatgttcatcaactgatgactggacacataaaatggggtctatccatacagtgaatattattaagacataaaagggaataaaaagtagtgatacatacaacatgatgaaccttgaagacatcatgctaagtgaaagaagtcggtcacaaagaaccacatatcatgtaattccatttatatgaaatgttcagaataggaaaatctatagagacataaagcatattagtggttgctagggacagagtgaatggaggtggcatggtggtgacagctaagggatgtggggttttctttgagggtaatacaaatgttctaaaattattctgatgaatgtacaactctgtgaatatactagaagtcattgaattgtatacttcaaatgggtgaatcatatggtatatgaattaaatttcagtaaaggtgtttttaaaataaatatatgtaatatatatttgcacaataaaaaatatagtatatatagttattttcttctaatattggattttccccctagaagtagctccttatcaccaagttgtataggtttttcttagtcattcttctataatgttactctttcctttccatttcatatgtaaatatatatatgtgtgtatgtgtatgtgtgtatgcgttcatatatataaagaaggaaaacatccctctatagtacagctctatagtatagtatccttctatagtacagctctatagtatagtatccctctatactacagctctgtagtatagcatccctctatagtacagctctatagtatagtatccctctataatacagctctatgatactcttcatgcccagcacctgttcctgtggtaaactgcttttccctccattctatgtcattctagtacggctgtcagtcacatgaaatccccaaatcccactcctgccacagaaactgcacaggaatttctgccaatgaactgtctcagctgtttatagttccatgcttccaggggcctatttattcggcttggcttttgattctgtgatataaccacattttatctaataaatcctcttcttattttgcttagataatctctgagtttaggctgcttgcaattacaaaactccatttgatatatactctaaactgttttaatctcttcacccgaagtaatgctatgaacaatttgctgttaatcctaccacagtattttctatgcatatacaactacacatccacatatatatcttatcataatactatacatagtattaatgtaccataattgattttagcatccttccattaataattctaacttaacttagttttacttattcatttttcttttaaaatcaaggggaatacggagaatccattaaaaaaaatcatgttaaaatccaagaaatatttatggaatagacttggtagctgaagatcgtgttttttaacacaactttagataatataaaaaaaactgaaatataatctctaatcaatttttgtttacaatgtagtttggcaggtaatatagaaaaattataaaacaattatatgtcaggatgtaagcaaaattgcatgataatcatcttataccagttgaagccatgaaaattcaattcaattttattaaatgtcaactgtataatgttttctgatatgtggattgtattggcactcaaaggaccacccaaaaagtttatagcttagcatacttataatccagttagtcaacattttataattgtcacaaatataaaaattgataaaacttccagcaaatttaaatatatttaagacaaaaatgttcatgacttttataataatacttcacatttattagtacttactaaatcttattatctaaattatttttcaaagcaattctatgaagcaggtattgttataatcacccaagggcaccgctgtagttgtaactggcaaatcagagaactgaagtcaagtctttctatctctaaaatccctttcttaatcaatatctgttatatcaaaattattttaatgactaaacagttgaactgaagagtgtttataatatccaattgcattctcacatcagtattaacaaaaaagctgttagcaacaaatccattgtctgaatcagctcaaagacttattaaacttgagatcttcttgttacatgataagttgcagtatcaatttcttcagctctatcatgaaggtgaattcagattaattcaagccacctagctgacttgcagtctttacaaacataaaaacaggttagtatactctcttaagggtgtagttattctgcatgagaaacaggtatacaattccataagaatacaagataatttgaaacatataataaccatgttgttacacagtagaccttcccatatttatgcatatttaattataatatttattaaaaggctaatgagaccattttgaaacacatttactgaaaggctaatccagtagtagaatacaatctgtttatcaactgaagaacacaatacgtgacatttgtacactgtaagagaagaccagaattgccaataaaatatcattgaaaacttcaagtaacccttatggtaaaaaaaaaaaaaaaaaaagtcctattaaagataagaaacatcatgtacagtatcacttcctctctcctacaacataattcaaacttaaactgatatgtaaatgaaaatttatattccagtcaaggaacgtacccaatgagagtacataaattatatatgtattatgcaagataatagttgttacagacatttcatcaaaagccattttaaaaactgcaaaatatgtcaagatgtttacatggtgaaatgaaatttcataatatggcaccttaaaacaatctcacattagattgctgcacctcagaaaagcactattgatatttcactgagccaaagaataatcataattcccttatcaagtgaatatagtggaaaggaaccaggctgaaagtcaaatagaaacaccattttctcaaataataatatattattaataatgatacatatctgaaggcttaagtttcaagatccgaaaattccagaagtataaaatgccacatattatcaaactctaaataacaaaattgtctaacatgtaactgcctactatttgctcatcaagtaaataagaactcattttaagattaagaaaactagcaagtcagttcgagtctgcaatttttagacgaaataacattcatgaacaactttattttctaacattaataacagatttcatacatccacgtaagtttaggtaaaaataaaatccatgtatacattgcaagtggcaactgttctccatagccaattcagtattatgaactatctaaataaaaatcaaaagtaagttactagaaaatagtaaaatagctccatcgaaaactcttctgtgcatattctgcaacattaattaacttaaaatgattaaatcactgctaatttatttgtcaggaaaaaataatattttattataatatctaaaaaatttgaaggcacttcacagtattacgtctttttgttaacaccatccaatggtatatttattagttgtcatatgaaggccccgccatgagagtttttaaacatttattaagaaataccctctatattcaaagttagatatttaatatctttaaggaatctgaaatagattatatattcattgactcctacaacatgcttcagccagataatgatcgtttgtcaaaatatgagcaagctaatcgtgtgatcctccacacacagactgataacaacactcagaatgcaatagaagcaaaactattcacctaaatggacatgaaaggactagtgctagggttcagattttttttctttaaaattttagtcccttgaaatttaacttcttgaattaacatgcagctattgaaaaagcagcagatatgtaacaatatttttactaacagctattccctagggttccttaattataagcagcagaggtatgcaagatggaaatacccaattaggttttcctggaccaatttagcttgtccagctattgaatattttcacaataaatagtcacagttgagtttgagagagaaaaattagccctttagttagcactaaaactagtctaaaattggccatctggcttgtctctgatatactctgatatcatattgtatcatcagacattgtaaaaagaaataccaggcataaactgctaaccttagaatacaatttaacctcagtattctccacaaaaaagtaacagaatctgtttctctaaggtacctgagttgattctaagtgaaaaatatcaggttattctcactactatctattttccatgtttccagaatgagagtgcaaatctgagcaccgtatttaaaaataaatagatctgagaataaagaaaaccatgttttcacccagatgcctgcatttccatcaacaagtgctgaaacaccacgcgaactgttgtagctgattaacccagcatatttctaggaagtacattagtttggtattagtagggtgcaaagtacaaaggtcagagagggaagtagagaagggccagaccacatcacaccttacagcagatactactaagctgagatttttttgacctgtaagacatgggagtcactgaaaaagtgaaaacagaggagcaatgtaagcagagactggatgagattttcactctgctagcagcgtagagctactttagtgaatatggtattccctagccacgtgtctactgagcatttgaaatgtgaccatgaccacaagttgaaagaatattctggataaactagatcaaataaactatattattataatcaataccacctgtttatttttatttttaaatgtagccactagaataggtaaaactgtatatatgccttgtataatacatctcaattggacagtacttgtatagatgaaaaactgtgaggaggaaaatacactaacaatgatgagaacaaggtagactattgcaatcgccaaggtgagagaggacagtctcagccagaatattaagaatggagaagaacaaaagagaaaagctcaaaagaagaaagaaaagatgcaggacttggtgactgactgagtataaggagtcagagagaaggcatttgttcattcattcattcattcaaacacatcattattgcatgcctaggatatgcaggtaccatgatggttatactataatgagctaaatggaagtcggaaatgcttaccaactctctggtttgagaaactgaggaaaggctgttatcacccattgaaatagcaaacaggaaagaggaacacttttattatcatcaaatgtatcaagtatgaagtgtgtgtaggttatttaagtggaaatgtctgggaagcaattggatgtcatgatctgaagtgtaacagaaatgcctacgctgaagctagagaatatggaaatagcagcagacccataaaagggtttgctccaggagaggttgtagagtgataaggtcaagggtccaagacagaacagtgacacaaaaattctgaaaaggagagagaggacagacagcaagttcactaacaaatagccatgtatgaacaagaaaaattcataaagagtagaatcacaaaaaccaaaacagaagaactttttaaggaagtaacattcaatagaatcaaatacaaaagaaaagtacataatttcagagaagcattgaaaagtatacacaatgccagaaaaaaaatcaaaaagtatttggcaagtcagagatcactgatgaccttcatgaaggcgatcccaatggtaagaacaagcaggactgccaaagactccaaaaggcgaaagagcaaaggagaggcaagaaagaccaagtataaacaactgtttctaaaatcttaactataataaaaaaataataaagtagtgagcacagaatcaagggatggtttggggtattgtcattttttattttggacatgagagagacctgagcatgttcaaaagctcagaaaagcaatcagtacagaaaagctgattaaaggggcaagaaatggaataactaatggagcaagagcctgaggaactgggagagaagacctagaacacagatggacaggcaaacctgaacagaagaaagaacacctcttcgtccagaaatgaaagtgaaggtggctcaagaggcaaagataaattcagaagcaggtaagaactctaggttctgtattaaaatattactcaggttatacagtaattaccgggcacctttagctaacagtagctgcaaatgtggttccatacttccaaggatttaatatttatagcaaatattcgaaagccaaggacacagattcatccaggtaggggagagtcatctttaatctactctgtggccagtcatctatactctactacacaaaaaataaacctgtgagaaatgattgccattagtcatggaggaagaaaatgtagactagagtgattggggacagggaacccacatatctctctacggtttctatctatgcacatggaagtagagagactgaagagaataaagagggtttctctcctgtctatataaccctaattagttccttcccaaggcaagagtcatagttatcatactttgccacagtttaaaccttttagatgaagttattgtgctttaaagaaatgagcccagattccccggacttctactctgcctgtttctgggagtggtaggcatgcctaggcaggatctggtcctccaggctgagtggtcataattattttgtgtgattaaaaagaatctcttggcctgcccatcctcatctctactctgcttcagtgtctccacctacaattgaatgagtgaagagtattgggcttcactggaccagaaaaccgagctacgcctacaaaaccaagactcatggttcaacactcctcattgaaaaagtcagacattgagggctatccagcctttgtccaccttttaaacagtactttatttccctgttggcttctatacatttttataaataatgcatcagtccagaatcccagaaggcaggaggggtaggtggaggattcaataatcaaaatctcaccttgaacctccaaaaaccctagtgacaaactaaaatgtgcactaagtttttctgcctctttctttttcatttttctttttctcactctgcccctcctgaaatccccctccttccacttttatatgttcaagcccatgaatattcagtttatatgtcaccttatcaaggaagttttctctgacctgtccagttacatttcagtatcactgcctcatctatgctcttgtgtcttatttatatctcaattaagcacttggttataattagttatttaattgtatctcccagccaggtgaggtggctcacatcttcaaccccagctacacaggacactgaggtgggggaaacatttgagatcaggagtttgaggttgtaatgagccataactataccagtgcactccagcccgcgtggcagagtgagagcccccatctctaaatgatgaagaagaaggaggagaaaggaggagaaggagaaggagaaaggagaaaggagagaagagagaggagagaggagaaaggagagaggagaaaggagagaggagaaaggagaaaggagagaggagaaaggagaaaggagagaggagaaaggaggaggagggaaaaggagaaggaggagggaggaggaggatgaggaagagaagagggggaggagggggaattgtatctccactaggaaatcaggtagagattgctgaattcagctttgtatctcaggccttgagtacattgtcaaggttggtccccactccaagtcacaattcattcctacttctcccaaactcctaaagcactttgtagggcagaaactgggccttgctgcactctatcagcactgcccctctattattgaaagaagacagaaagaaggagatcctgaaggcctttgtataataggtaaaaatcttttgactcttcagccaatcactgctccatttggcctctagctaaggaatctcttaagcagcaagcaaaaaatatgattcataaacaagtgaaaatgagtcacgtagcagtaaacagaactggggccagaaaggcagctttggagttgtccccattcatttcaaaaagagcattttacatactttttacatatttacattttatgtatttttttaactggataaagttaggaaatacataaattgtactaaatttagaatttctaacttgattaataatgacaaaacaccttataaagtatattacagcacacaaagtacttcctaacacttccattttatagttgaggaaatgaatttttagaaaaattaggtgggttctgtaaggccttattcatcaaccaataatgaacaaatgcctattttgtgcaatgcactgggatttcagcagccctgccctcatgcacctctttcttatagggaagacgtgtaataaataaaatgtatatgtcaaatggtactactgggaaaataaggcaaggtggaggtgggggggcaagggtacagttttgaataagatagccaaagaaggcctcactgacaagtggcatttgagcaaaaagggggtaagaaagtcaagtggttggtaccctaacctgaactattaaccaaatcttggatttgcattgcttacactcctttcaatacagcaatttgccctttataagagaaaaagatgctgacattcaggaaagcagcaggggaagcagtatcctgttctctacattttgggcacattagaaaagtggttcagaaaatcctgtacaagacccatagcgctaccctaggccgaagtgagtccacaaccacacattcggatactccaaaaagatgccaagtggtccttttcattgacaggactagcagtatcactccaaatggtaaaatgttaaagttgtaactagagaatgtttgatctttttattgctgtttttaaaggcagatgtcctgagtggttcattgtggtttctaccatataaacgtcattttactctactggttacttggctgtcataagacagaaaatgagctgccataagaaaagctgatggaaaaggaaaaaaattacaaatatctgatcccatacccaggtcactgtcttcatctaaggcataatttatcttttccaatgaaatatgtgtacatctcaattaattatccacttaccctctactaatcagaaataagatttggttcagtaaggcggggtgaaggaataaactcaacctaccaattgctccacatgaatttttttttttaatagaggcagggtcttactctgtcacccaggctggactgtgcagcctccaactcctgggcttaagcctcccgagtagctaggactacaaccacatgccaccactcccagctaattttttttttttaagaaacagggtctcgctctgttgtccaggctggtcttgaactcctggcctcagacaaacctcccaccacagcctcccaaagcagtgggataataggcataaaccaccactcccagcctgctccacatgattgataaataacctgatataataatctagacaagtcaatctttgctgaataaataacttccccatgagtaatccttcctatgcccagttttccccaatccttaatatcattgctctttttagactcatacattcattcacttaacaaacataaactgaatgtttaagataaggcaaatactttgtatgactggttttctatttgaaaatagagtgtgtgactatacaaatacatatatacataaaggtacatcaatttatatacattggccctatgtaacccccatttgagaatatttctaagcatgccagctactcaaattcaagtgtgaaggtatgtgtatttgggtgtgtgtgaatgaatgtatgtgagagacaaaggcagacagagagagggaatggataagaagcaagtaaagttacagcagacaaggacatgaaaactcataaaagactcatgataaactgtaaatacatttaaagaaaaagaataacacaagccttcactccccttccctgtgcgatcataatcactgcccatcaacttctctgtccatatcatgtgtgctccctgtgttccttgaaggttatgtataaccaagatctacctttaatgtgtttggcaaaaatatctgtgccataaactattagctgacaagcaattatattctaccttgtaaaagaaaattaggcataaaataaccccacaaaaagaagagaatgactgtttcacaaaagaggcaaaagagatttaaacaagataataccataagtttctatctcaccatccattaattttaaatttgattttgcttcttatatcacatagcacttattcaaaaatagcagaagaatacttctatctatctgttgtcctgtaaaaagaaaagaaaatactattatttgtatttcttgttcaaacactctaaggataaaagtactgttttcaaaaatgatgaggttcctgcagataacatttacccacaggatttgaggcttttttgtgacataaagtgcagagtactttgaggatggttacagatgcaatggcacagaaaaggcttttaactttggctcatttcctctgaccaccatgtctccattctaaattacaacctctcaagctacagatcctttaaaactagcttttaaaccagctttctgtggtatcatcacaaaataagaacactttgttacttgaaaataaaagcacaaaattattggactcaataactgttctcattattgcaaaccaataaacaaggttcaacaagaactcgttttagctattgcttatcaagctgccaaaaaataaatccaaaagaaaccaaagaaaaacctgccttaacaatatagatggtttcttattcataaactatctttaacatcaaaaatggctagcatgtatgccagtgttattgccttgcataacagaatcttaagctaagcactaaagttctgtcattcacatctagaataataattttttttacaaaaactaaaatacggccaggcgcagtggctcacacctataattccaacactttgggaggccaaggtgggcagacaacgaggtcaggagatcaagatcaccctggccaacatgatgaaacctcatctctactaaaatacaaaaaattagccaggcatggtggcgcgtgcctgcagttccaactactcaggaggttgaggcaggggaatcacctgaaaccaggaggcagaggttgcagtgagccaacatcacaccactgcactccagcctggagacagagcaagactctgtctttaaaaaaaaaaaaaaaaaaaaaaaactaaaatactaaataaccccatttttaatagaaatttgttttatgatataacccataccaaatgctacctgctcagccaaatcacttttagagtccacacagccctttatatctaaaagaaaataataaaagtgctaggaaacaagaagtatctgggccagttacccttggttaggactgagaaattagctggcacagacagcaagaccgggaccaaatattcaaccagttggctggggatagtgggttgaggtcaaggagatgacccatacagctgtaaaattaagtataaaaaggggaaattgggcaaacaaataaatatactgaggataatgggagccaggttttctaatgttggagaaggaacctacaagtacaaaaaggggaaggaagaataaaccctgtcgtttggaatcgaggagatcagtgggaacatatatttttagataatcactgatcaatagatagatagatggagatgtatatgtatatatgtacgtacatatatacatgtaatgtacatatgtattagtccgttttcatgctgctgataaagacatacccaaaactgggaacaaacagaggtttaattggacttacagttccacatggctgaggaggcctcagtatcatggcaggaagcgaaaagtacttcttacatggcagtggcaagagaaaaatgaggaggaagcaaaagcagaaaccccggataaacacatcagatctcgtgagacttattcactaccacgagaatagcacaggaaagaccggcccccatgattcaattacctccccctgggtccctcccacaacacatgggaattctgggagatacaactcaagttgagatttgggtggggacacagccaagccatatcaatatatgtatgtacatgcatatatgtacatacatatatacatataatgtgcaaatctgtatttcctaggtttgttcactgaaaagatctagaagcaaagacacctcagtagtaaagagcaatcttagacccagtagcaaagagcaaccttagcatccactaaaagaaaccagaagtctttggtagcgccagggctggggcaagaaaagtacaagataagcttgaaccacaccttttaacatgaggaactgagaacatagcatcgcttttgtggtaataatgcccaaaataacaacttattcataaggaaacatcagataaacccaagtagagaaacaaaacatagctgtactcttcagaaatgtcaaaatcattaaagataaggcaagattaatgaagattccagattgaaggagagcaaagagccagggcagctaaatacaaggcttagattctggacatataaagaacatcattgggacagttagtgaattatgaattgaatctgtgtaatagacggtaatattgtatcaatactagtttcctattttggtggttatactgagattatgtagggaaatgtccttatttttagaaaatagtcactgaagtactaagggagtactggggcatcatgtctccaatgtactctcaagccaaaaaaaaacttcaaaataataataatgtgtaatggtaagaggagagggagggcagattgagagagagagagagaatatgataaagcaactataataaaattttaatattgaaaatttgagtgaaaatcatatcagttctttgtactattcttgcaatgtttctacaagcttgaaatcattgtcaaatgattaaaaaacaaagacatgtttggccttaaatgcccatataactattaagaaaaaccttaactctctatgaagggccacaatctgctctgaattttgaatataaaaaagtatgcttgtgctagaggctaatacagcctatataattctaagggcactaaacaaataaaataaggatgttaaaaggtgtcttgaacgtgtctaaaatctgtaaaatgttaattctcacagaatacttggcttagaaagatgatgtacattggggaattataaatataaggataaaattgcaaaatttccctgatagtcacaaaataagacctatgtagacaacagtatgcatcacccagatcccccttcaaagaagcactcactcatggcccatatatgggcagtgcagtcagtagacagccgccaggtcagtagacttcaacatcgccacagctgcagagaaccgccctcccttggggtattcgacatcctcagacagggcaggggtaacttgagacaactctgaaggccacactgtctgagggccccactggcttgtctagggttctgtcaggcctgcctcacagtttggcttcctcccctgctcaatcctgtatctttcttcttcctttccccagggatgatccctaaaatacatctcacaccccaaactccatctcaatgtctgcttctagggaacccaacctgccacaggacctcttttgtgacttgacaaaacatagcttgatataggcacattttataattttgtcttgtgagtaggtaactttatttcctcaaaagacaggtataaatttttttcaggtaaattctgtctctaaatctcatccatttaccttctcatgcggtgtgacagaaaaagtgtactttccccttttcatgttagccaaatataaaagataatcattgtttaaacaacaaatttccctcttatggtccattagctcctgctgcttgttcctgtagtgaaatagaaatacaacaaacgatttccatggcaataggtaataatctagcaaatgtgaatttccgacttagcaacagaacaaagcaagaagaaattatggaactgcagtggggctaaatttcaatttctgtgtatttttagtatcacattttaaaacaaaaaagcacaaatgcagacacattaacacgtaactatgaagaataaaattctaattataggataaattcaagagacctcaataatcaacctgtaatatcactccttacttcactactaaaatatattcaactaacataaaacaccttaccttacaaatttgagaattcttacacttatttgaaagcctattatctactataatagcagtcccaattactgatatatcctgttattttcatttttagtaataattataaacatggcttattgctaatatgtaaacgaaagatgttcaaaggactaaagaatctctaggaagcacaggaatagaggaactggaaagactgcaagcatcaggagcagctctcttgctgatactccattagtcaaggctctccactcccttgtggaacatgcagcaccctgtacaggctactctctagtctgcacctgctcttcttcccacccctgagcttcacactcaccaagaggggttgttttgttcccacacttattaccatttcttcttgttatagtaattatatagtttaattatattattcacaatctgatgaaatatgagtgcagaaaggattatcgtatccaagaaagtaagtacaacgctttgcaaagatttgataaagatgaatcactaaaactatgaacaaattagatatgggcaatgttagactgtggacagttacagaaaaaataattcaaatctaggattctacactcagattgctttgtaagtgtcttaaatttctgcacttttaaataacccaacgtgaaaattataggtaatgcactgccttcgttttatacagaatgactatccaaagatgcaaattttttaaaataaaaagcttcagccttatacaatcagaaaaatggcaaaaagacaaacaactacgataagagtatgagttcaaggaaacctgaatagaggtccttaatatatgacaacacgaccatacctctctttcagttgcctccactctccagatgggattcctgccctctgttctaaaggatgacattgagcactgcccgccttgtccttgacctcagatatgcacttcttcaatcttaggctaactcttctcggttggcaacagaggttcagaaagtgtctccttgcttcaatgtcctctcctacctttgtatatgcaaattcttcattaccagcttgattgcatttatatccagcatacagcaatgtgcaaactatattttctctttggctattagcgacccaaggaggacctcagacaacaacatacttttagccccaaagtcacatgggcaatcacatttccaatcttttaagcacccttccaatggatatactgtctaaccaggaaaaagattaactggaccagtcaagtctctttttcctattctagccacatataaatgatcaatgcccccacccactggaaatgtacagaagctacaataaaaagaatttcctgcccagggccaagaatttatagatttagattctaaagcatctgatgtgactacttttttattttattgccttaacttccttagctacaactgaacacacttcccatcaacctattacttctttacctccctccagttttcctggcctttaactcaatgcctctcctaagtatgcttgagctgtgtttactcaagccacctctgacatcaagtgagaagtgtttttccttctaacaccaaccaattctgacacaaactcgaagtcccataattcaattaattctgataataacaaccaggagttagcatcagaatttttagtgctcagtcccacaaatcaaggtccctaggttacacacacttctgtccaacttggctataaagtctgaggtgggagggtcctcccctcacttcaggttcagtaatttgctagagtggtcataaaactccaaaaaacactttacttaccattactggtgcattaaaagtaccacaaatgaagagccagatgaggaggtaaatctagtgaggtctggaagggtccagagcatagtagcttttgtccccatggagctggggggtcccacccacctggcatgtggatgtgttcgccaattataaaagtctcagaacccaagcatttaggggtttttgtggaggctgcattacataagcgttattcattaaatcactggccatcagtgattagctcaatctccagcccctttgccctccccagaggttgtcacatgagattaaaagtcccaagctgctaatcaaggcttggtctgttgggcaaccagcctgcaacctgaagctttttaagggcccaccaagaataacctcactagaacaaaagatgctctcatcaccctaataactcaggaaattccaaggatttctgaagctctctgctgggaactggaaacaaaaaaagaaatatctttctacactactataatgctttaatctcttttttccactttttcacagatcttacaagtgaatagccagttacttgttccctggctctgcaacagctctcctcccattaccttttgtaaaaaacttgtcccatttctctttcccttccttcctccttcctcaagttttgcaccaaacaatgtgcagaatttagaacactgcatattttcaattaaattactctattgtctgctgtgctcagggaatatctgcagtctgtaaactctgcatgctaggaagagctatttaatcttgctcctgacattttacgtaggagggaatggtttacaggctcagtgtctctagaaagaacactccccaaggaacaacgtatttatttctcaatgttctttttctgttttactcttaaaatctttcctaccaccatccctcacgcccaagagtacaactttgaaatctaatgtataaaactagcagaaattaaagtttatcctatacttacattaaaagctactcctacttgaagatatgcagacccctccaaatccttcttttgattctctgctcacataagtgggttttatgtacgtgtgtttttttccacaaaggagaggcccaaagatagccaagagatcaggattggaacagtttcttaacatcatattctcacattttcaaaatttcctcctttattagtgataaactttttaaaaactgatttcaaaataggaaacagttgttcatcagtctgctagtctcactttcaccaatcaacatatttcattgatgataatataatttttaaaatattttatcatctctggaatcaagatatatcttacagtcgataatatcatagtttaactgacaatatttttgataaagtacatgaagaaatactttatcataaatacataagacaaagataaaataaatgacacaaagatgaatcttaggtttgataaatatattaagttcctctctcaacagtttctggcttacctcagatataacctatgtaaagcatttagcattaaatgtagtataacagattttcattgctgccatcattgatgacatcaacatcatcaacatcatcatcatttctaaacaaataacaaaagtctcagaaacaaatatgaatcaagttagggttctgatgtgttctccttattctatttcttttctgagtgccatttttgtttgtttgttttctatcctaattttctaaatttttcatttgtccccatattaaaaaactgtaaacactctgatggggttatgtaaggttgtgctaaatgacttagctcagagtattcaagccgaaataagttagttctttcatctcaaagaaataagtaaataaataaagtaataaagttctttcatctcaaagaactttaaatatccgtccctgtcactagctaccaaatcaaaaacctaggaatctcattggaaaatagactataagacaattccatggttatgagttttaaaagataactctaatcgatcatcctttttttgtacttattttttgtatatttgtaaaatagtagttacatgaagcaaatagtatcagtgtaaggcccattcacttttcaggctactcgacatgcagaaatggtggccattgatcaggtccttgattggtgtcatcgaagtggcaagggtctttctgaagtatttgaacacactgttatatgtcactgtggagctgtgcattatgtgtgcagctgttcgccacctgatgagtatcctttgacttcatgagttaatgtcttgtaccattcatgtgaacatgagagtggccaaacatatagcgcagcaggaagcagagggcagctgtgacgggactggccagcagtggttaggatggtgaaaacactaagaagccaaaggagtcaagagtagtcagacagagcaggtgtggccaattgcctcaatcatctttttctttcaaccaaaagtatcaagttatattttctattttttcttccacatcactcttctaccctctgccatttttttctttctccataaatggaaacctaaaatgtatttctaccataattagaaagcaatcaataaaaaattttagtccaattttgttcgtgtctccacacattactacatgaactcagttttactttatactgtattataatcatttgagcaaaatttctttatttcttgtaaatgaatgtgctagtataagaaatatctacattttaatgaaaatcatagtacaggtacaaaatttctaaaagtgagaaaatgaagcaaacacaatacagctttttggtacttttacatatgtaatctttctttattctgctgttgatagtttttgcctttcgcccatttaagtaagttaattgaaagcatagtataatttaatctctattgtactaaaaatacacaactatctatagtaatattattctgccacattctcaaaaaaactattgggcattaattccatctggactctccactaaataagcattagtaaacaaatttacttaaactataaaattcatattactgaatttgcatatatccagagtgtctgaagaagagaaaacaaacatatgagaaaaagctcatcatcactggtcattagagaaatgcaaatcaaaaccacaatgagatgccatctcatgccagttagaatggcgattattaaaaagtcaggaaacaacagatgctggtgaggctgtggagaaacaggaatacttttacagtgttggtgggagtgtaaattagttcaaccattgtggaagatagtgtggcaattcctcaaggatctagaactagaaataccatttgacccagcaaacccattactgggtatatacccaaaggattataaatcattttactataaagacacatggatatgtatgtttataaagacacatggacacgtatgtttactgcagcactatttacaatagcaaagacttggaaccaacctaaatgcccatcaatgataaaccggataaagaaaatgtggcacatatataccacggaatactatgcagccataaaaagaataagttcatgtcctttgcagggacatggataaagctggaagccatcattctcagcaaaccaacaaaggaacagaaaaccacatgttctcactcataagtggcagttgaacaatgagaacacatggatacagggaggggaacatcacacaccagggcctgtggaggctgtggggcaaggggagatatagcattaggacaaatacctaatgcatgcagggcttgaaacctagatgatgggttgacaggtgcagcaaaccaccatggcacatgtatacctatttaacaaacccgtacgttttgcatatgtatcccagaacttaaagtaaaataaaaatgaaaaagaatagataaatatagttagcaaattatatgtatatatacaatactatcataacaatatacaatgctagtctgtagtttgtaactttttctcataaaataaatgaagctttagaaaacatttttcactgggtgcggtggctcacgcctgtaatcccagcactttgggaggccgaggagggcggatcacaaggtcaggagattgagaccatcctggctaacacggtgaaaccccatctctactaaaaatacaaaaacaaaattagctaggcatcgtggcaggcgcctgtaatcccagctactcaggaggctgacgcaggagaatggtatgaaccagggaggcagagcttgcagtgagctgagatcgcgccactgcactccagcctgggcaacagagcgagactctatctcaaaaaaaaaaagaaaacatttttcactataagaaaataaaatcacttataatagacatatttccaatatttacattctctgtagtcctctagtcctttatctagacatatatactatatttttcaaatactggaattatagtatacatcattttgtaacttgcttttttgtttgacaatattataggagcactttcaatattcatagtcttcgaaaacatgatttttgaatggctgtatgaatattccatcatttgtaaatattgtagttgattttgctaacccaccactattggacagttactaccataataatgcagtagcgaacatccctttatctttgctctggtctctgatttatgtcttggaaaaaaattctaaaagttgaaagtaccaagtaaagacatgtaaatactgtcaagccttttgatgcctaccaccaaactgttctttctccaatatctataaaagtacagtttaaagaaaccatcaatattgtgttgctggtatgatggatgaaaaagtatgtctcatttaatttcatgccatttcatttacaagtaagattaatcactttaataaattcatttttcattttcttttttgaactatctgttcatgacctttgcctattatccttcggatgtatttgctttttattactattttgtggctgttttttatacaggagtgatatgtttgatgttgcaaatacttttccaggttctcattcactttatcatttcatgtttttttgacatataagagactttcattttgcataatcaaatttgttaaacttttccttcattatatgtccctttggttttatatcgaggaaggcctttctgggcctactatgaaataattcatttatactttcttctaagtattttatgacttacatttaatattatttctatatttaacccatctgaaatgcattttgtatacagaattggagagagctaatcatgtttttttcagacaaaagtattttaacacgtcaagtttaaaccataaacacttttcggattaatttttttccataagtttttggggtggaggtggtatttggttacatgagtaaaagaaaactactgactgatatccttgatcaacacagatgctaaactccttaacaaaacactagctaacctaatccaacaacatatcaaaaagatagtccaccatgatcaagtgggtttcataccagggatgcaggagtagtttaacatacacaagtcaataactgtgatacaccatataaacagaattaaaaataaaaatcacatgatcatctcagtaggtaagaagtattcgacaaaatccagcatccgtttatgattaaaactttcagcaaaaatcgacatacaagggacatacctcaatgtaataaaagccatttatgacaaacccacagccaacataatactaaatggggaaaagttgaaagcattccttctgagtactggaacaagacaaggatgccccctcccaccacttctcttcagcatagtactggaagtcctagacagagcaaacagacaagagacagaaataaagggcatccaaatcggtaaagaggaattcaaactgtcactgtttgctgaaaacatgatcatttaccttgaaaaccctaaagactcctacagaaagctcctagaactgataaaagaattcagcaaaatttccagatataagattaatgtacacaaatcagtagttcttctatacaccaacagtgaccaagcagagaatcaaataaagaactcaaccccttttacaatagctgcaaaaaaaaaaaaaaaatacttaggaatacagctaaacaaggagttgaaagacctctacaaggaaaactacaaaatgctgctgaaagaaatcacagatgacacaaacaaatagaaacacatcccatgctcatggatgggtagaatcaatattgtgaaaatgaccatactgccaaaagcagtctacaaattcaaagcaatctccaccaaaataccaccattattcttcttcacagaattagaaaaaacaattctaaaattcatatggaaccaaaaaagagcctgcatagccaaagcaagactaagcaaaaagaacaaatctggaggcatcacactacctgatttcaaactatactgtaaggccatagtcatcaaaacagcgtggtactggtttaaaaataggcacatagaccaatggaacacaatagagaacccagaaataaacccaaatacatacagccaattggtcttcaacaaagcaaacagattaatttttttttgacccagtatctctttctgttgcccaggctgcagtgcaatggcataatctcagctcactgcaacctccacctcccagattcaagtgtgcttcagccacctgaatgcctgggattacaggcatgcaccaccatgcctgcctaatttttttatttttattagagacagggtttcatcatattgcccaggctgatctccaactcctggtctcaagttatccatcagcctcagcctcccaaagtgctgggattacaggcatgagcctctgcacccggcctagatgtattattaatgcattattattaatgtatcctttcatactaacaacacctaagttgtttttaacatgtactaacatttcctaccttttaaacatgtagtagtatatcctatcatttaaacatgtactagcatatcctatctttaggctcctttaatatagagtcaaggttctccttctccttgcttcccatgctaccagcactataaagtaagagaatcaacaaaacatcctatattataaagagtagtttgacgttttggctctatgtagaacacatcaattatatctataatatattaatttaaaaagtgaactcaattcctctagctattgaaaaagatttgccccagaagtcttttctgagtccttagtcccactctccatctgaatgtgatacctctcctgtgtgttttccaagacctctcaacgtatctgatcacagcccttatcaccttatatttctgacttactagtcagtcccccaactaaaccaaaagaatttcagaagaactatgtctcagatattttatcactatcacctagctcatagtaagcagtctgtaaatatttgttaaataaatgaatgagtacaagactacaagacttttaattcctttcaggcctgccagtgactaacgattgcaacagtgaataagtcacttaacattttagactgtggtgaacaattcagaaatcagtaatttcttagcacaaagatctcttaagatttttcaatctcaaaattctatgatgacatgacctgtatccccagaaaccaattttacacaccctgctgctacatctcttgcttggtaatattcccctatccccaccagtctgacccttccagacttccttgaccttctccagcctaccccactgtccatttaaaatgttctcaccttgtgctccttaaggcttttctatggatcagccatctatatctgtagtctgaacaacagtgcattttactgtaccttccccatgttaaatttgtgtgtagatatactgcatggcttattcagaagatatcggtgatgtgaaatgcttaggtgtgaggttaaaaaggagctctcaatctcttgcttaccccatagacttatctttggaaatgcgtatgacattagatcaatgactgcatcctactctaaaacaaaatgcctcaagagtattagtattattttataattttacaacttttcttgtttccataatgatcaacagaagtgacatgattttgcagtcatgccaaaaaagaaaaaaaaaaggattatactgataatctcttcccaaatatattctggtgaggaaaggtttattttgttgctttttgctttttgtcatttccttgctctagtttagttgtttttaatatttccataaatgttgggagtaagtttactttggacagaacagatttgcttctatttttaagaatttgagagcatgtggtgagattgtttatcttgttgaaataccccaaaaactcagcctcttgatctaaaatgcaatccaataagttataacatgagttaaggttaatctgtaaataaaatacaattccaatttgctagtgaatacttacctgtaaatactaaagacagtattttaactcaaacattttctgattgccaacctattctaagtgttatgggggagcaaaggcaattaaagtcaattttctgcctccaaggagtgtattctgattaagacagacctgtgcttaactaacaataacacaaggcagaatatggttctttaaagaaaaacaaatcctgtagtagcaaaagaattttagcattaaaataatatatagataagtaggattaaaactgcagttctaatacctttccaaatttcaatgtacttctttgaataagagaaaaattaaccagtcatgtcctttccaaagaaacactacagattacacatcctgtagcactctggaattatgggctctgactggtagtagactactacttctgttcaagaggttctttaaatattcacgaagtctgattgagaaaaatgttaagcaagtcatggtcatactgagcaattcaactggtaaaccacggactgcatagctacgttcaacatcagatggaaggaataacttgagaggctattaaggaatagaattaggaagactataggctcattattaaaccattatttatttagcactgccaacattccaaacacagtggtaaatgcaagactggtgaatacaatccataaaaatattctctgagagactgtttatcatgttataaattcaaggttttaaaaaaataatagaagccaggtagggtggcatgcatctctagtcccatctactcaggaggttgaggcaagaggactgcttgagcccaggagttcaaggctgtagtgagctacgactgtgcttgtgaattgccactgcactccaggctggaccacatagcaagaccccatctcaaaaataataataataataataataataataataataataataataataatattaagttaggaaaaagcaatcctccattcattcacaatgtacatgtcctatatattcaaattaaaaccaagcaaaagccttctgttctgaaactaactttctatgaaacgcccaacttgtattcccagcaatatcaagtttccttattcatctctatagattacctcatataatgaaatggaatcatccttttccagaattaagatgctgcttttatcactttacttgctcaaaaaccttaaaagctttcatttacagatgggcacggtggctcacgcatgcaatcccagcactttgggaggctgaggcaggcagatcacctgaagtcaagagttcaagaccagcccaggcaacacagtgaaaccccgtctctaataaaaatacgaaaattagccaggcgcagtagcatgcaccagaagtcccagctactcgagaggctaaggcaggagaattacttgaattaccaggaggcagaggttacagtgagccaagatcgcaccactgcaatccagcctgggtgacagagtgagattctgtctcaaaacaaaacaaaaaaagcttcaatttactataaaatcaaattaaaaatcctcaaggtggcattcaagaatctgcatatctgtatattaaaactatttcctaataccttcacaatggaaattttctgttccagacacattgccttcatagtccacgaacacattatatatatttatgtctatttacatctattctttcttttctttctctgagacagggtttcactctgtcacccagtctggagtgctgtggtgcaatctcggctcactgcagccttgaccccccccccccaccccgccaggctcaggtgatcctcccacctcagcctcccaggcagctgggactacaggtgcaagctaccacgaccgtgatatggtttggctctgtgtccccacccaaatctcatctcaaattgtaatccccacatgttgaggaagggacctggtgggaggtgactgtatcacagggcggtttccccatgctattctcgtgatagtgagtactcacgagatctcatggtttaaaattgtttaataggtcctcccccctcactctctctctctctctcctgccaccacataagacatccactttgccttccaccatgattgtaagtttcctgaggcatttccagccatgtagaactgtaagtcaattgaacctcttttctttataaattacccagtctcaggtagttctttatagcagtgtaaaaacagaataatacagcccaggtatatatatatatatatatttttaaacagggtctcactttgtcacccaggttggtgcaatcacacctgcaatgttggtgcaatgtaccaggttggtacaatcactgcagcctcaagtagtaagtattcaaaatatatgttttgtttaaagggggtcaataaaataatctaagtcaactattttatttattacacatgaagaatcacaggaaaaaagttaagcagctattccaaattacatagtttgaaagctacatcccaaacacaaaacccaatattttttgggttgtaaagaatcctgcagaggattgtgaaagggtagaagtgaggatccctttctgtgtaatattgttaaagttgggatcctttgattacatgatagcttgaattctaaatacagagatgccatcagttaaatataaaataatattggggcaaaattagccatgccacttggaagtcttttgaaaggtttgtgtttatttttctaacctatatattactgtaagaggcatacttggaacaacccccccacaaacacatatactaattaactaatccagcagcggcataacacacagggagttttatcctttatgaaggcctggcatatgcatcacatttaacacagccctagctcacagtactttatctacttggctagaaaacaaatggccacagaaattcatgctagtcaatccattttttatatattttggagtaaaaaggatgtaaattcatctgagtagataactagcatacaaagaattcaggttgagtgtgctacaattaaaaatggtcaccacaagaagctgaaatattaggagtgttcaggggcattactgagagtcttcaagcaaaaagggttttcccagctgtcactgtaattacaatgaaaaaattttacttcctaaggatttcatctagaacacattatacataacagaatatacatgcattcaaatgtaatagacacataaggaataccaattttgactaccttcttcccacaaatcacaagcgacctctgagcacaactctcaagacttttaaatgctttctggaactctttttccatttagaaataagtaactacatacaacagttcacggaaaactcaaccacttaactatttcagtgaaaacaggtagaaagaaagtctataaactatactttttatccatttgaaaaaatttaaatttggaaaggaatcacttcattcttaaggtcccaacaccctaaaaataaagtttattctaaattttcacatttgtcaaagacaataatatcaagcagtagcccacaattccctaaaggaatgatgtcaattggtatttcttaaattaattcagtgacctacagtaatgtgagttcttggtacataatgtctgtcagtaggcaatacaaaaatttcagaatcacttctggtgtctgaactccaaaatgcaacccaaaaaatgtgtctaaagtagttccttaattcctacttcaccttgcatctgttacttatagcaacgtcagaaaaataaaaattacaccaggtgtagattgctagaactacagttctacaaattaaatacagtacaaatttaaccaagacttctggtaacatacaatcagttatctttctgagctaagacattacaagtctgtaactccttttaccgactatggtttagtgagtttcacatgtgcttacacagctcatttttagttacttactagacaatgtgcaatggtgtacttttataaaaatttcaaaggtctcaagaaatggaaatactcaaatttaaaggatttatctgttatctctgaactctctttctctgcttttactgctcccaagtatacaggcaccacgaacacagagaccagctaaaagttcaggaacagaaaattccaactacatcatcttaacaaataaccccacacattatagtttaaaaatagcatatttgaaaaaaatgcactaaaaattattattagaacttcacactcaaatctctaaaaagttatgaacattttatattgtaatacacataaattctaaagaatatcaaagtataatatcagagaaacaatatgtgtaagattataaaagattagagtattatctgtttggatttttacatgaattatttatgcacttaaaaacatagttgaagtgaggagaaacataaatgataacctaatcacattctctgagtttccctcctaggtcactggctgctccttctcattttcctgactcccattattcctaacctctaagtgttggactaccctaggaggggtataggacttttgtctttctctattcactgtctaggtcacaggtcagtaaactctacctgcagaccaaatgtagcttaccacctattaatttttataaataaagttttattggaacgcagccacacccattttcttaattattgtctacagctcctttcacaatacaaggtaaaaattgaatagctgcaacaaggactagatagtgcttctgatcctttacagaagaaaaattgccaatctctgtctaggtgatctcactaaggtgcatagctttaaatataatgtatatcctgaaaattacccaaattctatcttcagtcctgactcagatatgaatgacaacttctctacattatatttggatgtcttataggcatacaaatttaacatgtctaaaaggtaaaatttgctttctaccacccctgccactcctttgcctcttgtatctcaatacacaatttccattcatccaattgcttaggccaaaaacttcagaatcctccttgattcctctatttctctcatactccatatcccagccatcaaaaaagtacatctttaaaatatatccagaatctggccacttctcagccactccaatgctaccaccctaactcaagtcacaaccattttcacctggactattgtagtagcctccttactgggtccctatttctgttcttggtcccttacactcaatttttacagagcatctagagtgatcatggaattccattactgaaaacacttcaaaagccatgcaaggtgtggcctcttgttatattctacctttcctccctcttactgactctggtcactccccacatggtcttttactgtcaagcatggtcctgccttagatctttgcatttgctcttctgtctggaaaagtttcccccaacttatctaggtggtttaattcctcattttattcaggtctctgatcaaagattacctcaagttagaggtcttccttaatcactctctctaaattagtgactcctatcaattctatatccctgttaataggtggattccctagaaaacaggctctaagattctgggatttgcatgcattttggggagtgcccttaggaacaacatctgaaagggagtgaaggaagcaggacaggcagagaaagaagctgaattgcagtgtggttctaacagaggtttaagccacaggaacctctgcagtgggtatagtttttgaaaattatcccacatgaggaaaagagacagggtctttgagccgacatatacataatgaaattcccagtatccccagagttggggtgtaaccttgagtaagacacataaatatgtgttttagggaaatgcaaattaaatccaaaataagatactactttacacacactaggatagctaaaatcaaaaaagataaaaaataacaaatgttggtgaggttgtggggaaaatagaaccctcatacactgctcatgggaatgtaacatggtacacacagcagctccggaaaacaggtttggcagtctcttcaaaagttaaacataaatatatcacacaactcagcaataccatacctagaaatctgcctaagagacatgaaaacatatatctacggaaagaattataaaagcatattcatggtattattcataatacctaaaagcaacacaacataaaagtctagcaaatggtgtgtggattaacaaaatgaggtgcatctaaacaaaaaataatattcagcaaaaaaaagaacaaaatacagatacatactgtaacatggatgaacctcagaaacattacactcagggaaagaagccaacacaaaagaccatttattgtgtgattctttttaaatgaaatatccagaaggggaaaatcaatagaaatacaaaatagattactggttgcctggaggtaggggtaagaaataacagtaagtgcaaatggccatggggagtattttcaggatgattaaaacattccaaaattggattacagtgatggctgtacaaccctatacattcactatatcatcaatttctatacttagcatgagtgaattttatgaaatgtaaattacatataaataaagacataaaaaagaaaaataaatattactggctgattcttaaattgactaataataatggtgacaataactactactcactgaaaatttgcttaggttcaagaattgttctgagtgcttcatttgtattaactcatttaatcttcaacacaatcctacgaagcaggaactattttattcctatttcagagatgagataactcaggcatgggaaaattaaatagcatgctcaaggtcatagaactaaatatatattaattaacttataaaaataaaacattctaccttaaatgctaagcaacagcacttatctaaaacaaaccaaaaaagtagaagataataccatatgtgtacatacatggtaagttccctgtaagtagcgtatttaagattttccaataagtgaccaacttgcaacacttctgattatctgtatagccattgaaacaagtaataagtataatatttattataagacagcttggccagtacttggtgcatattcagtgagagacttaattactgtagacaaatataaagaatgctcatgatctaatctactgaatcactatgttcatacagacacagaaatatcactatgggtacacataaatacaactttattctgcaacagtcacgcataaacacacacacaaactctaagtcacacaatctctataataaagatttttctagtgcatcatatcacagaactgcaagcatatcattttgttcctgtaactgaaatgtacaatgggacaagatgagatgacagtgtgttttatctttttcatatgaaagttcagtaataaatttcacatggcagtaagccaatatgaatgaaatacttggagatactaacttctcatgtatctaccaataaaacactctcaaatttacagatacccctagaaaagacagctgataaccacattgtatgtagttaatattttttttaaatatgaaggcatataaatgatcagcaagcctgacatttagatatttgacaacaatgtattttaagcagtctaataaaacacaaagcacagatgtagaggaaggaagatatgtaactaaaaccacattcaccttcaattcctttgcagactagcactgaaaaacctacatcagcactttctgtctagatgatatattgatacaaagctagaataaaaatggtgataaaaagtaccatttgtaattgaaaataaatgttgctaagtgctgacaagcttctgtcagttaaattgtttttatttagaaatattttgcatttcctctattattcttaagaaactttgtaattaatttttgttccaaataatgtttttgtgtattgattacacaaactagtaatatttacatttaagacatccatttaaagttgaagaaaccatttcataatagaaagccaattcctacccttaattctcttaaaatttaacgtccacctagaaagcaatgcatcagtaataaatttatgattcaatatggttatcagcccacagctaaaaatttgcagatctgtataaccaagcatattaaaagtccccatggataacatataaccatgagtaactctcataattcaacatgcactacagtaagaaccattacaactgcatgttttcattgttaggtcccaatccatttttaaaagaagctgtacatgtacatcaccaacttgcacatacatgcaagtaaaattaaattacctaaagggtatcttctgaaaaacctgagagttttttttaagacatcagtataaccttggttaaataatcttatggtctctatataaagatttgaaatttctgaaaataaaaacatacagtaacataaagcttgcttctaagagtagccagattcaatattcagatttagaaaaattacattcattaaatttaagtgaaacaaataattatgctgaacttctacaggattgccctcaaaatcctatacataactagaaaagtggacaaaatatataaagctatttcagatagtggaccaatggcagaagaggcatgtgattattaacaaaagggaaacaaatcaggtgatatctaagactgcccctattccaacctagatgcaaagtccaaactgtggtataagaatggggaactcagagcctcatggtccaaataagttgagaaacagattagagtttgaagacactgggatggctggaatttgtgggacatattaaagataaaaagaacgctatgcagagattggcataagaatactcatgaggctttgaataggaatctgtgctgcatagggtgaaactccaagcagccaagtgaaaaatagcaggaaaagatcaatttcaggggagttataaagtgaacaattccaagaatgaagagcccttgttgttgaatacccagagtattctgtagagactccagaaagctcatgccttagtagtgagtctaaactagctctaaagattaccctagatcatccttgaaaagcacaaaaatagccttgaaatgagcaggctgatctgcaaataatttaaatgcctaccaaaaaagtggagggtggtggggagagagaccatttaaaagaaaaaccaaaatgtaattagtactacattagtaaccaaaaagaaaaaccaatgtaaattagtatgtacattgttcaaattcagctgaacaatgtaaatactaatattcaatgcctaacagtgaaaaaaaaaattagagacagacaaataaaagggaggaaaatgttgcccacaactaggagaaaaatcagtcaataaaaacagatccaattaacaaagataacaaaattaacattaaaaggccttaaaacagctattaaaataagttcaataagattaaagacttaaaggaaatatgaacataacgagaagacaaagagaacatattgagaatcaccaaattaagtgtctaaatatttaaaaatatttttgatacgaaaatgttgcagataagacactacagaaaatatcagtgaagctggaaacatagcaacataaattattttaaacaaagtatgaaggaagaaaatattttaaaaataaacagtcttggtaacatgtgagggcaacaacaatctaacatttttataattcaagcactaaaataagaggaaagaggtcaagaaaatatttaaagaaaacatgcccccaatttttctgaatttaataaacaatatcagcctacaaatccaagaagttcaacaaagcccaggaagaataaagaaaaaccatgacatgatataatcaaattgctaaaaaaaaaaaaaaaaagtaacaaagaaaaaaatcttaaaagtacccagaaaaaaaggcacataatataggagtaaatataataacacatgtcttgtcagaaattatgcaagctggaaggaaatggaatgacattcttagagtgctgttagaaaaaaactgtgagactaaaaatcatacagccagatcaaatatttttcaaaaatgaacacaaaggcaaagatgtcattaccgatatacccaggacctagccaaagcccacaacacccctgaaattctcaagatcaagttcaaaaaaaggggtccccgtgaaagtgaccatcaagatggcaccacctcaccagacctccttggagctcttcgtgtacctgaacgaagtcacgggcaagcacggcatgggctgtattgacattatggagaactgcttcattagaataaagtccagaggtatctacaagaccccagcaggcaccatccttcaacaggctgatttagacatcgaggacttcactatggatcgggaagtgcacaaaatcaaccctgagtgtaaatctgtccaccattgcatcaccaagtcccaggagcaaatggaaggaaaagtgcaggtgcccatcttcaagggccaggtgcacatcctcagccaggagtctctactctctctctacaaggaggagctggtgagcgtcaacgtgcaggggaattatgagccaatcgatgccaccggtttcatcaacatcaattacctcagactgaaggaatatcattatttccagagtaaggtcactgtcaaatagacccatgtacaatggagacctggggcctcctcactttgcagctctcccaactacaggtgctaattgttgtgacgatttgtaattgtgacttgttctccccagctggcagaatagtggggctgccaggccccaactttgttccctgatctccctgaagcctgcaaaattggtcatcaaagggaagggtggaggacaaatgcaggagtaagctataaaatgacaattaaaaaataacaattctaaatatttatgcacctaataatgaagcttcaaaacacatgaagtaaaaactagaactgaaaggaaaaaaaagaaacccataataatagctggagatttcaacactactctctaggtaattgacagaacaaagagaccagaaacagtaaggatataaaatacttcagtggcaccatcaacaagttgacctatttgatatttacagaacactcacccaacaatagcagaatacacataatttgctaatgcacgtaaaaaaattaactaaaatagggcatattccaggccttaaaaaaatggattgaaatcactcaaagtactttctttgatcacaaaggagttaaaacggaaatcaattaaggaacaagtcctgaaatatctggaagtcaaacaatataattctaaataatcaatggaaaaaagaaaccacaagggaaatttaaaaacatcttgaataaaatgaaaacataatataccaaaatttgtgggagaaaactaaagtactgctcagaacagtgtttccccaaatgtgctacacactaaaaatcacatagggagtttttaaaaatcccattgtacctcatatcaatttaatcaattaaataaaaatatctggggatgggagacagaattattaatttttaaggattccccagacaattccaattggcaacaaaatttgagagccactggtttagaagaaattttttttttaaataaacttctacgttaacaaggtagaaaaagaaaagcaaattaaaatcaaagtacatagaagggaagaaataataacaagcaaataatcgaagaaataaaaaacaaacccaaagctgctttttggaaaacatttttaaatgataaatagctagatgaccatgggaataaaatagaaaagacacaaattaacaaatatcagaaataaaaaaggagatattatccagatacttcagacatcgaaacaaaaacagaggactattgtgaacaattttataccataacttggataaattaaatgaaccaattgattaaaagacacaaattataaaactgaatcaaaataaacccctcatcaatctcaaaagtttaactcataattaacaatcttcccaaaaagaaaattcctggaccagatggtttcactggtcaattctatcaaatatttaaggaagaattaaaccctatacaaactttttttagaaaagaaaaaaagaagaaatacttcccagcttgtttatgaagccaccaagcctccaaatccagatagagattacaaaaaaaaaataaaagacagaccaatgtatctcatacatatagacataaagaaagatctttaacaaaatattaccaaatcaaacccagcaatataaaaaaaaaatacatcatgatgaggtttggcttatccaggaatgtgagatgggtttagcatccaaaaatccaatcaatgtaatttaccatattaacagattaaaaaacaaaactatatgacaatatcaatagttacagaaaagcatgtggcaataatccctcagtcctaatttaagaaaaaaaaaaaatctcagcaaagttgaaacagaaagtgtgccagttatcaacctcttgcctgtcagctccaaatttacccttccctgtcctgctttgtgatgtgggagctagaccctgtatcttttctttgccagctgctgtaacactaaattttgttagcagagggtgctggagagaacaatgcaagatgaaggagcttctctttctgcttccgatatgctttgttctcctgtttttcttatggcaatcagcatcacaaagatacccagtgatactcacatcccagcaagttgcagcagcacctccataagcaacttcccagccagttccactagcatcccaagtggtttcctggcaagtcgcaagatgttccaaccagcagtttcccggaaagtttcaaaaacacccccatgagaatctttgcagtgaacttgaccccctcctcaggggctggctcacttccaccacataccacagaagcaagaagagaataaagtacactagaaccagaaagagaagccccttcctcctgttcccctgcaggaagattccgagtgaatttcaatgtcacctctgcaggcaatttcccagcaagtctcaaaaagacccagagggtagcttcctgaatcaacaaactagggtgcatccatgtaatcaaatattagtgagtgatttaaaaaatcataacctataaagccatggaaagacatgaaagagtcttagccagcatactgctgaaagaagccagtatgaaaaagctacatattgtatgatcccaattaaatgacattctaaaaaagacaaaattgtataaacagtaaaaagaacagtagtaggagtaatgggcaggaggaagatagagatgaataggtaggagcatgggatttttagggaagtgaaactattctgtatgatatcacaatgatggaagcatgacatgcatttgtcaaaatccatagagctgtacaacacaaagaatgaaccctaatgtatagactttagttaataatattgtatcaatattggttcatcagttttaacaaatgtacattaatgtaagactatcataataggtgaaactgtgtacagggaaaaagggattatatgagagctctctacaaaaatataaaactgcactaaaaaatacagtctattaatttttaaaaaaacacattttcaaattttcccatagcttcctgtagtgggcagaattctaaggtggcatcccagattcctgcccactggtgcacacactctgaagattcccttccccttgggggtgggtagggctttaagtatgatagttttcactcccagtatgatgttacattatatgacaagcatgaaaagattgtattaacgtaattaaagtcccaaagcagttgtcttcgagtttgtcaaaacagagatgattctgggagtccttaaaagggagtgggtcctccttgaaggataagcctcaaagcttgagagagcttttcctgttggtcttaaagaagggggcctgtataggagccatgtagcaaggacttacaggaggggacctctagagaccgagagcagtctccagacaagagctagcaagaaaatgtggacttcagtcacacaatccccaaaaactggattatgccaacaaccacatgaacatgaaaaaggatcctatgagatcccagatgagattatagcccaggggagaccttgactttagtatataagaacttgagcacaaaattcagctatgcccagacttttgccctacaaaaagtctgagataattaatttatatttttacaagccactaagtttgtggcttattaaacagcaatagaaaactaatacagtctgttaccttcaggttgacaaatcaccaacgtcaacaaaataggctaaaagaagacattttggaattttgtacattttgacaattgaagtgaatttcatagtcataaaaatttacttattttgcatatagttggcatttgatattttgaaaagccaaattataactagtatatatgacacaaccacagcctatagaaaaaaattacacacctgagaataaaatgcaacaacaaatctatcaggaagtaatttaggaataaaattctcaatttcaaagaaatttcacataacaacttaaaattctacttaggattttacaaattgctaccaagtgataattaaatgtttttaatttttaaacatatacaggttttaaacaacaacaacaacaaaaaaacagaaaaaaaattttgaaacctgcaaataaaacatatcatgagtcctaaatttctgaaaagagatttgcataattttccttaattgtacactttaaaatggttcataatattatgtgaacttcatctcagttttaaaaagttaatctgagcattctaaatattaattataattattacatgtagatctacggagaacatctattcccagtttttgtcaacacccaactacgcaaataaaatcaacagcacataaacagaaaatcatcagctatcccattaaagtacatattgaaactttatatacgatgcttgaaaggtcacctgttcactgcattaaaaatttcttccccgtgctaggcatacaatgaataaaatatgcagtctttcagaaaactgtatgtaatgatatgtcatagcagttcacacaattgtactaaacaatatgcatgctttctgtttttctatcaattaaatattcaggaattactgtcaaatgccatgtcatagcatgacagagatttagcccagattttgaaatctggtttgaaccactagaattagcaaactaagcagcaacataaaatattaagcatgtcaaccaaataatccactttccctctgtctttggagatgccttattaaatttcctaagagaaaaataaaagtacttcatgtaaaaagttttaacccctgctttgaaaacacatattttagcccatcatataaggttttttaatatgattggttctaataatcatatttttaaaatcccaaccagaagaagcactttaaaagtattttttcagtttaatatgcacaggtctgccagcataatatttgtccataattaagaaaattgcttacttgctcagtaggcaatacatgaatcatatgtagtataaaattagaccacaattgagagtttaatccctaaacaacatccaaagttaagcagaatatggtatgatacataatacctttaatataattaaatgagccttaattttacataaatatattaataaattagatatatactatccaatacagtaaccataaactacatgtatctatttaaactgaaaataatttaaagtacataaaattaaagattcactttcttagttgcactcaccacatctcaagtattcaacaaactaccatattaggtagcacagatatagaagatttctatcattgaagaaacagtacttatttgacagagttgagtttaccataaaactcatcataaagcttaagcttcaggcctcctcatttgaaaatgtccctgcaggtaccctagcaatgtgtccatgattatatattttagtaaaatttgtaaaagtaagatactttgccaatgaaatatctttctccacttcctcttcttctccaccaatctcctgttgtcgggtggagggcgtcacagtgagcaacctggggatcatgcaaagggtgatatattcagtttgggtgatacattcagaattggtagcacattgtttttagtgggatatatgtaagtggttcttggtcatttctatgtgtaattagtttaccatctgttccagtataggaatggcttctaggaatacatccctttcccaactgtgctaactcacatggggtcctgatatgaaggttcgtagtcagaggtctatgaagacccctcaatgtgtaacctctgtcacgaatgtgtcccatggcaacgagaactaaagatttgtggcaaatgggagagaagcagagactgaaatttatacagccagaagctactctgtggaaaattcttccaataaggagacatgaaatagaataagcagataattccatttgtaatcaatgcctagtcaagttttctcttattaggaatagagttgatagtgcatatacaattataaatgtagcagacatttcttttttctttttgatgggactcacaatgaaatagaacttttcagacactgcgtttgcaaagcccaaatctgcagctgttctataaatactatgtctgtgagtgaagctgcacagtttatacagctcaattatcaataataaaaacaaaatcttcctaaccatagtacaggaaagtccaatttatctttctaaatctataaaaaattatattataaagtcattgtcatctgagaggggctcaaacattatgtatcctatagatgtggaaaaggtagtttaaaagtgtgatcagcagctatttttccaaatattattatgataatgtcactgaccatcttttacgaaattgtaatcagttgtgatttcttttctcattctaaatacatattgacttgtatataaatttgcatctgtaattttgtattttttttaggagggctgcctccaaatggtctgcctcctttcaggtccccaataaaaccttgatctgaccctgatgctagaaaattatgtcttgattaaaatatatattcactaattagtaatctctatgtattcctttcttcatcctagatgtactgcaatatcaataacccagtcacatcattgtcactgaattctaggatttaaaagggtaaatttgaaatacgtcccttctgctcactctggacctaatctgatatcttttcagccttcggtacaaaaagctcacacctcactagcactaatacaaatgtcattcctagtaattaggttacactgagtgcctttgagctttgcagtgctactgccagtgaagttcttaatacatttacagtcatggttatttaaaccactaaggcttttctttgagtaaacaatatattgatcaaatcaaatgctagcctgacaataccaattaatttaagaaaataaaaaatacacaaaaatttctgttatctaattatattgaagagattgctcctaaaacaaacatttgtaaaaccacctttttgtactatgaaaattatatttgtacacatacaaatataaaaatgcccaatagctaaatgccacttatgcaaatagtccctaagttttctttgatttacagtttatttcatactctttatatttcattaagccatccttcaataaactattttttcaatattgtgttgcgaagatattctcagcctgaaattacatcaaataaattacaaatcaaatttctgaaagccactgccataggtggaaatcaaatcaaatgcctagcttcacataaatggttaaagctttaaataaattgcatttatataattgccttacttgctgctgcctcctacagctgtagaataatgttattccaatatatgaagaatatattggcagacaagactaaaaaattttgaattattaattaaaaatgggaagttttattaaatacattaaagaactgaatttagacttggaatacatatattcctgtagctctgtttctctgattaggccctgactgttacacttttactaaagattttttttaaaaggaagaaaaaatttcttacctaagaggatttggagctgtgaaaggaaatgggccccaaaatcactaagctaaagggaaaagtcgatctgggaactgcttaggacaaacctgtctcccgtgctattcaaagtcactcctctgctcactgaaataaatgtgtatctgattgcctcctttggagaggctaatcagaaactcaaaagaaggcaatcatttgtctcttatctacctatgacctggaagtcccctccctgctttgagttgtcctgcctttctggacagaaccaatgtttatcttacatatgtttattatgtctcatgtctccctaaaatgcatgaaaccaaactgtgttctgaccaccatgggcacatatcgtcaggaccaccggagaccttgtcacaggcacgtgtcctcagccttggcaaaataaactttctaaattaactgagacctgtctcagattttcagggttcacagaacaaaatgataatttactgcccttactcaaaaaatattgtcctattcatagaaaaagaaaatgataaggtggtttccagacactggaagtagtggagaagtgttacatagttattgcttaatggatacacggcttcagtttgagactatgaaaacattctggaaatggatagtgaggatggctgcacctgcaccacaataagaatgtatttaatgtcattgaactgtacacttaaagatggttaaaatggtacattacatgttatatatattctatcacaataaaaatgtttcaattgttctaattatatttacatttttatattcattttttctgagattcagcctgaattgaaaagtgcttcattataaataatagaaattaaatacttaagttggtcattcaaactcacaataaaatggagaaaagaaatcaagttttctaagttgtgactctgtgagcactttactaccacacaaattgagagatcacaaaagaaattccgaacttctctgaccaaggacagttgttttgaaacaaataaaaaaactatctgtacaataaaggtacaggtgaaactttcttttttttaaacttcaagttctagggtacatgtgcacaatgtttgcaggtttgatacataactatgcatgtgccatcttggtttgctgcatccatcaactcatcttttacattaggtatttctcctaacgctatccctcccccagccccccaccccccgatagtcccccgtgtgtgatgttccccgccctgtgtccaggcgatctcattgttcaattcccacctatgagtgagaacatgcggtgtctggttttctgtccttgtgataatttactgagaatgatggtttccagcttcagccacatccctgccaataacatgaaatcatccttttttatgactacatagtattccatggtgtataagtgccacattttcttaatccagtctatcaatgatggacatttgggttggttccaagtctttgctattgtgaatagtgctgcaataaacatacgtgtgcatgtgcctttatagtagcatgatttataatcctttgggtatatacccagtaatgggaccgctgggtcaaatggtaattctagttctagatccttgaggaatcaccacactgtcttccacaatggcagaactaatttacagtcccaccaacagtgtaaaagcattcctatttctccacatcctctccagcatctgttgttccctgagtttttaatgattgccattctaactggcatgagatggttatctcattgtggttttgatttgcatttctctgatgaccagtgatgatgaccattttttcatgtgtctgttggctgcatagatgtcttcttttgagaagtgtctgtttatatcctttgcccactttttgatggggttgtttgtttttttcttttttttttttttttttttgagacggagtctcgctctgtggcccaggtgggagtgcagtggcgcaatctcggctcactgcaagctccgcctcccgggttcacgccattctcctgcctcagcctcccgagtagctgggactacaggcgcccgccatcatgcccggctaatttttttttgtatttttagtagagacggggtttcaccgtgttagccaggatggtctcgatctcctgaccttgatccacccgcctcggcctcccaaagtgctgggattacaagcgtgagccaccgcgcccggcctgtttttttcttgtaaattggtttgagtactttgtagattctggatattagccctttgtcagacgggtagattgcaaaaattttctcccattctgtagattgcctgttcactctgatggtagtttcttttgccatgcagaagctctttagtttaattagatcccatttgtctattttggcttttgttgccattgcttatggtgttttagtcatgaagtccttgtccatgcctatgtcctgaatggtattgcctaggtttccttctagggtttttatggttttaggtctagcatagaagtctttaatccatcttgaattaatttttgtataaggggttaggaagggatccagtttcagctttctacatacagctagccagttttcccagcaccatttattaaacagagaatcctttccccatttcttgttgtttttgtcacgtttgtcaaagaacagatggctgtagatgtgtggtgttatttctgagccctctgttctgttccattggtctatatctctgttttggtaccagtaccatgctgttttggttactgtagcattgtagtctagtttgaaatcaggtagcatgatgcctccagctttgttcttttggcttaggagtgtcttggcaatgagggctcttttttggttccatagaactttaaggtaccttttccaattctgtaaagaaagtcattggtagcttgatggggatggcattgaatcaataaattactttgggcagtatggccattttcatgatattgattcttcctatccatgagcaagggatattcttccacttgtttctgtcctcttctatttcattgagcagtggtttgtagttctccttgaagaggtcaccacatcccttggaagttggattcctaggtattttactctctttgtagcaattgtgaatgggagatcattcatgatttggctctctgtttgttaatggggtatagaaatgcttgtgatttttgcacattggttttgcatcctgagactttgctgaagttgcttatcagcttaaggagattttgggttgagacgatagtcttttctacaaatacaatcatgtcatctgcaaacaggaaaaatttgacttcctcttttcctaactgaataccctttatttctttctcttgcctgattgccctggccagaacttccaacactacgttgaataggagtggtgagagagggcatccttgtcttgtgtcggttttcaaagggaatgcttccagtttttgcccattcagtgtgatattggctgtgggtttgtcatagatagctcttttaattttgagatatgtttcatcaatacctagtttattgaaagtttttagcatgaaggggtgttgaattttgtcaaaggccttttctgcatctattgagataatcatgtggtttttgtcattggttctgtttaagtgatggattacgtttattgatttgcatatattgaaccagccttgcatcccagggatgaagcccacttgatcatggtggataagcttcttgatgtgctgctggatttggtttgccagtattttattgaggatttctgcatcgattttcatcagggatattggtctaaaattcttttttgttgtgtctctgccaggctttggtatcaggatgatgctggcctcataaaatgagttaaggaggattccctctttttctattgaatggaatagtttcagaaggaatggtaccagctaatctttgtacctctggtagaattcggctgtgaatccatctggtcctggactttttttgtttggtagcctattaattattgcctcaatttcagagcctgttattggtctatttagagattcaacttcttcctggtttagtcttgggaggctgtatgtttccaggaatttatccacttcttctagattttctagtttatttgcgtaaaggtgtttatagtattctctgatggtagtttgtatttctgtgggataggtggttataccccctttatcattttttattgtgtctatttgattcttctctcttttcttctttattaaacttgctagaggtgtatctttgggacacatttaaagcagtgtgtagagggaaatttatagcactaaatgcccacaagagaaagcaggaaagatctaaaatcgacactctaacatcacaattaaaagaactagagaagcaaaagcaaacaaattcaaaagccagcagaaggcaagaaataactaagatcagtgcagaagtgaaagacacaaaaaatccttcaaaaaaatcaatgaatccaggaactggttttttgaaaacatcaacaaaattgacagtgaaacttttttaagtaaaaagatagttaactatactaatggctacactgagcatgataattattgcagatggtcaatggtaaagcaagtgtagttgtttcagctgtagagataacgtaattaaatgaacagtatagacatctgatcaactttgaataatcaatcttatcacgtataccaacatgccctgttcttcacaaaatccattcacaaattctaggatgtatgattttttaagtgaattctgattcgttagaggttaatgtttacgaatgcaaacagcatctgtagaacctgatttacggtaaggtactttctactcatcacagtatctccaccgtttaacactgttacaacgcaagtgcacaacaaatatctgtttaagtagccaggaaggaaggagagaaggaagaagagaatgagggagagaaggaagatagatgggtggtttcggtagattcttaaaacccatccgttaatactcagtgtttggctgtggtatgaataaaagagagaggctagagactacaagtaattaacagactgcgagggccagtgtcccagactaagccatgctaatttttagatattactcgtgacttttttctctactgacaaaagctcagcatttaaatatattaggtgacacatatatcacaaggtacctgaataacagctgggattcattacatctgtataatcatctatgcatgatgtatagccatgctacttaaaactatatcttaaatatgaagactcttaacagagtaatttcatacattccaaaatatttctcttcattgtacattaattaaaactatattttcaacattttataataaatcattctaaaagccaaatattaagcaattctaccacaaaaccaaaacatttgaaacaatcaccatattttgactttgcaacttttgtaaaatatgtggttatttgggtcacagaattgtatcacatttgttgactaccaggcaaaattctttgacaagtgactttcaggtttacacagtctgctgccattatagcaattatatggcataatggaatgctagccatgtgtacttctgacattcctctaaatccaggtcattagtcattacatgaagtcattttaagtttccttcatcaattgccctctgtagttttccagctgtcatttcatttgttagtttcaactgaaatgtaaatgtaatagatgtaaatgtttatttagggattgcttcccctttctgtttttcacataaacacttacatacttcgattccttaaacacaacatgttttggcaaaactaatctatagtaaagggggaaaagtgagaaatgtggttccctgtgaggtgtgggagcagaaggtgactgagaaggaccatgagaggactttctgggatgatgttaatgttctgtatcttgatagagattagggttacacaacataggcatatgttaaaactagcaaatgttcacttaagatttatatacactattgtatttaaattttacctcaaaagaaaaaaaaactgtaaactattcttgaactctagttaacaatacgcatgttgaaagtatttagggggaagtgcctatagtttactttgaaatgcattataaataaataagatggactgatggatgaatagagggattaaaatatagatagataagataacagaaaagtgataagatatgagtggtgagtatactggtgttcactgtaattgtcttttgacttctctgtatgtttgaaaatttccataataaaatacattttcaaatttaaaaagtcatttctccaaaatccttttaattttcaaattcactcagtaaagaaagaggaatcagcaagtgttcccaaacattttgaaccataatcttagttacccacctgctggatcattcttagatcatttcttagtagtcagaaaaactggtccaaataattaagactcgataaaaatcttgctaaattaatcaaacatataatttattcatctactccttcatttattccacaaatacatgtcaaagacctctaagaagcagatgtctcttctaaatgctacagaaaaagagaactgaattgtaatacaacgtgatatacattaactgctataaaaacacgacagggagggcattttcgggaccatgaagggtgagtaaaattttgccagattgggtacagggagcagaaagttcatcccagggtatggactatcatgtaggtaaccttataatacataaactttgttttacagctaaaaaaggtaaattatatatttctggtagttgcttctcaaatatgtcaaaataatttaaaataaatatatgtacattaatccctcctttttgtatcttacatactgattttagaagattctgcaatcttttcaatcaccagtataatttaggttttgcttattcaccactaaatcacagcaacatgtatttcatttataataattaaaggtatgttcgttcacatttgatggtattaccactgagaggttttttgcaataacatgttttccctggaactcactttgggaaacaattctctaaagtcttgaaatcccaagagtgcatactcagggattagaaaggtttccctagaccaggatgcaaataaaaatgcaaatctttcacacagcaactctgcccccaaaaaactgacaaaggacaaatatcaaagtactgtgtaaattgtctacaatctatttagagactttaaatatgttatgttgtcctttttaaggcatgtggctggtcacatttcctttgatgagtagtttgcctttctaagcaacctaaccaaaattctggcatatgtgagtttactgcaatattatttctttatgatctgcaagatgtggatatcactgtctatctcacatgcttaacgtgaaggttatatgagatttttttaaataatgaaagtcagtgtttggtgtttaataaatagtagtaattaacaataaaaaatatttacccatatacctattcaggcaattgtacaaccatgcttttaaatttgagccaggaactgaggtgagccagaattcatcttattttatgagtatagttacaaagtcctaactcatagtctcattgcattactgatcactttaatgtcatgataatttttcatttgctccctttcagatccaaactccttacttcactgatcacccaagactggtactctttacggagttcgctagcgaagaccttagaattcttttatcatttatctgttagtggctgaggatagaaatatcagtggaccttcacctcaaataatcctctaaaaaaattcccagcgactgagttgggccagaagttcagactcaagatactttgtaatttgtttcaaattattttctgtaggtactatcaaatgatccctaagccaaatgaaatgctttgttctaatgactgaaaaaatcagttaagaaaggcaggattaatattagggcacttcttaggactggacagtgcattataaaagaaaatgaagaacattcagagatccaagagaaaagagacttctagaacaaaaaataaatagaaaacctgatttcatttgttagtacaaataataatgactgtcactatttaacagaaaactacattaccatattgaaatagaaagaagtgagaattcgaagctataactttgagatgcaattaagtgatccaactcaataaaccttaaacagaagactgtttctattcagagtgccagaacagtgtgaatctgggaacaaccttggaaaaggatcttgactatggatcagatattaatctccatgctatgtttccattatgccaaaaaattaagcactcttaatatttacgacagtattaaattataaatctagccccacatatcaaaaaattttaaaatagttacatctttaatgtcattaagagcaaatacagagcctcaggctcagttctattaggtaagttcatatcactgacattttcttcccatgaaacacattggacttaagatatagctatgaatataattttgctggaatactaatgatattcattttaaaatctgagtgctattagtacccactttcaatttttcatctttcatgatacgctcctggtacaagtgtagtctgtgtagcaacacactcatgctgtacacctcattggctcagtcctgtcagcagattgagtgcatttgaatctttatgttcctttttttagaatttgcaatattctaggagagtgattttctttattgttcccttatattgtatttcacccttacagaaaatgatagagtaattagaatcttattttccaaataagtcactctgtcttctttgtctaaaaaatatattttctgtttcacatatagatgataaagactaaagcagtagaaaaatgaataccaaaaatgtcaagagaaatagggggtttcaattgtaattttttaaagtaataaggactggaaaaaaattctatataaaaattgaatgattaaaaatactaaaatggttccttactgccctaaataaaacctttacaagatgcttcatatgtgaaataaattaagaatcaattcaaaagaagagaaacttttttcagtaaaatgggtaaaatcttttaaaaaccttttaaaattttctttgatacagtaactttctaaagaaatgttcaagtgtctatcaattttactttcacgaaagaaatctaactctgctttactgacaatgcagtttattttaaaactagagcagtacaaaaaggtcacaaaaagactttctgaaatataaaatcagtctaagataagcaaagctgaaatgactatctataccacctttccaaacctattaatgcttcaaactatattattatacaaccacaaacaaatatgtacatactctctactagaacatctccatagttgccgtgaatcattctttcattttccataagtacttacaaagctccataagtacttacaaagcagtatagtattcaattttaaaagtgtaaaaataaaatacacagagttttgacaaatagaaagtatcagataaaacgcgaatgaaggctagatggctaggtggatgggaggtgggtggatggacagatacataagtagttggatgaataggtgctcaggacatatgaatggatgaatatggtgctttctatcaaataaaagaacatgcaatccttttttcttctttcattaagtaacacttgtatattaatctaggtgttgcccatgagcttcaagagcagcttcatgaatctctgggaactgcatgtagggaaatgcatgttgatataggtacacacatgtggggcctggggaagggggtaagcatgcctataggcatcaacacaaaaaaaggccccttcttctaatctccagaaacaattaacctactcttttcaaaaactctactttgccagtctttcatctttcagcagaagaggcaaggcctgagtgaaaagtatgatgcctcctctggcttggcagcctaaacaaacaagctttccacacatagaccagggaagcttccacacccacatctggtgctaggcatggttcctgaattcaacagcaggataatacctgtccactatgtaataaaggcactaaaagttagctttaaaaaaaaaaatcaacatagaattcctgatttcatatttatgaaatagcatcctttcacaatagcacagaagaattaagtaaacaatttaaagattcacatctaattgagctccaactcagataaaatagcctgtgtttcttaaattgagactcccacaactaaattttgcctttcaaaggcaaaagaattttgaagaaatggtatcttcctagagatccctttggggaacatttttacaaacacttttcatgtgggcaaaataatttcactagtttgtttattggacatattggcctgtactttcacaaatgcagacccaaaaatcaaaatcagagatggaaaagggcaaacagtattatatagcaagtatgcttggataagaatcaaagtagaaggcttagggtttggctctaaaattagccaactagacatgagtttctgagcaagaatgatcataatgtagtttagttccctttcagtggctattgccacatgtatacaaaacaaacataaggaaatgcatcatattcttaagatactcatcctctcatccatctggttttatctcataaattacaaagtcctatttgaaattcttattataatattaaaattgggaaaagagcaaaattagagaatacataaggtaaggaatattgaaaattaataacaaagtaaagaaatacgtttgaattttttcacaatttctacaatatgcctcctgaataacctaactgaaatatgtctgacaactacagctatggaatctaaaagtaacagaatattattattttccttcctggtaaaaaaataaaaagcatataaatttatacatttttaggaaaagctaaaaatgtcatcaagtatgccttttagccttctttaacttcttttcaaaaatctaaatttataatagatctatagttctgagactatataatcctgttagcctaaaaagagataaataattataaataaaattattgtatttccttgatttatcagactctccatcctcaaaccaaaatccttacttaattaagcagggcaaatataagcaatcacttagaaaagtggtgtgataactattttaaactattaatctttttaaaagtaagcctttttaggagatctaagtagtacactcaaatattgtcttggatgctgggtgcacaaaataagaacctataccagttcatgaatatttttattgttttctcttttacccagggagagaaatagacaaaagacactattaaagttaaatataggctgggcatggtggctgacatctgtaatcccataactttggaagcccaagggaggtggatcacttgaggtcagcagttcgagaccagcctggacaacatggcaaaaccccatttctactaaaaatacaaaaattagtcagacgtggtggtgagtgcctgtagggccagctactcgggaggctgaggcatgagaatcgcttgaacctaggagacagagattgcagtgagccaagatcacgccactgcactccagcctaggcaaaagagtgagactctgtctcacaaaaaagttaaatacactgtgcccttttttatcttgaccacaaaaggtctccatctcagtaataggtatcatacttgcagtacctccgtggcatatgcccaggatttatagatcttttgttagataacaaaatccagataaattaagagagaaaatgcaacctgtggtacaataatacccatcattaatgaacttcggactttcccagtatttcactagtcagtgtaaagagaaattgttgtacgctcatgagcaagtcagtttgcttggtctcagttttctcatacataataaagtattttacacattccttttattaatctataaactctataagcaaggatcatggtaccctaacacccgcccaacataggcagccaaaaaatatgcatgtgcagaatgcaagatcacacaggttttttccagccaactttatcttcaattatataattttttaagtctaatatttgggtggataggtccataatgcatattaaaacaaaaaagagggtggttagggccacaaaaatgtggtagaaataattgaagatcacaaaagaagaaacaatttcctagagttcaagtggcctccatcaaactttaccaaaaccctaccaaaagctctaattctaaactttataaaaaagtcatagaagtataatttctctttcagaagtaatggcttttgttgttgttgctgttgttgttgtttctagttgagacctttgctgaatgtctaagaattggaaaaacaatgaagtcaaacctttcctaatttctattttaagatatttatactttttccaaactttcctcagatttaaaaaaaaaattgtattctttggaaaacaaaaagttagtactcagaaattcatatttggtaaaccactccagtaaattaattgaacccaaagagggggtcatgggaactgcaacttgaagccagttcatcagaagttccagagacctagacttgagactggtagaggaggaatagggaaaggtgcagtcttgggaactatgccctaaacctgtgggatctgacactatctccaggtaggtagtgtcaggactgaattagaggacacccagctggtgtctgctgcttggagtgtgggggaaaaaaaaccccacacatatggtcacagcagtcttctgtgttgatgattgttgtggtgttagagtagaggaaaaacacagttagagagagttttccttaaacaaatggtgtcagtgaagcaagattagctggaacaccatgatcaggtgggatttatcctagggaagcaaggatggttcaaaagacacaaattaataaatgtgatacattgcataaacagaattaaggacaaaacccatatgatcatctcaacagatgcagaaaatgccttcagtaaaattcagcatggcttcgtgataaaaatcctcaacaaactaggtatagaaggaacatacttcaacataataaaggccatatatgacaaacccacagccaacattttacttaatatggaaaagttgaaagcatttcctctgagaactggaaaaggacaagaattcccactttcaccactcttactcaatatcatactggaagttctcactagagcaatcaggcaagagaaaatattcaaaggcatccaaattggatgcctcttcactgatgataagatctagtatctagagaaccctaaagattccaccaaaaaaaccttagatttgataaatgaattcagtaaagtttcaggatacaaaattaatatacagaaatcagtagcatttctatacaccagtaacgacctagccaagaaccaaatcaaggaggcaatcccacttccaacagctacaaaaaaaaagaaaaaaaaaaacacacctgggaatatatttaacaaagaaggtgaactatctgttgtattagtcaattctcatgctgctatgaagaaacctgacactgggtaatttataaagaaaagaggttcaattggctcacagttctgcatgtctggggaggcctcaggatacttacaatcatggcagaagacacctcttcacatggcagcaggagacagaatgagtgccagaaggggaaatgccagatgcttatctcatgagaactcactcactatcacgagaacagcatgggggaaaccaccccagtattagtccgttttcacactgctgataaagacataccctagactgggcaatttacaaaagaaagagatttaattggacttacaggtcaacatggctggggaagcctcacaatcatggtggaaggcaaggaagaacaagtcccatcttacacggatggcagcaggcaaggagagaaatgatgaggaagacatgaaagcagaaaccccttatcaaaccatcagatcctgtgagagttattcactacaatgagaactgaatcatgagtgaaactgctcccataattcaattgtctcccaccatgtccttcctacaacacatgggaattatgggagtacaattcaagatgagatttgggtggggacacagagccaaaccatatcagaccccacgattcaattagctccacctgtcttgcccttgaaacgtgaggatattataattcaaggtgagatttgggtggggacacagaacaaaaccatatcatctctttaagaagaactacaaaatactgatgaaagaaagtgtagatgacacaaccaaatttttaaaaatcccataaccatagaatggaagaaataatattgttaaaaatgaccatactacatggagcaatctacaggttcaacacaatccctattaaattactaacatcatttttcacagaattagagaaaacaatcctaaaattcatatggaaacaaaaaagaccccaaatagccacagcaatcctaagcagaaagaacaatgttggaggcatcacattacctgactttaaattatactacgaggctacaggaaccaaaacagcatggtacaggtataaaagtagacaggtccatggtatagaatagagaacccagaaacaatgccacatacatataactaactaatcttcaacaaagtcaacaaaaatatacactgaaaaagttctatcctatttaatacatagtgctgtgaaaactgaatagcctagccatatgcagaagaatgaaagtggacccatacctgtcacaaagtcttatgttctggtctttggattaggcaatgattttatgaccaagtcctcaaaagccaatgcaacaaaaacaaaaatagacaaatgaggattaaatacagtaaaaagcttctgcacagcaaaagaatcacaatcagcagagtaaacagacaaactacagaatgttttccacaagaaaaaaaaaaaataaccccattaaaaagtgggcaaaggacatgaacagtcatttttctttttgtttttttgtcttgtttgttttttgtttttttgttttattgtttttgagacagactctcactctgttgcacaggatggagtgcagtggcgcaatcttggctcactgcaacctccacctcttggattcaagagattctcctgcctcagcctcccacccaggattacagctgggattacaggcgccttccaccatgcccagctaatttttgtatttttagtagagacagggttttaacatgttggtcaggctggtctcaaactcttgacctccggtgatccacccgcctcggcctcccaaagtgctgggatttacaagcatgagccactgtgcctggctgaacagccatttttcaaaagaagacaaacaagcagccaacaagcagccagtcatgacacaaggtgaaaaatgctcaccatcactattcatcagagaaattcaaattagaagcacaatcatacatttctcataccatctttcaccagtcagaatggctactattaaaaatcctaaaaacaatagatgttggcaaggatgcagataagtgaacacttataaactattggtaaaaatgtaaattagtacaagctctatagaaaactgtatggagatttctcaaagaattaaaagtgaaactaccattagatatactgatcacacttctgggtatctatccaaagggaagaaatcatcatattaaaaagatgcttgaaattatatctttatcactgcactagtcacaatagcaaaggtatggaatcaacctaaatgtccatcaatggaggatttcataaagaaaatgtggtatatatacaacttagaatactatgcagtcataaaaaagaatgaaataatgtccttggcagcaacatggatagaactggaggccattaccttagtaaaataactcacaaagtcaaatacttcatattctcacttataaatggaggctaaacaatgagtacacatggacatacagagtggaacaatggacactgcagactccaaaaggtgggagggtgggaggtgggtaagggtttaaaaattacctattgggtgcaatgttcactattcaggtgatgggcacactaaatgccaagactacaccactatgtaatatacacatgtaagaaacctgcacttgtccccactaaatatatttttaaagaaattcacaattggacaagcgattttaatatcccaaaatacaggaaaaaaaactatgagctacaaattatagaagcagccagccaatcacagctgccacagcttgggcatctcactttcatttagttagatccaccccgggcaacagttcttccagacccttcagtgttttgggggcatccctatactcctgcagtgggccccattcatcaaggatagcagctatcagaccccctatagatgtagacagccagcctagaatttcctccgcatacttcctctctcccaatcccatcatcttggcactcatgggattttcttcaacttattgccatgcataccaggtgtcctgccagacctctgtggacttcaattagatggcactatgtttgagaggccaaagaagagacccagaattagtaaaagagacaacagagtttattaagggaacatatgtactgggcagtccaatggcggaggctggacaggagaacctgtccagtaagactccagaaaaagcaaaaaatattaaaataaaggatttattacataaattatgtcatatccacttggccctctatttaaaatccattaggatattaaacataaaaaccaacaggcaacatggaaaagctttgtttacaaaaaaaaatgacattgggctggaaggaaatacactacactctaaaaaggtatacttttaaccaaacaatgtataaatacaaaaacaaaatttctcagcataatatttcataaactagaaaacttacataaaaatgtattcttaagtaagacagtacggacttgtctcccaagtctttttttcttacacacacacatacacacacacacacacaccccacacatatatgaatactttttaaacattttttctcattatgtaaaaaatcaaaataaagtaacccaaaaatttttaagccctaaatattttattatacttgtaatactgtcactaagttaaactcaaagaatctaacattaggtcattagacaaaactgcactgtgttaatctgtttgcactgctataaagcaatacctcagactgggtaatttataaagaagaggtttattttggcttacagttctacaggctgtacaggaagcagattgctagcatctgctcctggtgagggcctgaggaagtttccagtcatggcagaaggtgaagggggtgcaggtatggcaagagagcaagcaagagtggagaggtgccacactcttttagacaaacagattttgcatgaacttagagcaagaactcactcattatcatgaggaacgcaataagcttttcattagggatccgcccccatgacccaaccacctcccctaccttcatcattgggggttatatttcaacatgagatttggagcagacaaacatccaaactgtatataacgcacttattcttttttaatgaaaatcagtcaaaatatatctttaaaaaaatacatccacagccagacacggtggctcgtgcctgtaatcccagcactttgggaggccaaggcgggtggatcacctgaggtcatgagttcgagaccagcctgaccaacgtggaaaaaccccatctctactaaaaatacaaaattaaccaggcaacatgccacatgcctgtaatcccagctactcaggaggctgaggcaagagaatcgcttgaacccgggagacagaggttgcactgagccgagatcacgcccattgccccacagactgggcaacaagagcgaaactacatctcaaaaaaaataaattaatgcatcccactgctatcacagtttttaaaaacccaaagtgaaaacaaataactgtgtcagactatctttagcaacaaaacgcaaaaacgataacgtctagaaatatatgtaaaataattttaattataccatttataaaagattttattttttaaattaccagttcttttcattttactatttcttctaaaccagccatctggccgctttcaccttacaatgtatggtatctatttttatctgatatattcctatcttatttattgattatctgtctggcccactggaatgtaaactccttaagaaatttttttatcttgttcaaaacccagagtcactacatacaaatgtgtaggttttacacatgtgaatatcattacagttatgcagtgcacaacctgcagaactgaatatggtaggtctggctgtgaacaaataattatcagacatgtaataaaacgccagagatcttaacagttctgtgtcctccctagtggtgatgcaaaccctctctaggcatgcatgccaggaaaagctgttcctcaacattttcaattcctaaatattctttaacattatgttacacaagcatgtacaaattatttgctctttgctattccatgaaatctataacagcaaaatatttctgaggcagaaaccaactcaacggagttacctattaaaggccaatatgaatgaattataatagcagtaaatttttaaagtatttttcaccaaaaatactaaattgtttactattagacacatatcaattatttttaaaataacatgctgacagtctcaaagaatactgtaaatctatatatcattaatgtaatccatttttatgttcttaaacatctaaaattatagaactacatttttttataaactgtcatctcttttttattaaaaaaagaagatttttatgaaaaacctctgagtttaaattactattatattcaggagtcccacacccactgtttccaaacatagctctttttataacaacttctgacaatcctctagagaacaaaaattcacttttaatcaaagttaaatgctagaactgtttcctgggaaatttaattcaaggtaaacaatctacttgatattgtcttattcacacaaagctgtgttgttagaagaaatgataatgaaatataaaacctttctcttctaggttattgtttacaatctggacaaagctgataggcaaaagaaagcagagaaagccaatgtgaaaggaatgtgtaggattagtcacgcttcttcccagaagatagatgttgaccagtaagactatcagttactaaacacagccctctcattctacacccctaacacaatctcttaaaaaagaaattacaacttccaatctccatttgtcaagtatcttgaatttaaatatacaggtcttcacaaatatgaactaaaattcaacaaagttttgtctactatgtgctggacactaataggataaaaatgactaggaaacacttcttgcctcagaggaactttgcatgcaaatgacaacattacttggcaacaaaagaatgtggacacaatgtgaaatcaagccggggtccagcagttagaatcagcccttccttgactacaccagggacatactactacaaatcattctgtcttataccccagcatccagctatcctctggaaatgcttctccctgaagtttacatccttgcttagctatttcactcatctactccacggctaatcccttcatctctgcttctcagaaatggctctttccaatcctcccttccaatctctactccacaattctagtggcccagtctcaagcttcccctccagtgctctcataccttctcaaagctgcaattctagtcctgaagatctaggcaggggaaactggtactcacacattacatcaaggaaagacctcagaggtacacacaccagtggagataccataggttcagttccagatcacctcaataaagtgagtcacacgaattttttggtttcacagtgtatataaaagttacatttacactgaactgtaatctattagatgtgcaattgcattatggaaaaaaaagtacacactttatttttaaaatacttcattgctaaaaaaatgctaatgatcatctgagcctttggcaagttgtaatcttttagctgtggaagtgtcttgcctcaatgttgatggctgctgactgaccagggtggtggttgctgaagagtgaggtagttgtggcaatttcttaaaacaagacaatgaagcttgctgcatcaattggctcttctcttcatgaaagatttctctgtagcatgcattgctgtttgattgcattttacccacagtaaaacttctttcaaaattagggtcagtcctttaaaaccctgtcactgctttaccacctaagtttatgggatattccaaatcctttgtggttgtttcaacaatgttcatagcatcttcaccaggcatagattccatctcaagaaactactttctttgctgatccataagaagcacctcctcatccgttcaagatttatcacaagattgtagcaattcaatcaaatcttctgactccacttctaattcaaactgttttactgtttccaccacatctgcagttacttcttcccctgaagtcttaaaaccctcaaaggatcaacttcttccaaactgctgttcatgttggtattttgacctcctcccatgaatcatgaatcacaaatcccatgaatcagttcttaatggcatctagaatggtgaatccttttcaggaaattttcaacttaatttgactagatccatcagaggaatcgttatctatggcagctatagcctaacaaatgtacttcttaagtaataagactagaaagccaaaattattccgtgatccttgagcaacaggatggatattgttagcaagcaggaaaacactgatcgccttgtacatctccatcagagctcttgggtgaccaggtgcattatcaatgagcagtaatattttggaaggattctttgcttctgagcagtaggtctcaagaatgagcctaaaatattccacaatctatgctatgaacagatgtgctatcatctaggctttgttgttccatttatagagcacagtcagagcatattcagcataatgcttaaggggcctaggattttcagagtggtcaaggaccattggcttcaacttaaagtgaacagctacattagcccctaacaacaaagtcagactgtccttcaaaactttgaagccatgcactgacctctcctctgtagctagagaactcctagatggtatcttcttcctatataaagctgtttcgtctagcttaaaaatctgctgtgtagtgtaggcgcctttgtcaattatcttagctggatcttctaggtaacttgctgcagcttctacatcagcacttgctgcttcactttgtacttacatgttatgaaagtggtttctttccttaagcctcatgaactcagctctgctagcttcaaacttttcttctgaagcttcctcacctttctcaaccttcatagaattgaaggaagtcaggcccttgctctacattaagctttggcttaagagaattttgtggcttaatcttctgtccaaccactaaaactttctccataacagcaataaggctatttcactttctcatcatccatttattcactggagtagcatttttcacttcattcaaatacttttgctttgcattcacaacctggctaactgttcagcacaagaggcctacctttcagcctatctaggctttcaacacgccctcctcactaagctgaataatttctagcttttgatttaaagtgagagacatgcaactcttccttttacttgcacacttgccattgtagggttattaattggccgaatttcaatattgttgtgtctcagggaataggtaagcccaaggggagggagagagatggaggaactgcaggtcggtggaggtgaagtcaagtcagaacctagcacttactgattaggtcgggcatgttatatgagtgtgggtcatggtgcctcaaaacagttacaatggtgacatcaaaaatcactgattatgataatcatagcagatataataacaaaaaagtttgaaatattgtgaaaattaccaatgtaacacagagacatgaagtgagcacatggtgttgaaaaaatggtcccaacggacttccttgacacagagctggcacaaaccttcaacttgttaaaaaaaaaaaaaaaagaaaacacagtatctgcaaagtgcaatgagatgaaacacaattttttaaaaaagtgttcttgtatacaactaactggaaaataagacagtgtaaaactcacatgaaaagctctgcaagtagtccgggcactgtggctcacacctgtaatcccagcactttgggaggccaaggcgggcagatcacaaggtcagtagatcgagaccaccctggccaacatggtgaaaccctgtctctactaaaaatacaaaaattagctgggtgtggtggtgcgtgcctgttatcccagcttctcaggaggctgaggcaagagaatcgcttgaacccaggaagcggagattgcagtgagcagagatcatgccagtggtactccagcctgctgacagagcgagactccatctcaaaaaaaaaagctctgcaggtaatatagtctgaaatatttatcagaggaatgtccaaagccatacagttaagcgttcactgcaaagtagggattcctttttgggagccacttaccatgctccacaaatcaatctcacaatagtctcagtgtaactacactaagtatagttctacttccttagtggaactgtaggaagttatagccaaaaactattccaggttatttgccatttcaatcattggaagtagctatagagacatgtacttgagaacttcatcatttacagttgaatgattttctagaccttccaaatactggattttacccctttcatgaccctttgctccctatataaactttcatcaatgccagaatattgaatgaaatcaccctgaaatcagccatcatatcaaagatggctacaagatacatctcaaaccttcagaaaatggtctgtgctaatgagaaggccgaagtgtcaaccgcaatatgtctgtataggtacctcaaatgtgacaacaactaacaaaaaaaacactctggtacaaataaactagtactggatgcagctaataaagcacatgatactataatgttaaatacatacactaatagaattttctacaattctctgttacgaggtcctttgtaaatcacaggagagtaagtggttttaagattaaatttgcccatatagttaattgccacttcacagcaagtactgtgaataaaaaatccaaattgagctggtttggacctagttacaaataccatttaaacagaacagaaaaaaagcctctatgttgacagggataacaccaaagtggaacacaggcctcatacaaccatctagaatctctcagtttcaccttcgcttcagacatactgaggatttttcatttgagtttttctttccagagcatgtatcacaaacttcaaagataaattagtaaaaatacacacacataatagcataggttgattttatgttttttaagatgaaggttttaaggttatctcattcaatccccttcattttaaaaatgagaaaataaagctccaaaaaggtaattcacacatggctacatgatatatcagagacaataatttctctgttaattacttatacctctgttcaatacagtaatccaaattttcaaatgcaataagttattttacaagcctatcaaaggaacttgctactttaaagacaactggagtactacgaccactgtcttaagagaaggaaaactgagtgggctggttaaggatgcagaggaggataaaatcacagtcactctttgacccaaaatcaacttaatttccagaatgcctagtaagcttgaagcagcttggtgcagctaagcacaaagagctcaaacatttatcaagtctcctctgaagagttctaaatatggggacatcctagtgtgctgctttacatttcttcccagtccagactgcacagaacagaactctcctcaaaatatcccagaaggacttcagaatccattttttcaaatgttttgacacaacactgaaaaggtgcaattattaaaatatcggaaactattatattaattcaaatatgttcagctaccactcattcttcttcctatttttaaatgtggggatcactaagtatctttaaacttagtgtattttcaattttttttctctacagccacagtgaaaggggtggaaagttaaaaaagaaggaatttgattttttatctattagaaggaaggaaaagtttaggtggcattattatatgtgaaaactgaactgtaaagcatacagtatgtgcatcttcacagggtatataatttcaaaaggtgaaaaatgtttaaatagattttaaaattatttctctgcaaatatcacaaaatattaaaagtataggcttgctatgaaagtatctttaaatgttgtgtttctatttttaaaaaatcactttgtcacttgagagaaataaggttgttactttttttctattttccccattctcatatccttcatgtttttcttcattaattacattgtcctttttctgagggtttaaaatattgtgcatattcatgtatccgctgatacatatatttatggtctagctcagctaatgcattggtgaatatgttcacatagatgtatatgtatatgcacacacatgcacataacaagaaagatggcacagtggctaaggctctttctagagtaagactgcttggttcaaattctgcttccaccacttacaagcttggacaagtttcttaacctctcagtgccataattttcttatctataaaatggggataataacagtaagtgcctctaggggtacaaataggactaaataaagatttaatatttatagtgattataacagcgtctagcattgttaagtgcctgcaaataagtgttgaatttttttaaattattttttacttttcttcattctccttctcttcattttcctcatcgcttctactgctacatctttatcaagtatttaaccatcaaatccagccatacagacaaaatttatatacttcctacactcagaaaataaacaacaggacactgttaaccctgatgataatgaatatacctaaaacaaagaagtaagagagcaaaaatgataagcaagaacagaaactatatggcataatgcagtggtcttcaaattggagtagatatgcccctctaattacagtaggaaggtctgtcccttcctactgtccttcagcataatatctattggagacattacattattcagtgatacatgaaatactttagacttacgtttttcttgtaacagttatatattaatcaagatgcaggtttatagtctaatgttgagccttagaagatttttctaagaaacagctaggcatataaatatatttaaggaaatcaattgctagatctaaacgtccataaaaatttttcctaaaaatgacctatgtgagaaagtgcctctcaagtatgatatcctttcccatctctcttctcacaattatccttctctagatttatagggaaaaaaaagtcgtgctcttacacatccccaagaacactgcaggacattgttttgggcagacaaactgtggggagccaaaaaaaaatgaaatctcatatatttttccactacaggtgctctcagcttaagtgaggaccagctccccaagtcagaaaacatcttaccatctttactccttcctagcaatttattccccctttcctagaagaatgaaaaaaaaatagacacaaacatacatacatacatacatacatacataagtttaaactggtttggccttcaaaggaacaaaatcatacaagatcatgatgaataataaagaagtataaatgtgaagactgagaataacgaaactttaaaggactaatggagaattagaattcaagcacgttctctaagacatgggcattctcaaatatattctaacgttctaggtttcagattacatgatcccttttatggagtgctaaaagggcggagattgggaaatgggattaattaaagaacagggaagaggaggagccaagatggccgaataggaacagctccggtctacagctcccagcgtgagtgacgcagaagacgggtgatttctgcatttccatctgaggtaccgggttcatctcactagggagtgccagacagtgggcgcaggccagtgggtgcgcgcaccgtgcgtgagccgaagcagggcgaggcattgcctcacctgggaagcgcaaggggtcagggagttccctttcctagtcaaagaaaggggtgatggacgcacctggaaaatcgggtcactcccacccgaatattgcgcttttcagaccggcttaagaaacggcgcaccacgagactgtatcccacacctggctcggagggtcctacgcccacggaatctcgctgattgctagcacagcagtctgagatcaaactgcaaggcggcagcaaggctgggggaggggcgcccgccattgcccaggcttgcttaggtaaacaaagcagcctggaagctcaaactgggtggagcccgccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcacacagctggagatctgagaacaggcagactgcctcctcaagtgggtccctgacccctgacccccgagcagcctaactgggaggcagcccccagcaggggcacactgacacctcacacggcagggtattccaacagacctgcagctgagggtcctgtctgttagaagaaaaactaacaaacagaaaggacatccacaccgaaaacccatctgtacatcaccatcatcaaagaccaaaagtagataaaaccacaaagatggagaaaaaacagaacagaaaaactggaaactctaaaacacagagcgcctctcctcctccaaaggaacgcagttcctcaccagcaacggaacaaaactggatggagaatgatttcgatgagctaagagaggaacgcttcagacgatcaaattactctgagctacgggaggacattcaaagcaaaggcaaagaagttgaaaactttgaaaaaaatttagaagaatgtataactagaataaccaatacagagaaatgcttaaaggagctgatggagctgaaaaccaaggctcgagaactacgtgaagaatgcagaagcctcaggagccgatgcgatcaactggaagaaagggtatcagcaatggaagatgaaacgaatgaaatgaagcgagaagggaagtttagagaaaaaagaataaaaagaaatgagcaaagcctccaagaaatatgggactatgtgaaaagaccaaatctacgtctgattggtgtacctgaaagtgatgcggagaatggaaccaagttggaaaacactctgcaggatattatccaggagaacttccccaatctagcaaggcaggccgacgttcagattcaggaaatacagagaacgccacaaagatactcctcgagaagagcaactccaagacacataattgtcagattcaccaaagttgaaatgaaggaaaaaatgttaagggcagccagagagaaaggtcggattaccctcaaagggaagcccatcagactaacagcggatctctcgacagaaaccctacaagccagaagagagtgggggccaatattcaacattcttaaagaaaagaattttcaactcagaatttcatatccagccaaactaagcttcataagtgaaggagaaataaaatactttacagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaaggaacgaaatcaccagctaacatcataatgacaggatcaaattcacacataacaatattaactttaaatgtaaatggactaaattctccaattaaaagacacagactggcaagttggataaagagtcaagacccatcagtgtgctgcattcaggaaacccatctcacgtgcagagacacacataggctcaaaataaaaggatggaagaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcgtgagtgacctacaaagagacttagactcccacacattaataatgggagactttaacaccccactgtcaacattagacagatgaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaacctcactaaaagccgctcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactcaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacagacacctctacgcaaataaactagaaaatctagaagaaatggatacattcctcgacacatacactctcccaagactaaaccaggaagaagttgaatctctgaatagaccaataacaggagctaaaattgtggcaataatcaatagtttaccaaccaaaaagagtccaggaccagatggattcacagccgaattctaccagaggtacaaggaggaactggtaccattccttctgaaactatcccaatcaatagaaaaagagggaatcctccctaactcattttatgaggccagcatcattctgataccaaagccgggcagagacacaacaaaaaaagagaattttagaccaatatccttgatgaacattgatgcaaaaatcctcaataaaatactggcaaaccgaattcagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaacacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaagaatcacaagcattcctatacaccaacaacagacaaacagagagccaaatcatgagtgaactcccattcacaattgcttcaaagagaataaaatacctaggaatccaacttacaagggatgtgaagcacctcttcaaggagaactacaaaccactgctcaaggaaataaaggaggatacaaacaaatggaagaacattccatgctcatgggtaggaagaatcaatattgtgaaaatggccatactgcccaaggtaatttacagattcaatgccacccccatcaagctaccaatgactttcttcacagaattggaaaaaactactttaaagttcatatggaaccaaaaaagagcccgcatcgccaggtcaatcctaagccaaaagaacaaagctggaggcatcacactacatgacttcaaactatactacaaggctacagtaaccaaaacagcatggtactggtaccaaaacagagatatagatcaatggaacagaacagagccctcaaataacgccgcatacctacaactatctgatctttgacaaacctgacaaaaacaagcaatggggaaaggattccctatttaataaacggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaaccaaagccaaaattgacaaatgggatctaattaaactaaagagcttctgcacagcaaaagaaactaccatcagactgaacaggcaacctacaacatgggagaaaattttcacaacctactcatctgacaaagggctaatatccagaatctacaatgaactcaaacaaatttacaagaaaaaaacaaacaaccccatcaaaaagtgggcgagggacatgaacaggcacttctcaaaagaagacatttatgcagccaaaaaacacatgaaaaaatgctcatcatcactggccatcagagaaatgcaaatcaaaaccaccatgagatatcatctcacaccagttagaatggcgatcattaaaaagtcaggaaacaacaggtgctggagaggatgtggagaaataggaacacttttacactgttggtgggactgtaaactagttcaaccattgtggaagtcagtgtggcgatttctcagggatctagaactagaaataccatttgacccagccatcccattactgggtatatacccccaaatgactataaatcatgctgctataaagacacatgcacacgtatgtttattgcggcattattcacaatagcaaagacttggaaccaacccaaatgtccaagaatgatagactagattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacactgcatattctcactcataggtgggaattgaacaatgagatcacatggacacaggaaggggaatatcacactctggggactgtggtggggaggggggaggggggagggatagcattgggagatatacctaatgctagatgacgagttagggggtgcagcgcaccagcatggcacatgtatacatatgtaactaacctgcacaatgtgcacatgtaccctaaaacttaaagtataattaaaaaaaaaaaaaaagaacagggaagaacaagagaataaaggaaaaaagcagagagaaggcaaggcaaaatgatttattaggaaaggaagaaaccctttcaaacaaagaaatcctacgttttctctcgatatatcactagaagcatatgcaagaaatcaatatatacttttttaaaagaaaggattaagtagaagataagagaagatacacaggtcatagggaataaaaaattaatagtgcctttccacacagacttgaaacaattctggtcactgaagggcagtaaggctggggaaggtatctcccttcctactgtccttcagtgtagtatctattggagacattacattattcagtgatacatgaaatactttagacttatgtttttctagtaacagttacatattaatcaagatgcaggtttatagtctaattttgagccttactttagtttttatcagcaacaatcttgtataatctaccatgactatacatatgcatcaggtttagtaaagcaatttatgatacagtctccatatgtgaaattgaaagccagaagctaactattattttaacaagctgtcaagatatatagagttttgccaaagaaacattgattacactggtcttttgaaaagtagataaaacttagaattccctaagcaaaccatagttacacaaaattgtcctgagattcctatgaagcacatgactcaaatgctaccaaaatccttcataagtaagatttatttccaataaattatatatctctgttttagaactctgataatttgcagcccattttccagtaacatgtttttatcattttctactgctgaataaaaaagaaattaaaggacaaagagaagatcatgagtgaactatccaaattttattacaatcttgaaaaatacacatccgttgacttcctgttcctctgccactaaatctctgtggggaggtccaacttccaattctctgaagtcgcaaggtagaggaaataaaactaaggagcaggttgctatagctctccaattcaaaagcaaattattactctatttaatacagcaatctactataatctcctccaacactcctgatcctctttacagtactcttttctatagtacttatctcctaacaaaaaaatgtacatatttactatacctattatgtcacttgttgctagaaagtaagcttcaaaagggcagggatctacatcattttgttcactggccaatctcaaatacctagaacagtgtctgacacatagtaggagctctactgaataaataaactattactttaccagtatcaaactccccacctgaggtagcactacctaaactacatgttgttccgattctaattgcatgtgatttttctaatcttcgtgtcattatcatagataagtgtccattgctacaactggaagtaatctgtgcacactgcagccttcattgaaacccagataatacttctgttcgtagctgacctcatttttatggcatcccactgtatagcttgcttcttcactcttatttaggcagtgtcttcgcagtttcctgccttgaatacctcttgtatacatttaccaccttaattatttgctgtgtacattttccttgatgccttctccccactatgacagcagattccctcttctgattttccactgatcagcacggcccttcaaaaaccttcacaaaagcccgttagaaacagattgagagacgcatttgtgaagctatttaacaaatttaagtgtcatttttaaagtattcattgtaaattggagcattgtttcatatcggtatcattggagcattgtttgatatcggtaacttgctttaaactgattaagcacatgtaaagatacatgctaccaatagaagaggatgaaaccgagagatcatctttatggttaatagggagtcagtgacaggaaagtaaaaagactgaaggatgattttgggaagtccaggtaattgtctggttatccctcaccaatgtcttgatccaacccaagaatcactctaacacggcaaaactcaatccttcctgttattttatttgtggcaagagaaagatccctaaaataaaatgcatttataaaatgattgccttataataagcactcaataaatatttgctgaataagttaatggatcaatgagtatttccctatggtttgggaagtttagccaaattaaataccagactttcaaatgtaaagggttacgtctcaaaaatatacctcacccagctgatacacataacacttaaataactgtatctgcatgctcagtaagaacttcatgcattcatatatttaatacatcatcaaagcattgtgagacaactttctaacagtgaattgaaaccatataaaaaactttggactttttgagggtttttggtttttgttttttattagagatggggtcttgctttgtcagctaggctggagtgcagtgatgcgatcgcaactaactgaagcctcaacttgaaggtctcaagtaatcctccatctctgcctccagaatagctgggaccacaggtgcaggccaccacacgtggctcatcaagtgacaacttattctcagtcaaaattcatgggtaaaaataaagttaaaattttttattttaattttgaaaaagtatatattttgtgatcatagctttgattctgctctccatcaaatacatttaattttccatttctccatatttaagcgattaaccccattaaaaaatgggaaactattcattctcaactcactaaaggaagtataaaaggaattaaatacaaagacccactcaaatatagctaatttcattaatatttcctgtgtatcatttcaaaaaaaattactaaaaaatattcctaagattcttcttataatttttatagtttcattattaagaattattgagataatttattttaattagatgggcttttataaagtatataatcaataagtgtttgtagatcccttagttttaaagcttttttttaagtttctctttacccaaaaatataatctggattaaattcaatttactgacccaaagatataaatgagaaattcaaaaccattaacactctaacacagctagatggaatgatgaatgattaagggagaaaccataagaaaacatcaggtaatcatctttctagcatggtctgaatgaaatccttcccatgaaattaaaatttgatacaaagtctatcaggaaaacttctaaactttaagatttgtcaggaaaattgtgaaacactgaaatatgcaaaatattagtggatgtcctatctagtatacccttccagattatctgagtcagtcagaatatgagcctcacattgtctttctgctactttacaaccatgcagttgtaagacacagaataatacaaacaattcttttccataaaaatgcaaataaattgtgtccagtgaaatgaaatggataattggcctgtggctattaaccagttttgcgtctgtttcacattcatttcagcatccttgattgcccatatatgtgtgctcttaaaattctcctttgaattatttgtaacatcttactgatcccctcattaattaatgagcttaataaagtctttgatacccattctttttacatttgaataaaagacatgattttaacctttctttaaaagtatcccttgacagaatctatcactaaaagtatgacttttgatccaccttccataaacaggctttcttaaaatttccattaagtcataagtcatcccattcaaattactcaaaataaaatactgcagcatcaatattttgaatccaaatatgaatgaatccaaagcaccatcattatatgatataagtttactatttatatatccctagaagcaaaaaggctgccaattaaactaagacataatgcttttttatcaattagatttcattttttggatatctgtatcatatattccactgttctgccccatgcctctcatgtagatagatgagtatatattacttatccttctaagcctaaatcataggatttgggaatcatcagaatacctgaagtgcatataactcaattaaactttgacattatgaccacattcacacatgcacagataacaactccatcaaaaccaccacctacccaacatggattttgagtccatcaattcaaagaagcatcccagtttcaggtatgttcaaatatgaaaaaatagacatcttagaatgcataaaacaccacaaatataagtgcaaaaacatatagcaggattataaatggcaaatagcttacaatcagaaaacctgtcactagagggtcatcatttccttaaatagtaacactagaataatccacacagactgctagaaatttatgaatcttaaaactgatagtcaaaatctcaatgaagccaaataactctttagggcaagaaaaggtgagatccttgactgaactaaggttattcaatctcttgtttactaaaacagtggtaggggtggtttggtctctagcagaagggcaaacaagatggtatcacataatggagctggcttaaagcaaaataataaaaatgaaaaaacactcattcctctacttctaagaaaattatattcttcctttttgatgtactgctgacattcctttcctctcttcaatcctagattagttaacagcttgtaaaactgctgttattataatgacaatctcaatcaactacatcataaggctttttgcctaaaggatcatctctccaagttgtaatctctttgaagactaaggagacaaaagtctctcttgaacactaaggtcttttccaaattaaaaacaaaatattctaaatatttatgaacgatatcaatcagacttcctgctaaatattacttcttagtttttagccttttgtaatatgttataaaagtttccattgtctttgtattgttgaaggctacaatattgcctagcacatagtaacagcaaataaatgttggtaaactagaaactgactctcacagtggccttgattctcacagttaacctagaagtaagtaccgcaacaatgtttattcccatttcatatataaagaaactgaaggttggagaatttagggttttgctctaaaatcacagttaataagtggcattgtcaaaactgaatcccaggccctttgtctccaagaccagagcaattcttacagtaacagactgaacatcccatgcctagatttccttccctctctcttctcttacctactacatgatacttgactcaggattctggtttgctgaattactgaaaccacatcaacagtgagtcaatggtaattctctacctggttacatttacattttagcacagatattgtaagataaggtgcagcagagattattggaaatacacatattgacagtcagatagctcacttctagtggaactagaatatttaattttcctgtgtctcaagtcctttatctgcaaaagcaggtgaaatgcagatgatcaataaggtcttttcctaactaaaaacctaacattctaaatatttatcaattatacaaaatcagatcacctgctacattttacttaatactggccttgaaaaaaaaaagaaaactataaaaacctgtctgttagattctgcagtgggccaaaaacagaatatataaacaaaaatttaaatatattccaaccatactacttgactaaggacactgtctgtaccaatttaaaactagaaggttttaaggataaatgagatctatacaggcacaattgtcacagcagtccttctaggtatacaagatactgaaacattttactgacctataacttactttttcatacatggcaaaactatatttttctcattacaaatgccctagctctccccacaaagttattgtgaagtctccaaatattgctaatttgtcccttaaagcaaaaatataaaacactttgtgacatatgaaaaatgttcaccatgtcctttagttgcttcaagatatagcatataaatctttgagtttctaaacagaaccatactatctagatatttttgtctaaaagatttaaagcttaaatgtgctacctttttttctctcttgcagctttcaagtcacttagcctgctccagtctccaagatatacattatttttccaataaatcaataaataaaattggtatttttgactacttcttagtataaatcttgtctttgtatcaacaaatgttcgagtgcattttcattgtatgactaaatttctattaaaaatgtaaataatttctgcttactctatcgagtctttaattaaaagtggtttttaaagagtcaaaagactttgatcaatttttatagaatgcaccagggcacggtggttcacgcctgtaatcccagcactctgggaggctgaggcaggtgggtcactggaggtcaggagtttgtgactagcctgggcaacatggtgaaaccccatctccaccaaaaaatacaatttagctgggcgtgatggcgtgcgcctgtactccccagctactcaggaggctgaggcaggagaatcacttgaacttgggaggcagaggttgcagtgagccaagatcatgccactgcactccagcttgggcatcagaacaagacaccatctcaagaaaaaaaaaaacttatggaatgctatcattctgtcaaaaataaacataatatgctttctgttttaacaaatgaataacttaccattgtaccaccctaagttaccaggaaaactaccctaaattaccaataaaattgttcctcctatctttctcctctgcctctgctctacttcccttcaaaaagttctttactccacaatttccccaaacagaaaattttcctgattctcctatccctctgttctttctgtcactctcttcaagatccttttcctcttctatcccaccagcatccccctttgattctctgcctatattctccttcatcttgattcactccttcacagctcatctgcttccacaagatcaactaacatttccatactgatgaatccccaaagaacatttttagcctttatttttaaccagtctctgattctgtatttccagtttccttcaggatatgtctccttgaatgactggatacactattagaattcaaaacttctagtttctctacatcctcctaatctccttgtatataaactcaatacttggggacatataattatcctatgtaatcctaacaatctaaaatcttcaccatttgctagtccttacacccagaatgaactatgttatctgctttatgtcaccacaggatgctaaaatgttattgaaaatagccactaaaaaatgtagcaaatgtttctaatacaaactgatgagttcacaatattctatgagtaaatataatagagttccctctattttcctactagacatctgtttctgatttttcaatattacaaagaaaactgttatcttatcattatacatattttcatatttaataatatctccttagtgtagcagtccagaagtgaaattaatggggaaaaaagataaaagaattgttaaggttcttgataaatactgacaagcttatttccaaaacaatattatcacaacgttagctccatgagtgcaggaatcttgtcccttgtgcatatgataggcactagtaatacaacaatgataaacagtaagcattcaataaattttatttaaataaactaatcaatcaaccaatcagatctatgaaagtacttacaaatgataaacaaacattcctttatatctttattatatcattatactatatttacttactccccctttaagagtaaacatgtcactgctttgagcaatgaaatacaagcaaaagtggtatgtgatacttctagtcaaaagtttcaagtgccatttatcatgtcctttccctctgtcacagcaacctaaatgacaggcaaaagtttctgttactattatatatcatcgataatttcttatagtaaaatatagcttttcccttaaaacatatcctttttactgatcagaaattcaccgggaactccctcttcagtgcagggggatcctatggtaggaggattacaagtgtgcactgtcattcctaagaaagaatatggagcaataaaggaaattgctaaagtctggaaagcattcttggctttctgctttgaaatgaagctgacttggaaaatcagagaatttgaataaagttatcttagatttcaatgaaagaaaaatgcttcatggagtagctctttgtattactgcacctctagaggccccagaagacaactaaaaaccaggcaatatgctttattttgaaattcagctgtgtgggctgagatgtcaccttagcatgagggtcaaaggagtacagggagagagggtagccagagcctcagtcacaaattgtaactcacacttaaactcatttgaaatgcaataaacaaactaaacagaataagcacacaactacttgggcactcgaattgagttttttaagaaattttaactgttattatctaaatgctattagataaggaatatttctttcacaaatacagctgaacacattgatgtttaagagttttagtgcaaattccaagaactaaaagaaaatagaggaagacaaattagaaatgagaagctaacttaatgccaacaaattaacctttcagaaagttagaaagaaagaacaaaagagtcaggctattttattattgttttgtttatacttcataagcaaaggtattcgtgggagattttttaataaatgttttccttgtctttttttttaagtggttaaagaagaaaagttaactaggagaagataggaatgacagcagttatttgcaaatttttccacaaggaaaatcctatcaaaatccttctttgatattatttgtccttataatttgttcccacaattgccaaaaaaaaagattacagtcaggttgcatgattatctaaagcccaacatgatgttctatgtttttatcacaattcaagattactgcatttttcctaccataatattaattaatggtcaatataaaaatatggactatattgaaccccaggcaaaaggaaaaaatacacccacaaaactgtaagactatgacactagtaaatcattattcagcattttagtatagttccttctcatatttttccaagccatgtttttgcttgcttatttgattctatatacatgcttaaccatcttattcatttatttatttaacagcataatctttttccatgttaccataaactcttcacaggcttcactttaggtatggtattccatcaagtgtacattccacaatttatattttgacttagtgctggatagttgctttcaatttttgtaccattacaaataattctgttaggaacttattaaacataagcctttccaatatttcaaattcttttcctaaaatacgttcctcacaactgaattactatatatcaaaaacaataatcaaaattaaaagccaatatggtatctgggatttggtacaaaataatacagattggggaagcagatgggagttccaagtgaagcacatttaatttttttcaaaataaaacattcaaacaaaaaattaaaagcaaaaaaaatcatcctgaaatacacacacacatacacgcacacgcacaggaacacacattctagcaaagatgaaagtatttttatggctcttgctacacattgccaagttgcttccctaaagagttgtaatcatttttattcccaatatatagcttaaggtttatagtgaaggcttttttaactcctcttttctttgaagtctttgtttgtacattgactttggcatgtctctgcaacctactgcaaatttttcctattgagatatgttcctgagttttcactttattctggagactggaaatcgctcttatgatgctctttgctcatcatgcaaacttgattccatgtagaataatagttggataacagtacaatgatttacctacaggaatgtttttcatattgtttacaaggcaaaaatacatttaacataatgtttagtaaaaactggaaacaactgtttctgtatcacttgcaacgtcacagcattccttcaaaatgtatttactgtcatggaaaaaaataatttgccactataatgttgagtttttaaaagtaggctataagattgtttgtatgaacaattccattttatatagatcatacacacacacgtgcacaaacacagagataaaaaaaacctggatgtgtatgtactatagtatcttcttggggagttgataagtgatttttacaaacatctttatacttatttatatatttttattttaataataaatattctaaatgtataatttttaaatcatcaaccaaagtaagactcaaagtataaccagtaattgtttgagcaacttattatgtacacatgtcaatttccagcttgcttacataaatagtctcccaattggatacatcttagtgaatttataatcattaaacaaagtaatgaataacatgatcatcacctgaataagattatttttcttctaaattttcaaaacacagctttgtgcccaatggttttccaaaactgcctcatattaacaagaaaattttggttcaaagtagagattaggaaattaatgaaccaatgaaacacagttaattacatccagaaattaatgatcaggatattaaaacttggaaaatatagaaataatggttttcctttattaaaaattttttttgaattattgtgaatacataatagttgtatttatgaggtacgggtgacaatacaagcatacaatgtgcaatcatcaaatcagggtaactgggatatccatcatctcaaacatttatcatttctttgtgtgatagagcttttcttaactagaagttcaacgataaaatgtgcttacagacctaactaaaaccctatcatgtccacctctaagaattctaatacagttcgtctatagggccctagctctgcccctgccattaagtttgtgtgaccgatggcaaggtctgcatctccaaaatcagtattttacatcagttgatttctaaggtcttcgtggctctgtggctatatatacacttaaaaagaaactgaaaacaaatctgatcaataaagaactttttcatgacatatggtatgttattctgcagggttgccataacataataccaaacacgaggtggcttacaacaacataaaggtattctcacagttccggaggccagaaatctgaaattgaggtgccaggaaggctatgtccctctgaaggcagtaaggaaggatctgttccatgcctttctcctagtttctggcagcctcaggtgttccttgacttgcacatggccatcttctgcctatatctcttcacatcatcttccgtgtgtgtgtgtgtgtgtgtgtcccaatttcccctgtttataaagataccattcatattggattaggacccatacaaatgacacctcattttaacttgattacttctgtaaagacccagatcttcaacttttctgggggggatccaactcaacccataacatgtgacatgctggttaatctctgttgccctctaaatccattccctgctcctttctgctccacatcccagaggctaacctctgtgaactgcatcatccatgcttctttaatttctagcttcaagttggcaaatgggaggcacctgttcaagatcacaagacaacagaagagagaagggagggtatttgttgccactccatacccccaccaggccacttttttggtagcaactacattcagctatccacagtcctatttccctgtccactagccccgctcccataattctagctctcaccagaatgggtaattccattcccacctctttttccttctgccatcaggctatgatgacatcccactgttgctagtccctgggcacttcactattgttcaatggttgcattctgcactaccacccatccctctataatgaagtccattcattaaactctcttcattgtccccattgaatgtaccgtctgtttctcaccaaggccctatctggtacacagggataagtcaattctttagagtatttacataatttgtttatcaaaattctaaaaagtagtttagcctcagcatggctgccacaaattgagatttgaaataattggtagtaaagacatcactttctgtcatatatacatttgctactgttttgctcctttcctccttcacacttatatcttaatctagaaggatatggcagaggtcaggagcatggattgtgaaggcagactgcttcactttgaatctagcctctaccacgtactagattacataagtccagttaatttacctctctgtacactaataaaatgggcataaaggtaataatatacaaggccaggattacaggtatagcttacacctgtaatcccaatactttgggaagccgaggtgggagaatcgtttgaagtcaggaattcaagaccagcctgagaaaaatagcaattaccttgcctctgcaaaatatttaaaaatgaaaacattagccatgcatggtagtgttgacctgcagtcacagctacttgggaagctaaggcaggaggattacttgagcccaggagctgaatattacagtgagctatgaccatgccactgcactctgcctgggcaacacggcaaaaccatgcctcataagtaaataaataagtaaagtttacaagtcacaggacagctatgtgaaatatatgccaaattacttacattaattttttaactattaaatcaattaatctatataaagtgcttagaacaatacctggcttgtagtaagtgttctatgagcattagctgctattattatgattaatttttcctctgatgtttttcccttgacctacacattaagtcactctagcctcaatcatttttacacggaccctacccaaccaatcaaatgtatgctgggaatatacaaaaaacacagccaactcttttttattttattttattttttcccgaaacggagcctagcttgtcacccaggctggagtgcagtggtgcgacctcgcctcactgcaagctccgcctcccgggttcacgccattctctcgcctcagcctcccaagtagctgggactacaggcgcccgccaccaggcccggctaattttgttcttgtatttttagtagagacaaggtttcaccgtgttagccaggatggtctcaatcatcttctgaccttgtgatccacccgccttggcctcccaaagtgctgggattacaggtgtgagccaccgcgtccggccaacacagccaactctttaaattttcctatgtaaactacccattgtccaaaagatcagtaacacctgtcactcctgccataatgggctctctgacccctatatggtgtacatcctaagtcctcaagtgttttatttgcttacgacgtatttttgataattctgctctcagtcaagattctgataaatcatcaatcccctacctgggctatttcagctatatgtcaaacactacactcccactcacttcctggggtctattccggcttttaaaagacagttttcaaacccctacttcagccaaagaaatggtccttaatagtgattttcctcccaaaatatgtgtacttagttttgtttaattgtttggggatggggaggggtagtagtgtttgagaccaggtgtcactaaaaaaaaaaaaaaaaaaaaaaaattaaaaattaaaagaagacatttatgcagccaaaagacacatgaaaaaatgctcatcatcactggccatcagagaaatgcaaatcaaaaccacaatgagataccatctcacaccagttaaaatggcaatcattaaaaagtcaggaaacaacaggtgctggagaggatgtggagaaataggaacacttttacactgttggtgggactgtaaactagttcaaccattgtggaagtcagtgtggtgatttctcagggatctagaactagaaataccatttgacccagcaatcccattactgggtatatacccaaaggattataaatcatgctgctataaagacacatgcacacgtatgtttattgcggcactattcacaatagcaaagacttggaaccaggccaaatgtccaagaatgatagactggattaagaaaatgtggcacatatacaccatggaatactatgcagccataaaaatgatgaggtcatgtcctttgtagggacatggatgaagctggaaaccatcattctcagcaaactatcgcaaggacaaaaaaaccaaacaccacttgttctcactcacagatgggaattgaacaatgagaacacatggacacaggaaggggaacatcacacactgtggcctgttgtggggtggagggagcggggagggatagcattaggagatacacctaatgttaaatgacaagttaacgttaaatgacaagttaatgggtgcagcacaccaacatggcacatgtatacatatgtaactaacctgcacattgtgcacatgtaccctaaaacttaaagtataataaaaaaaattatcaaatttagtcgctttttaggaaagggtaaggagttggggagagaacatgggaaaagaaatcctcattgatctttgcaaattataaaccatctttttaaagtaaaaataaacacacacaaaacttatttaaaaaattcccttacttggcttagcagaaatatacctcagttacgataactataatgaacaaaaagtgattactgttactgtataaaatggccctgagatgtagttatgtactatatctgtgtatttatataagtacatttatcaatacatcagaaataactagatctcaagaaaggttcaacttagaaataagagtacagtaggccatccatatctgtgggttccacatccatggattcagccaaaagcagatcaaacatatttgggaaaaaactgtctgtactaaacatgtacagacattttttccctcttattattccctaaaaaatacagtgtaacaactatttacatagcatttacattgtattaggtgtcctaagtaatctggagataatttaaagtatacaaaatgatgtccataggttatatgcaaatactacaccattcacatcagggacttgagcatctttggattttggtacaattgagaggtcctggaaccaattccccatggatatgaagggacaactgtactaagtatgagctaagagtagtagcaggaaagttcataagtaaaaaaccagattgaccaaatagcagattaaatcactgatcagcagaagacccaagtggtcaaaagcacagcccctgaggcgagaaggccctggtgtaaatcctcaccccagcacctactgggtgaccttgggcaagtcacccaatctctatgtgcctcagtttcctcactgtaaaattacagttcttacctcacagtgctattggaaagattaaatgaggtaatatatgtaaagtatttagaacaattcctgacacatagtaagctcttaaaaacttttagttctaaaatttccaattctatatacagtccagaaatatattcagttctgtaaagatggtattcattttaaagggaatattttgttgcagtttttggcttcttttctcctacttatgtgagtcacactgctcatactcacttaagcataatacaagtcattttacagaataaatgttcaaagatggctggtatgtatattgaaaacaatatgccaactcctgagttcatgtctagacttcctcgggattacagagacggtaaggttaattacccttttaactatgatcattgtttattaccttgctttagttttgagaaaaggacaaaacattctgagtatatgcaaaaatattctagttgacaatatattcattactgtttatgacctctagtattctttcaaattaagtaattaagtatttaaacaaacactcccgaagtagaagcaaaaatcactttctcagactatttagcacttcttaaaggtctccaagaagtagtacactccaattaatatttatcctcttcctcagagcatcgatgcttacactgcctaagggaaacctgttgtcagctaaggcaaatgaggttaataacaggatttggctaagaagaaaaatatgttgcactttagagaactaacatctcatctcatctcaaatacgctaggagaataaagaggccaggaaacaaccaattgtaaaaatattagtaaataggtaacaattaaagtcattctttctcatcccaactagatatactaatggccataattactttttacttacattagtattacctcaggggatctattgttttcttataaaagtcagctgagctgtacagcttaaccaagataatctgctatattagtttccaagtatagaaagcatatgtgtaaataaaacatacatccctcattgttacctggatgttattaacccttgcttcccaacaactaaaatatccacacagggatttacttacaaaaaaaaagaaatatgcttattaacctaattatgggtatcacataaatacattgtatttgcccatttattattattatagcaaggctgtaggggccatactatccatattggatggctagtttctcccagtagccatcaagaagcctaaaatttcatcatttgaaatatttttaagtcttgacttttagaggagagagaactataaaagagaatgtctagagttaaagatagaacagcagtctaggactcatatgcaatataagaagaaaatggaatcagcagaagttctaagcaggaaagtgatattatccaaatcatgttggaaataaatctgctagcaatgtggaaaatgtactagagaaaacatatcatagtcaaagaaggagagatctatgtggcacctggacttagtaaatggagaaaagaaaaatattcaatagatatttttcaggtagacccaaaaagactctgtgtctaactggatacagatgataagaaaaacctagaagttaaagatggaagtgactctaactttgacttgtgactaaatatgatggcaataatcaaaatagtaaccagaagaagaaaaaaagtttggtatgggctaggttgggtttgagaagtctgaggaatatcatcatacacatatatccaatggagagctaaaattacaggtatgatgcttcaaaaagaaatcaggtaggcaagaagttaagagcagtggacaaagggaaaagagaagagggccatttctgagggctctgttctgttccactgatctatatctctgttttggtaccagtaccatgctgttttggttactgtagccttgtagtatagtttgaagtcaggtagcgtgatgcctccagctttgttcttttgatttaggattgacttggcgatgcgggctcttttttggttccatatgaactttaaagtagttttttccaattctgtgaagaaagtcattggtagcttgatggggatggcactgaatctataaattaccttgggcagtatggccattttcatgatattgattcttcctacccatgagcatggaatgttcttccattcgtttgtatcctcttttatttcattgagcagtggtttgtagttctccttgaacaggtccttcatgtcccttgtaagttggattcctaggtattttattctctttgaagcaattgtgaatgggagttcactcatgatttggctctctgtttgtctgttattgtgtatatctacaactatctgatctttgacaaacctgacaaaaacaagcaacggggaaaggattccttatttaataaatggtgctgggaaaactggctagccatatgtacaaagctgaaactggatccctgccttacatcttatacaaaaattaattcaacatggattaaagacttaaacgtcagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtcaacaggcaacctacaaaatgggagaaaattttcgcaagctactcatctgacaaagggctaatatccagaatctacaatgaactcaaacaaatttacaagaaaaaaataaacaaccccatcaaaaagtgggtgaaggacatgaacagacacttctcaaaagaagacattaatgcagtcaaaagacacatgaaaaaatgctcatcatcactggccatcagagaaatgcaaatcaaaaccacaatgagataccatctcacaccagttaaaatggcaatcattaaaaagtcagggaacaacaggtgctggagaggatgtggagaaataggaacacttttacactgttggtgggactgtaaactagttcaacccttgtggaagtcactgtggtgattcctcagggatctagaactagaaataccatttgacccagcaatcccattactgggtatatacccaaaggactataaatcatgctgctatagacacatgcacacgtatgtttattgtggcactattcacaatagcaaagacttggaaccaacccaaatgtccaacagtgatagactagattaagaaaatgtggcacatatacaccatggaatactatgcagccataaaaaatgatgagttcatgtcctttgtagggacatggatgaaattggaaatcatcattctcagtaaactatcccaaggacaaaaaaaccaaacaccgcatgttctcactcataggtgggaattgaacaatgagaacacatggacacaggaaggggaacatcacactctggggactgttgtggggtgggggggaggggggagggatagcattaggagatatacctaatgctaaatgacgagttaatgggtgcagcacaccagcatggcacatgtatacatatgtaactaacctgcacattgtgctcatgtaccctaaaacttaaagtataataataataaaataaataaataaataaataaagagaagagggccaaaaaaggaaccagcaaagcatacaaagctaaaacagaaccaagaaaaaaggatgtaatatacaacaaagggccagaaaacttcaaggaggaagaattcatactgtccatttctgctaagagatgaagaaacatttgtatcgtggccattggatttagcaatgagaagatttgagaatttttccaaagagtttttgtagaatattagagatagaagtctgattttactaaactaaggcagtaagtgacttaaggaattgaagaggactcacagatatttcttcccagaaatatctctttccagatgtttggaaataaacatcagtactctttccagatgcttggaaataagagcaaaatgtactgatttacccgcaaatcttgacagattctagggaatgcaagtctctgtcattattgtatagaagagaggagaaaacaaaaggtaattaaagctgactctaaagtctctaaatttgattcatgggtatagatataaagattccataactttagcagcaaggtccaatacagtagccaaaagccacatgtggttactgaacacttgaaatgcaactagtccaaactgagatgtgccaaatgaaaccaacaccagatttttaagaccttatttcgaaaaatgtaaaatatctcattaatattttaatattaattacatgtggaaatattttagatctattgggttagaaaatattaaaattaaaattacacttgtttcttttctcacttgtttcaaagtgttagtagacaatttaaaatcacatatatggctcacgttatatttcttttgaacgtccctgaacattcaaaatgttatcctctagaataaatactaaactggaagaacaggattcagaaaggttccatcacagccagcctatatatatatcatattagtgtgaaagttaatgaaggggacacccaggacaacatcatgactttaagaaaataaagtcctaactaattaagtggcttactcaggtcacctagctactggaaacaaaacccagactagaacctagtccgtgggtatttcctctattattccacctcttgaaatgtcagtgaaaatttaactgttatatacgatcttattctgtaccacattcaataaaatgacttgtaaaaaaatcttaaaatcataatctccataagagtatcctttgttcaccagtcaacttgtaatttaactaatattgttaacgtatgtcaactcacgattcagttttgttgtgttttactttgggcatgtatatatatactctgaatttatttcaaccaattccacatgaattttaaagagaatatcctcctttcaagtacacatctctttaaaaaaaagttctaagaaaacatatctggaaaagttcagagaaactactctcaaccattattatctgccatttgatagtggtaacttactaaggcatcatgttgctcattaatgtaatattcatacaaaattaaaagttatattcaaaatatagctatagtatatgatgatatactgtatttcaaattctggcaagatttaaaatcctgctttgcccaataaaatcttcaaagacactcaaccattatgttgtaggtaaaccacagttccagaatcaccaataattgtaaccaaccaaaatatttagctgtaatttcttcaatatactccaacaactataaatgtatttatgcttttcattaagaaaagacacaattatttaaaaaattagtcttttcatgctaactttccatgtgaaattgaaaagtaaacatcacttgaaactttaaaacttaattttatgagacatcttaataagctaataactgttgtagtcatggtagttatttcctttgtagaaatactgctccaaaaatagtgctatgctgagtgcagtggctcatgcctgtaatcccagcactttgggaggctgaggtgggtggatcacttgaggccaggatttcaagaccagcctggccaacatggcgaaaccaagtctctactaaaagaaaaaaaagaaagaaaaaagaaaaaaaatgcaaaatagtgctgataaaaatgaatgaagattatttgattaagcaacatgcttaattttgtacgtataccctatatttattttaacaaataaaactattattgtcattccaaaatgacattattaaaaataataaaaataaagaatatcagctccacttcttgaatatttgctgttatttcaatgttatcacatagataaaaggatggtgaaaatctagctaatagagttagctatgcacagggtgactatgcttccaaagaggagctttccatggcgatctgcatgtcttcttttctttgcctggctgtttgtggcccctcttcacataactggagttagtgtattcatctattccaaagttattccatctggactcctatgtggcagcctcccccaaaatacaaaatacaaaaaaatacaaaagtacagagccagatgtcactaagacctgagctttaccacatccttaaaagttttcaagttttccttggttgtatatgtccctttttggcttactatatagcagatgctaagtgtcccactgttgactgttcttagcaaggcgtaatccagcatggagctacagagaatcactgctccttcaatactggcagactgaatgacattgttggtgtttatgtcaacctacttcatgttaagaataactgacagttgatagtcatgacattgcataaacatctgtggtagattcaatatcaatattctagagaatatttgcaataagcagcatttaacagcatttgttcagccactatggaaagaagtttggagatttcttaaagaacttaaaacagaactatcatttgacccaccaaacccattactgggcatatatcaaaaggaaaataaatcattctaccaaaaagatgcacacactcatatgttcatcacagcactatgcacaatggctaagacatggaatcaacctaggtgcccatcaacagtggactgaataaagaaagtgtggtacaaatacaccatggagtactacacagccataagaaaggatgaaaccatgtcctttgcaacaacatgaacgcagatggaggccattatcctaagaataaattaatgcaggaacagagaaccaaatattgcaagtactcacttaaaagtgggagctaaacattggtcactcatgaacataaagatggcaataatagacactggggactacttgagtggggagggaaaaagggggaaaaaggttgataaactaactattggctattatactcactacctggatgacgggatcaatcataccctaaacctcagcatcacacaatatacccaagtaacaaagtgcacatgtgccccagaatctaaaataaaagttgaaattactttttttaaagtccacaatatgataaagtgtgctaaggaatcatacctccttgaaaataactaaaaacatcacttctcccatttataaagcaaaagtgaatattcaaagataactgcaggaggttaagttcattagccaatattcccctagcacctaaggcagttttccgcttttttttttcagtatgctcttattactgcctaattatccatattgcttttcttcctttttgttaaactgaaattcacccaagcagtttaacctttcatttagaatcattaaatacactcccctcccctcactgataattggcctctttctttattaactgatttccccccttgatttattacaaaccttttttgccaaatttggatccattctgttaatacattctttaccttcttgcaactcaattaacacagtgtcattgttaccaaagctttcctattatttcttcaagttcttattgctctttaaagatcatctagtagaataatgaatttttaataaacccggaatattttaatgattcttacttaattctatggtaaaatttatgtgagacatactattcttcacactgaaatgtttcctactgtactgtcataatactatacggtaactttctagcaatccaaatacacaaatccttgcaatataacttatgacttctaaaagtacagaaagccatattataattatcatatccatagctaaatcaaaccaagccagcttcttcaacagcagttccaacatccatacaatttttaataaagtgaaacttatacttgtgccatcagtaagtattaatgtaacctctgagtatgagtaaacctgtcactagattatgcaaaggaataacctttcatgggcccttgaggtttctccttaatggaaataaacaatttttttaaaaggcattcctgttctcttcttggaaagaaatactttcctgagctccaaggcactgataaaatttggtgggtgtcgttttaaggcctttccctttcttatcagctaccgacacatttcccagccttgccacctctactcaccaaaacagtgccttttttttttctaaaaggaaaagaaaaatgaaaggtatctactgaccttggatcaaataaggttatgtttaagtttagtttagagatttcttccacttttccaagacctaaaatatgaagcagaatatagactatggtatctttatttagcaagaaccagcggacactgtgtttaccagtgggaaacacatcttaagttgacaagagatatggagataaccagaacaaaattaaccattagaatattaaaaactctactcccagaataaattacaaggaacaaagaaacaaagatttctaccactatcttattttgagtaattttaaataaataggaaaggattttgatctcatccttctgtaaaacgtctacctgccaacatttatgtttgcaattttcaataattgcaactacagacataatctttataagtatatattcatttgatgtctttcaccaataaagacctggtgttccaagtctcctatctgttccagaatttctatttcatgtgccaatatagctcttctttaaaaaatttcaagtcagttttgactccaactttaaaactatgcaacatagttttctgatatcctgagggattaattcttatgttgaacttcctaacaattccattttgatccctaaagctattttcatgcattttttaaatgaaagagaccttaaagatcaactagtctgtacctcttattctgcagatgatgcaattgatccaaggaacagttaaagtaacctgtgcagggtcactcagccaattaaaaatgatgcaactcaaagtagaaacaagatgtcccaaagcctagacccatagtcttgcactgaagaactggcaaatagaggctttcagatttgtttcacagaaaagaaaataatactttttaaattagtcaattatgtaaataaaatcggtgttttcaaacacttaataatcttttgtaaaagtacatttccttgtacatagtaaacgtggttttagaactgtttgtattttttattgcttaagatgattttctattggcactgtaacaaattacagcaaatttggcggtttaaaataacatttgtttattatctaacagctctcaaagacagaagcctagtaggtttggctagatcctcttcttaagatctttcaaggccaaaatcaaggtgtcagtgggactaggtccttctatagaaatcccaggataatctatttccaggctcattaagttgttggcaaaattctgtgtagttgtaagaccgaggtacttgtttccttgctgatctttgattgaaggttattcttaccttctagaggcagcctgctttcctctgcccatggcccctgaatcttcaaaggctgtaacaatgtgttgcatccttcttgtcctttggatctctcacttcatatgctgcacttccctaactactacttctgcctctgtttctaagggctcatgtgattgcactggacctacatggataatccaggataacctttattttaaggtcaactgattagtagccttatttacatctgtccctttggcaatgtaaagtaacttattcatggatatatcatcttattatattcactatccagggaattagagcatggaatctgcttggaaaccaaagttctaattattacatttagctcatatttattgatgcatccttaaggaaatgtgactggttttctacagatcacgttgttcaaactctaacaaaataaataactttgcattcctaatatttatatatccatttccaggaatggctctgattggccctgcttaggtccagtgcccacccctctaccaaccaccagggctggcttcatggcaatgtgaccagtgcagtcacacataatcctgggctcagaagggaccccacatttggggcttaatgctctgaagctaccaacttgaaattcttaaccctttgaatttgttttgtacatgaagtccaatagaacaattgagcatgtgccaggggcttgtttgtctgaaaaagaatgcatttctctttcattttttaagaatatttccaacaggtacaacattctagattgacattttttttccttttaccactttatagagatgtcattcagttatctcctgtcttctatcagttgaaaagtaggctatatttttgcttctttgaaggaaatgtcttttttcctttgaagacttttatcggccggacacagtggctcatgcctgtaatctcagcactatgggaggccgaggcaggcagatcacctgaggtcaggagttcaagaccagcctgaccaacacagagaaaccccatctctactaaaaataaaaaattaaccaagtgtggtggtgcatgcctataatcccagctactcaggaggctgaggcaggagaatcgcttgaacactggaggtggaggttgtggtgagccaagatcatgctattgcactccagcctgggcaacaagagtgaatttctgcctcaaaaaaaaaaatagacttttatcttctttggttttcagtggtttgactgccatgtgccctaaatgtgctttcattgtatttattccaatagtgctttttcattctgtggattgatgtctttcattgattttagaaaactcttggcctgaatctattaagataatgcttcttcctcaattcctactctcctattctcctgggactccaattagatggtagtcagccttttccactattatattatttacactattgattgtgtgttccattcttttattcctcccatgcactattctatatattttctaattgacccatcatccagttcactaattctttcctcagctgtctaattttctaataaactaatctattgagttcttcatttcagtcacagtttttatttctagaatttctttaaattatttttatggattcttattctgtgctgaaattatccaccttttcatcactttaaaaaaatattgatcataatttttttctgtttttggagagagggtcttactctgtcacccaggctggaatgcagtggttagaccatagctcactgcagccatgatctcccaggctcacattatccttcctcccatctcagcctctgtagtagctagactacaggcatgcaacaccatgcccagcttttgtttgtttgtttgtttgtttgtttgtttgtttttggttaagtagagaccagggaagtcttgctatgtcacccaggctggtctcaaactcctgagctcaagtgatcctcccacctcggcctcccaaagtgctaggattacagacatgactcaccacacctggccaattacagttatttaatagtccatgtctaatcattccaatatctagattactgtgagactgtttctatcctttcttgttttatattgtttttcttggtcctggcttctaatatgcatggtataattttttattaaatgccaagtgttgcgtataaaaaaattatagaaactctgcatgatgtctcttgcttccagcaatgacagacagttgaagtaaaggcagaccaccttaaaatcaagattgggtttatcaaagaatacattttgatttttgtaagtagtggcctatttatagttcttcctaactcctaggatatagccccacaagaattccaatgaaaagcttagagtgttttaccagggtccttcttcctccttcctgaattttagcttgcaggcactgtgaaactgccaaaagttctgctcatcctgtcaccatcttagctattgctgcttggtttctcagcttggcctgtgttgcttgcaaattgacagaacccaaggtgaaaaatgacaccaaatacagggctcacttcagtgtgtttcctttcattcttagatctttagctcttggtagtgctccaatgcctttagatatatatatttttctaatccagtttttttcattattcacagtgtaggccttagtttgaaataaactagtccatttacagccagaaatagaaatcagccactgactgatctgtggcctatctttatgtatgcctctatatcttattaattccaaaagtatttaagataagttgacacccttatatgacggttgatttgccttgtgttctatttcctgcttgaaacctaaactgttcactactctaatatcctaattaattttgttgtaattattatgtaaacttacattcaaaatgcttctcctcgatagctaaatctgactccttacatataatatttaacgtgtatttgggaggtcctttgcaaatgccgtcttgtacttactcatttttttaaatataagaaacagcattctcagagactagattatttcagagtaaaaatgaaaacatttataaacataagcactagtatttaatagaatgttgcctgtataattttgttctttgaaaacttatagttacctctcaaaggatataaaatttataaaacaggatgagcagaagctatgtataactcctatggttacattaacacaaaatctcggtaattcaaaattgaaatttattaaacatttctaagatgtaatttgtctctgaactaagaaaatgtcttattacataattaagtgtataagcattgtgaaggcagtttatcctactttaaaaaataaattgctgttaaggactgtcttaaggataccaacttttttttttttttttgagatggagtctcactttgttgcccaggctggagtgcagtggcgcaatctcggctcactgcaagctccgcctcccaggttcacgccattctcctgcctcagcctcccgagtagctgggactacaggcgcccaccaccacgcccagctaattttttgtatttttagtagagatggggtttcaccgtagccaggatggtctccatctcctgacctcgtgatccacctgcctcagcctcccaaagtgctgagattacaggcgtgagccactgttcccggccaaggatatcaactttttgtatggctatgaacagcatttaaaaatcagtttaatctatatcaaataataagaataataatacctatactatctcattttatttattttaaaaatgtcacttgtacatatacttagtaatgactgcaaattactatggataattgaaagtaccaaaaataaactgcaacacaggatttccctccccagcattttactgtcaaaaaaaaaaaaaaaaaaaaaaaaactggaaacctaggtacttcatcctccctaaagaatctttcataaaagtcatggtctttctacatttggttcctaaatgtactacattaactacaaactcagaaaaatgtttggccatagattttaaaaattgggaatgagtacagatagaacagataagtatacacaattatattttcccagctcaattgataactggcttttaatacaattatgggtcattattcagtattattattactgtggccaaaacatgaaattccatttttagcaggttccaattaatttccttggttggtcaaggaacctttcaagatttacaagcactcaagacacaaagcatctttcgtttttcttttttcaaatgctctattctatttcatctatttcccttgctcaaatctttatgactctttgttcatacttatcgatagagaagcagccaccacactggccatctatcagaaagtggtaatgagtttagcatgacaaaaaccagctgttgaaactgctgtattatgcacactgtatgttcataatacagtaatattgctattaatgaagagactgctatgtatttcaggaaccactgtatcagaaattcaactacagaaatgggagtaaaataagagatgtagacataccagggccagaatgacttctttggtgagaatcaatgttattcaaccatagcatcgtaccacattatatggagacattataggatgatggttaagacacagctttgatgtgaggcacttcaagcctttgctctgccacttattaatatttactatgtccttaagcaggttatttagcctctctatgctttagtgttctcatctataaaaccggggataacaatacctactttactggtttttcttaataagaatcaaataaaagtgaagttagaactcctaacccagtggctaacaaaaaaataagcagtcaataaacactttaaaaatattatgttttttttttttctctccatagattatgtgtctttttctctctgcctttggacctgatcactccgacactcttaccaacaccaggtgtttattacctatctttagaagtctacctttgcttcataggaactaccttagtgttttccatctcagactttgggattttatcttagttcacttcagacatactccagggatacagcagtgtacaatgggaaaagatttagacgtagtgttatcaaatagaaataaaatgtatgtcacatgtgtaattttacattttctactaggcatatttaaaaaggaagaatcagccagatgcactgcttatgcctgtagtcccagccactcaggaggctgaggcaggaggatcacttaggcccaggagttcatgcccagcatgggcagcatagcaagacccaatctcataaactaaaactggaagaaaaagaggaaaaagaaacaggtagcattttagtaatatatttatttgcatgaatatatccaaattattatgattttaacaagcagcaatcaccacatttcaagtgttcagtaactataggtgcttgctatattagacagtacaggcttagagtcaaatgaatgtggattcaaattctggccttgctttttacttgccatgcacttgctgtaaatctgtttcattatgttaaaaattactatctccagatattgtgagaattaaataaaaacagcatactcaaagcacttagcacaatgcttacttacaggcatgctcattcaatgagaattccctcacaccaaccttctactatagaactgaacactggctcaatacagtgaaatctgtgatccagattaagaggaaaggaagagaaaggaagccccccatcgtccttcctttctagctctctataaactgtggccatttctcccactcacacagctctccttctttgcttcctagcagctataaatttgactcggtagacttatttctagaatccctgaacccttgtagtcatgacccaagtatgtggttccaagaaactaaaaaaaaacccatgcctgaaagagaaatcctaccatctctttcttctctgcccctgtggtatccacctccccagctggccctactgcctagtcagacagagtttctcctttattcaggggttctcactgctgcagcttcctcagcctcagcaactgccattaacgttagtgcttctctattgaaagagagtctggcatcaaacattaaagaggctgagcagcattctgcaaaataactggacagtacccttcaaaagtgtcaatggcataaaagacaaagatcaaggaactggcatatactgaaggtgactaaagagacataaaaaataaaaaatgaaaatatgggatcttgagtaggatcttggcccaaaaaaaggacattagtgggaaaacaggtgaaatctgaataaggtctagacctattcgtctaataagattagatctaataatattctactgatgtcaatttcctggtttcaatacttgaactatggttctatataatgttaatattaggggatttgtgggaactctctacactatttttgcaacttttcttcaaaacaaataaaagtaaaattaagttaaaacacttttaaatgtgattatttaggactttattatgaaagaacctctgtcccgatggacttgttaagtgatatattattgtgaaatagtgcaacttatgttaagccaggaaggccatcacacaggttaacgaaaagtcaattccaaggtatagaaaattcaccttactcaccactatgagtttgtaaatcactaagagagtatgatgccacctacatatactatagtgaggacttgatgacagcaaatcatattttgtgcaaccaataatgttattaaataaatgtagctactgaataacatacttaaacaataactccactgtgaccaactttttacagaaagaaagagacagtgaaaaataagaaagatatgcaaaaaaataatatgcacccacctccctctgccagatctcccatgctttaggaaacaacactggtcaaccaactctgaacaaaaccccttgcaatagaaaggacagtctgctttgctatatatgtgtttctgtaacatgaattaacatagacaattggtaagtggagaaaagatttcagtgtaatgcagaagttacattggttcctatgtaatttttttcccagatgattaatgttttgccttattagtacaggcaactgaaggctacgtatactaatggcagcaaaccaggaaggaatcagtattatacattcagcctttctctgagaagtgctactgcaaagttaaccctgatctttgtttataaataactaaataaataaaacaaagtaacacaaaacaatgaggagagcatacaactctggtatcagtacattttgtacaaagcttacaagcttttctctatttatgacttgtaatgataatgtctttctgcccttgcatccacagacagcctcaacccttccttataccacctaccaccaagctatcttcaccttttatgttttaagtaaaacactacttttactgcagtttaattattagaaacttcatgtcttttaaactgtgttagtatttttattgacattgttattgttttcatcagtgctctggttataaagttgaataagccctactgatttaagtaagaatttggaaactgcaaattttccagaaaagcacacataatattatagtagaaatggtgtattaccacacattctgaatacattgtctcaagatttttttaatataaaaaggttatactggtttgttttcaaagattacttatttatcaatgaagtatactgttaatatcaatttctaaacaaaattacgaagtgtattttatcatcagctttaaatcgaacattttaatatacacttctgtatgtgtcacacatttcttaaataaataggatgttccaatgtagtaacaaaaattatcatctatgttaaaaacaaactgatgcattgtataagaaaagcaaatattcaatatttgatataaattaaatgtatattatgaactgcaatcaaaccaacatcaatcttctaaaatgaagcagtttctaaattgtatgaaaatacatggatatggtctagaaagcatgtttcatcataagactaaaaagatactttttattaggcagggtctcactgtcacccaggctggagtgcagtggcacaatcacagattactgcagtctcgacctcccaggctcaatcgatcttcctacctcagcctcccaggtagctaagaactacaggcacgcatcaccaaacccggctaatttttgtattttttgtagagacagggtttcaccgtgttgcccaggctggtctcaaactcctgggcttaagggatccacacaccttgccctcccaaagtgccaggattacaggcctgagccacctggccctgacctaaaaaaatactttaaataatgctaaagaagaatttagcatcagattttttgtttctttctcaaagcaacaatattgcttcacgatcatctgttgttaaatatataatactagtaactaagcactcttttatgtaaatggctcctcctaagaacaagcacatgaaagtttgtgttatttgtacatgacaaagatatagcacataactgagtcattaaaaacacagttcaggccgggcgcagtggctcacgcctgtaatcccagcactttgggaggccgaggtggatagattatgaggtcaggagatcaagaccatcgtggctaacacggtgaaacccgtctctactaaaaatacaaaaaattagctgggcgtggtggtgggcccctgtagtcccaactactcaggaggctgaagcaggagaatggcctgaacccaggaggcggggcttgcagtgagccgagatcccgccactgcactccagcctgcgcaacagagcgagactctgtttcaaaaaaaaaaaaaaaaaaaaaaaaaaaacacagttcaactggaatagctataatttatatatcaatcccaatttgaatagaatatttttgaagttaatgtatataataaatatcaatcactatgaatatttatataaaatagtagtgtgctctttttaatatactccatgatatggtaggatacttttatggacccatgcaaccctgaatatcaagcagccctgttttatttttcaattatctatttaagtccacttggttagagatagtcagcatgtttctcacgggaaaaaaaaaatactgcacaattgtctgcgtatagtgtgacctctttcacttgggtgggtatcctttccatcaccaactaagtgaggatataaccttgtcaaaccaaaggcaaaagaataataagcatatgacaggctaacccagcatggaaaaggttgtttaggaggttgcaaaaatagtactcggaatgacaaaataaaagtacacttcaaagagcaggttaatatttttaaaagcactcaaaacctgagaagcatttaatccccctccttggatgtctgccatacaaaactccacttgaatttatttcattagtcactaacgagatttggttaatatgttttcaaatgaatactggtagaatagtctgaaagaaacacatttatagaatatctatttccacaaagcactagccaaaggtaagtacaaataagcagatgatgtcttgcttttaccaattataaattaccatccaacaagaaaaaaatccttccaattcaagaatcagaaatacaaatgggaaaagtatttacccagtagcaggtttttactgtctccaaatcaaatggcagtaacactgctaccttaattgctacccctaactggcataacagggaatcatactacaacatttttataagtatttgaaaccagaagaaattagacaagtttggctacagtcttcctagtgtaaatttacttttaaagcaaacaaacaaaaatctccaaaccatttaggcctgtcctaggactatgtattatatcattgtgtcagttatacacactttgacattccttttctacattaagactggaatgaaatttttgatcctgaccagtcatcatattataacagtgaaacagtgccaccttttggacccaaacagaagcatccagtgctagtctttcaaacttcctttttcagttaaactcctgatgtacataaatgtcaatgattttcatgtcataattatcaccttctaggaatactttttaatctatacaaaccaagaaaacattggggtaacaaaaaagttgcttaccaagatgcaaaatttcaaaatattccaaagtagtaccaaatgcatgtatttttaataatttctaatcaacatttcattaaatacatttcaccaaatccaaatatgttagtcaactaacatattttaaatgcaaaaaattctttttatagcattgttacactgcaaaattgattttttaaaaatgcattgtatttaacatgtattcaatttaataattggcaatatgatattaacagtggattaccagttaaatcagcataagtataaataattttatatacaaatatagtatgcttctgagttacttacaccaatgatacaatgtcaccacggtgtacttcaaaattcctcactttccagtggttcaaaagcaccacatcagatgactggctccccccaggattcaaagaaggctagaaaataaggagaaagagacacttctatcatttgtatttttcaatcttcatggttcttgcacttcacagctcgagtggactgaaataaaacatttctaatacagtacctttctataaattgctgttctaaagtaactgcaaatgatgagttttcaaaaaggctcactgggattcttcacagatgaaccagaaaaaaataaattaccaatgcttatttgaaaggaacgtgtgctagacattaaaatctttagtaaactccaataaagaggtatgaaaagccttaagaataatataaaaacatgaggaagaagtgagtcaaacctcctaacaaaatatccagataggatctaattccacagtagtacacatcattgttccatctggggaaaagaagaaataatcccaaatcacagtcatgtccacaaatcttcacagtcatatgaaaaactgaagggggcaaaagaaagatgtgataggattaccattataaaatgtatggatttcccactttgacctctcttttctcaaaagagcacatatcctaagggtcctggtcccagtttgagcctaataaggggctttcatcctaggattcagagaagtctaactgtgcctgagggttaatggatcaagaactgagaaacattttgtgtaagaatttttctaaaggtcaggaaccatacaggcacaaaaatttgactggggaactatgaaaccagcatacctgtcatttggacaggggtacagacaaagccaatgaataacaagcttgaggcaagaacagggggacaaaataattagaaaagctaagatagccttttcactgttttttaaattttttttcattttttatttcaataggttttgtaagaaaagacagtgttcggttacatgagttaagttcttcagcagtgatttctgagattctggtgcacccatcacccgagcaacgtacactgtacccagtgtgtaggcttttatccctcaccaccacccacattttcccccaagtccccaaagtccaatgtgtcattcttatgcctttgtgccctcatagcttagctcccacatatcagtgagaacatacaatgtctggttttccattcatgacttacttcacttagattaatagtctccaattcctttcagattgctgtgaataacattatttcgttcctttttatggctgagtaatatatatacacaccacattttctttatccactcgttgactgatgggcatttgggctggttccatatttttgcaactgtaaattgtgctgctataaacgtgcgtgcaagtacacatctttttcatataatgagttattttttcatataatgagtttattttcctctgggtagatacctagtattgctagggactgctggatcaaacggttgatcgactttagttatttaaggaacctcgatgctgtttttcatagtggttgtactagtttacattgccaccagcagcgtaaaagtgtttccttttcaccacatacacatcaacatctattattctttgattttttgattatggccactcttgcaggagtgaggtagtattgcattgtggttttgatttgcacttccctgataattaaagatgttgaagattttttcatatgcttattggccatttgtgtatcttctcttgagaattgtctattcatgtcctcaatccactttttttttttttttttttttttttgagatggagtctcacaccgtcgcccaggctggagtgcagtggcatcatctccgctcactgcaatctccgcctcccgggttcatgccattctcctgcctcagcctcccgagtagctgggactagaggcgcctgccatcacgcccagctaattttttttatttttagtagagacggggtttcaccatgttagccaggatggtctcaatctcctgaccttgtgatctgcccgcctcggcctcccaaagtgctgggattacaggcgtgagccaccgcgcctggcctcagcccactttttgctgcggttgtcctttcttgctgatttgagttctgactctccaataatgctaccatgggaagtggccatttctgtggtgacaggaaaggtgccaagcttcctctccgccttcactgaggggctgatgacagcagccagtggagacacaacaacaaccagggcagaagcaaggaaaatagtgaacgcagggcaacagccagtccctggagcagtaatgacgtgccttttgttaaagattcctgggattatttgcagattttctacaaagcaagagttgacaaatatgtcaaaattctgcatggaggctattatcttgacactatttttgatccagggttttgcagctgaaaaatactggttatccttgaacacctcaaacactttcagaactttcaccaactcctttagtgataatacctaaatccctaacttaaattccctgctactcatttcacttaactacctgacaaaaaattcaacaggattaaaatggaatttgttatcatttcaacaaataaatttttttttgagacagtctcttctgcttttctgcctcagcctcctgagtagagctgcgactacaggtgtgcgccactatgcccagctaatttttgtatttttagtagagacggggtttcaccatattggccaggctggtctcgaactcctgatctcgtgatccgcccgcctcagcctcccaaagtgctgtcattacacacgtgagccaccacgcctgccctcttttttttttttttttttttaagagggtctcgctctgtcacttaggctggagtgcaccggcatgatcatagttcactgtagccttgaactcctgggctcagtctcccagttccagttcccaggtagctaggactacaggtctacaagtgcataccaccacatccagctaagtcgggttttttttttcctttttttttttttagagatgggagggtcttgctatgttgagcaggatggtcttgaactcctgacctcaagcaatcctcctgccttatcaaccaaagcgctgagattacaggtaggagccaccatgcccagccctttcttattttcttacatccgggttacccttttcccagtcaaccagtttaaaaacttagttgtcttcttacttctcatccaaccagtcagcaagctaaagggatctttttttaatcataatgtcttctacttctggcacgttttctttcctctctagtatcatcatatttcaagcaccaatcattatgtaactcatgctatatctacactaatcagtctctcacctccaacttagaaatgattccatttctttctagttatatgatcttcagcaagttacttaacttcattatgccactcattactaggaaaatggtgatgaataataactattatctaattaataattaaataataatagccaatacctacgaagtacttaccatgtgtcctggtctaataataatagccagacatgttaagtgcttaccatgtgcaagacactgtttaacagctttacaaatatagttgacccttgaataacacaggtttgaactgcgtgggtccaacaatacacagatttttttcaataaaagttacactgagtgtgcctgcctctcctgcttccctttcccacctcttctacatctgccacccctgagacagtaagactaactcctcttctttctcctcctcctccttagcctactcaatatgaagacagtgaggatgaagtcctttacgatgatcctcttccacttaagaaacaaaaatatatttttctctttcttatgatgttcttaataacattttcttttccctatcttactttattgtaaaaatatagtatataatacatatagcatataaaaatatgtgttaatctcactgtttatgttaacagtaaggcttctggtcaggagcagactattagtagttaagttgtggggtgtgggacagtcaaaagttatatgcaaatttttaactgcatgggagttgggtccctcaccccctcgttgttcaagagtgaactgcgctaccttatttggtaagatcattcatttaaagtgcttatggtagttcttggcccatacttacctctcagtaacttctattattgatatttctacatcacaattttaattttaagcaggtctgtactctctacccccaggttcctcctatgtctctatctctagtgaggaacagagttgatatggtagcataagtccaaagggctttactgagccatggtgctgaggaatggagcttttgtcatcacaacagtaggtcagattattaaaaggtgagctttcacaagggtatgctctctatctcattcatatttctcattcaaattctctatctccctcttcctctctgtctttgacctcagtatccacaggtcctcttccctaatttatttgtattctttttcctatataactgacactgtaaaggtgacctggagggagaccatctgggctctggaccataaagagaaaatattcctattgaactttcactgcattcgttttttttttcttttttcttgccataatagtgaaggaacaaaaggtgatttaattatttctgactgttctccttggtctcttttactggtgttttttttgaagtttgtgaccacaactcataagatcaaaaatcccaagttcaccatcacagcctatgattatttctataataatatttaaatatgcattataatcactcccttgtctctctttccaagagtctataagctctttttttttctaagttttgagaataaattatttcctatgcctatatttttgagatcgagcactttgcaggtaattaacacattttagtggaaagaatttaaaaaaatcaattagtggaatttccaaagattttcaaaattaacaaggtcaaaacaaagatcctattccagcccactccagcccccaaatatacttcccctccttatttaacagtagtaccacttaccctatcccccatactagaagactcataagtcaggtccagtttctaacccgctctttggatgcctcattatcagacttcccctctgtcaagaatgttttttccccacttggaaacttctagtcatttgtcaaagtccttatctgatggggactcctctgtaaagcctttaaaaagaataaaaaacatgctgcagttcccttaaggaaattggaaaattatatcttggtgttccaacaatggggatagaaaaatccccactgacccaaattttaacttcgtctttcccttatagaatcactcaaatgcccaacttttctaattgtaattgttagaaccaaaaggtaaagcattataaacaaaagatttatgcaagggaagaaaacagaaggaagcatgtctaacttccaatagtgaagtaagtattagaatcaacagtcaacacctgaatgacattgcttgattttataaaggaagcaacagagttttcttttaccttttctttcctccacaagtttaaattagctactccctcatgtgcgctcccatagcaatgcaggtacttaataggtatctgcctacagataagactcttccactcaggtgtaagtttctcaactgctgaaaccgtgtcttagccatttttgtacacctaatcccagaacagtgattggaaaataatatttctataaagtctaaaagattaaaggtttttaaaagcgtatttaaatcagatagtttctagaatatacattatctaaataatgtatacatctctttcaatgaaaacatattctagataagtatagcaataaattttttgtgtctcatcaagttaggcaatttaagagttagaaatagttgaatagggctttgttattcataatgaaataatggtaatcacaacacaataaactatcttgtttatttattaatctaacacttatgaatatcaacaaaacatcataaagaaaaaccttcttgaattgggaagttgttcctatggcactataagaaccacagttttctgtacttcactaaaaacaaaagctttattaaaaagaaaaaaaacaggccgggcgcagtggctcacgcctgtaatcccagcactttgggaggccaaggtgggtggatcacgaggtcaggagatcgagaccatcctggctaacacggtgaaaccccgtctctaccaaaaatgcaaaaaaaaattagccgggcgtgggggcgggcgcctgtagtcccagctactcgggaggctgagacaggagaacggcgtgaacccgggaggcggagcttgcagtgagcggagatcgcgccactgcactccagcctgggcgacagagcaagactccgtctcaaaaaaaaagaaaaaaacagtggccggtcacggtggttcacgcctgtaatcccagcactttgggaggccgaggcaggcagatcatgaggtcaggagatcgagatcatcctggctcaacacggtgaaaccccgtctctgccaaaaaattagccgggtgtagtggtgggccgctgtagtcccagctactcgggaggctgaggcaggagaatggcgtgaacccaggaggcggggcttgcagtgagccgagaccacgccactgcactccagcctggggcgacagagcaagactccgtctctaaaaaaaatatagagcaagcaattttttcaaatcgatgaagttaaacacatcaagtagaaattaaaagtcataaataataatttgatatggccacagaatctgtattttcttgttatattgttaatatttaaatcctagattccaagagactacatcaaaatataactaacttaaaataataaagtgtttgaagaaatctcagagaatatttaatctaggagtttccacctgtatctccaagtatttgattgtatcagatattcctgctagtagtcacagtgatttccagtagcaaaaggaaaaacactaacaaagaacaaaaaaagccaaacatctgctctggactgagtaagaaagacccaccctcacccaaggtgggcagacaccatacaattagttgagagcttggaaacaacaacaaggaagaggaaaggtaaatattctctgtctgtctctctcaacaacttgcattctcacactcatctatttctctgcttctaccatggaccactaaagttaaaaatcaaacttggagaagtgttttgaatagtccttgccctaaacacagaaaactatgttcaaatcttgtctccatttcttattaaccatattactttaaacagattatttaacctgtctcatttcctcatctataaaatggggactgactgcaggaacactgatctcatggagttgctacaagaattaaatgagacagtctacaaaacattacagtcatgaaacagagtagcagtcaacaaataggacactaatgatgatggcaacaataacaaaataaagggaaacaatatcaggtacagtatcctttccacaagatttaagaaaaattaaacatttaaatattgccctgcacatttctcattttacatagtaaactgaaagtattcaggcagaaaattctacccctcatttctaaattctttgttgattgtttcctcacttttttaaagcaagtaaagttaggatgcttttatgtggggccttaattgttctgcctctataaattaatccaaaaaaatttaatatgcataattagttatgaatacctataaaatacctaaagaattttacacccgttatgttttacattcttatttttaaaacatatacacacatacagatatatataaaaacatatgcatttaaaaatctaacagttcttagctctggttgatgaaatgatttccattttctccctccctactgcttacccctccccacaccttgttttcctctggctcagttgtatctcacaaattgttttttataatgaacatatatttagtttgtatgctttgctctgacctaagtactatatagttcactctaagaaatacaatataagtcagcatatttcaacagatgttagtaagttatgctaaagctagaaatagccaatatctatcaaatctgcttttggaacaagcataacacaaaagttaggctttaatcttttctctgatcaaagactatgctgaaggatttttatttgtcctacaaacaaatattattgtcaaggtatcctaaatcctcagcttgtgtctaacctcaaatcatatgacaggtttggaagaatttatctttcggtttacgaaaataaaattctcctagagaattaagcacagtcacagtacacttcctgttttgtaagacttaactgaagccatcaatcaataaatgatattattctggctttttactataaattttttattcattttttaattttaaagaatctacagcctatgattcactgcctccaagatataaagaaagcctggttttgaccttacttctttgggtacaatgctttcaaccttttcaggcttataaaaagcaccactcacactggctacatacaatctacaacaggtaaatatcaaactttgtgcttttaagtgagatggagcccagctgcagccacaaggacccaacagtagccctcagacttcttttgaagaaccattactttgaagacatatctgtggaggcgggggcaataacagaagaaactgaaatagtactgttgatttagactttttaacactgcagcactggccaagaagcatgaagtaagtacagttaaagtaaatgtacattctgattaagaattattagatgtcacacctttgaaagaatgcggacaatatggtctacaatgccgtctttcttcccttgctattcaggggtctccataatttgcatggcttctagaattctcagatttgtctcactaggtgtgcataataaaatagactataatgtacccaggtctgtacaaagctgtaagttagaaatggaacattccttttatatcatgggtacttattacccataccccttctgatggttaattttaggtgtcaacttgactagattaaggctacccagaatgctaagaaagcattattctgggtatatctgtgagggagtgttcccaggagagattggcctttgaagcactggattgagtaagaaagatccaccctcacccaacatgggcaggcaccatgcaattagttgagggcttggatacaagaacaaggaagaggaaaggtaaatattttcatattctctctcgctctctctctcctgacgctgggacaaccttcttctctttccattgcaaatcttagaactccaggtcctctgacttttagactctgggacttgaaccagcagcccccaggtctcaggcccttggccttggactgagagttataccatcagcttctgtggttctgaggccttcagacttggactgagccaagctacctggacctccagcttgcacatagcctataatgaaacttcttagcctccatgatcacatgacccaattcccctaataaattccctctcatagatagatacatagatagatagatagatagatagatagacagacagacagataaatatcctattcgttctgtctctccggtgagatctaattataatataatttcttaatttttcttttaaaagcaagcctgtaaaactacattaataaaataaaagtgaacatataacatattgatttaattcagaattacactaggttgttaatttttcattctcctaatcttaactgcatgttctactatagaacgccccatcaaagtgtcacaggcacgctcacatactacctgtaggaatgaaaatctttataaactatcaacaaggtaatttgccaaaatatatttaaagtcttaaaagtgatcttgtccttagacttgaaaatgtcacatttaaaaagatttcctaagaaactaattggacatatgtgcaaaggaacatatacaaagatattcataatacattatttacaatagtgaatagcttcttagtcttttagctaaaatcaagtgaataactgagccaagctcaataccaataataggaaactgattaaaccttggtttagcaatggttaaactttatggatattaaaaaatgattgtaaaaattacattgtggaaaaatatatatttggatatgtctggagaataagtgaaaaatgcgacatagaaaaaacaaactgctatgatccaatttcaggaaagacaggacggaagaaaaaagggaaaaaccttaaaagaataaagtaaagaaggaaattgtgcagaaaagaaagagagtaacttataatggtttagaaatgcaaacttcaaagtcagaagctgggtttaaatctatgcaatcttcagtaagttatcccatctctctgattgtatttcttcatctgttaagtgggctaacatagtatcttcatcatacagttgtgggtgatattaaataaactaatatatataaagtcaatactgtaatgacttgaacatagtgatcattcaataatttttcactattagtattatataataatatatttaaaataaataattctgaaaggtggtatcaattatttattttccacatttttctatgttttctaagttttttgccaatcaatatgcagtgcttttatattaatgtaagcactaagcaatgaattgtttttgaaggggaaagcatctgatttttatatcctcttattactaatatttttaaagtttgtgttctttaaacaagctcttcagtatttaagcatctctttaattcaggtcgctacaactagattgcaaggttcaaatctgcaaagtttctgtttcaatgcactaattataaaatactaccattaaatacgtgcattgtgtttcctagctaataaaacatgttttgagatagctattctaatttatagttctaattaaccatatcagaaatagatcacatatagtcaatgaaatataaaatttatataaacatatctgcatattaacctgaagacagactgctatatataaaataagccagctacacggaaaaaccccagcaagatacatgcggaatctttaacttcctcataaaactgaataaggctttcctattcattgctaagtttttcttgctcagaaccacttttctgtctcctaacctaattaaaaaaaaaaaggtcatagtaaggtgtgtagcacagaaaggaagtgattcaacaaataacaaagattttaggaggctgcatgattccctcagaagcatgtaactccaaagaggccaaattccccaacatatacaatggtgtagcaatctattcacatggcttatataatatctgtgaacaaatctgtgaagataataccatggattttagatcctttagttcttcattgttgaacctgatgctgcattataaggaaaaaaataaaaaagaaccagtcagcatcctaacactacaaatgtgtatcaacaggaattttggtacctgggtaccctaaattacattgatcaaagctataagaacaaaggagctcaaatgcataggaaacagcttatcaaaaggaactgaaaagcattctggcagataaaaagggggaaaaaaggatatataccttatatcatttatctactgctacaaaacaaaccactccaaaacttaaaacaaaaatcatttattggttcatgattccacaatttaggctatgcttagctatgcaattagccagcttgtctggctgtgatcactcaggcagctgcagccatggaggcagcagtgttccaggagcaaaaactccctcgtgtaagcatctaccaagcctctgtttgcgtatttgctgatattccaccagccaaaatgagtcataaggccaagtcaagaatcagcataggtgaggatgacatagagctcagtaccgaggagcatgactcatgggggatggggtagacagggaatatcaatgtaataatctaccaaaactctgccctctagctccaatgaatcatatccctcacatatgcaaaatacatataacccttcctaagagccccaaggtctcctcagatgtttgcaataggattcatatccgttaattcatgatatgcatcaggtcccaggtcccagtatggaagaggactctagggtgcagctcatctcaaatcagagacttatgaagtgaaaagataaattatctgttccccaaacaccaaacatataatggaaagacagaaagaagataaccatggattttaaaaagcaatgaaaaaagcatagaagtcacttgtccatagaaagcttaaaatccagcagcatgtgttgtcaaggcctcccatctcatggagagaaatgtcctttaattaagattcttttctgttctctggaatggttccctaatttattggtctgcatggctcttagctctgccctctgggctttgggctcttttttaaaaaggaggcccggtggagccaagatggccaaataggaacagctctggtctacagctcccagaatgagcgacgcagaagacgggtgatttctgcatttccatctgaggtaccgggttcatctcactagggagtgccagacagcaggtgcaggacagtgggtgcagagcaccaggcacaagccaaagcagggtgaggcattgcctcactcgggaagcacaaggggtcagggagttccctttcctagtcaaagaaagaggtgacagatggcacctggaaaatcgggtcactcccaccctaatactgcgcttttccaacaggcttaaaaaaacggcataccaggagattatatcccgcacctggctcagagggtcctatgcccatggagtctcgctgattgctagcacagcagtctgagatcaaaatgcaaggcggcagcgaggctggggaaggggcgcctgccattgccgaggctcgattaggtaaacaaagcagccctgaagctcgaactacgcggagactaccacagctcaaggaggcctgcctgcctctgtaggctccacctctgggggcagggcacagacaaacaaaaagacagcagtaacctctgcagacttaaatgtccctgtctgacagctttgaagagagtagtggttctcccagcacacagctggagatctgagaaagggcagactgcctcctcaagtgggtccctgactcccaagcagcctaaatgggaggcatccgccagtacgggcagactgacacctcacatggccgggtactcctctgagacaaaacttccagaggaacaatcaggcaggagcatttgcggatcaccaacatccacttttctacagccaccgctgttctgcagccaccgctgctgatacccaggcatacagggtctggagtggacatctagcaaactccaacagacctgcagctgagggtcctgtctgttagaaggaaaactaacaaacagaaaggacatccacaccaaaaacccatctgtacgtcaccatcatcaaagaccaaaagtagataaaaccacaaagatgggggaaaaacagagcagaaaaactggaaactctaaaaagcagagtgcctctcctcctccaaaggaacgcagctcctcaccagcaacggaacaaagctggacggagaatgactttgacgagttgagagaagaaggcttcagacgatcaaactactccgagctacaggaggaaattcaaaccaatggcaaagaagttaaaaactttgaaaaaaaattagacgaatggatacctagaataaccaatgcagagaagtccttaaaggagctgatggagctgaaagccaaggctcgagaactacgtgaagaatgcagaagcctcaggagccgatgcgatcaactggaagaaagggtatcagtgatggaagacgaaatgaatgaaatgaagcgagaagggaagtttagagaaaaaagaataaaaagaaacaaacaaagcctccaagaaatatgggactatgtgaaaagaccaaatctacgtctgattggtgtacctgaaagtgacggggagaatggaaccaacttggaaaacactctgcaggatattatccaggagaacttccccagtctagcaaggcaggccaacattcaaattcaggaaatacagagaacgccacaaagatactcctcgagaagagcaactccaagacacataactgtcacattcaccaaagttgaaatgaaggaaaaaatgttaagggcagccagagagaaaggtcgggttacccacaaagggaagcccatcagacaaacagcggatctctcagcagaaactctacaagccagaagagagtgggggccaatattcaacattcttaaagaaaagaattttcaacccagaatttcatatccagccaaactaagcttcataagtgaaggagaaataaaatactttacagagatgcacatgctgagagattctgtcaccaccaggcctgccctaaaagagctcctgaaggaagcactaaacatagaaaggaacaaccggtaccagccactgcaaaacatgccaaaatgtaaagaccatcaaggctaggaagaaactgcatcaactaatgagcaaaataaccagctaacatcataatgacaggaccaaattcacacataacaatattaactttaaatgtaaatgggctaaatgctccaattaaaagacacagactggcaaattggataaagagtcatacatcagtgtgctgtattcaggaaacccatctcacgtgcagagacacacataggctcaaaataaagggatggaggaagatctaccaagcaaatggaaaacaaaaaaaggcagggattgcaatcctagtctctgacaaaacagactttaaaccaacaaagatcaaaagagacaaagaaggccattacataatggtaaagggatcaattcaacaagaagagctaactatcctaaatatatatgcacccaatacaggagcacccaggttcataaagcaagtccttagtgacctacaaagagacttagactcccacacaataataatgggagactttaacaccccgctgtcaacattagacagatcaacgagacagaaagttaacaaggatatccaggaattgaactcacctctgccccaagcatacctaatagacatctacagaactctccaccccaaatcaacagaatatacattttttttcagcaccacaccacacctattccaaaattgaccacatagttggaagtaaagcactcctcagcaaatgtaaaaaacagaaattataacaaactatctctcagaccacagtgcaatcaaactagaactcaggattaagaaactcactcaaaaccactcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgcagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaagatcaacaaaatcgatagactgctagcaagactaataaagaaaaaaagagagaagaatcaaatagacacaataaaaaatgataaaggggatatcacaaccgatcccacagaaatacaaactaccatcagagaatactacaaacacctctacgcaaataactagaaaatctagaagaaatggataaattcctcaacacatacaccctcccaagactaaaccaggaagaagctgaatctctgaatagaacaataagaggctctgaaattgtggcaataatcaatagcttaccaaccaaaaaaagtccaggaccagatggattcacagccgaattctaccagaggtacaaggaggagctggtaccattccttctgaaactattccaatcaatagaaaaagagggaatcctccctaactcattttaggaggccagcatcatcctgataccaaagcctggcagagacacaacaaaaaaagagaattttagaccaatatccttgatgaacattgatgcaaaaatcctcaataaaatactggcaaaccaaatccagcagcacatcaaaaagcttttccaccatgatcaagtgggcttcatccctgggatgaaaggctagttcaacatacacaaatcaataaatgtaatccagcatataaacagaaccaaagacaaaaaccacatgattatctcaatagatgcagaaaaggcctttgacaaaattcaacaacccttcatgctaaaaactctcaataaattagatattgatgggacgtatctcaaaataataagagctatctatgacaaacccacagccaatatcatactgaatggacaaaaactggaagcattccctttgaaaactggcacaagacagggatgccctctctcaccactcctattcaacatagtgttggaaattctggccagtgcaatcaggcaggagaaggaaataaagggtattcaattaggaaaagaggaagtcaaattgtccctgtttgcagatgacatgattgtatatctagaaaaccctattgtctcagcccaaaatctccttaagctgataagcaacttcagcaaagtctcaggatacaaaatcaatgcacaaaaatcacaagcattcttatacaccaataacagacaaacagagagccaaatcatgagtgaactaccattcacaattgcttcaaagagaataaaatacctaggaatccaacttacaagggatgtgaaagacctcttcaaggagaactacaaaccactgctcaatgaaataaaagaggatataaacaaatggaagggcattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcctgcatcaccaagtcaatcctaagccaaaagaacaaagctggaggcatcatgctacctgacttcaaactatactacaaggctacagtaaccaaaacagcatggtactggtaccaaaacagagatatagattaatggaacagaacagagccctcagaaataatgccgcatatctacaaccatctgatctttgacaaacctgacaaaaacaagcaatggggaaaggatttcctatttaataaatggtgctgggaaaactggctagccatgtgtagaaagctgaaactggatcccttccttacaccttatacaaaaattaattcaagatggattaaagacttacatgttagacctaaaaccataaaaaccctagaagaaaacctaggcaataccattcaggacataggcatgggcaaggacttcatgtctaaaacaccaaaagcaatggcaacaaaagccaaaactgacaaatgggatctaattaaactaaagagcttctgcacagcaaaagaaactaccatcagagtcaacaggcaacctacaaaatgggaaaaaattttcgcaacctactcatctgacaaagggctaatatccagaatctacaaagaactcaaacaaatttacaagaaaaaaaacaaacaaccccatcaaaaagtgggcaaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggtgattcctcagggatctagaactagaaataccatttgacccagccatcccattgctgggtatatacccaaaggattgtaaatcatgctgctgtaaaggcacacacacatatatattgtggcactattcacaatagcaaagacttggaaccaacccaaatgtccaacaatgatagactaggttaagaaaatgtggcacatatacaccatggaatactatgcagccataaaaaatgatgagttcatgtcctttgtagggacatggatgaaactggaaaccatcattctcagcaaactattgcaagaacaaaaaaccaaacaccacatgttctcactcataggtgggaattgaacaatgagaacacatggacacaggaaggggaacatcacacagtggggactgttgtggggtggggggagcggggagggatagcattaggagatatatgtaatgctaaatgacgagttaatgggtgcagcacaccaacatggcacatgtatacatatgtaacaaacctgcacattgtgcacatgtaccctaaaacttaaagtataataataataaaattaaaaaagaaagaaaggaggccaggctcacacctgtaaccccagcttcttgggaggcgggaggatggctccaggccaaaagtttgagaacacctgggcaacatagtgagactgcctccacacacaaaaattttaaaaattagctgtccaggacttcgaggctgattgcaccaatgcactccagcctgggcaacagagcaagaccctgtctctttaaaataataataataataataataatataaaaataaataataaatttttaaaaagaaatgctccttcataataaggtggacacaccccagaggtctctttctaaattgaccccattttagtacaagttaattcaacacccttaaaatgttgtagacttcccattaatctagttggggctcattccattccccccaaaactacatccatatcttccttcttttttctttttcttgccctgtcccccaggctgcagtgcagtggtgcaatctcagctcactgcaacctccgcctcccaggttcaagcgattctcctgcctcagcctccagagtagctgggactacaggcacatgccaccacaccaggctagtttttgtatttttagtagagacaggttttaccatgttggccaggatggtctcaatctcctaacctcgtgatccacctgccttggcctcccaaagtgctgggattacaggcgtgagccaccacgcccgacccttaatttttttcaaaccagatctttctttactttgaaagtgtcaggctgctgtggcacaaagccctgaagagtttacaatatattttgtctaattaaaaagatatactaagtaccaccttatatctttctgaggttttttttgtttttgcttttgtttttgtttgagacagagtctcacggtgtcacccaggctgaaatgcagtggcacagtcttggtttattgcaacctctgccttctgagctctggtgatcctcccacctcagcctcccaagtagctgggactacaggcgcatgccaccaagcctagctaagttttctatttttagtagagacagagtttcgccagttgcccaggttggtctcaaactcctgggctcaagttatcttcaagccttggcctccccaagtgctgggattataggcgtgagccactacacccagccctgaggtcttaataaagagtcttccagtcctgatttgatctctacccgaggctatttcttattttgaggatcttttgcctgctagatactgggaatgaaaaatagttttattttccaacccaaaaaagttctgggcaccctatatttcctctaatttctgctataagttcatttctctcttcccatatcttatataaagctatacgaagccagctgacaatttcaatattttcgcctggaaatctccttagccaaatctataagatcattaggtatatcttctatttttcaagttcttacagttcacatttttaaaaaatgtttaagtaccataaaacacagatcatcgtaattccagtccgcagtaacagatactttactatctttctgttttctattaacagttgtttgccatttgtccagcgtctgccaacactcccctcaccacattaccagccccaaactgccacccagtccccaaatcaatgctacatattttaggtttttgttatagtatcacttcactaatagtaccaatttttgtttcagttatctcttgcttcataacaaaccactccaaaactatatgtctaaaaagaacaaccaaaatgtatctgcttgtgatcctgcaattttggcttccctcagctggaaagttcaagatggcttcattgacatgtcaggcactcaactggggctggaaggccaggatgcttcatttattctccaaaatctccgtcatcaggatagcctgagtttttacatgtacccagctcacaagtactgaccaagctcctacttgagcagtatttgcttatatcctactgaccaaaacaagtcacatggtcagagtcattgtgggaggaaactacacaaatcaatgagggaggcctgattcactatggaatcattaccataaaaatctacacatatctcatactaaatgaatgggccatccattcagctgacaatcttgtgactgtgctttctgttgatcattttaaaagctacagaaataaaagatagtttatattttaaaaagaaagaaaaaaattcactgacaaaaaaataaaaattttaaagataactaaatagtcttaaaagcaaatgacaagctaaaaagtataaaacaggcattttaaaaaataaaattaaaaaagtttacgaagaaataaaaataaagttcataaaatagaaaaatgtttaattaaaacttaaaaattaaaaaaagaacataattataaaatgatatacccattggtataatattgttgtggtctttctactccttagctcaggtaggtccgagttcttgtcgcacaaccaggaagaattaggcatgcagacaccagagagtcagtaaagtagaatttaacaggcgaaaaaggaaagctttcagccaagagagggcacagagggtgggaggggtatggttcccctatctgaaggcagggaagtccccagtgtggctgggtccagggccttttatatactcagaatggggagagtgtgttgattggtttgtgagtatgcaaaaaatgttaaagcaaagacaccactcaaaggtgggcacgacagagtagaaaaccaattaggaaagggtaggtatatgtgaaataggtgaatggtggggatctatcagaggaaatcatgccaaataggcaagttctcaatccagtctgaggatgtaacttgtagcttggctttcaggctttaaactgtcttgggcttggaaggggggtttcactggggacccaccctatctgcctaggcatttggctgcttcctgccactctcaatattagaaacaataagctaaaattagcacaaatatatgataaataatttaacagacaaagagatgggaaataaaacaaattttttaaaagttataagactaagaattcaaaagtttagtaaacaaaggcaatcaggattttccaagcaaaagcaattaccatgtctagcaaatcccccaacaatttgccctcacccaagacatggagctctccttaagaaaatggttctcaaactttagtatttacagagtttgttaatgcagattccaaggtcctcacaaaacgattctaatttcataggtctgaaatggggctcattaatcttcattaataagtaccccagattatgtaataaaaaaggcccaaggaccacagcagctacaaaagggttttctcaaacaagggacagactatggggctccttatccttcgtgttgcacttattgcttgaagtgcttatgacaagcccacatttaaaatttcagaatcaaaagttaacatgctccactcccttagttatagctcaatttgagctgtctcacccttgtaagcttccctccagcaataaagcagcattttgcaaactacaggtcacaaccaatgagtgagtcagaatcatcaatttaataggttatgaccagaacagaaaatatcagagggcattgcacataatgatagtaattacaatttaagtattgttacatgaaacttttgttccagttgcatgtatgtgtgtatagtgcaaaatatattacttaatatgagtcatgagcaaaaaggtttgaaaatctctgccataaagaatatgatgaatttgtcaagaagctaaaaactttttaggagaatagttcaccagaaacaccctcaaagtctaagaaaaaaaaaattttaatgatcataatttcattttatcatatttctgtagggtttaattattcaggcatatcaatgcttcaaagaagaaatttcatatgcatttattccagcatccctctgaactagcaggtgagaggattatggtcccctttcttttagaaacttacagagtagagttattattaacccatgaaattaataattagagggcagtacaaaaggatttataatcatgagttaaacttacaatgctgtaggatttctaataagtgaatgacagaattaaagaaagttacatgaagaaaatagagcttgagtttagacttaaagggaacttcagaaaaagcagaggagaaaaggtataataatgagtcgtgttatacagtcagaataggctaaatgcttgtaaaaagaatttcaaaagctcagtggtataacacaatagtgagtggactgactccacacaatcattcagaaacccagttttttcgagcttgtacatctaccatcccctgcggcatcgtgtcctcaactggatcctctgctgtattgtattatatacatacatatacataaatatagatatagatattgatacagatatcaaaatcagtatagatatcctgtatattatgatgttttgacacgttaaaaaaaacattcctagctggggagacactgcctctgccagacctagccaattcttccagctagcaagagctcaaccagaagcatgcctttcatatacaaactaaccaatccagaaccatacctcctccagccagcataaccctggagacaatttcctctgccttcatcttcccaaggccaggtaccaggcaaccagggaccacccctacagcttagaatctgccaaaattattcaaactagccagtcctaaactgttcattctgccctgccttgccttgccttgcctgcacagaaaccccaaaaaggctttggcctagctgctattgtcatctgcttcctgaccactctggtgtctttcccatgtggccccacataccgtgctttaccttcctgtctctaggacctgtaagtctaataaactttgttttcctgagcctctcctctgtctgctctagtggccatacctaactaaccaactcataaaagaatacaaaacatctgccttcagccagcagacagaggagagagcatggaggatcacaaagatttttcatgggccaggcctaaaaatggcacttcacttcctcccattttccactggccagacctcagtaacctctgatatcaggaaagattaaaaaacaggacaagaaatcatccattcatcattagtcatccctcttacaactaaaacaccctgaacataacaccacacacaaaaatataggaggatctgcaaggtggaaagaagataaactagaggctaggaaccacaggacttgagaaatgacaccatcgctcccctggactttctttttgcttctcatatatcctagatcaggcactagggaatcctgcaacctgtagctaccaacaggccaagcaaaaaaaagggcctgaagacgtggtggccaacacctgtaatccagcactttgggaggctgaaacgggcagatcgcttgagctcaggagtttgagaccagcctgggcaacatggtgaaaccccatctctaccaaaaataccaaataaaattagccaggcatggtggtgcaagcctgtaatcccagctactcagggggctgaggcacaagaatgtcttgagcccaggaagcagaggttgcagtgagcggagatcgcgccactgcactccagcctgggcaacagagtctccctctgttgaacaaaaaaaaaaaaaaaggccttaagaaaagcctactctctctagccaaaggaccaggaaaaggaagacctagcagaacagaaacatttttgctaataaccatcctaatccagtcaaacatcaaaggaaaaactaccccaccccatcccccaacaccatggtgtcagcagggcccagcaaggagctggacttctaaccccactcagcaattaggagatggggcaagtaggcccttcacttccccgtatcaggtgtcaaagaggtggaatgagagtgcaagtggtgccagttagcagcccactttccccaccccagttagttgagcaatttctttagaagttaaacataaatgtaccatgccactcagcaaccccactattacgtatctgcccaagagaaatgaaatcatgtatatacacgtaactgtacacaaatatctatagcagcattactcacgataatgaaaacatcaaaacccaaacatttatcatctggtgagtggagaaacaaaatgtggtatattcatacagagaatactttttgcaataaacagacacaaaatgctaatacatagtacaacatggctaaacctcaaaaaaatctagtaagtaaaagagccagtcaggaaaaaccacattagtatggttctatttacaggaaaggttcagaaaaggcaaatctataaatcagatcagcagttgcctaaggaaagagatgggagtgaggattaacttcaaacaagcataaggttcctttctcaggtgatgaaaatattttaaaaccgggttatggtaatgattgcatgactccataagtttacttttaatactatttattgatattttattatataaaacataatttttaataaaaaattcaagtcatcccaaagcgttctacagattcaattgcactatctttaaaactctgatgtcatttttcgcagaaatacacaacacaatcctaaattcatatggaaccacaaaagaccctgaatagccaaacaatcttaagcaagaagaacaaagctggaggcatcacactacttaactcaaatgcaaaattatagtaatcaaaacagtatggtactagcataaaaacagacatatagaccaatgtaatagaatagagaatccagaaataaatgtacacatttatgaaaaatcaattttcaacaaagatgccaagaacatacaatgaggaaagaataggttcttcaataaatggtgcttggaaaactgaatatccacatgaagaagaataaaatcagacccttatctcacaccatatacaaaaatcaactctcaatggatttttaaagatgatgcctgaaactgtaaaactacctgaaactgtaaaactactagaagaaaacatagggagaaaagctccatgacactgatctgagcaatgatttgttagatacgaccccaaaagcacaagcaacaaagcaaaaatagacagctgagctcctatcaaactgaaaagtttctgaagagagaaggaaacaatcaacatggtaaagagacaatctatggaatggaagaaaatatttgcaaaccatatatctaataaggggttaatgtataaaatataaggtacacaaacaactctatagcaagaaaacaacttgattttaaaataggaaaaagacctgtatagagaattctcaagacatacaaatggcccagaagcatataaaaaatattcaatatcactaattatcagggaaatggaaattaaattaaatgtgcaatgagatgtcacctcatacctgttaggaaggctattatcagaaattcaagagataaatgttggtgagaatatgcagaaaagagaacccttgtgctctattggtaggaatgtaaattagttcaaccattatgaaaaatagggatatatctcaaagaattgaaaacagaactaccagatgatctaccactctcacttctggatatgtatccaaaggaaatgaaatcagtaagtcaaagaaatatcttcactcccatttcattgcagaattattcaaaacagccaagatatggaagtaacctaaatgctcataaatggatgaagggataaagaaagtgtagtcagtgtgggtgtgggtttctgtatatatatgagtgcgtgtggatattcttctgcaggtgtatatatacacacacacagtggtatatatactatgaaatattattcagcttttaaaaagaaggaaatcttgttatttgtgacagtgtggatgaacctagagaacattatgttaaatgaaataagccaggcacagaaagacaaatactgcatgatctcacttatatgggtaatcaaaaaaagctggactcacagaagcagagagtagaatagtggttgcaaagagctgagaagtagggaaaatgagaagatgttggtcacagtatacaaagtttcagttatgtaggattaataatttctggaagtctaatgtacagcaaggtgactatagctaataatactgtattatacactcgaattttactaagagagtagatcttaaatgttctcaccaccaaaaagaaggtaactatatgaagtaaagggtatgttaattagtttgtggtaatcatttcataatgtctacacatatcaaaatatcatgtatactgttctcactcacaggtgggaactgaacaatgagaacacttggacacagaatgggcaacatcgcacaccggggcctgtggtggggttgggggatgggggagggatagcattaggagatatacctaatgtaaatgacgagttaatgggtgtggcacaccaacatggcacatgtatacatatgtaacaaacctgcacattgtgcacatgtaccctaaaacttaaagtataataaaaatatatatatatcatgtatactttaaatatatgtaattgttgccagtttacctcagtaaagctggaaaacatcattacatcacttacaatgggtaaattcaatggtatataaattatacctcaataaaaatgtgttttaaaaagtagatggactggcataatgaaccaccatgtaatccatcacctagagccaacaattatggattcatagccaatcttgtttcatctgtaacccttctacttttattcttgccatattattttaaagtacatctcagctattatgcatttcactgcaaattttataatattcatactatgaggataagggttttttttaacataacagcagtaaataccattatcaccccaaaaaacaatgtatcaaagcacaagtgatataagtagtgctttgcttgaccattttagataatctcttgttgctttctgctattttcattctcctctctttctttcaactacatttagtatctgatagctccaatttctaaagcctttaaagtctagttcggctaatggttgcttctgactctcacttacagagctcattttctcatgcaatatttttactgggatataatgttcatcaaactttatctttgggattctataaggcctggttgcaagctgcatgtgcccagggaatttggtgcctgaggctgctctaaacccaggccactgtaaattaatatctcagtttagggtttttcaggtgcagtgaatgtgaattcaaacctcaattccacatcagggctttctctctcagagcctagacaatttttcttacagaacagatttttgctttagtctacccatttcctaaagatgtgtctcttctatggtcctgactttattaagaatttctgttccaatttcctgccttctatgagcctatggccttgtcttctgatccccatgtggccattgaaaccaaaagctctaaatgaccaggaattgacaaatatccatgtgacagctactgactttaatgtatacttactgccctggaaatgtattcccccttattgtggtctctgagaatttcccttgcttccctgcaagttagttacacatttttaaagtttttaatgttttgtttttaattttttaagagttttgcactgggaatatttcaagatgtttcatctgctatatttccagatagtctaatcccttcttataaactttaaaatctttagactttttataagagaaacgtatcttccatcaacctgagcggcacagtttaaaatctttttcccccattataacataaagcttaatttctatatttaagtcctaaatgtactacagaatcataccaaaattaaataacttactaagtacatcattccataaaccaaaataaaatggaataaaacatcactgtgagaaggaatagtataaacaggcaccaaaacagtgacaaggcacaacttttattagttattatttagtgaaatggacagcactgtcagagttggttcaagccagagttccaaaattcaatgattgtctgagcttacgtaaagtacctcaactgtctgagcctcagttgtttcaaatgtaaaatttagaacttgagtcatttcttaatgtatttaaagctctatactactatgaataaagtgttaaattttaaaatcagctgaagaaaagcattaatataccaatcagcaagcatcgtgactcaggaagaatgtacaagagtatcaagaattaaaggggcatgatgtatgcaacctactttcagatggtttaataagattttttgagggtatatattcatacacgcataaatacagagggagaggaagaggagggggaggaggaggaagagagagagaagagggagggaaaaaagataataaaataaatatactaaaatattgaaactggtgtatctgggtagagaagccataggagttctacgcactactcttgcaacttttgtgtaaatctaaatttacaacaagtttttaaaaagtgtaataaagttggtatttaaataacagatataaccctggctatataaaacagaaacacatagttattctatcatgggaagtgaagaaaaatccacaaagggacattacaaatttatcactcaccaactgtttcaggaacacacgtttgttgctataaatacaaagtctctattaatgacaggttacagaactatgtaaaaactcataactcatcctaaggggtaaaacatcaggtgagatttctgagccaaaagtaatttgggcagaaagcacgcaagtaagccaataaagcattccaacattaaatcctgacttcctttgacgtcagccccagcagaccaaggtgagtgacgacacagagaagtcagcacaggaggaaatgtgtgccagcttgtgcccagtatcttggaagtgcaaatttaccaggtaacataaaactccataactctatcttaaatgctggtatataaatcacaatgtatctcttttcttaagagtctgtatccagcttctcagagttcaaaataagttacaagcaataatgactgttgagtattattaagctgactgtaggttaaaattttttaaaaaaaacatagattgaaagagagcttgctttttgatgatacttttaatttcaaactcagcaggaaacaagataatcacaggtagctgaaagtcaagacaatttaaaacccataaatgtatgttattgatgaacaaagacctcaatgctaattaaactgcattttccttcatattctgtaatttcctaatatattctgcatacattatctctaaggtctgacctagagatacagtattgtgtagcagtgttttcaagtatttttgccctctggccatgcaaatgaaaaaaggaaaatggtacactatgtaaaaattatgtatcaattgcaaaaaaaaaaaaagataatgacacaaaattatttattttacttactttttaaagtcttaaatcttagttttaaatgtggaaagcatataccttttatcaggaccagtgaccccactgcaggaattctcactcaaataaaatctaaaactttggcatgaggtcattaaactattcctagggcacccttttacgctaaaagcctctgtaagcgattaaagttctaatttgaataattacattccacctacataaattccctctgtagtttcaactgtatgcaatatcagtcttcatttcctgaattaaattaatgtcgtgtaatgtggtgcttcttttttaaaaaaagaagtacatctactttcataggtaacctttcagcaaccagtaaaagtgattcatgtgcatgaggggaataggtcagtatgaataatcattaaccaacaatttgtgccagcatttattgtgtcgagcattgcaaaagggacaactcatataatgaaatgaatgcagctatacggctttataaaaatcaaatattttataaactaaatcctattttccattgaatttaccaatgcatcattagaaactttattttttatttatggcttgcctttaattagctgatacttcccatgtttgatcacccttatctttctagtcaaatacttaatgaattgcaaattaatactgaaaatcctaacttaaaaaaagaaccactgagtagtgtttaaaaagtaaataagtatttctcatagagggaatcttaaaaacatgcttcccctaatcacaaaccaacagaatttttgaaagaccgaaaaacaattcttacagcaaaatttgttactcaaagtgaatttccagtgtaaccaaaacagtatttattcaataaacccaaaagactagtattacacctccctttaatgagatttaatctttcgatccttggatatttcttaaataatgtgtctaccagttgctgagtgaccttcaagagtggcttttcccagagtaaagaaaaacagctgtgttccttgcaggatgctcagtgacttccagagatctccacaccatgccaactatttcagtccttgagtcattagagaaatttaaagagaagaatttatcccaattgtcaaaaattctgttgaaccccatgacataaacgtgtttagttgatcaaagctgtatagtagcaaagatgtcttcaaatatgttgaattagttaatccctaaatctcattattataatttctgctcttaaagaatttaaagtatgatttactggcatctagtgaaactgtaaattaaattatctattatacctagagttggtctcaaattcatgaaatatagatccaattgtaaaaacatattttcctttcttcctagaattccattctactttgattctgaaaatagcatcctctttcctctaggaaatgtcacctgtactccaatccccaattcccacagaacaatgtgattcaaagagatgctgtcattttcttacagatcacttggcctagccacaggcttggggtgtgtacttgttcaaagctggaccaatcacggtaccccattctggtggccaaagttgatctgtatagttgtatagataagggcatgtgacccaagctgaatacatcacagtccttccccaagatattccacactgaaatcaaggcagtaggagcaatctctctcaggcggtgaagaaactgggcatgcgagctgccagcagccatgtaccctgctatgcagagaaaactggtctgagagaactaagccaagatgcagagaagaacttaaaaaagacggagcactccagcggcatccaagtcctggctctagttgtccctgacaactgtctcactcgtgccttccttgtgtgtatataataagccttccaataaatcccctttataccaagctattttcctattaccagtagccaaggaaactatacaatataccaaacaaattctaacataatacatttgacttcttagggatagggcctaggaatactgcaagaaatcctaatacctctgcaaattcaaatatatctaatgcaaacctgggtttaatccatgaaccgacatttagaaataacatgatttaacactttcttcactgccttcttcactggggataagccttgtcctttcataaggcagtcaaggtcttgtgagcaagacctgtatcttatattttgcaatgaattgctctctcagcacaagccatgaacatagatgttcagtaggaatatattaggctaaaaatatgaagattgggatattatgattgccacatgatcctctggaatatcatcagatccaaagtaaggagattttgtgttctggaaaagtccttcttagaatagtgatagctgtatagcaagacagcagtaacaaaattgggggaaaaaaaatcattcttaaactgattatttgttaccaaaagatacatgcttgtgaatggattcaaagggatccttgggaccaaaaaggaatgtgggtggctgtgaagaaggcagttttaatctgaaatgaagaatctgactccaaagctcagcaaagaaagtctacgtttccctaaggattgagtctaagacaaggctgctaggaattcaagattaaagaggcaacgaatgtaaaatacattctatcttaaacatattaaagtgtatttaaagccatatgcctataaatctttctttctatgtttactgtacccctacattaagatattttggcattcaaagtaagtgaccagtttgctttgggctggtgatccactatggagagaacctgaaagacacggttgagagcagaatcttctgcccaagaaaaggccctaaccatgctcaaatgatggaagtagaatataaaggcagtcctgttttaaaaatgtagcttttcccaaagaagctaaaggatttcctgaccttctgtatctgactaccagaactcagggagaagttcaataccataattataataaataaagcaaactaattctaactccttaaagctgataactatgcccttaactagttctaactgaaacaaaaagaaaaaaaattaagctggttattctctgtataattttgattttttagaagcttatatattcattttagttatttgttttatacaactatttaccacaacgcatgaacttaatacatattgataatacaggaaaccaaatcctataacaaaatgcaaattctgcctaactgcttaaacttactaaaaaagctaggttctagacatcaactttaggacaacataattttctctaagttattccagaagactatttgcataaaacttttggaaatctccactccaaagttcttccactgtaaactgcacttaatcttttcaattagcaacatgcttaaagaacacaatacaatatctgggatcaatggtctagacatttctacaaactgaaatcatatacctatataacaagagagcaactgattgtgactcaaacccatcttgcaactacactaataatttggcattaaaaggatattctaatagagccatattcacagaaaacagtgtcatttagtataatttcttaagaatctccatttaaaattctcagaaaaatttaaactacagacccagagaactgatagttacttttattaacctctcctctgattataatacgactgtattagaagaccttaagaacaaattcagtaaagtaaaatttcatttcaatgcctttttataacctttcagttcccagaataggaataataattagcactctcatttctagtgcttgaaaaacaatgaagtatgtgctttaaagaacgaagttatatcattttcacctgcatcgatgctccttctactcttgccacacaggcgacccgatccaagaaagtcactgccacaggcaccgccacaaagaagcctttacaaaaggccttgatgtatcttttcacccacccttgtgactgtgccatacctaaaaatacaaagaaaacaactatgaaattagtctcaagaaaggtgaaaaacaaagacataaaaacagtacatgaaaagtaagagttaccgaagggcaatcttgtctcttaatatattacacactcattcctgtaaccattagaataaatctgacttacttaaagtcctaaagtgaaatacgtgaactcaggttaatgcttttccacaactcaagtccacttgctaacttcagtgggaaatttctccccacaaaacagtaagttagaaaaaaacaagcattccagaagtaaattcttttctgttgctattatgatgaagttactccttatacccctgatatctgttctcttctacagtaataaaagtttcagtggaacatgtggctgcccaactaaagactgttttccagcctcccttgcagctaattgtgaccatgtcactggatttgatcaacagcatgagtagaaaggatataattcttggttgcaccctgaaaaggaggatgccctcccttttcttccccattttataactgtaatactaacaatttggtggtaggagcaggggtggccatctcaaactatgagataaaagcttcaagtaaagatgacaaagcaacaaaatggaacgatcctaggtccgcaacaccatggaggcaccatactgtcctgcattgcttacatttggactgttaaatcacagataaatcacttgcgctgtttgtggtggcagtgttggtgttgttgttgtcgttgttgtttttagacagggtctcactctgtcacccaagctggagtcttggcaagacttttttggataagacttcaaaagcacagtcaatcatagcaaaaacagacaatggagattacatcaagctaaaaagtttctgtgcagcaaacaatcaacgtaatgaagagacaacctacagaatggaagaaaatataaggaaactatacttctgacaagaggctaatatccaaaaacgcataaggaactccaacaattcaatagcaaaaagacaacccaattaaaaaatgcccaagagcttaacaataatttctcaaaagaagacatacaaatagccaacaggtatatgaaaagaatgcgcagtcatgagggaaatgcaaatcaaaaccacatggatatcattccaccccagttagaatggccattatcaaaaggcaacaagtgctggcaaaggtggagcaaaaggaacccttatatctgtttatgggaatgtaaattaatatggccattacagaaaagagtatggaggttcctcaaaaagttaaaaatagaactaccacatgattctgcaatcctattcttaggaatatatccaaaggaactgaaatcagtatattgaagagatatttgcactcttatgtttatcacagcactattcacaatagccaaggtatggaattaatccaagtgtccatcaatggatgaatgaactttaagatgtgagatacatatatatatattatttcaccataaaaaaagaatgaaatcctgccatctggtacaacatggaaaaacctggaggacattaagtaaaataacccaggcacagaaagacaatattgcacgaccactcatatatagaatctaaatagttaaactcataaaagtagagagtagaagggtagttaccagaaggtggggtagttagtggggaggagaggttggggagatgttgctcaaaggatatataattatatttaggaggaatacatttcaggacatctattgttcagtaaggtgagtacagttaatggtaagatattgtattcttgaaaaatgtaaacagagtggatgttatatgctcttaccacaaaaatgataaatatgttaggtaatgcatttattaattagctagatttaaccattccacaatgtacatgtacttcaaaacattatgttgtatacaataaaactcacaatgttatctgttcactcataaaataaataaaaataaaaatactcaaccactaattccctcccaaatctttaacatgtcacaggaaaaagatgaatgataatctaaattggctaattctgaattacctactgtaactgacatcaatgagggctatatgtatgcaaggtaagtaagaccagtactcttgttttttatacttttatcaacatatattgcacataacattcacccaaaccagtaatctttttatacctaatcaaaataatgtaactcagactaactttagaatataagcaatttaaaaacatgttttcattcaaactcatctaacaactataatcttaagttaaattgcttatgagttcacacatctggtactcaagaaacgtgtttggcccaaggtactgattgtttctgcgagcagtcttaaccactatattcctaaaagagtaaacctgcttgacatgtttcattcattcatacccagctttaatgtgagcccttgagtgaaactaatttctcttcaatgacgtcttttgcctagaatcaaaacacctttactaactcattttatatatctctacaaaagatttaatatacttttccaatggactattttacaaagatcccatttatcatgtactacctccattaatataaaagaataaccttgacatatttatcaaatcagtaccttcaagatgcaaaagatgcattttcctcaatattagatttcattagctcagtctctctgaaaacacttctaaccacaggtttagcaacacaaacatcagtcttataataaatttaaaaacggaatgacctccacatctattctttttattgtttccaaaatatatataaataaataaataaatccaaagatttcagattataaaatatctgaatccacaaataatttataaaatgctcccatgtacataggaaaaaaaatagttactacgtagaagagaaaggaaacggctcaacagtaaataatcaattcctctttgaccagtttgatagcttcaaagttattttaagtggtctacacttatgtttaagtcatatacaactcccagataataattccagggtagtgttccccaagcttgccttgactgacatgcttaaaaatgaagatccccactccgactcagacctccaaaatcaaacacttcaggtgattcccttaatagagcaagtctggaaaatactgatatttgggtgtttaaaggtcagctgtttactcactcctcaagtttattaccttctgaaaatgaaaacaggggaaaagttagcaaagaaatatcaccctgaatgtctcctcacatttagtttacctccttactagattaagaaaaagtatctgcagaacaaacattgcacagaaaatgaacaccactaccagatcctactttgtaacctctacgtggttccatcagaaaatgacttccagtggattttctctttgccccactaaggcagttcaatcatccatccactcatctacccagtcacttactacctggctcattcattctttcaaccagtatttactaacggtcttccacaagcactgtgttaggtaccagggaatcataaaacagtgaacaaggccagtcccagtccctgatcttatcaagtttttacagtcaactatggagtgataagggtcaatctgaaaatcacataaacatacataagagttgtaataagtgctataagagagatacacagaggtcaggaaaggtctttgaggaagaggctgaactgaaaaatgaggagaacttctctagataaagaactgtgggtaggcaagggtattccagagagcagccatgtcacatgccaaagtccctgggtcaggagtggccatgttgtgatggacaactgaagggaggctggtgcagataaagcacacaggaagtggaagagcacagtgggacatgaatgggaggaggcaatgtaaatcccagagcagttaagacctcacaggccccgtaaggatttgcagcaaatgagaagtaactgaaatgttctaaaattgaggtgaatgatcctatctgcattttgaaataatcatctatctgaaagcctggataggacaaaaatggatatagggaaaccacattattctagtggtccagggcaagagatgatagttggagtagcatgatagtggagatggattaaaatgggcagatttatgtatatattttggaagttaaactgacaggatctggaaatagatggacaatggtgggagaaggaaggagataagaaagtgtcaaggggccgtggtagcctgtcaaagcactgctattctgttgttctcttgaattacatgtcaaaatatttaatactaaaattatgctcataattccattcctcaaactttttttttggcaaacaagcagatgtgctccctgccctcaaggagttacaatataccaaggaagactgcccttcaacaattatttccaatggatgagcattaaaagggacgatggccctgaagcatgacagcatgaagcaaggctgtctattcatcagaaaatgatcaaggaaggcctgccccactccacccccacccccaaaaaatggcatttgaggcaagacctcggcatttcaggtaaaagcagtaacatatatgaaggcctaggggcaaaataaaatgtagctgtttaagaaactaaaataagttcagtttggatagagtatatacagaatttattacgtgaatttttaattcagtaagcatttatttgctatcaagcagcaatgctaagtacagaggatataaagatggctaagcatacagtatagtaccattcaaaaactctcactaaacaataccttacatttcaacatacatttatatgtgcacataaaagtatttaaaattgaatatttatattgttttaattgtttaataaccactcatatgttacttgtgtaattattaaagtataccaaaagagggaagaaagcagcatcaaaatgctagcagtggttaattctatatgctaggaatggagacgattactattttcttctttgaatttttgctggtttctaaaacagaaagatggtatctgccctaggaagtcactatgatatacagataatacggggtaacactagtgttaatttctatcccatcacaatgaacaaaccacactctcaccccaatctctgctgctctaagtagtacaaataacactgagcaagattctttcctgtttatgcagcaatcaatatatttaactgactataatgttgtttatgtagccagtgcaggctatctatatttctggaaacttctggaaagttctgtcaaatattcgctacttttattttaagaggcacagaatggaaacatgtcttctctttgctgttcatcatgccctgcatgcatggaccttcacaaaacagctgaggatacctgcaggacagaaacggaatgcttccaaatatgatgccacagctatcttagttataaggtagtatgcatgattaaaatgtaaattaagggggaaacattaataaaagttgcattaaattcacatttcctgaattgtgagcctcctcttcttttccagtaatgctctcctacattacttctactccatgtagtcactggtccccaaaaaggagcatggtaatgagactcaggagacctgaggtagatatctgtctctgtctataaccagttccatgactttgaacaagtcacttctggcctgtttcctcatgtgtgacaagaaggggcttatttgggaggccaagcaagagggtcacttcaggtcaggagttcgaggccagcctgagcaacacagcaagacttccatctctaaaaatttaaaaattagcaaggcatggtagcatacacctgtagtcctatctacttgggaggctgaggtggaaggactgcttgagctaaggagtttgagactgcagtgagctatgactgtgccaccacactacagcctaggtgaccaaacaagaccctgtctccaaaaagggggggggggtagatttaatatctaaggttctttctaagccagaattctttatttctataactttttattgtcttttaactgtttcttaagaactttggcagatactaaaacaaacactgagatcactattgactaagaaaaagtgagttgcctttatggtttgagacttttttaagtattgaaaataaaagagaattaactttttttaaacaactggttaaaagacccaacagtgagggagctgaaaccagtgccaatgatgtaaaagaacattttaaatatagataaagacctgaacaccgttgctctttcacttctcatttccacaacctgactgctgaccagagcattgctaccatcgcctgcacaacaaagtcagggcaagtgtttttctgagagattataaaggagcatgtgggagatgtctcaatctgatatgtgctgatcctgctccaagccaaggaagcaagagcaataaaagctaccctggaaacaaggtacaagtggttgctattttcagaggctcaaaagaaaacgctcaattcagtcctgttttatctgaattgtgaggggcacctatatttcataataataaaacactgttaaaagcttctatcatgtaaatactaaagaagccattcatacatgaagaaatgaacacaacatttctatgttgtcatatccaataattttcttaaagttttatggcattcacatattggcaaagttaatgcacctccttgtctatgtaaattgccaaagaatcattcagatgatccggtcttttgttcacaccttaaatgtttaaaaccaccacagtaataagtacctagccccgacttcctctgggaaaatttcatctaagcaataacaatcaggtactaaaatcacccccagcaaaaagggaataatttttatcagttacctcattcttcttgtaactatggaagtcactgaggttcaaaacactgctcctgagaaaattattgcttaaaattgtaagtacacccagttcattgttgaagtgcttaaactgagaatattttttaaataagctttcagaatcaagtgaaaccatatttgccacctggcatacagcacttacaagtgagagtttcttggtgatgctgacctcaaccacataacaacccacactgtaaatttctctccttcccgtaacaacttgtggcttgatcatgcattaattcatctaaaattgttcttaagcctgcttatattttagcttgtacaaagtcaccaatcactcatccatggcaaccaggtggataaatccaccacaagtcatcctaattataaaaactatttaaaagttgtgtgggaggtttgaaggtaagaggaaaataataagttataaagcagtatcttatgtaaaatgtaacctttcaatcatcataagcctacacaaaatcaagattttatttataaagaggaaaccatcaaactatgaatatcagagaacacaagagtagggatccaagcaaatctgacacacaattcctgaatcagtcagtatatgtgtacctaccatgcaccatggaattgtgctaagagataaatatgtgttatagaacaaggtcagcatggtcctttctccacgtagagtttgcattttcattctttcaacattaagtgcctactttgtgctagacactatgttaagacaccagattgaccaagccatacttcctccccagagggacctgtgacaaggtcacaagaaacaagtatatgaccataaataatccagctatcatcctccacggatctttctagcagcccctggtaccaataacctggctcggcaaacagagcctaagcatgtgaaaaatcaggagacatttggatacatgtggtctaatacaaggataaaaaagaaaaactgatgaattacaacaattttggttccactggaagcagatcctggcaagtaatctatagaaagcaatttaaaaaattttttcaggactatcttgctcctttcacattataagtaaacaatattttataaacagacacttagtactctttagaacatgaataccagtatcaaattctttatctttagtcttgtctgacctagtagttctcacttgaaaattctcaggaaagaccaaaatggcacatacacaaaaaaagaaataagaaagaaagaggaaaaccagccaaaaataataaaggaggagaaatgtaattatgtaaggcataaagttagtcattttttggcaaagatacccaataaaaaagtcaacactgatacaatgatgaagctaagccctataaaattgcttctttcatggagataattgtgactttctgttggtaaactgataagcatctggatactaagagaagagaggttaaaactgatgtattcaatcttaagtcagcaatatgtaaaaacaaatgaatttgaaggtcatgctctagtacaactgatgtagagagaaaatacaaccaggaaacaactaggatacagaaattcataaaggcttcctgatttttggtaaggactccttcaacttgcaaacatcatgcatttatgcacacccttccctctgattcagtggaaaagcaggccccatcctatccaaggtgctcttcagaagcagcatcagcaaagagggaaagtcagtgaaaacctggtgggctttgaatccaagacctcagttcaaatcgtgattcaacagtgtggaaattactttatctcagtaagcaaaatttttcatctgtgaaaccttgcagggtttccagaggttcaaaatgttcatatgtgtttgttttcttttgtttacataagcatttgtgtaaagaaaatgactagatcatcaaataaaggatatttcttcagataaagcactagctatgtctaaggaagaggactagtaataacaaatcaaaaaaggataacagaattaaggatgtccattacagacaataaaccaataaagcccatcttctaggtgataagacacctaatacataatcattttgttctgctttgaacctcatgctgttctaagatttgaccagttaggggcaatcatatgtactgatattaaccagttaacaagaatgtattcagcactgtcttaggtgtcttgagatttttttaaaagcaaaataaaaggaaatataagacttagtgccagaattggaccacagggatagattatataatattcattgaggaaagaataaaaaggaagaaaactggaattacaggaaaaaaattcatgatgagaaaggctaaaaagaaaaaaaaaggaattagaatgtaggtggtgggtttaaaaatgttcattataaaattcttagaatgtttctgtatgtttaaaatttttcctcaaaactttggaaataaaagaataaattacatctgttaagtcactcagataaaagaaaaatataattagaatgaagatgcatacagcccatctgagatagcaagaatgctggccagatcagcgaacaggacctatattaagacaagtgagacataagactgaatattaattttttttttttttttgaggcagagtcttgctctgtcacccaggctggagtgcagtggtgtcagctcactgcaagctccgcctcccgggttcacgccatcctcctgtctcagcctccagagtagctgggactacaggcgcccaccaccacgcccggctaattttgttttggtatttttagtagaaacagggtttcaccatgttagccaggatggtctcaatttcctgaccttgtgatccgcccgcctcggcctcccaaagtgctgggattacaggcatgagccactgcgtccggcctgaatacgaatttttcttgttttagttgttttctttttttttttttcctcatcaatatggacatcttcatggctccagtatttttggaaaccatataaagcaaaatcctttaacaataatctaggactctctaagaactggctcaggccatcctaatcctataaattatccttatcctgtaactccaaatagacaccatttaacagcatttacaaccaaggcctaatctcaaatttcagttattaaaatgaaataaattctgcaaaaagtttaccataaaaattaataagacagtgaatagctttttacaggagaaaaatcctattaaatgataaccattagcacggagaagcttggtaagctttaaaccctaataaccacaaaatttggatttcaacactgtactttatttttttccaatttaatagaaaagcataactgctatcattaagtagaagctaaaggcaacgtgaattttaagctaacaatgtgaggacttaaatatgtatataaatgaaacagaccagctacttatccataacccaagcaaagcaattagaggatacttttcaccataagtccattttttcttgaagtaataatacagtgggttagtaaaaggatatattaccagcatcaggaatacttactgaatagctaagaagaaaatactgcattatttggcatttgggctgtgttcaaaattggctttaaaaaaattaagaaggcctataaatggaaaaagcactctttttagaaaaaaaaaatctcaagaacctttcaaaaatcaaaacttagaagaagtgagataggggaaataagaaaaaggtagtaacactcagaacctaaaaaaagaagggtacaaaatattagaaagtgggcattaggcaataacatgagtaatggaaaagtatcactagaaaccatgtgacagccagtttccaaagcacggtcatccaagtaccaagctttgctgttccttatctactttgctacctcacattttttcctactatctgacactgcttcatattcacttctcttacactgcagccctacttcggtcttattttagaatggtacaagggtcttattagggctcaacaataagcggaattgaaaaacttttttaaagaacatggtttctgggtctcatgaaaatcctatcctgatccctactcttcatgcctcaaatatattgctatctatactagaatgcaaatgcctttactagaatgccatatcaactcaagtcatacttacaacatggcttttcctttgatcagggttgggagtaaggagtaggaaggcttctcaaaagaatcaggccactagaccccaagggacaaaaatggaaagagaaagtcacaaaaaagtaggactgaaaaatacaatttaaccagcaaacttatagctagcccagggactattactactctttacaaaatgataaatacaaaaaaattagaaacacaggctcccccatcaggaaagcacattaaggctccaattagtctgtcaaaaataaaatctattcagactatggcttgaagatttggaaaggtgcccacagcccatgtatggcagctgcaagtccatggggagttcaaacagcaacagtgcagagtcagtactgaagatgcaagccagaggaaaagatttatgcaatttaaggtgaaagcaacagaaataaactcccttggaatgagtgcttatggtccttttagcttataagtgcaagtgtacccacaaacatgcatgcacacttgctgaaatggcaacaaaggccaagttagcagcatatgttaaaaaagaaaaagtaaaaataaatatataaataaatagaacagccaagaggccagagtataaagcagctcatcctgagtggcctggagataaaagcagatggagcacagcattacccagactcaagtgtctgttgcacaaaaagtccaggtattataacgagcctgtggtattacagcaaatggaactgcgatctcatttagattattctccactcttatatgccttgttttgatttctgcatacttgcctataaattggaagacactgttttaagatacctgtgaaatttcatcaactgtggctagagttgaaatcttaacttcaaccttaagagaaacactgaatcagaactacaaagctgacccgctcctaaatttctgatgatccatggaaactgtgtgagataataaatgtgttaagccactgatttgggtggttatttgttttgcagaaatgactaatacaatacaaaatgcacaaaaagacccaagggcgcaaagaaacttggtatttgataaagtcgacattcatattgggaagagaagttgaattaacaagttatgttgaaacaattagctacaatttggaaggagaataaaatcaaagctagatatttattaaattcattataagaaaataaattccagataagccaaacattatatgtaataaatagaaatataaaaataacaagagaaaataaaggcaacagtcttttaagggtagaaagaggtctttctgaacattttacaaaatccagaaaacatgaaagataaatactgatagatttcactacataaaaatcaaaacataccataaataatgttaaaagacaatcagcaggacataaaaaattataatatcagtatctctaaaattacacaattcttataaagtataagaaaaaagacaataattttgagagaaaggtatttcactgaaacaaaatatggacagtatataaagacataaaaagatgtacaaacacactaataataaaatcaatataaataaaaacaaagtactactttagtctatcaaactgacaaatttaatatggtaatatgtaccaaaatgttacatgaatataccttctgatgcagaaacaccactccaggaatttattttatggatgcaaagatatgatcaacgatattcaacataccatttttattgcagtgaaaaaatgaaaacaaccaaatgttcacaaatatgtaaataaattatgacatgcatacagtagagtaatctgcaatcattaaaaagaacaatatatcgttatattgcttgagattctcctccaaaaaagttggaaaattgcatttttaatatgaacccatttatgtgaaattttatacacacacagcatcatcctcatcgtcatccttatcatcatcatcatagaaagaggtcaaataataaagaatatgaaccaaaatgatgacagtatttatttgcaatgaaaggaatttcactttatgctttatatttttccatattacttaaatcttcagtaataggtatttagtatctttatatactaaaacaaaattaatattacagtcttttctgctacaatagctatttcttaatgtaaattagctcatatataggaaaatgacgtcagtcttatgtgaaagctatgctggttcatacacaattttccccagtacatgaaggttttgattcaaccaagagcaagtcttctcccaattaaagtgaaagtctcatttggtggcttcaagactttccactgttaaaggaggctgagcataccaacgaagaaatgcaaagatattttcccctgtgtttaaaatagaataaaatcaacagatcaatatcctagagcagattttcaactttgatgaaattggtctgtattagaagtagatgactttaaggacctacaacaaaggaagaaaaccagggtttcaagctaagactgatgtgatgctgggtgcaaatgcaaggagggagttaatagtgctcgtttttatgacaacttctattttctcagctctgtttacaaaatgtcactggtttcaaatgatctgttcctagccctattttctttataagccctaaaattttatggtttaattttgcagaattaaagatttttcaggaatgcatgtatgtcattaataggagaaatgcctctactattctgagtaaaatgcagtaaggtagagaaatgttccatatcaaaaagaaacaaaaaacaaaaaaaggaagcaaaaaggagaaatgaaggaagggagggaaggaaagaaagagggggaaaaagaggaagaggaaagaaaaaaactgcacacttcactttgttttagtgagagtgtctaacgaaagatattaaatgcagggcaaaacaatctcattaatattcttgatttataccacacattttgattctatatgagatatatctaaagaaatggtctttgccccatcggacacttaaaatctaaacaagggagtgaattaaacagtcatcaactatggtggggcaggaaaagggactaatccaattaactttaggacacagttatttaattatacccaacccaagggtatagagtcaaatactataggcggtatttgggctgggaagttggggggtggggaatgcaaacagtgagagaaacaattgtgaaactacttaagatacattgtaggactcagcaaatgagttgggagaacagtggtgactgtgggaaaagggagataaaaatacacagtgggaatcagggaagaatgctgtggggccctggaagcaaaaccatatagaagtagcaatgagtatatgtagtactcaattcttagggtctaataccattccctactccaaagaatcagcaatcttcagagtaaaggttgattctggggctgtggtggggaaggtttaagatgagcctgaaacattttctttggccactaagaagtgcttagaaaaaagatggaagtacatcaaaaggagacgggagcttgcctggtgatcccactggctaaatatgaaaaaaatttgattacttattaaataaagtcagtaatgagtttaaactactggaaaaacagctttgaatgtgctaattttctgaatctgagcaatactttaaaatatgggttttagcttcaaaaggtaaatcaggtaatttcattttatttaagtaataccatgaaaataatgttacaaactactaagttaaatacaatatgaaatattggtggtgggttgttttttgttgttttttggggtttttttgaaacaaggtctccctctgttgcccacgctggagtgcagtggcatgatcacggctcactgcagcctcaattcccaggctcaagtgatcctcccacttctgcctcccaatagctaggaccacagatgcacaccaccaggcctggctaattttttatattttttgtagagatggagtttcaccatgttgcccaggctggtcacaaactcctgaattcaagtggtccaccagcctcagcctccggaagtgctgggattacaggtgtgagctactgtgctccgcctaaaatattgttttaaaataagtcccctttatgatcattctcagaaatttgttagaaaagaagttcccttgcacatataaaaaatttttttcaatttataaattatccttctacactaatttccaaagaataatcattgagatgagttaaagcttttcactattctttgaatattatatcagcatatccaactgttaattgaatttgagatccactagtaaagcaaaaagcttgtgactttgaagactatttaaaatgtacaatgttttattaattatcattagtagtactattatacaatggttgtacccttgtaagtttgttaagaaacagctgacattgaaattgtctgcatctaaaggacatgtcaggaaaagcagagaaatcttaccaaaaaaaaaaattgaatcaacatctcttcttttggtatttacccctttcacatcaataaacatttactgaatatctgctaagtgccaggcatcatatcagtttctataccgaaagagtaaagacgtttctgtatagtatctatatagatattgaacattaagcattgttctttggaattattccagccttgagataaggctaaaagggccataaaaataaaatgaagaaagatggattttataaaggatagaggcaattggggatgttatggaaagacaaactacacagcattttatactctctggttcttctactttcagagaatgactctatcatccaaacagctgcccaaaggtcaacatggtagtgagccaaagtgagcattcatgaaaaaaatagaaatcatcctaactttctcttactttaaatcgttcaataactcctcattttctataggataatatcaagctgcttagatttagcatataaggctaattatgattagattcctagtctcatcacttccacttttttttttttttttttttttttttgagacagggtctcactctgtcacccaggctggagtgccgtggtgcgacctcagctcactgcaacctctgcctcccaggcacaagcaatcctcccacttcagcctcccaagtagcgggaaccacaggtatgtgccaccacacctggctaatttttgtattttttgtagagatggagtttcatcatgtttcccaggctaatctcaaactcctgagctcaagtgatctacccaccttcccaaagtgctgggattacaggtaccagccaccgtgctgggccagttcctctctttcacagcacatcatgcttcaaccaaacccacctccatacaatttctagaatatgccacacttttacttgtctctgggcccttatacatctctcccttctgtctacatcactcttcccacctttctttgttttggccagctttacccatccttcaggttagcttagatgtcactatcaggaagtccactccgactctccaaatctgacttagatttccttcctatgtgttcccataaaactctatgctccccctagcacagcatttatcacacctgattttctcatccttacccctaatcagttgtgagttctgcgcgagcagaaacacttgttcactactatacttaagtgctttgcacttaagtgctcagtgttcaatacagtttcattgaagaaattaattaaccacttagctgtccatataaactacatcatactcagaatgtgatataagttctggaggccttgattgaacagcactgcacaaccacatgccataaattttatgtgtgtgtgtgttagtttgtgtgtgtggtgtatgtacacacaaatgactgtctccatctcttacctgatagttttacttcacagctgaagatatttatgaagaaagtggtttttaaaagaaattatacttatgctgtaagtataaatatacacagaaagaaatatgtgggctggacacagtggttcatgcctgtaatcccagcactttggaggccaaggcaggaggatcacttgagctcaggagtttgaaaccaacctgagcagcataggaagaccctgtctctaaaaaaaaaaaaaaaaaaaaaattaacatagccagtcatggtggcacatgcctgtgctcccagctactcaggaggctgaggtgggaggatcacttgagccaaggagatcgagactgcagtgagctctgatcacaccactgcactccagcctgggtgacagagcaatgagaccctggctcatttaaaaaaaaaaaaaaaaaaaaaaggctgggcacagtggctcacggctgtaatcccagaattttgggaggctgaggtgggcagatcacaaggtcaggatgttcaagaccagcctggccaacatggtgaaaccccgtctctactaaaaaaacaaaaattagccaggtgtggtggcgcatgcctgtagtcccagctactcgggaggctaaagcaggagaattgcttgaacctgagagacggaggttgcagtgagcagatcatgccactgcactccagccttggcgacagaacaagactccatctcacaaaaagaaaagaaaaggaaggaaggaaggaaggaaggaaggaaggaaggaaggaaggaaggaaggaaggaaggagggagaaagaaagaaagaaagaaagaaagaaagaaagaaagaaagaaagaaagaaagaaagaaagaaagaaagaaagagaacatacgtcgattactacatatatatctgtatattgaacttcaggaagttgacttttctgtatttttcttcaataaatcataacacaacactcttgtccaaaagcagtaaagatggataagaaggatcaagtaactttcataatccacccaactataaggcattaagaatttttttcccaattaacagctgatttttaggaagtgtttagttagattttctttcaaagcaattatttttcagtctgtgcttcatggtctcctaatgattccctggagtctcaagggccagggggagcaggtgctaagtgaacagagttctgaactgcctcaatcagagccactctgctttttatctggttttttttttttcaataatggaattccaaccaagattttctttgaagaagggttcactacattaaaataagaataaaagaaaaaaagaaaaaggttaaaaaacactgccttaaagaatcagcagtggattgaggtttgcactatataattcaagctctaatgtatttcatatttcttggttagactaaattcaactgtcagctttataggcctttctttgtgctaaaatgagaaataccatttgaatacaaaaatatccaggtagagggaaaacaaaatgggtttttgataagtatatttattctctgatgcagctatttctaaatttacttattatttttaatggctttatttatgtaccaatcttcaagttaatgattcataacagaacaccaaaataatctaattgaacaacagaagcccactgtaaatgccagctgctgctatgtttcatatactgtaaacaaatacccacctcattttaatagtttcttagtagaaagattaccttaaaggaaaagatccaccaaactcatatttaaataataattttagctattttcgcaatctagaaacaacaggggctccgggtaactgaaactgggggtgctccatcataaaacatccagaagaccagtggggtgaatttgatctgctggtgaacacaatgaagactaataagcaaaaatgggcttcttccaacagaaacctcctgccaacctgtgcacaacattgtgcaattgcagaacggcacttcactggaagtcagggaaacacttgcaatcaagtccaggctctgtaacaagttaagtgaatccaaaacctttacagctgaacacataaaattattcaaaagctctaacgaggtgagaagcaaccaaacttgattttcatctctgggaaaccctatattagcactgtaacccacaaggccctcttccacttccaaactcctctggcattcactagccacaccttcatttggcacccaagagtgttagttaccgttttataggtaactccccaactaagttgtaagcccctaaagggtatacataggtcatgtctcactcttttctatacatcctaaaattcttagaattttgctaagcatttgcagatgctaaataaatgtatcttgactgtttgtttaattgtagatatggtttatattaccacccgtttacaatgttgatagtttcatatggttgtgtcagacgacattccactcctttaaatgccagtcaggagagtaacggagaaaataagcggccagatcaggctgtattgacagccatgcaactaatctgatactacctctccatgcatgcgtccctcccaaagaccaagtgcccactctgttctagggctaagtgttttctgttcctgctatgctttgtaccaagtcagaaataagatttggattcaagtcttagctatgccaatgagtaagcaatttgaatagatgaccttagctccaattatctatgattctatgattctaacttcaggcctttaccttccaatatcagaatggcccctccctcacagtactaaaattacttatcttccatgatatgtcccattatcatcatcaatacacccatgttcaaaggccatttctgacttctgctacaaggtcaacatactcatgaaattatttacacttctaaagataacactgttaaatttcttgtctgatctttacgtcatacctgcgttcatttaataaacacaagtgggtagttgggtaatatgggaaaagacactcatttagggaagtttctaacatattcctgctttcagcagcaaagataagttatggctccatttgcaaataagcaccaataatagtaaataaaactaaattatttttatactggtcactaggaaggttgttttcatcttaaacggcagcttagtagccttgagaataatctgatctctcccattttataagaaacttatttttattgtctcatcaacatcaaatgatattagggagtttcacaatgactgtgacaataaatggcttagaaagaaaattcagtaacaattttgataggttttaaggaatatatgagctagataaaaatatatgagccatatagagatttgatgcaatttaaattaatatctaccagttttgaaaaataaagtttctcagaacctaatgtagctttcttctgcaaaaaagacgaggcatatcacctaaaaagacctgtccctaaccaactgttatccaagtaattaaaaagaaaagtgaaaatttcacctcttcatacatgttaagcaaaaccagccataataaaatccctgatgaaaggtgagttttaaaaataaaagtgagacgtaggtaacagaatcctccaagaaatacttaaaaggttagttttcctcagccaaaatcatatcaacattttcgtatattttggatattaacctcagtacaaatattagattatcaaacataaaatataaaaatatttggctaatggtatagtaaggttttgtttcatttttaatagagtgattagccattcacaaaaatcagtcaatattactcctccataaattatgacaaaaaatatacaaactctgaatgaagcattaattgggaaaagaaaaaagctaaatatttttattgtgaaactaataaaataaaaacctcagtctagtagagaatatacactttgtgttgattaaaattttatatcactatgttaaacacagtaatactgaaaattgttattttaattacctcatttaatctctacattaaccttatttttatccccattttaaaagatataaaccgatgctcagagtgcttaaggaatcttcccaaggtcaaagaaacagtaagtagcagagctgaatccagattatttgaccctgtaaactaggtatttaagcactatgctacactgcctccagttattcataactcccaataaatattcaacactcccaataaaacacagggcacgatgagttattgatttcataactgctactgcagcattcagatactacttatttggaaaagtgttctgaatacacaattaattcaatccactatgtaaaaggtaaatgttcaagtctcattcaaatggagaaggggtagaaaaggaagaaaagtacaaagtctatatggaacatcaattaataaaaaatattatcagggttgtctttaaacttcacaattactgaaggtccttattatcttgctgtcatttcagcactctcaattgcctcttagaatttgaaatttcactgttgaaacaaaagaaacataaaatatatgtgcattctaaaaaattctgcccttttgcaatttatcttctacatttattacctggatcttctaacactcgactagaaactaaagcaatccaactgtatatacaaaatgtaaaactggaaatgccagaaaatcaacatgacctttcaaatataacattttccacaatcatttacttaatactagaaaaacattttacagtatttaaagcataatctttatgtgtaatactttcggcaaatataaaagcaaatacagaataaagtcaaccacatttttaaaccaaaactgcaattaattttaaactactactttttctccagtagttcattatctatctattaaaacattcataaccatattagtgtgctctccgtttcaaatacaaagctgatgttaaccactgtactagtcacctcctgtacctggtagggactgctagtataacaaacccctcccctgacaccaatttccctatattagtttgcttgagaacaaaaatatgtattgggcaaagaaatgagataagccttctctgtaagccagcaagaccactcttgattaatccccaacgtactggcctcaacagcatggcttctaaccaaccagaatcctcagtcaaaaatactttaaacaaagataaaaattagctagaagatcatgttaccctaaaattaaattttatttgagagcaaatgtatagcctttatattttctgatccaatcacatctttgttaaaagcaaaagatatgtaaatcaacactaataggatgttagattttccaagagagaatcacacttcagataaactactactcaaaatcttttttattccataatcaaatagcaatccttaagaatatacctttcattcccttttgactactttaagtatttccaaaagaagctgaacagaaaatacttttcttcagacttttttccgcacatctcctagcaggagagaaaaattagcaaaacaaatgaactcagaatcattaaaaggtgtggacagtgtccatcttatagctttaatacctaagaattaggaagaaaaagagatcaaggaaataaagcgaccaacataatacctggctgaaggacaaattctatacttaaaattaagtatggctctaaaaaaggatgagtttatgtcctttgtagggacatggatgaagctggaaatccatcattctgagcaaactatcccaaggacagaaaccaaacaccacatgttctcactcataggtgtgaactgaacaatgagaacacttggacacaggatggggaacatcacacaccggggcctgtcgtggggtggggggatggggtgggatagcattaggagatatacctaatgtaaatgacgagttaatgggtgcagcacaccaacatggcacatgtatacacatgtaacaaacctgcacattgtgtacatgtaccctagaacttaaagtataataaaaaaaattaagtatggctcctaccgactctatgaattcagttcatatttctttaatgcaaagagagaaagagcaaagttactgaatgaagagataaaagtgtaaaacatcaacaaagcaactaaattagatacctcacctatcacagagaaaatcaacaaggcccaatgaatttatatgtacacatttacctttggaataatacgtcatctgctttttgtattctagacatgttctattccattgactgggaaaaatcgaaaaggtggcctttgtagcagaggacaaacagaactcaggcttagtgtaacagagcagcaaaataaggtgagagaaaagcagctgagaaggggaggtttacattcaacatgtataaaaataatgtatattggctttttttttttcatgagggaaggaaggtaactggctaccctaagaatgaagcagaatcagcatggcaagaaacaaaacaggcagaaaattaaaggatccctgagaatggtttataccccaaacaaaacaaaagtgagacaaagtagaaaaaagaccaaaacccaaactaagacaaaaaccccaatcctctctcttacattgagagaagcagaataagacaacatcaagaacaaaatatctgcatccagaagtcagactcacacacacacatactctcagagcagcaggagaacaaaaggacaacatattttacaatattaagataaaactagtacaattatatttttaaatattaattttttttaaaaaagagaaagaacaggttggtcagctctgcccatagatgcttccaaaaaactccatagcagtcatcctaatggatgtgagacacaatttcactaggcctttgatatgcatttccctaatgattaatgatgctgagcatcttttcatgcccttattggccatttgtatattttctttgcagaaatgtcaattcaaaccatttgcccatgttttaatcttgttgttttttcttgtagagatgttcggagttttttgagacagaatcttgctctgtcacccagctggagtgcagcggcgcaatctcagctcaccgcaacctctgcctcccaggttcaagcaattctcctgcctcagcctcctgagtagctgggattacaggccaccattcccagctaactttttgtatttttagtagagacggggtttcaccatgttggccaggctagtcttgaactcctgaactcaggtgatccacctgccctagcctctcaaattatatactgtggatagtaaccccttatcagatacatgaactgcaggattctttttaaattcatttctctattccctaatttctcagagttggctatatgtaatgcagaagtacattttgagttgaatatatttcttctttgtttttattttttacctaatacaaaatttacaatactcaaaagaggaatacaatggaaaataacctccatccctgttcttcagctacgaagttccaatccccagagacatttttcatcttcttataattccctccagaaatattctatgcctatataagaaaatacatttcttaagtctcctccaaaataatctattcattgttctgcattttcctttttgatttactacatcctgaagattattacatttcagtatatataaactgccttatttttaacaacataaatatttcattatatatactataatttatttatccagtcccctaaggatgggcatttgtttccagtcattgccaagagtatccttaaatatatgttatttcacacaattacaggatctataggatacaatctagtagaaaacttaaatgctatatatatttcaaattttccaaactgacctcaatgaaaattgcacaaatccatactcccattagcaatgatcacacttgcctagttccctataccctcaatgacacattgtgttttcaaaatttgtttctttgccaattaggttttaaaaaaaggcatctcattagagttttaattttgcatttctcttattatgaaatattaatactctttgtatctttgtccatttttctatccaattgttggtcttcttcccattgagttgttcgtgctctttatatatttatgaaatcagctgtcttcctatgatatgaattgcaaacattttttcctagtttttctttgctttttgatatactttgttttcttaattctcaaatttaggaacaaaagtacttccactatgtctttgttcaaactatattccttattttgaatgttcttcccttccttcaaaggtcaattcaagttgatgtctctgctctctccctaatcactcaagatcaccttgattcaaaaattatttagtgagagcctactgcattatatttacaaataagtaaatccagtgaattttgtgatatagtagcacacagcaaggaaaatttatagaggccactaaacatttaaattgtatctgaaaaaatgagaagatatgatccaaattttaaaaatgaaacaaaggcccaggtaacgagaacttattgtctataaattagtctcattggggtacagaatgctaatgttgtagtgaaaaagagaaaaagctgaagaggcaagcagagccaggtaggataggtcttttaggccaatttaagtaagtttttcttaatctaagggcaactagaagccacagaaccattttaagcagcagaatgctggtcagagaagaattttacaaagaccactgactgcaatcttgagtttaaccagcacttcagtgaacagagttgaaactgattcaaatatcaaatatactcttatttattcaataagtgaattttaaaccactatggaatagaatgctacagaaaggtgaaataaggtactgtgctgctctacttccttaactgagggcttggaacaatcactgttgcaagtcaatttaaacaaccagacaatcagaccatgttaaagatgagacctctaataataaaaaatcatagttgattctcactttatcataaaatccaaaacggacaagtatgggcccaaattcatgcagttcactcaacaactgtactcttacttctccattgtaggctaaacaaactgtcataccccccccccctttttatcctgcttttttgcttgtttttttttaattttttatttatttaggttgggggagacagggccttgttctgtcacccaggctggagtacagtggtgtgattatggctcactgcagtctcaaactcctgggctcaagagattcccctgtctcagcctcctgagtagctgggactacccatgggcaccaccacaccagtctaattttttttttttttttgagacagggtctcactgtgttgcccaggctggtgtacagtggcatgatcacggcttactgcaacctctgcctcccagtctcaaacactcctcccacctcagcctcccaaggagctgggaccagaggcacatgccaccacgtccagctaattttttgtatttttgggagacacagggtttcaccatgttgttcacactggtctcaaactcccagactcaagtgatcctcctgcctcagcctcacaaagtgctgggattacaggtgtgagccactgcacctggcccatcctgctttcaacagatgacattaaatgtccagaaagaattcatgagatgttatgaccattgaatttccccacgtttagcctgggtagtgagaaaccagtttcagggagagaatattatctatcagggagagaatattatctatcttgtcacccaattcaatcctctaaaatgaccttctatgtgcttgctacaaaaaaaaagttcttccaaacaaatacattcaaaaaataaagtttgtttgactgcatgcttctctagaatgcttttaaaattttcttctccccattctcaatatcataaatcaggtaacacctaacaggaattgtctgtactatttcttatttgctggtgacaattcctttttgattccccatgtctactttaggggttagtggtttaacagtcattcttacatcttttgtcataggatattccaccgttctgtctttagatatatgatacactttgaagttaacagaagaaagtaaattagtataaatacaaaaagttgatattacaatataataagcatgtcaatggtactaacaggagatgacaattacacctttatctcgaagtaatcaccatcaaccattctcaaactcagaagtgtatagttttttttataattttaattcattatcatgtcacttaccatttttctctaagtattttaaactatagggacattttgattgaaactagaattgtattcaatacaacacctccctcaggaatttaactttacaagcctatttctattctcttcccaagaatctttccatctaattctaccttgccctcgtggcttaacccatacagagactggtcataagtgctttagaatctagcattttcttcctacaaacaggaaataatgtgtctctgacactatccaaaaatgtggcaacataatttatgcttttggaaggaagactaacatctcaagctgacaactaggtaataaatatgattaagacccaagcacacaatgagaatatcccaaagggtatacctttcagaagaagacaaggcttaatcagtgagacattttcagcaaaaaatacagtcatttttttctcagatgctcctaaataaccatctttttggcagtattgacttgttagccccaaatcattatttcccttctttactattaatcttcaaaacaaaaaaatttaagtctatgatagtaaccaagtctgactcattaaccgaacaattccccactattctctgagtttaaattcacataggattcttacaaacagcttatgaagtcctcaaaaataacccatgaagtatgtgttatctctgctttcccagaaggaaaatgaagttcacagacaaaaagtgacttgttcatgttcacataggtaataacagagctagcacctgaataaagatcttacatatccttttcactatatatcaccactttaacatctggatatttatatttaaagcctattttttaacttttaatatagaagttttaactgaatgtttagagtattagcataatgtagtcatatacatcagacaggtctcaaaaaatcttctaatatgttgtcataatccacatactcagactacaggatgtctcttaaacatgagaaatagtaagattctggccacgtgtggtggctcacacctgtaatcccagcactttgggaggccaaggcaggtggatcatctgaggtcaggagttcaagaccagcctggccaatatagtgagacctccatctctactaaaaatacaaagattagccagacatggtaacacatgcctgtaatcccagctacttgggaggctgaggcacgaaaatcacttgaacttgggaggcagaagttgcagtgagccgagatcacgtcatagcactccagcctggatgacagagcgagactccgtgtcaaaaaaaaaaaaaaaaacatagtgagactcataaaaagcacaagctaattcatttataaactgattcaaactgccctcacataataacagtgctaaatagttattaatatttaacaaaactaaataataattattcagtatttaaatctgacactaaaaaaaactcttattcaagcaactattaaacaaataagctcctgggaaaataccaagatccttagtaaataatctgcaataccaataaaactaaaaataaaggccaaaaaggctacatactgtatgattctaactctatgacattatggaaaaggcaaaaacattggagacagtgaaaagatcagaagttaccaggggttaggagaagggagggatgaataagcacaacccaagatttttaggcagtgaaaatactctgtatactataagcatacatacatggcattacacatttgtccaaacccacaaaatgcactacaccaagaatgaaccctaatgtaaacaatgaactttgggggataatgatgtgtccatgtagtttcatcaattgtagcaaacgtaccattctggtgggggatgttgatcatgcaggagaggctatgcatgtgtgagggcagggagtaaatgggatatctctgtaccttccattcaattttactgtgaaccaaaagaccctaaaaaaaagtctattttaaataaggcaaaatatctgcggcaatcttaatcttctcctatcaattattacttcacaggtcctctgttaactatttagtagaaagcatccttggctgtcaatgctaaccttctgcacagctcttatttacacacacattgctcctcataacatctgctctgcccactgtagcctgcttatcctctaatggtcatcagtatactgagtccaaagacagggaaggagtcaggtacaaatgagatggagaagacaggtagtggggctaaggaagcaaagaactgctaaagagggaagtcagcagataaatctgcaggagaaaatctgcagcaacaaggagaaaagaatcctgagttgatacaaatttgtttattggtttacataatgggaaaatcatatgaaatgaaattatcctaaaatacaaaacatgatgacattacaaacatttcccttctttaaaaaaaagtctttgctgtatacaattccgtaactagaacttgataatctgtttgcaatgtgtcccccagcgacaagcaagatgatttttcaaaagttgactgtaaatgctacatttttcaaaggaaagatatataaaagtgtgtgtgacaaagacctatgtctcagaataacttggaaaaaagtacaaatattaaatttttatgatttattgcctgaaagaaagttgtacacttttatattctgggtattcttaatctaagaagtcaagaacatactatgtattaccaaactgggcaagagttcaatgagattctgaaagttatacctaacgtactatgtattaccaaaaacatacaatatgtttagtaacaaatagtatgttaggtatgttaggtatgactgttagaggtgtgtgtgtgtgtgtgtgtgtgtgtgtgtgtgtgtggtcacttgcttgctttggtcatcggtgaggaagccaggctaagcaactaacaaagagtccaaatatctgagtcatttatgagaggctaagggctccagtggcaaatcagggacctataagacaggctcaaagatggttctggcaggatccaccaccaccatcactaccacctcagcaaaatacaaccttcttcatctgaagtttcagggaagcacaaaggctcgagttctgccagcagtccagctcagtaaacactgattaagcaccagtgaagtacaaagcattaggttaaaggtgataaaagacactgaataggaggaaatatagcccctactaccttaagaattttccagtaaaaaatatggtaagactataatccaggcaaggtagagcaagtactaaaagagaaatacaaagaaggcattcagaggtttcctcaaggagatgctctagaatgaaacctgaggctattactcagatgaccaacaagttcatgctatagccactgctcgtttataattttctcccattcaatgtactacttctacaccagagatgtgagaaacttgaaaaaggctattttgttctagctgattattaaagggggagaattcttgaatataaagtaagatataaggtaaagcaagcaggaaaggatttggagcaaggtgtgtcataatgctaacatggcacaaagcaaaataattcaacttccattcagttttactggtcaaaaggaatagcatcatttttgttttgttttgttttgttttgagacagagtctcactctgtcacccagcctggagtgcacgggcacaatctctgcccactgcaacttccacctccagggttcaagagatcctcctgcctcagcctcctgaggacctggcatcacaggcatgtatcatcacacccggctaatttttgtatttttagtagagacagagtttcactatgttggccaggctgttctcaaactcctgacctcaagtgatccacctgcctcggcctcccaaagtgctgggattacaggtgtgagccaccatcacttctataacacatttatatgctgctttaatggtttacaaaggactctcacataaatgcttacaatgaaactcaaagcaatcctatgtcaggtagagactgttatcctctcagagagcctaccctcacaagacagtccacaatgatccttgcctcatgtccttgtgtaatccactcccatactgaatcagggctggtctgtagaaccaattgaatacatctgaaatgatggtgtatgacttccacaggtaagtcataaagggcactgcagtttctactttggcagcttgaatctcgggaaagtcatctgccatctcatgagaatagtcccacggcaagcccattgtggaaaggaaccaacctgccaacaccaactggccagccaagtgagtaagccaccttggaagtgaatcttttagctccagtgatgctcctataaaacttccactcctgctgatatctgacagcaacctccagagaaccaagcaaggaccctcaaattgctgacccacagcaaccatgagataacaaacaatcattgttgttttcagccactaaggttttcatgttacaaaacaacagagaacccaattttacatatgaggctcagagaggttaatttaccaattatcatataggaatgagtagagaaaacagatctggaacccagtctttaggctttaggttcaatttgtcattaaacaataccactttcttctcaactaaaataaggtataatactgtaaggatgatcattcctacacgattatatgactgatactagtatgtcaagcttcctacagtacagagacacagtatatgtccctgcattcttaacgaatataatgggaatctccaaaataagtccatttgtggtgctccattgtgctctgtggagttgttactattttctggaaaatggctatttttaatgtgcatatcatgaaaataaacacttaacacatttagagaattttaatactaaaatattactgacactgagactacacacttaaatcttaattacaataagcatctgtgtaattttaaacaattagaatatatcagacaggaaatgctcaactgctatttctttaaggttctgcattttggctttaggtcttcaaccttgtagcattacacaaatgtagtaaaatatatcatcaaaatgctcgtgatggtaaaatattaaatcaaaatccataaagtagttcctatcttacaggacaaggtagccagctcttaagcctgtccacttctggagaaggtcaagagaacattttattgttataatcacatctgcatataatgttccttcacacaaatctcctcttttgagccatataactttgcaaaacaggtaggcaggacgggtatactaccatcctatttttcaatgatggccttagagaagtctcagtaacttaactaaggatacgtaactattaaaaggaattcaagaatctaatctacaattttttagctccaaatcccagccttttcttctaagccatgttttagcccagtggttctccaccctgactgccatgaggacacctaagatgctttgaaaatatcactgcctggacctcatcccccagatacttgatataattgcactggtttgtgttagctgtctaatatataataaaccagtgttggtaaattcacagaaagtttatatcacaagggagaaaatgctgatacgtctatatgtaaactgaaacatattaaccccctaagaactccctcaaacacaaaaatatcttgcaataaaatcacgcagaacaagaagaaagggaagatgagaaacccaagccccttctgctgctatcgtggggccattaaggaatattttattcccctaatcttactccccgaacctcaccatgccatatctcaagctatagctcaggtatcaccttttgtgagaccttcaggatcacaaaaataatgaagtccattttttgcatctatcttaccttgaactctatcatagcacatattgtccctcaaagcattgctttatttttattttattattattattattattatttgagatggagtcttgctctgtcacccaggctggagtgcagtaccacattctcggctcactgcaacctccacctcctgggttcaagtgattctcctgcctcagcctctgggattacaggtacatgccagcatgcctgactaatttttgtatttttagtagagacggggttttgccatattggccaggctagtctcgaactcctgacctctggtgatccacccacctcagcctcccaaagtactggtgctgctttatttatatatccatttttctcactgccctgaggggtccttaacccatttatgctggaggttgcaaattttttttgtgaaaaatcaggccttggcgatgaccttgagaagtaggatataaataactcccactagcttagcgctccaataatggagcactaggcataaatgcattaagatcagatccctatgttactcatccttcctgccatatatatctttgtatccagggcctttaccatagcagatattaatacatgttggctatgctgaatgatttttatgtttgttatcattatttcctccattctcctagcagacactcctgtgaaatttttcaacttttaataaaggaaaatggagtttttacgcacaactggattaggttagagaataatgtatgcaaaagggccagacgtagtgagagcaagacagcagtgaactgtggggcaggaaagaatagagtagaaaggacatttaaaattcatatctgacagttggggtcagatatgaattttgcaagccgggaaggagtaggcaaacaaagcgacaacctaatcttcattcacaaaaaaaaaaatatgacaagcaaggaatcaggcaactgtattttcaacatctccctttctatggtgtttctaactcacagcatacagacatgttgtttctctctcaaaaaataaaatctgaagcagtgatatgatttcactatgtatttgacttttttttaagattccacatgtgagataatacaatatttttctttctgcatttggcttacttcacttagcataatgtcccctaggtttacctatcttatggcaaaaagcagaatctatttcttttttaaggctgaataatattccattctatatatgtactgcagtttgattttctgttgtcttttgttggacagttaggttgtttccatatattcacacccatcaagatggctactaccaaataaaacaagagataagtgttggcgagggtgggagaaaagagaacccttgtatactattggtacaaccattatggaaaaagtagggaggttcctaaagaaattaaaaatagaactaccattacttctattttgtaccaattagccatccctcttctgtgtgcatgtatatatatatatatatacatacccaaagaaaatgaaaccgcaaccttgtaaagatatcagtcggaatttttaaaagctctctaggggattctaatatgtgtgcatacagagatggagaataaaacagtgatcccaggggagggggaaggaaattgagatgtaggtcaaaggacacaaagtagcagccatgtataatgaaagagtttgggaactcatgtacagcatcagtactatataatactgtattgtattcctgacttttgctaaatgagtagattttagctactcttgtcatacacacaaaaatggataactatgtaagatgatggatgttactatgtctcactacagtaaccattttactatttacatgtattccataacatgttattttccttaaatatacacaataaaatgtattaagtaaataccctgactgaagaacaattatctcctaagagggacccaagcatatctactctctattctcatgtccagcccccttcagcctcatctcctattcagtcctttacccacagcacgatagctttacctccaccactacaatgaaaccagtgacttctaacagtcattgatgattgtaactttacaatcatcatcatacttaatggccactctccttcagcatctttacatctttctcttttatggtttctcctttaaatttttacattctctaagactaatttttagcccttttctcttctctttctatacaattcctctatgtacttttatccgtatctatggatacttcagttactctccatatggtaagaacacacaaatctgtttctccagcctttgcaatctcttgtgatgttccaggatcctatatccaactgccttctagacatctcacacttgccaatgatatgccctgcgagcatgttaaacacaggtccaaagttgaactcattctcttctccctcataccttcttcctcttctcttttcccactcacaacccagaaacctaggaagcattctaacattctccctctcccatatcttttacattcaaacagtcacaaagaccagcaaattctccctcatcttacttttcctaaacattctcacttctctattcccactacttccacctttatctaagctttcaacctctcttatccctactgatgtactgtccttgaaagcttccagtcttgccatgaccccacacccaaccccactctaccctcaatctacccagcacactgctttcagtgatcttccatgacactcacaattcttcagtggctcactactacacatggtataagaagtgtaccctgaactggctatccagtttcatctaggaagtgtaccctgaactggctaaccagtttcatctcctttcactcctgaccttgtccttcacactctaatataactgacctacatatagttcccagtatacactatgttctcgtaatgccacacaactactcatgctgttagctttacctagaaatgctttctattgcttgtcaacatgcccactcctactcagttttcaagtctcagctcaaacacaaccactactaaaacccttacctggtattgcaggcagagatcaagagctcttgctagatttcatttgtacttgtacctacctctgttatagcaaatagcatacagtatttgaactattggtcaagatatctgtagtcctacagactataagatccttggtcaaagatgacttttcatctttatatcctcctaactagttcaattcacacagtcactagttccatgtacattactagctcaatgcagatagatatactaaaaaaaggaggggcgaggttaatgaataaggtacgagtcaatgaaagaacaagaaaatcaactggactttgagtatagaaaaaaaaacaccagatcttaagaacgtacagacatctttagtacagacatctgttactgtagtacagatatccattactaagtcctaaccattaaaaaaaatagaaaaatatggttattcaggtagtatgaagatgacaaagaaaaaaacttattattggactaagtagacattaagaaggtaagagtttccagcggaacagttgacaaagatcaacagagaagccagagaaaaagatggttctttctaggaaacaagtaattcattgatctaaattcatggactgagcaaaagactgccacctttctctcagttcacaacccctctcctttgtcattattctgcatgaccccttctgagtcctcactaccaaatccccaataccatgggtagttcccctccaatggagccacaggtccaggccagtgacttaatctggatgcaagggcaagggatagaagggtatctttgttcttgtgtctaggactttgaggaaaaatgaaacaactatttactgagaatttattttacggcagattctgtgccacattacactcactcactgaatttcacagtaatcataagtaattatcccatttatagatgaggaatttgtgtccaaggtcaacagttaagcaataacaggccctgcctgaaaacctaagaatgacaacctccagagctttttctatacccctcactacctcaaaatggagggagacgtggtccagccattctaggttggcactcaggagacacttacctccaaaacactattatatatgttgattagagtctacagtaccactaatatataataagcacacaatgagtttaaaaagctttccttagtacctttaggaaagtaagtactagatttcctggggttctgatctggaaatctaaatgctatttattcctataagtacattgttaactttacaaacaacagacttgaaaatgaacttgtggaatacaatgggttcttaagtaaggcttttctttaagaatattttcttgcttccacaaaaaatacaaaagccaccaaagatagaatgattttgccttgttaacttgtaagaacaatgacactagaagaaacctatgggaaatgtgcttatctgaccaggtgctcattttcggtgggctgtcatttgactaaaacatcatactaaaccctacagaccacagcttatgagagaaatgccacaaactatagcagtacagttaatatgcctataatctactgacaaaacatactcctcagtaaagtgaaaccagatgtctggtgtgaaatcagatgtctgtgaacttgtctttctcagtttccagagcagtatcagatatactaaatacacagctaagctgtatattaaatccacaacttggcaaaatcatgacagtttggacatgaagcatcagcatttttattgtaatccttataaaccaaagacatttccaaaatggaaatcctaagtttaagtactcagctaaatacagtaatatgtctttctcactttaagaatagtgtcagggctttttaaacacattatagaaattctttcccttcatttttcaagctgacactctttatccaaggctgtggaatgatctgataaggccacatcaggtgtcagtcctcgtcccagaaattctaggatcagatacaccaggtgaacccctgtgaaaagcaaatcccagggaggcttaacagctataggaaagttaggcactacatggctttccacaatcaaaaggaagatcataggaaagtaatgggtgaccacatagaaaaacagggagggaaatttaaaagtaagtacttctatgccaggcactgttttttcacacattcttttatatatactctttgttctgttttgatggataagaaatcaagcagcagagaaattttaatggcccaaagtgacacagctaataaaataagagccagaaatcaagctcatgtccaaaagactgtaaaagtcatgctacttctacatgaagttgtggggtggagtgaggaggggtggtaaatagccaagaagaaggagaaaaagaaagaaatttacaattttatcaaataacagtgaaatatatatatataaaacatgtattatgttccacatatgttccatatataatacgcagttaagatgtatacatgtttaacatatacttaagctgcatatttagtatgtgtatatatggaacaaaaagttgaagaaacaagtatcaaattgttaagtggtcatctgaaagtggactcataggaaactcacttattgccttttataccctcccagatttaattctaaataacttttttttgactttttattactcttataaccagaaaaagacaaagaactattctagcttagatcttttaaatgaggctaaatgcacagaaacccatgcaagttaaaaatggtctactttcgaatttatttttctaagtacatcatcctttacactctccatgattcctaatattaggtccttcttatggaacaactacaaaagttatcctcatctaattattatactcgtacactggaaaatgactataacattattcattataggaaacaaatcatcaaggtcagccatccttgtaagtttattactgaaagtactagaaaggcggaataataattctgttctcccacaacactgtatagacctgcaaaccactatgatcagtagtacagggaaagtcttgtaaattaacatgtaactattgagaaaatccacaaaactggtgaaaggcctaccccaaaacagccatctccaatacaatctcatcattctcaccatcctacttttatcaaagtgctgataaaagtgcgtagcacatggtaagagagaattagctattgaatcaatgaaggaacccattatcaataaacaatcacttcctgttttccataaattatgtggtcacctatcacttgagcacaaacaaataggcacgttcaggacacaggcagccagtatcagaataggcagcctatcacagagggcaattctacttttcctgtgtaagaatccaagaatgcagttttactacattcctgcttgtagctaatctgaatttcaactaatttaaaacggttatttatatgtgacatataggatgcataatgagctcccaaccttgtgagaggagctgtgtttcatttcaccatacaggggagagggaagcagtgtattaaagaagtgatagaaaagtcccacagaagaaccaatgaaatagaccacactgaaaatcacagtaagcctcagagaacttcagtgtcctttttggcaacttttcaaaagtgaatggaatgcttgccaggaggtaccaagagtgaaagcccagagaaaaaggcccagcctggtcatctctctcccctcaaaacatcttcttctgtaagcttgagagatcccaaagaacttcaacacttgtaatcttgttactaactttatgctttggggtcctaaaggattttttcaggagtacccttttaaaatgtaaacatccctaggggggttactgttcattatcaaacaggacctggattctttagtgctatggtctcagggattagtcaaagctggctaataagataggggccggagacagacaactagagaggaccaatgttccaaggtaaaaacaggtaaaggggaagtgcagttttctgtcgggtcaaggggctaaaagggatccacatgcccaagctgttaaactctatagactgtgtgaggctgaaaacagtccggggcctggagcctgtgactttgaaggtgggtcctccagttcccgatgaaaaggtagaatctgggcccaagttccccacgagcagttctggacatctagcccttctctctctcgctcgctctcaggataaagtcctaggtccttccacccctgaccattccttacttaccctttctcccgctcttcctcggtgagaaggggtaagtggttattttgtgccctcgcccaatttggccaaaaccctaaaagtaaaaaacgacagacagacacgtgctttaaaatcatgttgttcaagcctgacgctctcccaccacctgcccaacacttccaggcagaaggcagcgcgcccccacagcgctccctcacggccagagccgggggccggactaggcccctttgtgaggactgggagagggcgcgttgttggggcgccggctcggcggggaggagcgggccagctccgggccaggtgtgccgcctgtggcgccggtttctcaacctagttagccagtggcaccaagaagaggactaggctggggtggccgccgcacgcgcctcagataaacacgcgcacgcacacatgctcgcgatcacgcaggactcgcggccgcgcacccctccgcctcccggcaacgcccgccccgccggggccggggccgactcccagggaagggtccccagcccaagagaccaccaagggtcggcggctacgcgcccgccgacccctgccagcctcacagccccccacccgccgccggacgccgggcgcccgccctccgcacccgctgcgcagctcagcccgggggaagtccccgcgcagaccccgccctccgccggcggcaagctccgccccgctgccccgtcgcgcgctggccgcccgaagctccgcccccggcggaaaactggtctctggaccgcccgcccaggtcgggctcaaaatgcggcgtggatctgaaaggatcaaacacaacactaattcagcaagctattattgagcacttgccctaagctcagcaacgtactaatgggggagactacaataaagagccgaaaagtctatgaaactgtgtcttcagctcttcctcttgttttagaagccaggaaacagagaaccctcacagttacttaagtacagggcagtagtggcaaagcacctcactagcgatctctgggcaactcttcatttcattttttcctactcatgagcactcaggaaaactattcagttttgctgcctccaggtaaaacaaagtgagtaacacaggacaggcggtttacttgagagaaacgggaatttcatactgaagcttttgccctcaaatggtacaaactctttttttttttttcctgagacggagtctcgctctgtcgccagagcgacactgcaatctccgcctcccgggttcacgccattctcctgcctcagcctccctagtagccgggactacaggcccccgccaccatgcccggctaatcttcttgtatttttagtagagatgggatttcaccgtgttagcaaagatggtctccatctcctgacctcgtgatccgctcacctaggcctcccaaagtgctaggattacaggcgtgagccactgcgcccggccgaatggtacaaactcttaactgggttattacaacctacaaagaaaccttcttatccatgttattaattatcctaattcaatgtggtttaaaatgttgatgaaagtacccaaatcatggtgctccaacaagctggatgccaaccaggtactcgtaagtacttgcaattacaggtgcgatattttcattccatatcatcccaagatgcccttccttcacgtgaagcagccagaaagatcaactaccagattccgcatgattgaggaattgataaatagaaagggaagaccgaaaccggccaaattttcccttcgaagtgaaacttgagaaacttgcgtgcattttacctgagttcctttctcagcagataaactgtcagacctcccagatagtgtcaaggaaatgcaactttccagaacactacatctggacaatgaggtgcatctgctgcctgttcacaaactcctcttccttacccctccataattccctgctatagaaagccctaactttagtctccctaagacatgtttgagactggtctccctgccagcatcacctgcattaaagcctgtcttccctggcaatactcgttgtctcagggactggttttctttgctaggagcaacccaacctaggctgaagcccaggcatttagcagcagtggcacctagaaatactgaacagacataaaatactttttttctccttttcttactcctccagttgtatcttcattatttctgtctctattctccctctagatactgccaaactactctgtgcactttcagatcacttaatactaatgtaaataacagacattctggcactcttggttcaaaatttattctaaaggtttaagaatctactcagggtcttaaatagcctgataactaaaattccaagagtttcctaaagagagcaaaattgctctcctgtgaaggggatatgtcccagtttttcttacttgtcactgaaataattactgcaaagtaagctcttttcggccagtgcttaaggacttaatttcaagagcacttaggtgacaggaccaccctcatcaaatagcagtcaagaactatttggtaccatgaccccaaattgaatggagctcctggtcactaggaactgacagtctgggatggaatgtaggtgaataaacaacaaagacaggtgtttatggcctttattgtattgggaagtcaataaacatacaaaaagagttgctaggtctggcctgattttatcactaagattcatcaagtgtacttaaaaagaagctaatatctggaaagggcagaactatggtatattagtcagggtttcctagagggacagaaccaataggatagacatataaatataaagaggagtttattaagtattaacttacatgatgacaaagtcccacaataggctgtctgcaagcttgaggagcaagagagccagtccgagtctcaaaattgaagaactttgaatccgatgtttgagggcagtaagcgtccagcacaggagaaagctgtaggctgagagactaggccagtctctccttttcatgtttttctgcctgctttatattcactggcagcttattagatggtgcccacccaattaaaggtgggtctgcctttcccagcccactgactcaaatgttaatctccttggcaacaccctcatagacacacccaggatcaatactttctatccttcaatacattcaagctgacactcagtattaaccatcacatatggagacagtaaaaagatcagtgattgccagaggtcacagaggagggggatatgaagcacagatttttagggcagtgaaactattctgtatgatatgataatggtgatgcatgtcattatacatttgtccaaacccataaaatatacaacccaaagagggagccttaatataaaatctcaactttgggtgataatgatgtcaatgtaagttcatcaattgtaacaaatatactgctctggtacaggatattcatagtcagggaggctgtgcagatgtggggtacaggaatatataggaaccctatacttcctgctcaattttgctctgaacctgaaactgatctttgggagaaaaaagtttatgagaaaaagaagcagcagttagagcatcctattttattctaatttatcaattaaattctaagctgaatatttggctttatgtatctagttcaaatatatttgccttgtctccttatatattaaagcagacctctatttgttgttaataccatcaggggaaaatgaatcataaagtcctaactaaggtacaaatttaaactatagttaggcatcaaatctaatggtcaaagagatatttaaacaaagttaaaataattaagtttacagattccacaaatatagatattaaaatatattcctatctatacatacttaccattggtaagcaaataatagaaggtatcatagagtagcagttctcaaactactttttgatctcaagttctctttacattcttaaaaatgattgagaactttaaagagctgttgtttatgtgggttatatatgtccatatttactgtattaaaatttaagatagaaaaatgttagacatgtgtttgcttaatttaaacccattacatgttactgtaaaagttatttttataaataatgactactttttttccaaaaaattagagaaaagtggcatttttaacattttataaatctcttattatctggcttaaggagagcactggattctcatattctgcctctgcattcaggctgttgtgatatgttgttatacctaagatatgaagaaaattaactgtcatacgaattcatagttgaaaaagagaggaccttacaaagctccgggaagggtttcagtaacccctaggtgttctcaaacctcacttggagaattactgccaaatggccttttgcatttcatttgtttgaatgtcatatatttccacacaggcttctgttaacacctgaaattatagccctttacttatttcaagctaaaactcatatttgtcagctcatatcaaaccatgacatttcaataaagtttttaaaagcttttactatagcaactctgatgaaattgatattattatttgaattgatatgaaaacacttgagatttcatttatatccttcatctcaaacgttttggaaaattttgaatataaattgtaccatctggaaaaaatgtaagattggtatatagttattaatccaattttaggtatgcttataacaaggtatatccccttttataaaaataatttaaaagcgagcttaaaacaaaaacaaaacaagcaattacagttttatttatgaactaaatacttgattctaaacttactaccttggaataaaattttaaatatataacctttcatttttattacaaataaaaataatgtaaatcatccagtttggggttttttaatacaatttccaactaaaagaaactagagctgaccaaccaaatgtctgacttcagatctgggtcaggttatacacaagatgagcataggataacttgtcccacaaagccgggaatccattaacaacaaaatgtgtcaaagggacacagaaaccaatatcaaatagctcctttggccaaagatggacaatttaagcatcaaaaaaagtaatggatgcagttgttagaaacatactgaatatataaaaattcatgagttcttaatgatgttccaaaaaggggaggtcaataaaaggaaaaaaaaaatccactggacactattgcaagtagctagcattaagcccttattctaaaattgtccattaaaagaaaataattcaaattttctgatgtatctttcctgattaaactatatatcagaaaaccaaattggtgttgagggaaagttgttttttataataaatatgaaacaacagaattggaaacccaccatttagcaatcttgcatttaataaatgattcaggcaaccatcatcaatggatcaaaccaacagatgaaatgttcatgaggaacttcacaatggagatcagaccgtcactacctcagcctaataatctgtcattacaagtgggactccagacattgtgtgcttcctgatctaatgccatctgaagcactcagcacaactatgaaatgttatcacccaaaaaacatgaatgggatctaatcaagccttaaaactgacttctcacttacaggcttacaaaaaacatgagggttacaggaataagttaaatgacaccacaaagaggctgggcgcagtggctcgcacctataatcccagcactttgggaggtcgaggaaggtggatcacttggggccaggagttcaagaccaccctgggtaacatggtgaaaccctgtctctactaaaaataaacaatgagccaggcatggtggtgcgtgcctataatcccagctactcaggaggctgaggcaggagaatcgcttgaacccgggaagcggaggttacagtgagccaagatggcaccactgcactccagcctggatgacagggtgagaccctgtctcaaaaaaaaagaaaaaaagatgccacaaagaaggaaacaggtaaatctagaatggagtagaatggaggacactctctaggacaattgatgtagtctctacaacaagttaataactggacacacaggagagggaatgggtcaggagaagcctaggttaaaaaaaatacagccatgaaatgtaagatgtgaacctttatttggatcctgattgaaacatcacaactataaagacttgtaagacaatcacggacatttaactatggactggtgttagatgataccaaagaaatattattttattaggtgtaataatggcattgtgattatgtaagaaaatgtccataatttttggagaggcattctgaagtatgttgaagttaaatgacatactctctggaatttactttatacttcaacataaaaaaaaagaaggaagaaaaagagatagcataaataagaaaataaaatggataattattgaatctagatgatgaggggagttctttgtacttttccatggttttcgtatatgtatgaaattttgtataatgaatatttaaaaatataagtgacggccgtagctcagattttctagaaaacagtgcctgagacaagctcacatgttaaaattttcttgggggttgcagtactagaaaagcaataatgaaggaaaagggagaacagaggcagggacagagggaggaagatccatggtggtatgtttccaagctgattatagcatcccagtacatgcagttggttgcttagtcacacaggacatctcaagaaggctgtgtgaaaccactgggtaacaatcctccctcaggaggggaaaggttaaggcactttttttaactggatccttcctgccttctgtctctcattcatcaatgtttgttccataaagcagggcaagcatgtgggggaaaaaaggttgggggcagggaagtgaaaatgggttttatgaagtgactgagatttgtttaatctcacaatgtagaatttaaacaaatcagtgacttttgggtttagtgaagacttacctataattttagcctttttgaactagaataatcattctgcttgactttcttattacatcagtaaataatttattcaggtcaaagccattatttttgattaacagaaatcacagtcacataaatggctacagaaactaaatataggagaagggttctaccacagtgacctgaacatttgcatgcgcccttgcacatctccacaaaggccacatcagcaagacttgactgcagctgatctaagtcatggtggaattctgttgattctcctacaacatgagatcatgagaggcttgttaagagctgacccaaggccatttctcattcacctcccagtttctcattgcctcctgtgttttgaggaggtatgacactttctgcctcattctccctagaatacagcctcaggctgtaaaactgcttagctgaagcatgacattggttcctcaggaacagggtgccctatcatccaggttgtggtcatctggcctcctttgtatcagtgtcaccctgtgcaagggataccagagctggcatctttggctactcttgcttttgctttccaagtaagtaataaactgtctgaatctaaaaatggcaactcattgttttcttactagctgaatctatcacccttgccttaccttgacaaattctaggcaagaaatttttactttccttaatgctaaagaggtcctttactctttcctctttgtattttgctcagcctacaaagttagtagccagtaaacaaactgatatgaaaatatgaaagacttagattcacatttttagaaagagtaactgttctctaagtattttaggataatttttggccaacagttaaaggagccttccttctcctggccttgccttcaaattaattaataggctattcttacaaggcaggtcaagattcagtcctcttaaaaaataaagaccaatcagaaggattttcaacaaagtccctttattttctactcacacttaaacactatagttggtagggttcaaaaagtctgggaaagagggagacgaagcaagatggtgaaatacaaagctccacgaatcgttcccactaacccacaccaagttaacaactatctacatggaaaaaaacaccttcataagaacaagaaatcaggtgagcactcatagtaccttgctttaacttcatagtgctgaaagaggcaacaaagagagaaaaaatagtactgaattgccgatgccaccccctattcctccccgaccccaggagcagcatggtgtggagagtgtccttgggtgctgggggagtgagaacacagcaattgtgcggcgttgaactcggtgctgtcttgttagagcagaaaggaaaccccaaactcagctggtgtccacccacagagagaacatttaaactagccctagccagagggggacttgagtgcctgcaaacctcgccacccagggctacagctgtctgtctccaagtaaacttgaaaggcagtctaggccataaggactacaactcttaggcatatcctagtgctgaagtaggcccaggacagtggactggtggggcatgtgacatactgagacactggataggtagtcaaggaagtgctggcctcacccctctcctaacctcaggctgcacagtttgcagctccaaaagagacaccttcttccacttgaagagaagagagggaagaacaaggagaactttgtcctgcatctacggtacaagctcagccacaacaggatggggcaccagatagacttgcaaggctgcaaggcccctgttccaggccctagttcccagagaacatttctagacacaccctggaccagaagagaatggcttcaggtaacagcccagccacagtgggtagaaaatcaagcaagctctcgaggtccctgattctaggattttactcttgaacagcatttccggacctgtcctgggccagaggggtgtccactaccctgaagggtgagtcccaggccaggcagcattcatgacaagctgacttaagagctgttgggcattaagggaacatcagtggtagtctggcagtactcttcatggcccaggatggcagtggctatagggtaaggctcctctgcctttggaaaggggagggaagagtgggaaggacagcatcttgtggtttgtttaacagctcagccacaatacaatagaacaccaggtagacttctaaggtttttcactctagtctctgactcctagacaatggcacttctgtacccactggtgggctgggggaccttccctccctgaagggaaggacacaggcctggctggctttgccatctggtgatagtagagccccagggtcttcagcaaacataggcagtagccagggggtggttataggaggccttggtcaagtaccagtgctctgctggcttcaggtctaacccggcacggtcttagtggtggtggccacaggggtgtttgtgttactccatccctagctttaggtggcttggaacaaagacagaggctgtttgggagaaagtaagaagaaaggaacaagagtctctgccttgtaatctagagaattctcccagattttgtccaaggccatcaaagcagtactctgtgagtctgcaagaatcatagcattactgggtttggggtgctccctgaagtacatcacaacactcacgtccttgtagatcacaacacccaagtcctttcaaatatctggaaagccttcccaaagatggctataaataagcccagacagtgaagactatagtaaatatccactcttcaatgcccagacaccaaagatcatctactaggatcaacactattcaggaaaacatgacttcatcaaatgaactgaataatgcaccagggatcaatcctagagaaacagagataggttgaagaaactcaaaaacattcaagataacacagagaaggaattcagaataatatcagataaatttaagaaaaagattgaaataactaagaagaatcaagcagaaattctggaactaaaaaatgcaattggcagactaaagaatccatcagagtactttaatagcagaatttgtcggggaatttgccctgatattcacgtaggttcttttctatttttccgaagtgtcagccagtttgagaaataaagggacagagtacaaaagagagaaattgtaaagctgggcatccgggggagacatcacatgtcggtaggttctgtgatgccccacaagccacaaaaaccagcaagtattttttaaggattttcaaaaggggagggagtgtgcgaataggtatgggtgacagacatcaagtacttaacagggtaatagaatgtcccaaggcaagtggaggcagggcgagagcacaggaccacaggaccgaggtgaaattaaaattgctaatgaagtttcaggcaccattgtcattgatagcatcttatcaggagacagggttttgagatcaaccggtctgaccaaaatttattaggtgggaatttcatcttcctaataagcctgggagcgctatgggagactggagcttatttcatctctgcagtttcgaccataagagacaggcacaccttgcgggggctgtttataagcctaaaactccaggcgtgtattctctttctcagggatgttccatgctgagaaaaagaattcagcgatatttctcccatttgcttttgaaagaagagaaatatggctctgttctgcccggctcaccagcggtcagaatttaaggttatctctcttttttcctaaacattgctgttatcttgttcttttttcaaggtgcccagatttcatattgctcaaacacacatgctctacaatttgtgcagttaatgcaattattacatggtcctgaggtgacatacgtcctcctcagctgacaggatcaggggattaaagtaaagacaggcataggaaatcacaagggtattgattggggaagtgataagtgtccatgaaatctttgcaatttatttttagagattgcagtaaagacaggcataagaaattataaaagtattaatttggggaactaataaatgtccataaaatcttcacaatccacattcttctgccatggcttcagccggtccctccttttggggtccctgacttcccgcaacaagaattgatcaagcagaagaaagatttagggagcttgaagacaggctatttgaaaatacagccaaaggagaccaaagaaaaaagaaaaaccaatgaaacatgcctacaggatctagaaaatagcttcaaaagggcaactctaagagttgttgttcttaaagaggaggtagagaagggaatacaggtagaaagcttattcaaagggacaataacagagcccaaacctagataaagataacaacatccatgtacaagaaggtaatagaacactaagcagatttaacccaaagaagactacctcaaggaatttaataatcaaactcccaaaggtcaaggataaagaacaaatcctaaaagactggtggctttgcatggtggctcacatctctaatcccagcactttgggaggccaaggcaggcatatcacttgaggtcaggagttcgagatcagcctggccaatatggtgaaaccctgtgtctactaaaaaaaaaaaaaaattagccaggcgttgtggtgggcacctgtaatcccaggtacttgggaggctaaggcaagaagaatcacttaaaccgaggaagtggaggttgcagtgagccaagatcatgccactgctctccagcctgggtgacagagtaagactctatctcaaaacaaaacaaacacacacacacacacacacaaagcaagagaaaagaaacaaataacatatgacggagctccaatacatctggcagcagacttttcaatggaaaccttgcaggccaggagagagtggcatgacatatttagagtgctgaaggaaaaaaactttaaacctagaataatatattcagtgaaaatatccttcaaacatgaaggagaaataaagacttttctacacaaagaaaagctgagggatttcagcaataccagccctgtcctacaagacaagatgaaatgctaaagagactatttcaatcagaaaggaaagaacattaatgaacaataaataatcacctgaaaatacaaaactcactggtaacaataagtacagacacaaaaaaaaatgttgtaaaactgtaactgtggtatatgaactactcttaccctaagtagttgaagactaaacaatgaaccaatcaaaaataataactataacaacttttcaagacatagtaagtacaataagatataaatagaaacagcaaaaagttaataagtggggaaacaatgttaagtcatagagctttcattagttttctttttgtttgtttatgcaaatagtattaagttgttatcaggttaaacataatgggttataaaatagtattagcaagcctcatagtaacctcaagccaaaaagcatacaatgtatacacaaaagataaacagcaagaaatcatatcaccagagaaaatcaccttcaccagaatacaaataacacaagggcaggagtaagtctttacttatcaaaattaacattgtatgtaatagactaaactttccaatagaaaaacatagagtggccgaatggatgaaaaaacaagacgcattgatctgttgcctacaataaacacaactcagctacaaagacacacatagcctaaaaataaagagatggaaaaagatattctgtgacaatgaaaaccaagaaagaacaggagttgctgtactcatatcaggcaaaggatatttcaagacaaaacctagaagaaacaaaggtcagcatataatgataaaggggtcaattcagcaagaggacataacagttttaaatatatatgcacccaacagtggagcacccagattcataaaggaaatattattaccactaaagagagagatagaccccaaggcaataatagctggagacttttacaccccactttcagcagaaagacagatcttccagataaaaatcaacaaagaaacatcagattaatagacatttacagaccattccatccacgagctgcagatacacattcatttcctcagcacacggatcattctcaaagatagatcctatgttaggtcataaaacaaatattaaaacattcaaaaaattgaaataatatcaagcatcttctctgaccacaatggaataaaactagaaatcaataagaagaattttgaaaactatacaaatacatggaaattagaccatgtgctcctgaatgatgagcaggtcaatgaagaaattaagaagaaaattgaaaagtttcttgaaacaaatgataaaggaaatatgacataccaaaacccatgggacacagcaaaagcagtactaagagggaagtttatttatgttggtgcaaatgtaattgtggtttttgccattaaaagtaattaaaagtaatggcaaaaccacaattatgtttgcaccaacctaataactataagtgcttaaatcataaaacaggaaaacttcaaataagcaatctaaggatgcctcttaaagaactggaaaagcaaaagcaagccaaatccaaaattaggagaagaaaattagtagaagaaaagaaataataaagatcagagtagagataaataaaattgaaatgaaaaaaatacaaaagaccaatgaaataaaaagtaggttttttgaaaagattaacaaaatcgacaaacctttaaccaaactaagaaaaaaagagaaagaaatccaaataaataaaatcagaaatgaaaaaagagacattaaaactgatactacagaaattcaaaggcccattagtggctactatgagcaaccagatgccaatgaattggaaaatatagacaaaatgaacaaattgccagatacatacaacctaccaagactgaaccaggcagcaatccaaaacctgaacagaccaataacaagtaacaagattgaagccataataaaaagtctcccagtaaagaaaagactgagacgtgatggctacactactgaattctatcaaacttttaaataagaactaatgccaatcctactcaaactattctataaaatagaagaggagagaagacttccaacctcattctacaaggccaatattaccctgataccaaaagtagacaaagacacatttaaataaataaataaataagtaagtataagccaatatctgatgaatatcgatgaaaaaattctcaataaattccacgaccaagtggaatttattccagggttgcaaggatggttcaacatgtgcaaatcagccagtgtgatgcatcatatcaacagaatgaaggaaaaaaaccacatgatcatttcaattcatgttgagaaagcatctgataacattcaaaatccctttatgataaaaaccctcaaacaactggggatagaaggaacatgtctcatcataataatagctatatatgacagacccacagcaagcatcaaaatgaataaggaaaaactgaaagcctctcctctaaggtctggaacatgacaaaggtaccctctgtcaacagtgttattcaagttatactggaagtcctagatagaccaatcaaactagagaaagatgtaaaggacattcaaataggaaaggaggaagtcaaattatccttgtttacagatgatattatatttggaaaaacctaaagactccacaagaaaactattagaaatgatcaacaaattcagtgaagtttcaggatataaaatcaacatacaaaaatcagtagcatttctatatgccaacagtgaacaatgtgaaaaacaaatttaaaaagtaatcccatttacaataaccacacataaaattaaatacctgggaattaatttaaccaaagaagtgaaaaatctctataatgaaaatgataaaacaccaattgaagaaattgaagaggacaccaaaaaaatgaagaaatattccatatgcatggatttgaagaatcaatattgttaaaaggcccatactacccaaagaattacagattcaatgcaatccctgtcaaaatatcaatggcattcttcgcagaaatagaaaaaacaatcctaaaatttatatggaaccacaaaatacccaggttagccaaagctctcctgagcaaaaggaacaaaattggaggaatcacattacctgacttcaaattatgctacagagctatagtaaccaaaacagcatggtactggcataaaaacagacacagagaccaatggaacaaaatagagaacctagaaaaaaatccacacatctacagtgaactcgtttttgacaaaggtgccaagaacatacactgaggaaaagacagtctcttcaataaatagcactgggaaaactggatatttaaatacagaagaatgaaatttgacccctatctctcaccgtatacaaaaatcaaactgaaatggattaaagacttaaattgaagacctcaaactacgaaactactgcaagaagacagtggggaaaatcttcaggacattgggttgtgtaaaaatttcttgagccatactccacaagaacaggcagccaaagcaaacatgggcaaaagggatcacatcaagttaaaaagctcctgcacatcaaaggaaatcagcagagtgaagagacaacccacagaatgggaataaatatttgtgaactccccatttgacaagggattagtacccagaatatagaaggacctcaaacaactctataggagaaaaaaaaatctaataattcaatcaaaatatggaccaaagatgtgaatagacatttttctttattttttatttttttacttttttttaaaattatacttcaagttctagggtacatgtgcacaatgtgcaggtttgttacatatgtatacatgtgccatgttggtgtgctgcacccattaactcatcatttacattaggtatatctcttaatgctaaccctcccgactccccccacaccacgacaggccccagtgtgtgatgttccccttcctatgtccaagtgttctcattgttcaattcccacctatgagtgagaacaagcggtgtttggttttctgtccttgcgatagtttgctcagaatgatagtttccagcttcattcatgtccctacaaaggacatgaagtcatcattttttatggctgcatagtattccatggtgtatatgtgccacattttcttaatccagtctatcattgatggacatttgggttggttccaagtctttgctattgtgaatagtgccacaataaacatacgtgtgcatgtgtctttgtagcagtatgatttataatcctttgggtatatacccagtaatgggatggctgggtcaaatggtatttctagttctagatccttgaagaatcgccacactgtcttccacaatgattgaactggtttacagtcccatcaacagtgtaaaagtgttcctatttctccacatcctctccagcacctgttgtttcctgactttttaatgattgccattctaactggtgtgagatggtatatcattgtggttttgatttgcatttctctgatggccagtgatgatgagcattttttcatgtgtctgttggctgcataaatgtgaatagacatttttcaaaagaagacatacaaatagcaaacaggcatatgaaaaggtgctcaacataattaatcatcagagaaatggaaatcaaaactacaatgagatataatatcatcccagtcataatagcttacgtccaaaagacaggcaataagaaatgctggtgaggatatggagaaataggaatccttatacactgtttctaggaatgtaaattagtacaaccactgtggagaacaatttggaagttcctcaaaaaactaaaacttgagctactgtgtgattcagcaatcccactgctgggtatataccaaaaagaaagaaaagcaatacatcaaagagatctctgcactcctatgttggttgcagtactgtttataatagctaagatttggaagcaacttaagtgttcatcagcaagtaatggataaagaaaatgtggtacatataaacaatggaatactattcagtcataaaaaagaatggaatccagtcatttgcaacaatatggatggaagtggagatcatttgtgaagtgaaataagctaggcactgaaagacaaacatcacatgttctcacttatttgtagaatctaaaaatcaaaataattgatctcatggagatagggagtagaaggatggttaccagaggctgggaagtgtagtgggagggttgggggaggtggggatggttaatgggtaccaaaaacattagttagaaagaatgaataaggctgggtgtagtggctcacacctataatcccagcacttttggaggccaaggcgggcagatcacttgaggccaggagttcaagagcagcctggccatcatggcaaaaccctgtctctactaaaaatacaaaaattagccagggtggtggtgcacagctgtaatcccaggtactcaggaggctgaggcatgagaatcacttgaacccaggaggtggaggttgcagtgaactgagattgcatcactcactgtattccagcctggtgacagagggagactctgtctcaaaaaaaaataaaagaaaaagaaaaagagaaagtaccctaaaacttaaaatataataataataaaataaaaaataaaaataaaaaaagaaaaagagaaaagaaaaagaataagacctactatttgatagcacaacagagtgactcttaagtcaataataacaaacaattgtatattttaaagtaacttaaaaagtataattagattgtagctcaaaggataactacttgatgggatggatacaaaaagtttataggaataaataaagcaaattttgaactaacaaaaaaagataggaaaagctagaataaaaaagagaagcatcaaagatcaagctccatagacatgccctactcagattttcacaggtaggtgatctgcctctgtcttttatatacaagatgattgataatgatgttaaccaattacaactttgcctttcttatttggtacactgagaggcagggttcctctcttcttttataagcttataataaagtagaaaacagaaaaataagtgagggcaaaacataaaagctagtgaatatctcatctttttcatttctttatcacaacatatgtagattatctcttggtaatggaaatacataagccttgctaaatgactatcctagtaatagttgaccaaatccttagatccatgaatgaaggaagcagttatgtaggagacccgggcctgcctcacattttgtccagggatttcctggtactctacagtgggggtaaaaaaacgggggggactggttttgattgactttttattgataatcctgagatatctgaaagaattccttaaattatctaatgaattagccagataacaattacaaaccagcaatttatagtaactagtaatgggagaaacaattcaaaataaaaccacacatggtaaaaatttgttgaaataaaaaccaacccaagattcatatcttcatatcttcttaataactataaaaaccaaaaacactgagagagtagatttagctggaataataaacacaaaataatgaagcaatggctaagcctgcacatgatcaaaatatattattgactacagttaacaaattctattttcattcatctgagaatgtctttatttcccactgatttctgaagcaatatattttcatcagatagaattgacagttcttttctttcagtacttgaaaatgttttgttattaatacttccttttcgcctccagatgagaaatctgctctcactcaaattggtgtacccctctataagttatgtgctgtttccctctggatgctttcagtactttatttgtctttactattcaaaagtttaattgaaatgtcttggcatggatttctcctatttggggttcactccatctcctattgtgtccggaattggtgagttcttggtcttactgacttaaagaatgaagccgcggaccctcgcagtgagtgttacagctcttaaggtggcgcgtctggagtttgttccttctgatgttcggatgtgttcggagtttcttccttctggtgggttcatagtctcgctggctcagaagtgaagctgcagaccttcgcggtgagtgttacagctcttaaggcggcgcatctggagttgttccttcctcccggtgggctcctggtctcgctggcttcaggagagaagctgcagaccttcgcggtgagtgttacagctcataaaagcagtgtggacccaaagagtgagcagtagcaagatttattgcaaaaagcgaaagaacaaagtttccacagtgtggaaggggacctgagcgggttgccactgctggcttgggcagcctgcttttattctcttatctggccccacccacattctgctgattggtagagccgagtggtctgttttgacagggcactgattggtgcgtttacaatccctgagctagatacaaaggttctccacgtccccatcagattagttagatacagagtatccacacaaaagttctccaaggccccaccagagcagctagatacagagtgtcaattggtgcactcacaaaccctgagctagacacagagtgctgattggtgtgtttacaaaccttgagctagatacagaatgccaattgatgtatttacaatccctgagctagacataaaggttctccaaggccccaccagagcagctagatacggagtgtcgattggtgcactcacaaaccctgagctagacacagggtgctgattggtgtgtttacaaaccttgagctagatacagaatgccgattggtgtatttacaatccctgagctagacataaaggttctccaaggtcccaccagactcaggagcccagctggcttcacccagtggatctcccaccagggatgcaggtggagctgccagccagtcccgcgccatgcgcttgcactcttcggcccttgggtggtcgatgggactgtgtgctggggagcaggaggtggcgctcatcggggaggctggggctgcacaggagcccacggaggcaggggaaggctcaggcatggcgtgctgcagtcccgaggcctgccccgcgggaaggcagctaaggcccggcgagaaatcgagcgcagcgccggtgggctggcactgctgggggacccagtacaccctccgcagccgctggcccgggtgctaagtccctcattgccccgggccggcagggccggccggctgctccgagtgcgggacccgccaagcccacgcccacccgaaactccagctggcccgcaagtgccacatgcagccccggttcccgctcgtgcctctccctccacacctccctgcaagctgagggagtgggctccggccttggctagcccagaaaggggctcccacagtgcagcggtgggctgaagggctcctcaagtgccgccaaagtgggagcccaggcagaggaggcgcccagagcgagcaagggctgtgaggactgccagcaggctgtcacctctcattatatctataggtttatatcttttgccaaatttaggacatattaacaaattatttcttcaaataccttttcagtctcactctttctcctgtacttctgaaactccaataatgcaaatgctagctcttttgttattgtcccacaggttcctcagtctgttcaattttttgttctagtctattttctctattgttcaggttgggtaaattgttattatcattattattattgtagagacagggtctctgtgtgttgctcatgctggtataaaacttctgggctcaagggattctcctgcctgagcctcccaaagtgctgggattacagacataagccaccacacccagtcaggttggataaattctattgatgtgtcctgaagttcatcaattctatctttagtcatcttgactctactattgaacccatccagcaaattttttatttcattgctttatgttttagttctataatttctatttggttcttttttaacttatttatttgctgagatattttattttttatttgtgtcaagagaatttgtaattgctggttaaaacatttttataataactactttaaaatccatattagatcgttccaacatctgattcatcttgattttagcatctgttgattttcttttctcattcaaattgtgatcttcctggttcttggtatgaggaatgatgttcaattatattctggatattttggatattatagtataagactctggattctatttaatcttttttaatcaggtaggcctcctgttggggtgtagcaagaaggcaggtgattttgtatgtttggtctcccagtgggcccaccaacaccttccagacaaacatgcagtacttattcatcctgtccagatgtctatgggggggcggggtggggggcgggggggagggtattcattttctagtgctgccataacaaaatgcgacagattggatggcttaaaaaacagaaatttgaccaggcgcggtggctcacacctgtaatcccagcactttgggaggctgaggtgggcggatcacaagttcaggagtttgagaccagcctggccaacatagtgaaaccccgtctctactaaaaatataaaacttagcctggcatgatggtgtatgcttgtagtaccagctactcgggaggctgcggcaggagaattgcttgaacccgggaggcagaggttgtggtgagccaatattgcgccactgcactccagcctgggcaacagagtgagatccgtctcaaaaacaaacaaacaaacaaaccaaaaacagaaatttattttctcacagttatggaggctggaagtccaagatcaaggtgttgacagggttggcttcctctgaggcctctctccttggcttacagatggccacccactcaccgtatcctcacatagttgcccctctgggtacacatgccactggtgtctctatgtgtgtccttatctcctcttcttattaggaccccagtcagattggattaagggccaccctaataacctcattttaatttaatatttcttttaggaactatctgtaaatacattcacattctgaggtactggggattagagcttcaacatatgactttaggatgggaaacacaattcagcccacaacatgtgagttggaagttcagctaccccttgccctgttgacaccttcccagtcaaagtgagatattcgctcacacctctaagttcaggtgccactagaaaggtggaagcagatgattgattcacaccattttattacagcaggattggggtagaaattaggttctcaactctctgctgggcctccctgatgccagaggaggagagggagacaagcaaagtgccaactatccctgcctctaccgctttgttctgtctcattgatgccaggtggaagtgaagactcagcaacccactgggccctgcctacatggaggtgtgggggtaagtggagtactgaccagacttgagtcacacgacccagttcagttgttgatgctggatgggagtggagtctcagcttcctattggttaccactgacactagactgaagcataactgtgatgagccctgcatcccaccgtctctttgagtctcactgtgggtgcaagctcagctcattgctgcaccctgccaacacaaggtgagggatagaaaaccagatccctgctcagccaggcaaagccaccctgagtgggatcacagtgctgctgcctgcctccagtgagtggagtaaaaaatcagcctcctgtcctattctactcaaactttgagaaagggagggtgcagttgttacactggtatttgccctgagtagggcaggtatcgccaaaaagttctggctacggggaacgaacaggctcatcttggggctttttgtgtatgtttgttagtggctccaagttgaaagcttctgcaggaccctgtctggaatatatgagaggcaataaggaaatccagggaactcagtgccatgtcattccttgggtccccaggttcctaagtagttcaccttcttcttttcagtgttagagtcttcctgtgcttgtttgttgagttatggccagggtttttttagttgtaagaaagagggtctgggaggaatgaggctacttccatttgcccagaaccagaagtcctccttataaacactttaatagaagaaatgcaaagaagatagggatttttatggaatattccaacataaaatcagcaactgatctaaaacctgaattatcaaaaggaatatcaatttctaaaaccagggcaagctgacaaaataaagctgagctatataaaggtatgtgtgctgtaatactcaacttcaagatgcttttggatgagctcaattcaactaacatcaaaacaaaaggaaataaatttttctacattcggaatatttgtcacaaaacaaagaccaacactatcagatagggcaattcatgttttgtgtgttttaaatttttattttaagaataacttttaaatatttgtaacagctttcaattttttaattgattttatttggtgttagtgatacttttttagttttttctatcatcaggtatagatcatttttacatgttattaaaatacataatctcatcaaatgcagttaatattgtatttttatttttatagaaaacctctgaaacttttagcataattctatcatcaaaaatgacacaccactattattgtggtcacttatcaaaatttgaaaacacaggctcagcacagtgggtcacgtctgtcatcccagcactttgggagacagaggtggctggatcacttgacgtcagaagttcgagaccagcctggccaacatggtgaaaccccgtgtctactaaaaatacaaaaattagccaggcgcgttggtgcgtgtctgtaatcccagctactcaggaggctgaggctggagaatcacttgaacctgggaggtggaggttgcagtgaggcaagatcgtgccactgcactccagcctgggcaacagagcaagactctgtctttaaaaaaaataataaaaacatgtaaatatcacaaaaaaaaataggatgaattctgttttgagaattcccaggaatttgtattttttttaacctgaatcctgaagatatttgtcagggatttagaaacactataaaaggcaaatactgtcccaattaccttattaacaaagactttttctttttcaatgatcaagacttaatcaaaattgtttttatctcttcagtttatatgtccagacttacttggttattacaggcacagtgatgcagtgaaatcatgacctatacctaaacagcctgaaaatattcagcctataaaagaaaagacttaggtgagaatttaatagctgtcctcataaacttcgagagctctcctgaacaagagggattgcatttgttctgtatgacccaagaggaaagaattaggataaatgagatgaagttacaggaaagaaaattttgacttactatatatatccactttctagcaactagagaattctgaaatgagagcagactccctcaagcaatagtgatttcttgtcaaggtaaaaggctggacgaccatttatcggggatattatcaaaaagactcagtgtttgtgattttttttttttggtgtgtatcatctcattttgttctccaagtgacacacatagaaaatgtatttaaatggctatgtatgaatgaaaatagtaaagttcagagggtatattagttaggattctttgtaaattataaagcaatttgagctagcctgagcaaaaacaaaatacagtataagaataaatggtatttcacagaacctaaggccagtgtaatgcagctgtctctagggtcggactgaggccaaagctctctctctctctgtatcttcaccctgtttctctctaacaactgctttgttctctatttctgcagatgtattttctatgcttcccaaccacataatgggtaggagatatttatgccacagatccccaatttacatctctatcattcaagggaccagtccagaatgattgggtgcctaaattattctggactttatgcagccaattaatcacattattctcccttctgaatgctaagccaattaagaaatagccacagtaaaactggatgggataatgtggcttaaacttgaggccaaaatgtacttttctgcaactttcctttgcctttgaattgaattcagccagtccaggcagatatccagattgcatctcaggagatggcctgatctggcggcctgacctgacgagcttatcagatgggaaagacgtccaggaggtgagcacattgcacttgcacatatgcaaaaggagaataaaggatctggtcagacatgtgcaatgaccctttactgaaacctactaattaagtaagtcactccaccaactccctcagggttgagttgctgaaaaacggagataagggcagaaactttcctcataacattttcaaagatattttatacgatggactaaggtaggaatgtgcagatgggaagagaatagccttcccgcaattaccaattcttatttctggagatagggaagttaactcacccactttgaaccagttattcatctacgtccaatcaattatggttttaggagagtctctcgatgcataaacagcatggccaggggacaaccattacagataggacaggcgatttttggtaaaagatggctagacagatacatgaataagtacactcagaatgcatacacttcttcgtttacattataaagttattcttgactcataatatccagctacctcacgttcaaatgcaaatacacacaagtacacacacactcattcacacatgctctgcagtggaggactacccaagtaatgagtggataatccattacattaggaagtgatgttgccttgaggtcactgctcttcctgtgtaaaatttctggatgaggtccatttcctccccgaatccagttttaattttgttctcattttcttaaaatttagagattaaattacaaacgtaaccactctcaatatatctaatatacaacacttggggaaatggccatatagagaaatagcgacggaaagaaagctccacatagtggtcactggtctgtgatttattctgctggacagtggcagtttgaaaagcttgaaagaacaggtgacttatttgggcataattttgactcactcctttggcgtgtttcttgaccctatagtgaactttcagtttgtgttatttcttctttggattgtgtctgaaaatttcctaagaattgactcttctggtatgagtcaactatgggtccctttcaccagatttagtatttttcactgacattttcattcttgtaaaacatttctggttggctctcacatccattttggactccatttgctaaaatccagcaccacaaatcttgttaggtcatgctccaaattgaatagccaggacttgttcactctactcaggcgtatgttctgttttgttcgtttttgaagtaagtctgaaggtttcaccatccatatggtctttaatacatgaattaaaaactataaaattagctgggcgtggtagcaggggcctgtaatcccagccactcaggaggctgaggcaggagaatcctttgaacctgggaggcagaggttgcagtgagccaagatcacaccattgcactccagcctgggtgacaaggaaagattctgtctcaaaaaaaacaaacaaacaaacaaaaactatagcctggccgggtgcagtggatcatgcctgtaatcccagtactttaggaggccaaggtgggaggatcacttgagcccaggagttcaagaccatctgggcaacatagcaagaccccatctctaaaacaacaacaacaaaaaaaactatggcctgatacgaggtagctagcataacagaactccttcctttcttatcagctatggaaatattgtccctattctcctattttagctagtgagaaggactttggaaggatgggggtgggaggtagaagtatggtcagtctttctccactcttctgcttcttccaggatattcccattcctgtttccaggatcttgcgttttcttggtccagacatttatttatcctaactacaaaaaggagagtcaactcagaacttgactactgcaattcacatttccttgatttatttcttcatcagtacctcagcaattgattgattaattgattgagacagtcttgctgtgctcactggagtacagtggcatgatctttgctcactgcaacctccacctcccaggttcaagcaattctcccttccccagcctctcgagtagctggaattacaggtgcctgccaccatgcccagctaatttttgtatttttaagagagacaggctttcgccatgttggccagtttggtcttgaactcctgacctcaagtgatccgcccgccttggcctcccaaagtgctgggattacaggcgtgagccactgcacccggccagcaatctatttagaagctcagattttctctctgtgcttccagtcaagcaaatctaagttggtttttttcttctgcaccttatactgacagctacaaaaaatagatatatactaatattttctaccaaggccccccatggcttggtggagaatgatctgagatgtaagagacaatgagcaggttttcctacttacttcaatattgcagaaagactgtaagtttctatcctaagattggggtggtaggtgggagtgtgaggctcctcccaatctgacacctgccttaacttcactcattttatattttctgattaagaatctgttactccgaaccctatcacaggtagcactttgtatattaaataagattctctgttgccttaagctgtatgcaacagaaactgtatcgagccagcctaagcaagaaaagaatttaagaattcagaagggcactcaggcctaagaaagagatagaaaagttaccagatctttcttcatctctcatatcttcttctctctgcatgtttgctttatttatttattttctctgaagttaggctttctctgtttctctttccacataccaggtaagatcatggtcactcagcagcttccaacttcatatgtcttttctttgagaaaccaagggtagtatgccaaaaccattgttggttttttttcagatatgtccagggagaaaatctggttgaccagtttgtccttatagtgaaccttcatcagtggtgtgtgttcaatatcaaaacatctttctaattataaagaatcttcagttaggtgagcagatatttcatctccccaccttttggttcctaaaacaaagacatgtgacccaagtcccaccaatatgatgtttttgcctggaactttatcaagtgatacacacaatttggaatttttctatggctgtggcaccaatggcagtggcttctggttctggtggcagtagtggcttccagcatctgatgatacagtggtgactgctcggcaaagacagcagtcatgtcctaaccaggttctttctgcagcataattttaaatgtcctgagttatggcctcccttaattattgctcatttctttccaagcccaatcttcagttcttctcattgattctgtgagcgttcctaaactcttctaataatgttttttttcctcaaatataccagaatgattttatgttgtttacaactaagaacttgcctatattctaatgagctaaaccagtgggtaggggccttgtagagcaaacctgattgtcagaggtctacccctgtgaacaggaagaacagttcccagagaagacagaatcagtggacatcccaataagtgtctttttgcattaatattggaaaagttgtccaagaccatagaagagctgaatatcagaactttaagaagaatctgcacatctcactactcaatataggatttattcctttgtcccaaggattaattttaattcttgaattaataatggatggggatacctaaggttattatagaaaggccaacataagcccttcacaatctcaataatttgctatttcaccaaactgaaaaacctatttcaaaaaagaaaaggctgaattcaattaaacaacctggttctttcaaaataactggttacctaattaaaccttactattgccttaaactttgtaaacatatcttaaacactactatgctaagatggggcagaggaatgaattactgataaaattcatagttaattgaaaatgatatcaaaaacattttaatacttttcaccacataataaaataaaaactgtgtgatttgagtttttatctccttttatgggcctgtttaatttctgtaaaggagctttgaaattaagcaaaatagaaagggaaatagtaatttggataatcagtcccaaataaacaagaattgctaattgcatttcttgtacacaactaggagtaaattcaaaaactgaaagtaaattggacatgatgctcagagagtatccttgagcatgagtaactaaaattaaccagaattttaaataaactggggactcctagacttctgaagacatgaatgaggctattagaactctctttctcctactcatccattagcaatgtcgggaacagttcataaaagattaatgtttaaatgcttaagaatatatatttgaataccttgaaaacaccaagcaatgctttttaaattaattgataagtcattttatacttgtgatgtagacttagacttttttgtagtaacaagccagaaaacatctatccttctgagagataatatgtgaaagaattgtagaagaaatgagaaagatgattagtaatcctgtattgcttcttgagacagcaattctctcgtaagtggaaacttaggcaagcatcagtgatgagaaatagatacattttactctttacttcatggttgagaagtgcctgtaattcacctttcaaataagaggcaacatgtatagcataatcccacagtattatgaaattttggaggtgaaagggaccttgatgtatcggtaagctattgctctataacaagccattcccaaaactcagtggtttaaaacatttattattgttcaagcatctacagattagctaagggtaggctgagctcatctggggtgattctgctccatgtgtttctcattctccataaaccacaaacaaaataataataataataataatagtatttttttaagttctcacttgttgaaggcttactatgtgctaaaagcactttaaaatgttatctcctttacttctcacaaaaacattatgaggtaggtactactaatatcctaatttcacagatgaggaaacaaagaaggaatttccccaagctcaagaagctactgtatggtgaacctggagcacacagatgaaggtctacctgacactaaactttatgttcttaatcattctgttatattctgtttcatgaaatttactattccattttcagagagttctaaccactaagaagttattcttatattcagtgaaatgattttctctataacttttaatcactgatcttaatttggcccttgagtacatacaggataaagataataatcataaattaaatgatatagtaaaagtgcctgacaaacagaatgtgttccacaaaaattaatctaagtcagccccacaataggcataacagtcgttaataaaatgttcaaccgggcagggccagaattatttgcagttttacccagttggcacttatcctattatacagaaaactatccaacctaggataaatacaatgtttaagtccagatatactgtgtctataacatttcctttatctatcagcctagtaatcttgtcaaaaaggaaatgagccctagattgaataagcaacagacaattagaatttagagggtagagaggaggtaagggaacattaaataatgctttttaaaattaatcagcatatattttattaataagcaagcaggcaaaacctagtaaatgttgactttctttctatttggaaaaaatttaatttgttcaaaggtaaacttttgtttatattataggtttacctaagctgatgagagaactgagtacataatacctattgaggataataaacttgttaaaagatgattttcaaaatgacaaaatacaaatattaaaagagcatatgtgaaaatttttatttaactcattaattaatgaaggaccctgtaagatattacaagctattcaaaaaagaatagaaacagtcatatgtaggcaagcaggaatgttgaagtaaatgtgctaatatgtgcaaattaatagatcctataggtactaaattgtaatgtttggaatcatcttttctacagagaggaaatcaattatatctctatgataaaattcattagcatgtctatggaaaagaataatttgcattttactgtcagtcaattttttacaacttcctgagttgtaaaatagctcagtcaagggcagtccaaagcacaggttccaacagaatcagataaccttaccttggagagtaagccagacagtgtcagacgttccagaacacccagaattgtgcccattcaaaattcttcactagtcttcctgacaaagtttctagaagaacatcaaggagaaaaactgggggaagtgctgattacatgaaaatgtacactggttgaaacgttttacaattttttaaaaacatattatttgagactctttgagaaaaaagataatcccggaaaatcatgaaattatttttttttaatttttttgtcacatccttcaaataaactgttaatcatgatatacaaggtcagatggaaattgaaaaaaggaaaaattaacgttttttaatataccctcccatttgtctgccaaaattgtatttaaaagtagtgttatataattaatgatattttatattttcagatgattgctaacaagccaaagaaaaaaatttccctgatcgtatttggaattaaaaaaatcattgattgaatgaactagtaatattttatttagcatttccttgtatttagagtggtaagaatttctatgtcagctctgtcctctgcattgacaaatcagaaggtcctgaatcctctttactctgttatgagatcataaaaaagaaattaaaagtcaattgctctccactgaaaatcctagaattgagaatcaaggaataatcttctcttccaaccaaagtccctgtgtgactaaagatcagtgtaattttaaaatgtggcaacttgtatattaaaatgtcatatagaatttttaaaaatcttttattgagattcaaaaatagacaaagaaaatataataatggctaataagcacatagaaagatgttcaacatcactggttattagggaaatgcaaatcaaaatcacaataagacactactttacatccatcaaaatggctattgtttcttaaaaattgaacacactaggcattagtgagtgtcttacttcgttttgtgctgctgtaataaaataccacagactggataatttataaagaacagaaatttattctctcacagttctggaggctgagcagttcatgatcaagggactggcaagttaagaactggtctctctgcttccaagatagtgcctggaatgctgagttctctggagagaagaaacgtggtttcctcaactgacaaacaggcaggagagagagagaacctactcctgcaggcctgttttatagcagcattaatccattcataagggtggagcctcatgacttaaacacctcccatcatgccctatctcccaacactgttgccttggagattaagtttcaacatgagttttggagtggacgaaaacatttaaaccatagcaataaggatgtagaaaaattagaaccatcccatattgctggtaagaatgtaaaatggtgcagccactatggaaaatagtatggcagctcctcaaaaagttaaacatagaattaccacatgatctagcattctatttctaggtatatacctaaaataattaaaagtaggggctcaaacagatgcttgtacagcaatgttcacagcagcattattcacttgtagaatttaagacactctaccccaaaatacttatttaagctgaaagaatttgagaaaacagcagaatcaggaaggtcaccctcactttactccacccttcttttctgaagcaggtcataaaacttaggcaggattttctgaccttcccttgaagcaggtcatagcaccctcatgtgagaggtgccctctctaatacctggataaagcagccaaagacagagacacgaataatctgaacaggcaggccttgctaagtttccccaaattcattactggtagattacacccactatgtccaagtctacttctccacgtctatacatttattcatcaaacttggcataaaagtacacatgtttaatctgcttctttgggtcttcattgccttatgcaggctcccatgtcacataaaacttatattgaataaattcatatgcttttctcttgttgatctgcatttcagccatgaacctgggataagtgaggaaatacttctcttcccctatatcgcagtaggcaacaggtagaaacaacccaaatgtccatcaacaaatgaatggataaactaaatgtggcatatacatataatgaaatattattcagccttaaaaaggaatgaaattttgttacatgctacaacatggatgaaccttgaaaacattgtgttaagtgaaataagccagactcaaagggacaaatattgtgtaatttcacttatatgaagtacctaaaatagtcaaattcatagagacagaaagtagaatagaagttttcagggactgagaggaatagggatagggagttattgattaatggtcatagtgtttctgtctgggatgatgaaagagttttggaaatggagagtggtaatggttgcacaacaatgtaaatgtacataatgccactgaactgtacacttaaaaaaggttaaaatgataaattttatgttatgtatatgttatcgcaatgaggaaaaaaatcactagttggaagtcaagaatgttttaaagctttttcagagctccaagtgttacaggaaagggatcccgatccagatgccaagagagggttcttggatctcaggcaagaaataattcagggcgagtccatagagtaaagtgaaagcaagttttattaagaaagtagaggaataaaagaatggctactccatagacagagcagccccatggctgctggttgcccatttttatgattatttcttgatggtatgctaaacaaagagtggattattcatgcctcccttttttagaccatacagggtaactttcagatgttgccatggtatttgtaaattgtcatggtgctggtgggagtatagcagtgaggacaaccagaggtcactctcattgccatcttggttttggtgggtttttgtgggttttggtgggcttctttactgcaacctgttttatcagcaaggtttttatgacctcaatcctgtgccatcctcctatcttatcctgcgacttagaatgccgtagccatctgggaatgcagtgatgttgcgggaagtcagggaccccgaacagagggaccggctgaagccatggcagaagaacatggattgtgaagatttcatggacatttattagttccccaaattaatacttttataatttcttttgcctgtctttactgcagtcgctgaacataaattgtgaagatttcatggacacttatcacttccccagtcaataccctgtgatttcctatgcttgtctttacttcaatcacttaatcctgtcagctgaggcggatgtatgtagcctcaggaccctgtgataattgcgttaactgcacaaattgtagagcatgtgtgtttgaacaatatgaaatctgggcaccttgaaaaaagaacagggtaacagcaatgttcagagaataagagagataaccttaaattctcaccaccggtgagccaggcggaacagagccatatttctcttctttcaaaagcaaatgggagaaatatcgctgaattctttttctcagcaaggagcatccctgagaaagagaatgcgcccctgagggtgggcctctaaaatggcccccttgggtgtggccatcttctgtggtcgagctgtagggatgaaataagtcccagtctcccatagcgctcccaggcttattaggacgaggaaattcccacctaataaattttggtcagactggttgctctcaaaccatgtctcctgataagatgttatcaatgacaatggtgcccgaaacttcattagcaattttaatttcgccccagtcctgtggtcctgtgatctcgccctgcctccatttgccttgtgatattctattaccttgtgaagcatgtgatctctgtgacccacaccctattcatacactccctcccctttgaaaatcactaataaaacttgctggttttacagctcagggggcatcatggaacctaccgacatgtgatgtctcccctggatgcccagctttaaaatttctctcttttgtactctgtccctttatttctcaaaccggccgacacttagggaaaatagaaaagaacctacgtgaaatattgggggtgaattttgcccaatatctggctgaattttctgcgatacagcacagtatgtttcagccttattttacccagctcctattcaagatggagtttctctggttcacatgcctctgacacaagcactccaaactggtttccatttcaattttctctcattattttatttaattaataggcatttattaagagctttttttgctaaacactgtactaggcacagcaaaaaaattcaaaataataagatctttttttctctgaaatccatcatttagctcttcctaaactgggatttaaggaaagctgtttctttttttatggttttgtttctttttgttgggatgggttgttcataggtgtgctgaaaggaaaaacatttttcctctttgcaaataaatgagtgtttaattattaaacaaagttaaatggatttttttaactgtgaagacttcccataacctttaaaatgctaatgtattttttgaatctacaagactggatttagtaagtggcattcctaagcttatttaatcaagaattctttgtctctcagagcccaattaattaacatctccctttgtactgtggctgcagaagttgagctatgtggtggattctttttatactgggctaaatgtattatacaatctgtaattatggtataaatgtgtattttgttttatccctatgtgttctagaatgtgagtatgattttaaaagcatttttaaatttaaaaatgtagattaaacattagagacaataaagtcattataatttcttacctcaatttaccattttttttctcctttagatagcatttattattctggaaaaagggatattcttgttttggggagaaggatttgctaatggagattttgcagaaaactgtgatgctgactgtgatatgtaacttgtgagcatttttaataagaagaaacatagaatgccagtccttattcttttcttgataaaagaattcctaccgaattgtatccaatcaatagctttaaggacttgtgattttctctctgcctttgaataattgcaaatttttgatgctaattcttactccataagtttaaacgtccctatttttccgattactaaacttatactttaagtcacaacctacaataatatgcagacaatccctgacttacgatggtttgacttatgattttttgacattattatgatgtgaaagtgagatgcattcagtagaaatactgttgtatccatacaaccattctgtttttcacttttagtatacagtattcagtaaattatgtgagacattaaatcctgtattataaaacaggctttgtgttagatgattttgcccaactgtaaactaaagtaagtgttctgcacatgtttaaggtaggctgggctacattgtgatgtttggtaggttagatataataatgcatttttgccttacaatattttcaactgttgaagatttattgggacatatcccacattgtatgaacatctgtattcctgcatcctccatatattccttttttttttttttgagatggagtctcactctgttgcccaggctggagtgcagtggcatgatcttggctcactgcaacctccacctcccctgttcaaatgattctctttcctcagcctcccaagtagctggaattacagatgtgcaccatcacacctggctaatttttgtatttttagtagagacggggttttgccatgttggccaggctggtctcgaactcccaacctcaggtgatccactgacctcagcctcccaaggtgttgggattacaggtgtgagccaccgtacccagccctacatatattcttaattttgtgcttttccttcaaaattaaacacagtagaacaatttaagtaaagctaaagatatagcaaatttgagcctatttcatgattttaatattggtctcagttatattttcattagtagtatcattttcatgtgtctaaagtatcacgtaaaatgcattagaatatttaagtaattgcacaggcattacaaaggaataaaaatgataaaattgccaagatcaaccagctggtcatcaggcagaagcaccccgtgatactgtgaaatacttggttattggtgaaggatgaaagtctagattcagcataggaaagagaattgttatgtgtatatgtacactggatggaggtgctagttgtttgcaagtcaagcattctaaagcctaggactgcctgaactagagcaacaaataacaaagtatcagagttcaaggatttattctgaccggatgattttggaaaccttcctggacaacacattgggctgggttctgaagaataaataggattcccacaaatttttccagactgaggagagaggctaagatgtgcaaatagagggtctatctaggagtgtaattttggagtgcaaagtatagagtgcgtaagggatagtgaagtaaattaaactagaaaaaattattgaggccagatcattagtactaacaaatttagactttattctctaagtaactgagagctgaggaaagtttttgagcagagggcatggtttgtgtttcagaacaattactctggtgggcccatagggagcagatgagactggaatgaggcagggaagctaattaggatgttataattgtctagcaagaaaagatgaagacttgattgactgtcaaggaaacaataaataggagacattttgaaaaaattaactgagcttggtgaataaatcaattagaaatccctttggatgcaagaaacagaatttcttttgaacagagttgaacatacagagccttactttattcaagtagatgcagatagatgcagatagatcaagtagatgcagatgaatctactttattcaagtagattcaagtagatgctgctggtgttggtgcagaggcttgacaatatcagtgacatcatttctcagctctcttggtttttctttcatgttgttgaacaaccgtctcctccacggcctactttaggtgagtgattggctggagctgagtcacatggcagcctctagctacagtagaggctaggaaggtggggaatagtagtgtcttgatcacctgagactgatcatggtctgtaactatgggctgatcacactgtccttttgaaaaaacattattagcatggagtacatgggcattggatattaggtgaacaattaatagagtttgctacagtaactaattggctatcggagtgcagtgggttgaatagtgtccttccaaaattcctgtccacccagaacattagaacactacattatttaaaaatgtgtgttgcagatacaaataaagtaaggatcatggtgagatcatactggattagggtggaacataaatccaaaaagactgtcttataattaccaaagataaacaaagacagatactattaaagtgataaagacaggttttgttttgttttgttttttttgtctttttttttttgagacagagttttgttcttgttgcccaggctggagtgcaatggtgcgatctcggctcactgcaacctctgcctcccaggttcaagtgattctcctgcctcagcctcccaagtagctgggattgcaggcatgcaccaccacacttggctaattttgtatttttagtagagatggggtttctccatttggtcatgctggctggtctagaactcctgacctcaggtgatccacccacctcaccctcccaaagtgctgggattacaggcatgagccaccgcaccctgcctaaagacaggttttaattagtaattaactattgcaaaagggaagagaatccagtataaactgaactcaactttgatttgttttaaagagagaatgagagaataggaaaggggaacggtagggaccagagtcagggagtggaaatttacaaaaagtgagaagacgagtgtcttagtctgttttgtgttgctataacaaaatatcacagaccaggtaatttataaagaaaagaaatttatttagctcatggtcctggaggtgaaaagtccaaaagcatggtgccagcatctggcaagggccttcatgctgaatgataacatggtagaaagtatcacatggtgaaagaaagcaggagagtttgtgtacaacttcaagccgtttaaataatcaacattattccattagtgaaggtggagtatcaatgactaaaataacccccatatggccccaactcccaaaactgttgtattggtattaagtttccaacacatgcactttgggggacacatctaaaccacagcagtgagttggcccatgtaaaatcatctgagtttgctaactggtactggtcaaagttaggctcctaccctcccaaagaggcaaaaagacaggggccctatcttcaggtgttggccagaacaaacaatatgttttttgggcagccttgagctttcccaagcaggaacttaaagagactggagtggtgatactaaggatgggaacttgagctgtcagaaactatactaatgtttgttcagacttttaatgagaatggaggaggaggccaggcatgaaggctcacacctgtaatcccagcactttgggaggccaaggtggatggattgcttgagcccaagagtttgagaccagcatgggcaacatggtgaaaccccatctctaagaaaaatataaaaattagctgggtgtgatgacctgtacctgcggtcccagctactcaggaagctgagaggagaggatcacttgaacctgggagggcagaggttgcagtgagctgagatcgcaccactgcaatccagcctggataccagagtgagacaccatctccaaaaaaaaaaaaaaaaaaaaaaagacagagagagagaaagagagaatggaggaatggaggagggacattgtcgtaagagacaaagttaagaaggctatgtgaaaatgaaggcagagattggagttatgctgctacaaaccaagaaatgtcagaagtcatcagaagctggaagagacaaggaaggatcctcctctagaaactttggaaggagtgtggctctggtgacaccttgatttctaatttctggcctcctgaactgtaagagaataaatttctgctattttaagccactcagcttatgataatttgttatagaagccctaagaatctactacatggggtgaaggagagggggaggtatctaaacataatagcctggaagaggatattgacagggctcagaacatgataccccaaagtatggcgccctgggatgctgagtactttgagctgaaggacattggaagggcctcagaagcaagtctctctaaacatttctcactctcctgtctctcatccttttttctcctccaggtgagtcatagaaatcagaatccctcttccccaaggtgggtcatagaaattagaacccctctcccacaaaacaagccataaaacctggaaagataacaagggccttgctgcattctgggaggaaggaattctacatggagagaccaagaagaatctaaacagacaggtgttactgagtattccccttcagtctattaccattccatcatacccttttggccaataacatttctacatggctgtccattcttcatagaatccaagcataaaaacaattttttccttggtctttgggtcttcatttctaaaggctcctgtgtcaagtaaaaccttttttttttctttgagacggagcttcttgttgcccgggctggagtgcaatggcacgatctcagctcactgcaaactctgcctcccgggttcaagtgattctcctgcctcagcctcccaagtagctgggattacaggtatgcaccaccacacctggctaattttgtatttttagtcaagatggggtttctccacgttggtcaggctggtctcgaactcccgacctcaggtgatccacctgcctcagcctcccaaagtgctgggattacaagtatgagccaccacgcctggaccataaaactttgattaaataagtttgttatccttttatcttgttaatctgtcttttgttataggagtgtcagccatgactcttacaatgggtgagggaaggtatcacacttttctgctcctacaatattaataccatgagtagaacatgttgtctgtgagacatttaggaaatattcatatgaggatgttaggcaagaattgggattatggatttagaattgaggaatgaagtaaggaataaagaaactgcagggaaaagaaaaataaacttcaccaagcaatagttaataacataagataaagtataagttagtatttaattgaccacttgaacacaattctttccctcttatttccaaattctattcctgtgtagcaggaatagaagaaaaagccagcatcattgagggttaatgaatttggcctataagggctaataaatatctacaaacaaactttggaaagagtcattaacaggactttgatttcccatttgccttagtagcaaatttagcagcactttttaaactgcctcatggatgactatctccattagtttttttttttaataagaaaacagtaaacactatgcatggtagtgttgtatcctcagtgcttctaatataatttcttcatatttctagtattacatttatctcactgcattctaattattgttctgtctcccctgctagactgggagcttcttaaaggtaatgcaccatttttattcatatttgtatttcaattacttgacacaatattcagcacttaagcaatttatgtaataactactggatggattgtaataacaataatagttaaggatgcagatctagagctagtttagttgggataaatcctggctttactgcttatttgttttgtgaccttgtgaaattactaaacctctctgtgccccagttttttcatcacaatgtgaaataataataagacctttgtcttggtcaatttgggctgttctaacaaaaatattatgtaccgactggcttaaacaacaaacatctgtttttcgtagttctgtggctgggaagtccaagatcaaggtgccagcatattcagtatatagtgagggctctttttctggttagcagacagcctccttctttctgtatcctcatatggctgagagaaagaaaggtcatctctctggtgtctcttctcataagggcactaatcccgtagtgaaagctccaccctcatgacctaattaccttccagaggatccatcttcaaatatcatcacattaaaattagggttttagcatttgaattttgaggacatacaaacattcagtccatagcaaacctcctcaaacaattgttgtgataattaaataaattaatctatttaaagcacttagaagattgctagacatacagtaagtgctcaatacacacatatatgttattgaattattaaatagaataatgcctctagcattcattactgctgttcaattttgtcttcattgttattttattttatgtcttcctgtgtaattcccttgtggcaatttcataattgctatagctttttttgtttgaccctccacatctcatgttcaaatttgatccccattgttggaggtagggcctaatgaaagctgtttgggtcatgggggtggatccctcacaaatatcttggtaccgtcctctggtaatgagtgagttttaactctattagctcccatgagagctggttgttaaaaagagcctggcacctccccctgcattctctcttgcttcctctctcaccatatgatctctacacatgccagctcccctttgccttccaccatgagtggaggcagcttgaagccttcatcagaaacagatgctggagccatgctttctatacagcctgaagaaccatgagccagtttatttataaattacccagcctcaggtattcctttatagcaacataaatgaactaagacaataatctacaaattcatttacttgattactggcaaattactcccatgagagtgagaacgttttctgtgaagttctctacccattccatgcataacacagcatctacacacagcagagattagtaacagtttgttaaaggagtaaattgatccacttttaccttctgtaaagaccaatttaaatctttcttatattgctaacactgaacctcctggttcaaagttaaaaaaaagataaggcgcagtaacaacagagtttcaggaagatctgggaaagaaagatttcctattattttttatttatttatttatttttgagacagattctcactctgttgcccaggctacagtgcagtggcataatctcggctcactgcaacctctgcctcccggattcaagcgattcttccacctcagcctctcgagtagctgggactacaggcacgtgccaccacacctggctaatttttgtattttttagtagagacggggtttcaccatatcggacaggctggtctcctgaccttattatccacccacctcagcctcccaaagtgctgggattactgacgtgaccccctgcacctggcctatttcctattaattctaggactaactacctgaaaataggataataccttgcatcactacattaatatactcatttttattgtcccctgtttctgagagtaacaacttcaaatctcctaccttctttcctgactttgacttcctataccgtcagctcttcagggcagtcttgacattggaataataataataacatcatgttcttagacaaagactgatccactctcagaaatcaggttaaaggttattttatgtgattcttttttgttttaatatgatttataaagagggagagtcaatgttgaagaatcagctattttaaaattgatccctctactggagtactaaaaagtatttgtgaaatgaacacgaataatctttataacattaaacattgcaaaacccaaatgcaaaatagtcctatttaacataaagtctttcatattgttctgttctgccatccttctatacatttgcccagacaggacagcaacaaggaaagaatatgtaaacactaatcatttctaacttgccatctgtgacagttcactgtgctgaaattagaaaggatggaatcacttttccatttccttaaggtcaccaaggacagacaagctcaggacatactgtatttgtcagaagaaaaagagatgactggtgaggtggcagtgacaaatctgttctaggttcagctcattttactgaagaatgtgtgtccccttctgacatttatcaaaagaaattcaattttataaaaagaaggatgtcaaataatagtacattgctaacactcattttgttgctgtcagaagggcagatgggggcaaaaagggaaaagggtggatggaagagaaagttattccagcaagaaacaaacaaagtcatgctaataatacacttataggcttgaatatatttctgattaaaacacctatttttgagatccatcttagtgcctggctcacactttagaataccagttttcacttcttccagacagaaggaacgacacaaagcaggttgatttgtgggttttgtgtttgtttttggttttgtattttgttattgtttgagtgccattctgctgcaccaggaaggaaagaaagctaatgaaacctggtaaaaccccaggtacaatgacatgcaccctgtgggcatgcaatcaatagttcttatggtgatgatgatgtttttctctggcagaaaagggtattttgggtcaaaaaataacccaaaagttgtgacagaggtaacggaaaaatagaagtcagattaaaatcaaaggaagaaattctaacccaaaagttgtgacagaggtaacggaaaaatagaagtcagattaaaatcaaaggaagaaattctatcaggagactaataatgaagctgacaatatactgtaacaagtaatagtgttttaccatactgcataaaaatattggattaagatacaaattaaatctctttctcagtgagggttttctgcagaacataaacaattaagctgctttctggagaagacaggaaacttgattaacagatccaaaaagacagcatagggaagatgggtttaacactaggaggtgaaacaccaactgttatccaaattgacttttccagaaacgttggataatttcaatcaaggactgaaatatactcttttctttttaagcgtcagtgttctctggacttaaacaagtcaaaggaggttcttattaaataaatgctactggtgcatatgttccagtcacagtctcctgaggtgagtatggagacactacagaaaattgaaccatgaaatagggttttgtgtctctataccaaaatttcaaatatctggaggtgtcctagctcatggtggctaagcaggcagcttgtgggagtacaggaggctacaggagacgccaggagtaaaacgacctattctgagtcctgtagtctctgtaaggtgcctatttgatgcaatctaagacagtcttatttagaatagggacccttagaagctgctaatataagtcaaagaaacaaatacttctgtgcatttttccccacaaataagggattgtcctaaacctctaagcattaaaccaggaatccagtaaaaaccaggcttattgtactccaatccccaactcacgtactgtcttagagattttcagacacaaggtgctaaaagttatatagcatattttaaaatttatctgttatcaagtgcctttcattgaacaaaaaaaaaatcaaattcaatagtacataaacaagatctttctgctccttcttggaagatttttaggagaattaaagtcatagagacaatcatctacatgccattaatattgtcatcttcacatattattaccagtattattaccagcacagctttcaaggtttgaaattttgcattgggctggccttaacatttggacaaatcctttttaaatatagggaataaataataaatttaaaaataaaatacgttaatatgcaattttttttttttgagactgagtctcacactgtcacctgggctggtgtgcagtggcaccatcttgacttactgcaacctccgcctcccaggttcaagcaattctcttgcctcagcctcccaagtagctggattgcaggtgcctgccaccacgcccggctaattttttgtattttttagtagagatggggtttcaccatgttggccaggctagtcttgaacccctgaccttgtgattctcctgcctcggactcccaaagtgctagaattacaggcgtgagacactgtgaccagccaatatgcaaaattttaacgctttaaattagaggtcagcaaacttttttcattaacagagagtaaaatatgttctgctttccattccatacactctcacacaactaatcaactctgctgttgcagtacaaaagcagccatagacaatacaaaaacaaataggggtggctgtgttccgataaaattttctttacaggcctctgcctctgcctctgcctctgcctctgcctctccctctcccctctcccctctcccctctcccctctcccctctcccctctccctctcggtctccctctccctctctttccacggtctccctctgatgccgagccgaagctggactgtactgctgccatctcggctcactgcagcctccctgcctgattctcctgcctcagcctgccgagtgcctgcgattgcgggcgcgcgccaccacgcctgactggttttcgtacttttttggtggagacggggtttcgctgtgttggccgggctggtctccagctcctagccgtgggtggtccgccagccttggcctcccagggtgccgggattgcagacggagtctggttcgctcggtgctcggtggtgcccaggctggagtgcagtggcgtggtctcggctcgctgcagcctccatctcccggccgcctgccttggccgcccagagtgccgagattgcagcctctgcccggcctccaccccgtctgggaggtggggagcgtctctgcctggccgcccatcgtctgggacgtggggagcccctctgcctggctgcccagtctggagggtggggagcatctctgcccggccgccatcccgtctgggaggtggggagcgcctcttcccggcagccatcccatctgggaggtggggagcgtctctgcccggccgcccatcgtctgagatgtggggagcgcctctgccccgccgccccgtctgggatgtgaggagcgcctctgcccggctgcgaccccgtctgggaggtggggagcgtctctgcccagccgccccgtctgagaggtgaggggaccctccgcccggcagccgccccgtctgagaggtgaggagtccctctgcccggcagccaccccgtctgggaagtgaggagtgtctccgcccggcagccgccccgtccaggagggaggtggggggtcagccccccgcccagccagccgccccatccgggagggaggtgggggggtcagccccacgtccgggagggaggtggggggggtcagccccccgcccggccagccgccccgtctgggagggaggtggggtcagccccccgcccggccagccgccccgtccgggaggtgaggggcgcctctgcccagccgcccctactgggaagtgaggagcccctctgccgggccagccaccccgtccgggagggaggtggggggctcagccccccgcccggccagccgaccagtccgggagggaagtggggggatcagcaccccgcccggccagccgccccgtccgggagggaggtgggggggtcagccccccgcccggccagccgccccgtccgggaggtgaggggcgcctctgcccggccacccctactaggaagtgaggagcccctctgcccagccaccacctcgtctgggaggtgtacccaacagctcattgagaacgggccgggatgacaatggcggctttgtggaatagaaaggggggaaaggtggggaaaagattgagaaatcggatggttgccgtgtctgtgtagaaagaagtagacatgggagacttttcattttgttctgtactaagataaattcttctgccttgggatcctgttgatcggtgaccttacccccaaccctgtgctctctgaaacatgtgctgtgtccactcagggttaaatggattaagggcggtgcaagatgtgctttgttaaacagatgcttgaaggcagcatgctcgttaagaatcatcaccactccctaatctcaagtacccagggacacaaacactgcggaaggccgcagggtcctctgcctaggaaaaccagagacctttgttcacttgtttatctgccaaccttccctccactattgtcctatgaccctgccaaatccccctctgcgagaaacacccaagaatgatcaataaaaaaaataaaaattaaaaaaaaaaagttaaaaaaaaaaaattttctttacaataacagcataaaactttggcttcaggtcacagtttgttgacccctacttcatattatcatgtcccccccacccccatttctttcattcaccttctatcacagagtcacagctttgcactcacagtgtagccaagttgtagctacagaccaaacattgtaaagaaatacctccggggaacttgagaataagttaaaacttgtgctaaatcatgagtgaaatatacattgggaaacacagttaacaacccattccccaacctgcttactgggccatctttctaaaaatgcaaatttgatcctgcagctccctagcttaaaaggcttcacctgcaacagaaagccctggctttttagtttttcaccataggcttatttatggctggtcctgctttcttcccctccttatttcttctcatcccttccttctcacattctatgcttcagctacatagaaggacttataatttccagaatgatacctgctcccttgcctttcaacccatacacttatttttttttttcttcttagatggagtttcactcctgtcgcccaggctggagtgcaatggtgcgatctcggctcaccacaacctccatctcccatgttcaagcaattgtccttcctcagcctcctgagtagctgggattacaggtacccgccaccacacctggctaatttttgtagttttagtagagaaggggtctcactatgttggccaggctggtctcgaactcctgatcttagggaatctgcctgccttggcctcccaaagtgctgggattacacgtgtgagccaccatgcccagccaacccatacacttgttactcattctccttgaagcactcttctccacacatccttggccttgccaactccttgaaggctgagcttaggtgtcttaaggacttcaactcccagacacttctgtatacctgcgttataatatttttactgctggctgtgtgtggttgctcacacccgtaatcccagcacttcgggaggccaaggcaagaggattgcttgaagccaggcattcaagacagcctgggcaacatagtgagaccccatctctaccaaaaaattagaacttagctgggcatgtggtacatgcctgtactgccagctacttgggaggctaacatggtagaatcgcttgaacccaggatgtcaaggctgcagtgactcgtgattgcaccactgcactccagcctgggtgacagagcaagatcttgtctaataataataataataatattcttaccactatctacagatgattactggtgcagataaatttaaaattcttcttggccatgtgtggtggctcacacctgtaatctcagcactttgggaggccgaggtgggcggattgcttgagctcaggagttcaagactagcctgggcaacatgattaaaccctgtctctaccaaaaatacaaaaacttagccgggcatggtggcacatgtctgtggtctcagctacctgagaggctgaagtaggagtattgcttgagccctgggtggtagtggggagactggaggttatagtgagctgagattgtactactgcactcctgactccagcctgggtgacagagtgagatttcatctcaaaaaatatataaaaaataaaaaatttaaaatccttgaaagctgaaactgcattttcttgtaagcacatgatatccctcttagggtcctgctcccccatcccctgagcatgggaataaagaaaaaatcttgactccctttaggggaaaattccaggcaccccactatccttgagaaataaataaataacccactaatcaataaggtaataataagcttaaacaatagccacccaagtaatctagagtcataaaatgtttggttccctataaaaactaaagataacatcttgacatatttccctgagttgtttttcagaaacctgtacccccacaagatggaaaatgctgaccactgtcacacagacctcaaataagggagagctaaggactgaactctaatcgttgtcccttgttctaaatgtcttcatgaggggcctggagagggtcatcatgcccatagatcaaaccttaacattcctttcttctgaccccaagtttttagacaaagcattgcttccctaaccaattgtaaatcaaataatctgtgaacctctctatgacttgtaagcccccacttccagatattctgccttttgaggcaaaaccaatgtgtaacctccatgtattgaattacatatgattttgcctgtaacttctgctttcctgaaatgtaccccttcctttaaagacccttgcttgtaagccgtgggagagtttgggtcttaagtgttagctgcccaattctccttgcttaatgccatgccataaatgcctcactttctctcactgcaaatcttggtgtcaatgtttgcctttgctgcaccaggtgggctgaccaaagttgggttggataacacatggtatctggtacattgagaataatccctaatgcttattaaatgaagccatcaattatttaatgtctttaataagcttttggcctttctacttcagaatataactttagttattcccagctatgggcaatttattttcttttgcatattgtctataaatgatacccaaagaactaataggaaaaaaaattattagtcagttaaacaggtaatttaatatcaaaccatagaggaggaaaaataattgtctctctacccttcagagttcgtagctgagactctgaaggttaacaggagaaaaataaataaaagatgaataacgtgtgtacctccagtatacatggaaggcatactcagcgaaatctgaaagagtaaaatctccaggctaaatctcaagagatctcaaaagggttgtttaaacttcaggcttataccatcctttgttgaaacaaaaagagaagtttattgggaaaggctgattatgggagataggaagagtacagtatacaagaacagtttgttatgcaaacttaagtcagtcccttctccattgattaagagtatcttggatttagtcattctcttcctggtactaagagagagagagacacccttacaaataacgattttctttatagacataaatttctcttacaaaagggtaccttctactctagttttcagagcttctcctgtgtctgctgtttcccaaaataattcaattcaaaaaattctatgtcaaagaggcttatttggggtggtgtattctggtcttttacagtcacactttgagatgacgtgttctgaacgccatcaatataaaaatcttcttaacttgatttaaaatttttttcaggttgaaattagacatatagctttatgttgtcattattgttttgtttctttagagtgttaacttaaaaggaagaagctgaggaaaattaatatatgtagagagtttctttgggccaagcttgcagattgcaacacaggagcacagattgaagttgccctgaatataattcaacaagcagtagttacaagtgaaaaaaagtagttaaaggcaaaaaggggagacacagagtgggctgatacaaagttgcttgtcaggaattctcattgtttcatggaaatgacgtggagtagtgattggctatacatttttggctatagtgtgtgggttatagtgtctggtgtggcattattagcttaatttatagctacttgtagcaatagcaagcagtttcaagagattaatatatagctcaaagtgggaaataggacattattgcagtctcattttaatgtctctttgggcctggtaagtactgtcttcttttttttctttttttttttttttcttttttgagacagggtctcactctgtcacccagactggagtgcaatggcaccatctcggctcactgcaacctctacctcccagcctcccaagtagctgggactataggcatgcactaccataccgtgctaaatttttgtatttttttgtagagatgaggtttccccatgttgctcaggctggccttgaactcctgagctcaagcgatctgcctgcctcagcctcccaaagtgctgggattacaggcatgggccatcgcaccaggccaggacctgataattaaaaggcctcagataaaagttcttttctcaagagacaatcttaggaccacttgctgcattatctatcagtattaataaagccactttacatttaccctataagtggaaatattttctcaactaatcacttaacagccaggttttatttgagaagcaattaaacatttatggggtctacagaagatatgaacaaatgctatataaagacatccctaataacagactataggaaaaaaattgtgctttaatgcattatccacatacagcatgtcactctgggttactagattttagcctttcatgatctttgcattttattgcatatttattttatgactctttgcaagttaaaagtgacaaagaccctccccttaggctcctttgaatcttctttttgactaactctcactcttggtctcatccttgccccacctagtctagttttagcaagaatcctcttgaatcaatatggcaaaaatcccctgcccttggcatgtgatcactattgatgactgattaggttcctcttacttcatcctctatatcttttcacagtgggctgccttcagcaagaatcctaagtcagtgtagccataatccccatagtcttgatgtttcctcttagtaattttctatcctctgatctccgccctttaccttggccataaatccccactttttcttgttgtattaagaatgggatttcattctatgctgagatctctttttccctattgcaataattcctgaataaaatttgcttttatcactttaactttctgtctggctgtggtttgctttgacaatagacatgcatattctgtcttacagagtggagttcaatcgacttcccatctcctatgggggaaaaaaaccagttttgcctctatttgtaattccatttctttactccatagaaatgtgtgactttggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaagaaatgtgtgcctttgaattttcctttcaaccaattataatatctacccgccttccttactgaatgagtaaaataaacattttaacacatgcttatttgtatgcccacatgacagtcatgatcttaccttttcttttttctttttttttttttttttttttgagacggagtctcgctctgtcgcccaggctggactgcagtggcgcaatctcagctcactgcaagctccgcctcccgggttcacgccattctcctgcctcagcctcccgagtagctgggactacaggcgcccgccaccacgcccagctaattttttgtatttttttagtagagacagggtttcaccgttttagccaggatggtctcgatctcctgacctcgtgatccgcccgcctcggcctcccaaagtgctgggattacaggcgtgagccaccgcgcccggctgatcttaccttttctagaaaattatcttttaacaattttggaagttccactgaaatgcccagtggatttacctaccaaagccaggtaacctttgcaggcagagaaatgcacttcatgggcagtgtaagcccaggtagatcttttcttggctcacagaattgaatccaagatggcaagaaaaccttgctcactctgtttttctcattctaattctcctctatactaattttacatttttggttttgggttgtttactgtcagtaagttagtccccgttgcaggaagtaatggttgggaattcacttttatgatctgattatttgatgatctctgtaaatgaattaatagttaacagagatctctgctaggtgagagatagcagagaatctagtgggttagtcttttctgtttatctgttttctattttgaactcttgcagaaaccaaattaatgttttaagaaatcaagttcagctgggtgcagtggctcacgcctgtaatgccagcactttgggaggccgagatgggagtatcgcctgaggtcaggaatttgagaccatcctggccaacatggtgaaaccccgtctctactaaaaatacaaaaaaaaaaaaaaaaaaaaatagccgggcatggtggcatgtgcctgtaatcccagctactggggaggctgatgcaggagaatagcttgaacctgggaggcagcggttgcaacgagtggagattgggccactgtactccagcctgggcgacaagaacgaaactctgtttcaaaaaaaaagaaaagaattcaagttcacataatttagataaatttttggcaaatgatacaagcttaatattattggtttaacaaaaaatacctatgtcttctttgatttactagagaatgagaataatataatgtaggtgcttatgctacttgggtatgtttttcctaatcttaaacaggttaatagattgaataagcttgccttacttctacttcatgtttaagatgtttataaatataaatttatatttactcatactgaatcattattgtgataaactttatttcaacaataattatgttttgtgtatgtcagcttcaggacaattttcaaggtctgtaagtaacttaaaaccttggaccaatggtaagttgagttaattaatggagaatcattagatagacagacagtatttcaagatagtaagatagaatactcattactactcataatttcaagtttatatccctttacttcttattttcataagactatctctttgggtctgtactgaatgtgctgctcatttctgccactttggggagtgtataaaaatgatatgtgtggctaaggcaagctgtattgtgtgtattcacaagttctgctagtctgctgcaaaatgctggtgtgacagtgaacaattatccactctccaggtctctctgtgaaatagaagtgtgttactttggctaaaagttataatggatatgtggctttggctatatttaggagccatagtttctgacaaatacagctgtgtatttccattttttgaggaaaagagtaattttgtcccaaaggagtggagtatttttggtctccaaacccccttgtgctcttcaagcttattgagaaccacaaagaaatagaactgcctttgagatttcccaaaggactcccataaagtcacaaagatttgttcttttgccttctaaaaaggcagatgttaaaaataattaggctcatgtaacattattagggctaaaaacaaaaaacttatactgtaaaatatggtgccttgacaagtcttttttttttttttttttttttttggagacaaggtccactctatcacccaggctggagggcagtggcatgatctcagctcactgcagcctgacctgccaggctcaagagatcctcccactccagcctcccaagtagctgggaccataggcacatgccaccatgcccagctaatttttgtatttttttgtagagatggggttttgccatgttgcccaggctgatcttgaactctgagctcaagcatcttcccaacttggcctcccaaagtgctgggattataggcatgacccaccatgcccagcctcttgacatgctttgaactaaaaaaccagcctcagaaacaaagtctctctgactttctcccaccctcaccctctgtcccccaatctcagtcctctgcctctctgaaagcacagggagaggctttctctcaagttcatttatgggactgcaggaagttcctccagacagaatgcaattgtcttaggtcttctccctgtaatctcagaaaacaaagaaggttaacttgctggaatgatgactagattgggcaccatacccaaagcccagacagactttctcccaggctattgtttgttcttctcccctaaaaatcatttacttttcctctaaaattgcatacatcccccactccttctcccctatgaagagagtatttaaacttcaaccatctggcccttctttgagtatcacactttgtgtgactcccgtgcacttgcacgttaataaatttttatgccttttctactgttgatctgtctattgtcattttgttttataggctcaaattcttgaactcccagggagtggaagaaaactttctttcatccctacagtgtgttattattaatgagttacatagaaagagttgtcgaattaaaaaagatacttatgcttccctagattaaatttatatgggtaaaatcatcacaaacattttacaaactaaaatccatatgtgaagttcctagagatttgtcaatgccttcactgcctatgacatggttctatttatcagagttcaggtgtagctctgcctgataatagacaatagacaatagtatacagtagacagtcataatttcagttatttttggcatgccagctttgttaagatataattcacacacaacacaatttaaccatttaaactatacaattcagccaggcatggtggctcatgcctgcaatcccagcactttgggaggctgaggcgggaggattgcttgagatcaggagtttgacatcagcctaggcaatatagggagacctcctctctacaaaaaatttttaaaaatcagccaggcatagtggtacatgcctatagccccagctacttgggaggctgatagggggattgcctgagcctgggagatcaaggctgcaagtgagccatgatcatgctactgcactccagcctgggagacaaatcaaggctttgtctcaaaaatactaataataataataataataattaggtgtataattcaatggttcttagtatattcagttatgcaaccatcaccacaatcaattttagaacatattcttcacttcaaaaagaaatcctgtaaccattaacagtcattctgcatttccccactaaccaccaacccagaattgcctatttgggacatttcgtatagatggaatcatgccatatgtgatcttttatagctggcttctttcccttagcataacattttaaggttcatttatattttaccatgtatcattacttcattccttgttatttgcaaatattattccattgtacaaatataactttttatttatccactcatcaattgataggcatttagattgttttcactctttggttattatgaatgctgatgctataaaaattcatttacaagtttttgtgtaaacatgttttcatttctcttgggtatatacttagaagtagattttctaggtcatatggtaattctatgtttaatcatttttatggcaaccctatgtttaactatcagattgttttccaaagtggctgccccatttttcagtccactagcagtgtatgagggtttcaatatctttataccttaaacaacacttggccaggcacagtggctcatgcctgtaatcccagcactttgggaggctgaggcaggtggatctcttgagcacaggagtttgagaccagcctgggcaacatggcgaaaccacatttctactaaaagtacaaaaagctagccaggtgtggtgtcatgcgcctggagtcccagttacctgggaggctgaggtgggagggtcacctgagctcaggacgttgagctgtgatcacagcactgcactctagcctggatgacagaatgagaccctgtctcaaaaaaaccgaaaaccaaaaaccactacaaccaataacaaaaacacttattatctgtctatttgattacagcatcttaatgggtatgaagtgctatcctatcaccttgagatttacttgttttcttttctccctaatggctaatgatgttaaacatcttttcatgtgtttattggccatttatatatcttctttagagaaatgttaattcgaatactttgcccattttgtacttgggttattttattgagttgtaagacttctttatgtatactaggtacaagttccttataagatgtatgagttgcaaatattttctccagttcgtggattgtctcttcacttttttgatggtgtcctttgaagcatgactgtggtgaagtccacaattttctaatttttcttttgtcaattgtgtttttggtgttacatctagaaaggctttgcctaacccaaggtcacaaagatttataccctacatttcattccaagagttttattgttttagctcttacatttaggactctgatccatttttagttaatttttgtgtatggtttgaggaagaagttcatctttattcttttgcatgtgcatatccagttgtcatatttgagaatgatgctcattttaccaaatatgaccatgttcctataagtaactaaggttgtaaacttcatgaaaccaatgcttgcaatgtcctgttgggtaagctcacctggtacctggcttataggtttccctgccttccaggtaggtttagaaggtcactttctggcaggtccaaaagtcttagcatctttgggggacctggagaagaaagcaatttgtctcatttataggaaatgcaaggaaatctgatgatgagttcttaccttggtttcttagcctcatgatagtaaataatgagaggttttaaaagcccattccgagattgcttataaaaacttccagcaaagcaaatttaaggtctctatggtaaaggaattttcttgctacacctgtatatataatcaggccagatctgtcaatgttgagagaggaggaagggagaaaccagttaggcagcagttagggtgggtcctctgttgaattctttcaaacaaaagaacagcctgaaaaatcaagctgcaggcacagataagggaacttgcacaggggcttgcctaagacatacccaccgctgcacagataagaaaggctacacaggtgacttgcccaaacattcccgcaatggaaaatttcgtcctctgacacatgcacagtgaagggaacaaagcaatatggagtaattcaagctaaaggcctgcatgcacactaggtggatgcaatggggctaccagaaatttgtgccttatggaaataaaatgtccagccctcatcggttcctataaaaggctttgtattcaactttgaaaacagcaatcctctttcaggccccctctctgcagcggagagctttcttttttagcttactaaacttttgctccaacctcacccttggtgtctgcgcttcttaattttcttggtcattacacaaagaacttcctgtgatactttgggcaatgagaaactgctacattgtggtgcactggggagactgtaaccatgtgtatcttactttgtgatcaagaataatctttcgagggttattttttattaaaagaggagagactatacaaaaaaaaattgtgtttcaatggaaaactatggattatctacatacaacacgccttgtgttacctaatctagactttctaatttttcttagagacagggctttgctctgttgcccagactgaagtcaagtggcatgatcatcactcactgcagcttgaactcttgggctcaagtgatcctcccacctcacctcacctaggactacagggatgtgtcactatgcccagctaagtgtttgtttatttgttttgtagatctggggcctctctgtgttgcccaggctggtcgttaactcctggcctcaactcatcctcccacctcagcctcccaaagtgctgggattacggttgtgagcccctgtgcccagccagtcagattttagcctttataatctctgagctattttacaactctttgtaaacggatagactacacattctgtcttgtctgatagggtttcaatgaacttatctcccctctcagggaaaaaatacctttgcctccatttgtaattccattcctttattccatataaatctgtaccttttgacttttcctttgatccagtgtaatatttgcctgcttccctcatcaaataagtaaaatctttcacacatgttcattttttatctgtatgagagtcatgattttacctttatttcaaaagttatcttttaacaatacattacaaagtgggatagagatgaaatcagataagagagaaaaagacccatgaaaatgcataggtttaggatgtacctcatttggactctgcagagacaatgaaacaaagtctcaaagaagttgatttgccgaaagatacaaccaggaaatgggggtgagataagggtgaagggtaaacaataattaatggaaaagaaattaaaatgacacaaaacatgtgaataaatgctcaatcccataatgctctcaaatccttttttaaaaagacctatcatttttcatttaagagagtggtaaagaaatagaagtgtggtactattcagggctggtaagtaggtagcaggaataggcgcatttctgctttgtgaataagggagcaggatacactctttaggaggctatttaataatatttaaatacaagtatcctttaaaccagcatttctacttttagatgtttaattggtgaaatgcttgcacaagtatgtgatgatatatgttcaaggatgttcattttcaatattgttgtaatagaaagcttggaagcaccctagatttccatcaataaaggactgtttcagaactctgtatctagaatggtgcattttttgtttaaaaatatacatatagtggtcatcttagagggatgggactataaaactttgtactccacattttttgttttacatgtttgtattacttttgccatattttttaaaaagtaaaaatatacctataagagaatccaatcttttgaacttggtacagtatcatataaatgaactcattttttcagtgcaccaatggaagcttctcagtggaggtggagagggttgtagaacagcattctgaattggacctccatgaagtagggcatagtcattactcactagtcactaagaacattttctatgggatgtgcacaatatccagacaagaattttaacaagatccacacatgctacttgagccaatgaaacactttacttaatcaattaactaatgaaggttttagggcaaataactacgactgaagaattgatgaactatagaatgtaggtgtatgtgtgtgtcttttgactgtagttcccactgaagagttgccgaatgatgaattaatgctaaatgatccagatacacatcatataaataattacttataaatattattcaaatgaaatttatctactttaaacagctatttgtgcagttaattgattttaaactgcatatacttccaatttcaaaataggctgatttgaagtagagtcttcagtaggggcgtagcatattatgattttaaaaatttaaatcttatgttacactaaaatgctgtaggaaatagatttgatcgggcaaccaaaccgatgtcatgggtcactattcgtaagtaccatggcaaataataatgattaacatttaccacagacttattgcatagaaataatttctgtaagttatgcctccaagcaactcagtgatgtaagtaatgatttatcctggcttaacagaagttaactaaagatacggagggagaaaatgaggccagggagttctctggggcctcttttataagggtacaatcccattcgtgaaaactccatttccattacccagtcctatcccaaagaccttgcctcctaacaccatcacatttcaggtgagaattttgcataggcatttgggaagggaggacaaaaatattcagtccataacaaaattcctcattgaggttgtgtgtattgactagataaaagaaattcaacagtttccatcccaaatttgtttgctatccaatatagatagcttggtttttgttttgagacagagtcttactctgtcacccaggctggagtgcagtggcacaatcatagctcactgcagccttgaccttctgggatcaggtgatcctcccacctcagcctccttagtagctgggactacaggcatgtgccactgtgcatggatcttatttatttatttatttttgtggagacagggttttgctttgttgtccaggctggacttggacttctggcctcaagtgattctcctacgttggcctcccaaaatgttaggattacagatgtgagccactgcacctggcctcataatttctgatttatattcacaataaagctaaaagaggaaacacatgtattgtggaacaaaaagcacacaaagaagctgtttgaatgtctttttaaaatttttacttttcaatgtttttattgatgtgaaatatttgaacatatttataggatacatgtaatattttgttacatgaatagaatctgtaatgatcaagtcaggatatttaggatatccatcaccatcagcattttaccatttccatgtgttgagaatgtttcaagtccttacttctagctattttgaaatgtgtaatacataattgttaaatatagtcacctatatcactataaaatattagaacttattctaactaactgtatgtacccattaacccatcctactttacttccccccacgcacactcacagatagttcccagcctctgataactgtcattctactcactacctccatgaaatcaacatttttatgagcatatgagtacatgtgataatatttgtctttctggtttttgtttttgttttgagacagggtctcaccccgtagcccaggctggagtttagtggcactatcacagctcactgcagcttccaactccctgggctcaggtgatcttcccccctgtacctcctgactagctgggactacaggcacatgccatcatgcctgtctaatttttgtatttttttttgtagagatggggttttgccatgttgtccaggctggtctcaaactcacgggctcaagtgatcagcccaccttggcctcccaaaatgctgggattacaggcatgagccaccacacctggccatatttatctttctgtgtcaggcttatttaacttaacataatgacctccagtttcatccatgttgctgcagatgacattatttcattcttttctatggctgaatagcatcctactgtgtaaatatatgacattttctttatgcattaattcattggtggacacttaagttgattccctatctttgctattgtgaatagtgcagcaataaacacaggggagtatgtatccctttgatatgctgatttcctttcttttggataaatacccagtaatgggatagctggactacaaggtagttctattttcagttttttgagtaatcttcataccattttccataatggctgtactaccttacattcccaccaacagtgtatgagagttttattttctctgcattgtcaccaacatctgttattttttgtattttttatagtcatttttactggggtaagatgatattgtggttttgattagcatttccctgataattagtgattttgagcatttttattatacctgttggccatttgtaggtcttccttggaggaatgtctatttagatccttgcccaacttttaaatggggttgtttgtgtttttgctgttgagttgtttcagttccttgtatattctggatattagtccttgtcagataaataatttgcaaatattttcttccattgaataggttatctctttgctctgttgattgtttactttgctgtgtggagctttgtagtttaatataacttcatttgttaagttttggttttgttgcttgtatttttggggtcttagccataaaatctttgcttaggcaaaagtcctagagtattccccgctatgtttttttctagttgttttatagtttagggtcttacgtttaagtcctcaatccatcttcatttgatttttgaatatggtgagagataggggtttaatttcattcttctgcatataaatatccagttttctcagcaccatttattgaagaggatgtcctttcccccagtgcatgttcctggcacatttgtctaaaatcagctgtctataaatatgtaagtttatttctgggttctctattttgttccgttggtctgtgtttttctttttataccaatatcatgctgatttggctactatggcctgataatatattttaaagtcaggtagtgtggtgcctccagcttggttattttcattcagaattgctttggctatttaggctcttttttggttccatacaaattttaggatttatttttttctatttctgtaaagaatgtcattggcattttgataggaattgctttagtagtatggtcattttacaatattaattcttccaatccatgagcatggaatatctttacgtttgtttgtgacctttgcaatttctttcactggtgttttgtagttttccttgtagagatctttcacctccttggttaaatttattcctagtttttttgtttttgtttttgtttttgttttgtcattgtacatgggatttctttattatttttcagctaattcattattgacattataaggtatatagaaatgctactgatttttgtatgttgattttgttttctgaaactttactgaatttgtttatttgctctaggagtcttttgaaggaatctatagggttttctagatatagaattatgttgtcagtgaacagagataatttggtttcctctttttctatttggatgccttttatttctatctcttatttgattgctctggcgaagactcccagtagtatgttgcatagaaatggtaaaagtgggcatcctcgcttgttttagttcttaggggaaagggttttagtttttccccatcagtgtgttaactgtgggtttgtcatacatggtctttattatgttgaggtatgttccttctgtgcagagtttgttgagtgttgtttatcatgaagggatgttgaattttatcaaatgctttttctgcatctattaggtgatcatgtagtttttgtcttttgttctgctgaggtgatatatcacatttactgtttacatatgtagaaccatgcttgcaatcctggggtaaattccacttgattgtggtatattatctttttgaggtgctgctagatttggtttgctaatattttgttgaggatttctatgtctacgttcattagtttattgacctgtcattttctttctgtgttgtgtttttgtttggctttgttaccaaggtaatactggttttacagaatgagttagggcaaattcccacctcttctcttttttagaatagtttgaggagaattgaaattagttcttctttataagtttggtagaattatgcagtaaagccattatgttttcagcttttctttgttgggagacttttaaatttgttttcaatctcattacactttattgatctgttcaggttttctatttcttcctgatttgatcttagtaggttgcatgtttccagggatttatccattttctctaggttttgcagtttgttagtgtgtagttgttcataatagtatctgatgatcttttgtatttctgtggttatcagttgtaatgcctcctttttatttctaattttatttgggtcttctctctttcttcactggtctagctagtggtctgccaatattatttatcttttcaaaaaacccactttttgtttgctgatttttttgtatatttttagtcccataggttttagtatgctatgtttccattttcatttgtttcaagaaatttttggcttctttctttccttccttccttccttccttccttccttctttctttcttttttctttttttgagacactctcactctgttacgcaggctggagtggagtggcacaatctcggctcactgcaacctccgcctaccaggttcaaccaattctcatgtctcagccccccgagtagctgaaactaaagtcatgtatcaccacatctgcctaatttttgtatttttagtagagatggggtttcaccatgttggccaggctggtctcgaactcctggtctcaagtgacctgcccacctcaacctcccaaagtgctgggattacaggcacgagccaccatgcccagcctgatttgcttcttaatttctttgttaacccaatggtcattcaggagcatattgtttaatttcatgtatttgtacagtttccagaaaccctcttgttttttatttctagttttatttcattgtggtcagagaagatacatgatatgatttcaatgtttaaacatttgttgaggcttgttttgtattctaacatatgggctatctttgaaaatattccatgtgctgatgaatgtgtactctgtagctgtcagatgaaaagctctgtaaatgtctgttaggtccatttgatctaaaatatgcagtttaaacccaatattcctttgttgatattctgtgtagataatctgtcagttgctgacaatggggtattgaagtccccaaccattattatattggagcctattcctcactttagagctaataatatctgttttacatttccaggtgctcttgtgttgggtgcatatatatttagacttattacatcctcttgcccaggcacggtggctcacacctgtaaccccagagctttgggaggccaaggcaagaggatcactcaagactaggagttacagactagcctcagtaacatagtgagaccccatcttacacaaaattttaaaaaattagccaagtacggggcatgtgcctgagggtgaagtgagaggattgcttgagcccaggaggttgaggctggagtgagccatgattgtgccattcccttccagcttgagtgacagagcaacagagcgaggctctgtctcaaaataaaaaaagagagaaaaaagatttttatatcctcttaatgaattgatatctttatcattatataattaccttttgtctctttttgctgtttttcacttaaagtctgttttatatgctataaatatagcacattctgcttatttttggtttctgtttgtggaatattttttccatccctttgcttttagtctatatatgtcttcacacgtgaaataagtttcttgtagataagacatagttaagtcatgttctcttacccattcatccagtctatatcttttaggtggaaattttaatttgtttacattcaaggtaactgctgatatgtgaggacttattcctgtcattctgttaattgttctctggttgttttgtatatcctttgttattttcttcctctcttattttttatctttatggtttggtgattttatgtagttgtaacatttgagtcctttctctttctcgtgtgtgttttctctattcattagttttatactttcatgtgttttcatgatagtagatatggtccttttgcttccaagcacagaactcctttatgcatttcttgtaggtctggtctagtagagatgaattgcctcagcttttccttgtctgggaaagtctttatctttttcttcatttatgaaggataatttagctgggtatagtattcttgagtagccatttttttcacttagcactttgaatatatcattccgctctcttttggcctgtcatgtttctgctgagaagtcaatttttagtctggtgaggattctcttatatgtgactaggtactgttctcttgctgttttaaaattctttctttgtctttgacttttaacagtttggctacaatatgacaggaaaaagcctttttttggattgtatctgtttggggatctttgagcttcctgtatttggatgtctaaatctcttgctagaactgggaaattttcagctaatattttgttaaataggcatttctatggcattaacttctccttgccttctgggacacaaaacatttggatattttgtcacttatgatgtcccatatatcagatagcctttcctcattctcttgtattcttttttttttttgtctgattggattatttcaaaagacctctcttcaagtttttcaagtttcttctgcttgatctagtctatcattgaagctcttgattatatttttaaattttatttattgaattcttcagttccaggatttgtttagttcttttttatagtgtctatctctttggtgaatttcccattcatatagtgaattatttttctgatttgatttctttgtattgttcatctccattcttttgtatctcactgagcttctttaatgttatttttaatttctcaagcatttcataaatttctcaagcatttcataaattactattttttgaaatctgttgttggaaaattattatgttcctttggaggtttcatatttccttgttttttcatgtttcctatttcctttttttttttagatggagtcttgctcttgctgcccaggttggagcacagtggtgcgatctctgctcattgcaacctccgcctctcgggttcaagcaattctccttcctcagcctccccagtagctggaattacaggtgcccaccaccacacctggataatttttttgtatttttagtacagacagggtttcaccatgctgtccaggctggtctctaactcctgacctcaggtgatccacccgccttggcctcccaaagtgctgggatcacaggcgtaagccaccacgcccagcctcctatttcctttcattgacatttgcacatcaggtgtaacagtctcttcttctatttttggattggcttttgcatggggaagactttttcctgtaggtgaatctatggtgttggttgggtagggcacttttgctttgattctgggtgtgtgcagtagtgcaggctcataggagttcctcggctataaactcagtcagtggtgtttgtgattttctcagtagcttgggctctggttgttaatggaagctgtggtgaggtttttctggggacaggacaaccctcaggcttccaggtggcacttgctggccggtcttgcttccttctttctttctttctttctttctttctttctttctttctttctttctttctttctttctttccttccttccttcttttcttttttctttctttctttccttctttctttctttctctttctttatctttctttctcttcctctttctctctttccttccttccctttcttccttccttcctttctttttctttctttcttatttctttttttttttttttgtctgtgatggtctaagcaggccattccctaggtccccaggtggcacatgcagttgtgtgctggtggtggtggtgatggaaggctgggcaggcccatcttcaggaccccacgaggagttcccagatgccagtagttatgaatgaggcagggagatgcccaggcctccagagagcatgcttggttgctggttgctggttttctaggcctgttgttaggccctttgcttgtgtgcatgtgttcccagggcaactgttggggtggtgtggccccaggctcccaggtggtgtgtttggggcactgaggggccaagcctggtaagatgggtctgtttttaggtgtcctgttggcccacttaagtgttggctttagtgggtggggcagggcaggcccccaggcctctggaaggtatgatagggtgccagcagtggcaggtgttctgaggctattattaggccccctgctggtttgcatcctcacctgggtgactgataggatgggctaacccctgggtccccaggtggaaggtttgggaacgggggggtgtggttccagtctgggtgggcctatccttaagctccccattgttgcgtatggccacaggctgtggtgagcattgtgggtcgatccccaattcttgggcagtgtgctcaggcagggatagtagcagtggcagtgggcagtaaaaacccatcctgaaggcatatgcaagtgtgcagtagccctgctagggatgggggtgctatttgtggtagccatcccaggaaggtggggttcagactctggacagtatgtactttggctcccagtaacagcagtggctgaagcagctggcaaggatagcccggactccaggcataagcaagtgcatggcagccctgctgctggggagagcattagggttgctgtttgtgaccacagcttaaggtagatggatttcagactctggggtgtaagcactttggctccctcctccctggtgtgctgcacctctctctccccagtgtataggacactgtacgggctagattgctggggatcctgctgttctactggttccaactggcatctcacctctgtagcccttctggtggatgtggggaaatgtcactgggactccagggaggtggagatgcaggagctgtggggcactgggacaggatgtagcttggtggaagttgggctctcaaaatggtgtcatgctgcagctgcctgggagttaggagacggggtggtgtgagacccactatgagctccctctctggagcaaaactctctcatggactctagggagctcctcatgccagtctcagggcctgcagggcttgaggaactctcccatggctagtattacaggaatctgtggtaaggatgtggaccactggggatcttgcacttcccctttccttgcactgaggagcctctctgagctcccagctgatcctggctgggctgtcggtttcacctctggctccttcagtgcctcaggtgtttcttgtcactttgttaaattctagctttctctcttagatgttctgttccaagtgtgagtatctactcaccattttggttctttgtggaggagctgagtgtcttgtgcctctagtcagtcatctcaaaacgtcactgctcagacttcttttttttttttcttaaatagagacaggatcttgctatgttgcccaggcaagttggtcttgaactcctgggttcaagcaatcctcccacctcagcctcccgcagtgctgggataacaggcatgagccaccacacctggcccaaacttctcgagagtagtagtgtttgacttttgtcttctgtggtgtaattattctctaatagcttgggattgaactctgacatgataaacagtgagtgtatgctactgagagaccaaaaagattggaatagttcacaaagggatataggagactctatttcccaggaggtcctgaacaaagatttacccacttagagtaagtataggcagggatacccttgaagctagaacactaagaggtggcacttatatgactctattcttgagaaaatttattttttccccctcgtggttggttataacatcgaaatagttaaatgaaacttgctctgagttgttatttgtctgccaccctcccctttagagaaactgatttctgaataatttctcttgtacatgcattttaaaggtgtgtaattaactggtaacaggttgttaggtagctgatgaggtgtgaagtagccactaatttgttttctttatttacaactttccctgctcttgaagatgacagcatgatgtttttcattccctgcttacttcaccagattgaaaagtgatttgtgaagccatttttaatccctcaaattccattaaaaaggaatctccaagggagtcttaatcaagacataatagacactaaaatgtgatcacacaacagcacttctaatatggccctatttcaactataatgttaagcgtttgcctccagtttactgaactcagccctaacactgacctacaacttctgaaatgaaataacctctatgcagttggcaattactttattgtaaatgtttgcagctaacatactttattgctttagaatttaacatataccccaaagggataattcgttaccaaattattatagtattatcagtaaaatagtttgctttccccttcaaattgccttttcccctacttaataatatatataatttaaatcagtttaagaaattaaaatggaaacataatgaaatgagaatcattaaaaacaccacactagaatactgaaaatgaagctgaaacagaaatggctaaatgtaaaatttgtatgtaaccaaaaggggtaatttgaaaccagggagcatattgagttattggatgagtttgatgaaaataaaaactctgtccttgaagttttaaaaatattaccaaaagtaagctacagaatatgtaaagaatatatcatggagaactccccttcacccttgaatagacagttaaccaacatgcaacaaagcacagatgttagatacgtggcaacattttcctttctacctgtcagagcctacattaatacttccatcgagaacattgtggcctccaggatactattttcaaatgtagatatgtctcagagcatcaatgctacaagttgctatggtgatcacttttgtatgataataaccaatgctcactgagtttttgatttatggcaggcactgttttaagtgctttatagtattaactcctttaatcttcacaacaatcctataaatctcattaggactctaagaatcctattaggattcttattttatagacaagggaactgaggcccaattttacagttaaaagtaatttggctaaggttacatagtgttggagaaattaaaaacaaaatctcttcccaatctctcagcaaagaaagaagagaaaggtaacagttttattattgaataagcactaaaccagaatgtgatgcccatcacaggcaatatgctaagagattgcaaagacagaaagaaatctcagccttttccatagccaagcagataccagatacaacccattacatacatgttttcttttctcttttttttttttttttttttttgagatgaagtctcgctctgtcatccaggctggagtgcagtgacatgatctcggctcactgcaacttctgccccctgggttcaagtgattgttctgcctcagcgtctcaagtagctgggactacaggctcccatcaccacactcagcgaatttttgtatttttagtagagatggggtttcaccatgttggccaggctggtctcgaactcctgacctcaagtgatccacccgccttggcctcccaaagtgccaggattacaggcatgagccaccatgtccggctacatatatgttttcaagataaataattatagtaagaggtctgtcagcactatttgtcacacatagttatcctcattttacttgatattttgtggtgttagctaattggctttatccagaagaaaaaacaagcatctcatctctttataataggaggtagttttgcagcttggagcaaggtatctaccaaagttaggctcctaccttcccacagaagacaggggtactatctcctctgatgtttacatttcaaagagatggctcctaggtcttaaaagtgacaaaaggcctatcattttcaaatggaattttatacatttcaaagagaggaggaagtccttacaattagaagggtttttgttttgttttgttttgataaatgctttaagaagaaggagaggatgaaaagtctcttcctttattttcatttttttctttcttttctctctctgtgtgtgtttgtgtgtgtgtgtgtgtgttttgtttttttgagacagggtcatactctgtcacccaggctgaagtacagtggcacaatcatggctcacagcagcctcgaacccctcagattcaagtgattctcccacctcaggctcccgagtagctgggactacaggtgcatgcctccacacccagctaatttttgtatttttcatagagacagggtctcactatgttgcccaggctgatcttgaactcctggcttcaagcaatctgcctgcctcagcctcccaaagtgttgggattacaggcgtgagcccctgcatctggccttatttttaatttgcatttgtccttacaacagataataagtagtggagttaggatttaagatagtctagctttaatttttttttttttttgagacagagtcttgctctgtcacccaggctggacgcagtggcatgatctcacctccacctcctgggttcaagcaattctcctgcctctcagcctcccgaatagctgggaccacatgcacgtgccaccatacctggccaacttttgtatttttagtagagacggggtttcaccatgttggccaggatggtctcgaactcctgacctcaagtgttccacccatcttggcctcccaaagtgctgggattacagacatgagccaccactcccagccactttaaagcctttttaagaatcctatactatgccatctttgtaagcttcctacttggaagccattgaacagaggcaatatactgaggaaattaatatattcactcaacacttacttaatgagcacctactatgtaccaggcactttgctagttattaaggatataattatgaataaaacagacaacagttttgccctcatggaacttagggtctaggtggagagactcatattaaacaaatagttcttcaaggttatcaaacaaaattatgaaaactgagaagaatgaaaagtataaagagttttgagagcatattaaagagagaatgtcaactagtccaggtggtcttgagggctatttaagttcaaaataggagttttgatgaagaagaaaggaagataacaaaaggataatttgaggtataaaggaaaacaaaaaaaatctcaggacccctaaacttcttattgcaaaagaggttaagctgcgaggctgagttaggcaacaccctcttccaaatgaacagctgttactaacatgcatcagccagatccccatggaaagataaaaggcctcaagcatctatgaagggctgcccccacacatcattcataagttctttgccggtctcctataaacaaggacatgccaatttaacttaaggtcttcctaaaattaaagtctgttcagttccacactgatagtgtagtacaagtttatcttcccaggtgcagaacaaagacaagactcatttctccacctagccagtgatgcctgcataactgaatcttcctttactccctttttctcttcaaaccttcaccttatcttatgtaaaatgtagattgaccaggcactaaccaaagtcccccgggaatgtaaccattcgcccgacctcctacctgcccctcttcctacactccttcccaactttaagaaaatgtataaatacgaaaactcttgagagtctctttggaaaaaacagccacagatgtgtctgtggcttgtgtttttcccagacgtgcttaaagctggcttaataaaccttgatgattgagatttgtgcctcattttggttgtcccagctttggggtattagattgggaggaataggattaaaaagtaggaatgctaccaggcacagtgactcgtgcctgtaatcccagcactttgggaggctgaggcaggcagatcatgaggtcaggagtttgagaccagcctgaccaacatggtaaaaccctgtctctactaaaaatacaaaaattagccaggtgtggtggtgtgtgcctgtagtcccagctactggggaggccgaggcaggataatcgcttgaacctgggaggtggaggttgcagtgagctgagatcataccaccgcactccagcctgggtgacagagcaagactccatcaaaaaaaaaaaaaaaaacaaaaaagtaatgccacactttgaacacttattctgccggactgaaataatatcatttgatagcacacatagaggtggaaaaggaatgatccttttcctccccatcataaagcatcatggctgatgccccagtttgggtgctcagaaacagatgccccaaaatatgagactcccccatctcaaaaaaacaaagttgggcactgttgattaatattttaaatgcttactcattatttttctagtttattcctttaatattttatttcattttttatttacacaagtagttcatagatatacaatttacacaaggtgctacagattgaatgtttgtgcccccctccattcatatgttgaaatcctagcccacaaggtgatggcattaggaggtggggcatttgggaggtgaataggtcatgagggtggagccctcatgaataagattagtgtccctataaaagaggccaggagaaatccttcaccccttccatcatgtgaggacacagtgagaagacatccatctttgaaacaggaagaatgcatttcacagacattgaatctactgataatgttgatcttggattacccagccttcagaactgtgaagaataaatttctgttatttataagactcagtgcccttataaaaagtccccacagggacaaagacaatagtgttctttatttatttagtagagacagggtctcactatgttgcctaggctggtcttgaactcctggcttcaagagatcctcctgccttggcctcccaaaatgctaagattacaggcacgagccacaccttgccaacagtgatatattttatcttacttttttccccactctattcaggaacttctctgtgattccagatgttcaaagtatttcatcacagctttatttgtcttaaatccagatgtctttcgttaaatgaaaaaatgagcaaccaccaacaagctgagattatcttcttccaatgagcaatgagtcagaactgggctggactttcagtgatccttttaattttattttgtttaaatgctattgggagtaaacccatgaatgcactgtgaccccagaaaggcatgaagggcaggagaggaagaattagctatgagcaaatggggaaggcaggcagtgagctgctttgcattaaaattctaaaagttggttgtggcaggggacaagtgcccggagagaaagagaatgtaagggaagtgagccaaataataatttctctcaaacctagcaaaaatttgactgagatttatgagagtttaaagccctccctctatgcttactccatgtctctttatataatttttttttctttttggtttatgtcccccttcccccttggatttaagctaaatttagactttctttaggattaaaacaagcttaataaaagttcttggagcaggatttttggagtgagagtttaaaggattaattcacctgtcacgtgactgctatatagaggaggatcacagaaatgtaatcacgagtttgcatttattattgtcaaaccaggaagaccccttgcctgaaccgttatataatactttctaaactataattttcaaaaagggacatttatgactcttgccaaatataaaatatagacatgtcacacatttccttttttttcctttaactcattaattaatcagagaactattaagatactgaaaacagttcagaccaggtgcaatgacttacgcctgtaatcccaacactttgggaggccgaggtgggcagatcacttgaggtcaggagtttgagaccagcctgaccaacatggtaaaaccctgtatcccatctctattaaaaatacaaaaattagctgagcagggtggcacttgcctgtagtcccagctacttaggaggctgaggcaggagaagcacttgagcctgggaggcggaagttgcagtgagccaagatcacaccactgtactacaaccagggcaacagagtgagactctgtctaaaaaaacaaaaaacaaacaaacaaaaaaacccaaaaaattcaaataaaaatttgaataacaggtatgtgtgtatgtaggataccaaaaatgctgaaatgaacttgttaataggtgcatactggttaatattttataggtcttaaaatgtcatgtttggggattatctcttctaaaagttagaaatcaattgcaactctaccagacaaaaatttttatttgcatttttttttcttagacagagtctcattctgtcgcccaggatggagtgcagtggtgtgatctcggctcactgcagcctctgcctcctgggttcaagcgattctcctgcctcagcctcctgaatagctgggactacaggcgcgcgccaccatgcctggctaatttgttttgtatttttagtgcagatggggtttcaccatgttggccaggatggtcttaatctcctgacttcgtgatctgcccaccttggcctcccaaagtgtatttgcatttttttttttttttttttgagacagagtatcgctctgtcacccaggctggagtgctttggtgcgatcttggctcactgcaacctccacctcccgggttcaaatgattctcctgcctcagcctcctgagcagctgggactacaggcacgtgccaccacgcccagctaatttttgtatttttagtagagacggggtttcaccaggttgaccaagatggtctcgatctcttgacttcgtgatccgcccacctcggccttccaaagtgctgggattacaggtgtgagccaccacacccggccatgtgtatttgcatttttatggaaaaaatattttgtattactacagaaaagaaacatttgggttgtcaccaggttttttcaacttaactattttccctataggttgtgaaacagtctagtcgatcaaagattatttaagatacaatattttttgtgtgtaaaggaaaccaaaaacattttaccccaaaatatacttctttgacatatttcaagatggttattcagaggccctgcagacaggaatagtctagcataaactaaactaaaatcctaaacctccccaaatgactgagtgggccacctcttggccaaggggacccagagaagcctgaaaaactgaactcctggtcatgatgggatgagagtgttacaggtagttaggtctgagtggggcaggagagacctcttccctgcacccattagaaatgtcggatggttcggcaattatcacattgcctctctaatagtgataaattggctatttcctgagggtccacacctgtcaacattaaagtattaattaaaggcagaccccagggagaagaaacttcctgggcatgcacattaagagtcaaaaatggcgaagtatgatcttccgggtacacttcactgtaaacaggaagaaagcctcagatgggcatgcatacaacttcctaaaaacactgcgcatgctcacttcccaagggtaaggagggctctgcacatgctggcagccaaccctaagggaagaatcatgagaaagaggcaagcctatgaaagtcctaggatcacagttaaaacagagcactggacctctctctactcctcatgcaccctcctggatctcttccaagtgaactttcctttctttcctgttctaaggccttttaaataaacttccactcctgctctgaaacttgccttggtctctttttctgctttatgtccctcagttgaattctttcttctgaggaggcaagaattgaagttgctgcagatgcgtagggatttgctgctggtaactcagggtaactcagatctcttccaccactaacaagaggtcaggcaagcctcattatctcctccttcctttggagttcagaaacatcataacactaacaaaatggacttttttttttttttgagacggagtctcactctgttgcccaggctggagtgcagtggcatgatctcggctcattgcaaactctgcctcccgggttcacaccattctcctgcctcagcctcccaagcagcttggactacaggcacccaccaccacgcccggctgattttttgcatttttagtagagacagggtttcaccgtgttagccaggatcgtctcgatctcctgacctcgtgatccacctgcctcggcctcccaaagtgctgggattacaggcatgagccaccacacccggcccaaaatggactttaagttaatagtatcttaacttaaaatattcctttctgttgactccaaatttttagacaaaactttacttctttaaccaattgcaaattggagactctctgaacacacctatgacctataaaccctcgtgtcaagataatgccacctttttgggccaaatcagtgtctaaccatttatggattgatgactttgcctgtgacttctccttccctaaaatgtataaacagagttgtaacctcactttgagtgaggactgctcactcaaagcttcttgggtttgtgttttttcccaggccatggtcattcctattggcccagaataaacctctttaaaatattttacagactttggtttttctgttaacacctgaaaagctgccttttgtaaaggagatttgcatctgtggagaaaattgacattggtgaaatagccaggctttctccgaggctcccctcccttttcaggatctaggacagatgaaccaaaccacaggctatcaactattctttctgaaagcagctccaaaattacctgagatatttcacctgcataagatggcctttgcttgacatgcttttccgctcttcattctcccataacctgtgacaccaccttccacagagcccggagaaacttggtcccaggcccttggtctttgggctcattcattttccctcaaaatcatatttacttctatacctccccatctcccttctccccagtgaagaagatatttaaacatcaaacatctgtccctcctccgaattctttgagacaaagtctcatcctgtcacccaggctggagtgcagtggtgcgatctcagttcactgcaacctctacctcccgggatcaagtaactctcctgtctcagccacccgagtagctgggattacatgcatgcacgaccatgcctggctaatttttgtatttttagtagagacagggtttcaccatgttggccaggctggtttcgaactcctgacctcaggtaatctgcgtacctcgtcctcccaaagtactgagattacaggcgtgagctaccacgcccagcccgaattcatattttgtatgactcccatgcatgcctgtgcacacagtaatctgttatgcttttctctgtgggtggcaagccactcaggtgccgaggcaagagaccgagggcacgagctgttccagtataataaaatatataaaataagaagttatactagatataaatcttagatatgattatatatgactatcattaatcattagtttgtagcaattactctttattccaatattataataatcctcgctctacaatcataacctaggaaaaaccaggccatacagagataggagctgaggggacatagtaagaagtgaccagaagacgagtgcgagccttctgttatgcccagacagggccaccagagggctccttggtttagcagtaacgccagcatctgggaagacgcccattgctaagcggaccgtggtctagcggtagcgtcagtgtcaaggaaaaacacccactacttagcagaccaggaaagggagtctccctttccctgggagagtttagagaagactctactcctccacctcttgcggagggcctgacattagtcaggcccgcccgcagttatccggaggcctaaccgtctccctgtgatgctgtgcttcagtagtcatgctcctagtccgccttcatgttccatcctgtacacctggctctgccttttagatagcagtagcaaattagtgaaagtactaaaagtctctgataagcagaaataatggcgtaagctgtctctctctcctctctctctctctctgcctcggctgccaggcagggaagggcccccctgtccaatggacacgtgacccacatgaccttacctatcattggagatggctcacactccttaccctgcccctttatcttgtatccaataaatatcagtacagcctggcattcggggccactaccggtctctgcgtcttggtggtagtggtcccccgggcccagctgtcttttcttttatctctttgtctcatgtctttatttctacactctcttgtctccgcacatgggaagaaaacccaccgaccctgtggggctggaccctacatttctctcctgaatctgtattttgtgacagaggtgtagggaccaagggacaacttctcctttggtctctgaaggtacagtgaaaaattaactgacaaaaaccagattaacaggagaaaagacatacacatttataaatatgcatggagggaacaatcatagcatgattaccccatcacacaatgaggtacggatggttatacagtttttcttaggggaagggagatggataattttaggggaatagcaaataatttttaggggaattcaatgaacttgaagaacatacaatggtctgagatgaagtttgttgggtttgcagagcagacaatggcttgtgactaaagtctatccaattgtgttgacaggctttggtgtttcagctaacgttgcccaggctggtctcaaactcctggcctcaaataatcctctttggcttcccaaggtactggaattataggcaccaatgcacctggccagtgaccaactttaacagttagcatttgaactttggtagttagtactagaatgttaaatatcttaaagtgatttttctccaaaatttgaacttgatatcatctctatagtttaaaatccttcaaatagcttctcatagtatttcagatgagtaatacaatgttttaactgagtcagcctatttttctagctttatcttccaaccattgcccttgttcacaatttgaggagtggaaagatggggaaggggagggcaaagatgcgtcaatagtaggttgcatcactgcactgttccctcctctccctcctcctcggatagcatctaaaacaggtaagtatcagcatatcgactggaactctccaaattctacctctactcctttcaggaaagagacgttctccgcacacatatcagctctggagcttcttgttatgtgggatgattttagggggaaaagtgagtcctacttttccagggtttttttttttttttttttctctttaggggaagcttagtccattgtgtgagtctatagttattgggtaaactcaaatatccagatttatgtcaaatttccatatatattaaatggaaaaagtgcctcaaaatgttaccatactcaagctgtcctaattcctaacattgaaataaatcttatttttaaaaggtaatcctgttttaagtaaaatggatttcactttggacacaccttagtgtaaattcattgattcattaacaagccccagttacattcctaagaccacacggctttgtttctgcttccacctagttcccacacacaaggcaatcatcacaactcttattgtacccactaattttcaatggaagccaggagtggaagccaaagacacttctctccactgctcccacggagacataccatatgggcgtgtgtgtgacatgggtgattcaaaaaactgctgtgcccccaatctgatatgctttgccagaaaatgggtcccatttttataaatttctatttatgtgaataaaacctgagagaggggcacatggaattggggaatctgtgggttggggttggtgagaagatggggaaagggctttaacacagggtgttgctcaaatacattaagcctggacaggacatcgaagtaagggggattgatgaacgctggcacctgggaaaggagaggcacttagagagggtggtgcctgcagagagaaggcttttgcagaacatccaacattaactcagtccacttcacactttaaataagagccagtgttattcactcccaggggtgttcttagtctgaagagagcagttctgtgaacatagatgagggagaaaaagaaaaaaaccctgtatcttcctacattggaaaagggaggtccacaagctttaccaaagggaccagtggctcaaaagatagtttaagaatccctgagtcttagcgattttctcattattatgtacttacaatactatttttttcttatcaacaatctctctagagactttttcaatttattcttttaataacactttatatttttgtggctctctgtatatgtcttttgatatacttcttacaaagtctgttctggtttatagggactttgaaagaatgggctacctggagaaaaatatccgcagactaaggtacagctaaggacaagagccctaatttcagtttagaacattgtgatggacttgttgagagcatttatggtgcattcaaaatctgcaaaaaggccaggtgcagcggctcatgcctgtaatctgagtactttgggaggccaaggtgggaggattgcatgaggccaggaatttgagaccagcctgggcaacatagtgagaccatttctagaaaaaaaagaaaagaaagaaagaaggaaagaaagaatgaatctgcaaaatattttaccaacacacccaccagttttgcccaaatgccagagaagaaagaaaaagaaaagatgaaggcattataaacacgacggtgtgcagcattgctatcatttatctcaggctgctcaatactagcctcaattcatcttctcccaggaaggaatgtttgtaaattgcatcagaatggttctggactatcaggaatgctgggcggcctggacacctggaagcagttagagaagctctcatttgcaatgtcttgttggtttcttattcttgaatatattagccaagggggaaaatgcccagacatttgtgctcacagcagtacgtgatcacatctctttttgcatgaagtattttaagagggaagtgatttctttaagtgcctgattatatgaaagttgtgtatctgtcatcaagaggtcataactgagtgttgggttaactttctgctgcagttatttttaagcatttctactcgatattcttccagttgtgtagtttcacattttaatggaaacaacacagctcaaaacacatcaagaatattttaggccgggcgcggtggctcacgcttgtaatcccagcactttgggaggccgaggcaggcggatcctgaggtcaggagatcgagaccatcctggctaacacggtgaaaccctgtctctaataaaaaagtacaaaaaattagccgggtgtggtggtgggcacctgtagtcccagctgctcaggaggctgaggcaggagaatggcgtgaacccgggaggtggagcttgcggtgagccaagatcgtgccactgcactctagcctgggcaacagtgcaagactcggtctcaaaaaaaaaaaaaaaagaatattttagtgattagagagcaagtttagattatatttgtctatgcattttggaaatggtagaaaaaatgtttattctctgcaagactatttcatactctgtcaagaatgttcaagaaaaaaacagttttctttcgtttctaaataatcaaataattactgttcacttattttcttgtctaacgtaaaatatataaactggggtaaaaaatgtcagtgcaaaaggcttttagattgtctatcattttttaagttttcctaaacctttttatatcaaattaatacatatcctaagatataaattttacttgataatataagaaattttctttattgttcagattacttagtttattgctatctttatttattggcagatggctaaaatttgagaaatgtttaagaatttaaaacacctgtagatgagacatgattaaatttaactcctttaggctaagagaagcctattttctagattacctttccaaatacacttccccaggatcctagaacacaacttagtgacatttcagagagttaacaggaacattgagtaacattgttagaagtgtaaaaatcaatcaagaaatcactcactttgggttgtcaggttcaaaagatacgtgagttcagccaaagcctacttgtaagaagccagtagattgctctcttgcgagaagcatatgattcttttccaagaaaagttgaaatggtgtattaaattgctttattttttatttaaagtagatctcctccattaaggctcctttgagtaacattctaaaagtgaaaagaaagctttgtatcggagactattcttattaaaaagagtaatataaatattatatcccaaaattctagggttactgggatggggtggagataaggcctaggatatggaggcagttttcactggttacaactaatcaggctgggcttggtgattctgttgggcaattttgttttatgtatttttatagaccagaactaaacattttaggaggaggaggaggaagaagagaagataggagaatatcattagacaagcccagccacctaggtcaacatacaaactaattagagtagccaacttcctcaatcctacgctgtctttcaaaaagcattaaaatcttctcccccatccactcccatgaaaatattttgtcacctggtgaagcttccacatttttcagtgagaatctcctaaatgaagaagataaagtatttttttcagtcacttccagacgagaggattttattcagttttcttttctctttctttctttctcttttcttttttttttttttttttcccagggtctccctctgttgcccaggctggagtgcagtggtgcaatcatggctcactgcagcctcgacctcccaggctcaaatgatcctcccacctcagcctcccaagtagaggggactataggtgcatgccaccatgcctggctgatttttgtattttttttttttttgtagagacagggtttcaccatgttgcccaggcttttattttctgtggtttacatttcaaaaatgatagggtttgtaggggtggggaaggtgttttttaaatataaaatacatttttcaaaatcccctcccccccaccacataaaacaagataaaagacaagcatctctctactaactgactttagaacctgacatttccacattagttcaatctttggattaaggcaacaaagggatcctgtttcaatgtaattctactggtacttttatagatgtttatcagattggtccaaatgcctagtacggttcacatttgaaaagaaaaccaaggtacaactcaggtagggctgcttggtgagggctaccttagataaggcaccactgagagggtcccaggcaactatggaaagacgactggggagtccccaaagaggggtggcttgtgccttgttttcttttatagctttgacatttgtgtagtgccttgaaggactgagttatatgtgacagacttttctgcttttccctggaggctccaaaatagtcatctgagacggagtaaatggaaccagctgatatggatttataactcattacaaatctggcctgctactttttgcattattggatgtgtttcactaggtctgttttctggcagatgtctggcatgaaaggctgacttccatttttgccagcgttatttcctgccttcctttcgactacaggacttacaaacatctggcagagaaaaggcaaacacagttatgagtcacaatgtagaaagtcaacagtaggcccaactcatattcttgtgtatcctactttgtgtaataaggcgcattcaaaattctaaaaacccacactattttaaatcaaataatattctgccattgacttttggttttttaagatatatggtcctatacaacataaatcttgaagatttatgttcaaaacattatgaagatctatatatttaatagaaaaattaaactttataataaaataacagcaacaaaaggttaaaaatattttaaaaaacacaattgctataccaaatgaaaaagtggctattgtcagcgaagaataggaaagaacacatgttttttaaatgttctcaaagaacaatttttctcaatgtacaatttattgtcccagtttatttaaatattggcttttttcttatcttatcttatcttttcttttcttttttgagacgaagtcttggtcttgtcccccaggctgaagttcaatggcgcgatcttggctcactgcaacctccgcctcctgggttcaagcaattctccagcctcagcctcccgagtagttgggattataggcacctgccaccacgcccagctaatttttgtatttttaatagagatgaggtttcaccatgttggccaggctggtcttgaactcctgacgtcaggtgatccgcctgcctcggcctcctgaagtgctgggattacaggcgtaagccaccgcgcctggcctatggttggcttttttctaggcatctttaaactaaatttaataatggctgacaatagcacaaaaactccaaacccaaccaaacaacagacagacagactccacccccatttgagaatttgctctactgcaaagcactatgctaagagatctagacagattgttctgttttatccttacaacaatttactattattattgctggtgaaaatgtagaagacatacagaggtatgaatttgaagtactaatgagtcattctgcagtatttctcagtgaatattgctcagaccacctacaccagaatcatctgagacccttgttagatattcattttcttgggtccccaacactcagaaattctaattcagaggtttgaggtaggaatctggaatttacttaagaagcactttgagtgattctgatacacaataaagtttgagatcacttgtgaatattcattgttaatattaattgtatacttttttttttaaacggagccttgctctgtcatgcaggctgaagtgcagtggcacgatctcggctcactgcaacctccttctcccaggttcaagcaattctcctgccttagcctcccaagtagctgggattacaggcgtgtgccaccatacccagctaatttttgtatttttaatagagacggggttttgccatgttggctgggctggtctcgaactcctgacctcaggtgattcacccaccttggccccccaaagtgctgggattacaggcatgagccaccacactcggctaatgtatacatattttaacatagaaaagtataagtaaaatggcccatgcttcccctcttggcataaaaataaaaatgtgtattagacaattaaagtaaaacaaaaagttagaggtaaaggctccccctttgccacgcccttcatcctaacacacacacacacacacacacacacacacacacaaaatctccctcacccctaaataactgtgattaagtttcttgttaccccctaggaaaatgttagcatttacgtagatatactttgtatcaagtgaatcatactatgtttactgttgtgcatcttaaaacttactacatatgactcaagatctgtctatgtaggacatataaaaccctaactcattcatttaaactgctgcataatatttcattaaatctacgtactaaaatttaattatttcttactttcagtttttttttactattataaacagtgtttccatgaatatttatatagagctatagatatctctcttggttgtgctatcgctttaaaagtgtaaattgggtattataattacctaaatagagacatctatgtttactagaagcctagagccttcatttaaacttatttctgcaagaatggaaagaaaatttcttaccaaagttcatattaaagcagctaattagtgttttatttgagttggcttaattgtagaaacacagagaaccctatcatttatgaatttaagaggactacaaatgcaaaagaatgaataaaattaattggaataaggcaaaacggaagaaaatggagcaaatgtagcaaaactctaagagaaaaaggattagagaagattcagaaagtaaaatttaactgagaaagaggattattagaaggaagactataaaagcaactgtattaattcattttcatgctgctgataaagacatacccaagattgggcaatttacaaaagagaaaggtttcatggacttacagttcctcatggctggggaggcctcacaatcatggcagaaggcaaggaggagcaagtcacatcttacatggatggcagtaggcagagggagagcttgtgtgggggaattcccacttataaaatcatcagatctcagccaggcatggtggctcacgcctgtaatcccagcactttgagaggccgaggtgggcggatcatgaggtcaagagatcaagaccatcctgaccaacatggtgaaacctcgcctctactaaaaatacaaaaattagctgggtgtggtggctcacacctgtagtcccagctacttgggaggctgaggcaggagaatcacttgaaccttgggaggcggaggttgcagtgagccgagatcacaccactgcattgcatcctgggcaacagagcgagattccatctcaaaaaaaaaaaaaaaaaaaaacccatcagatctcaggagactttattcagtatcatgagaacagcaagggaaagacctgcccccaggattcaactacttcccactgggtccctcccacaacacatgggaattcaagatgagatctgggtggggacacagccaaactatatctgcaacacagtaatctgcagtgattatttcaaacataccaaagttattcagtgtatgcatttgttcatgcactaatttactcaatgaatatttatcattcggcactgtgctaagtttgaggatatagggaaggaaagacatatttcctaccggcaacgagcttactgttcatggaaatacagatgcaaaaaaaaaaaaaaaaatcaattgcttttaaaaagcagaaaaatagtgttcctgacaaagtctaagatgttttcaaagaagaggtttccaagttgcatctaaggtagaagtaacatgtgctgcgtcattgaggaatataagagcagagtgggttagaaacccacatgtagttcgtgttgccacagtggaaagcataaggtgagaactgcagcagtgagaggtgatgtcgctaaacaggagctgatgctagatagggacacagggccagatcctgaaaggtttcgtttgcatgctagaaaactgagatttttatcctgtgagcaatagggagcagccaagaattttgaatataaatttaacataatcagattcacgttgtaaaaagccctctggagactgggtggagttgaaataatctaggtcacagataatgagaacgtggtgatctccagtagttatggggctaggccaggaaatgagaggactcctaacaggcagactcacagcgtcttggccattgattggatggtgaagggaggtgggggaaataatttatgacattgccaacactggggaaatggatgtctgatagtatcattctttgaagtaggaattaatgaaaggggagcagatctttccaaaatctcttttagatgttctccaccatatcagaggcaacactcttacacacacaaaaaatcatcactttcccttgactaatctgaaaatttataggtaatataacctacttatatacatatttaaaaaactttaatacaatagctcaacagtaagataaagtataaataaaaggaaagtaattgaggacaaaatatattaatacataaatgttcaggcatgactacataaaggcataatgaagaagtcagatgtgtttgcctatatgtgaagtcattgttagtgtcccaaccacaggtgcaaatcaacacacctctgtaatgcatgtcataaagtcttggaaaagagctgtgttagttcattcttgtgttgcaataaagaaatacctgagaccgggtaatttataaagacaagaggtttattttggctaacagttctgcagcctttacaggaagcatggtgctggcatctgcttttggtgagggcctcgggaaccttccactcatggtggaaggcaaaggaaagctggcatgtcacatgtggagagagggaggaagagagagaagagggaggtcctagactcctttaaagaaccagatctcacatgaattaactgagtgagaattcactcatcacccagggaatggtactaagacattcatgagtgatttacccctatgatccaatacttcccaccaggtcccacttccaacactgaggatgaaatttcaacatgagatttggaggggacaaacatccaaaccatatcaagagcttgtcttggttgcagtattggagaaggctccataacactgttgacatttcagcttggcgtttcaagaaggaatataattttgaaaggcagaactagaggaagaagaaaggggtgttcccaatacagagaacagtacaaatggggagagaaaaaggaaaatactgggtgttctttggctttggctttggctacggcagaggttgcgtgtagctggtgtacgaagctggagagatgtgttcccgctagtacagggagggcttcgaaagtgtaccaatgagtttagactctaataatcccacgtgacctcttgctttggtaggttgtttgcattcatcatcatcaagaataattctattttcccatatatattgaactgattatctttaatctttccctgaccaaattatctcaaattctaaagtgatgacatacaaattaatgatattttgttttctaaattgataatgctgctttaaagagagtttgaaggtaatgactacatataaaaatagatttcatataaagtcaggcttgaaaggatcaaataaagtatttggtgctttttcttctggataataatctgtgaagaggacatttattatctctgctggtagtgatatcagagggagagtaaaaagcatgtagatgatagtgccaggctgagagaagagaatagattccactggacaacttcctaagggaaggtgcatgttaacattctatcatttaaatcacagaagttttcttttgaaagtataaagatgtattatataataatatttaacaatcctaagaggtttgttaattatccttgctgaaagacaacagagataagtttcgctcaagcaatattcttctgagaaaaatggacctctgtctctccctttcttattttgttttattttagcctgaagtgtcccattacgttttcaatgccttatatctaccttctcttcaactgtccatttggctaagaattcagcccacaggaatcaggaataggacatttaaaactacttcacgcattttaaatcttataaataattgagatacagttgatggttgctaggctgcagttgaattccatttcatcctatcccattataatgtaatttaggtttgtttagttgttgttttttttgcttctttttaatcctatagggaaaagtttttgatgattgaatgctgtatttgatagtacctattatcaggcaaggactttgagatatttcataccgtttcttttcatatcttcaaataaaagaatgtgtgaagttcccatgctagccacaccacggacaacgttaaggagaatgaaaatgagcagggcctgaaagttgctttctttggtcccaaagtgactcttctggacacccagaggtaagggcactaaactaagttacatcagtttatcaggtggaaatcaacaacaggtgaattaaacgtcaacagtgaaacaccattgcatcttgttctttagcccaggaactccagaaggattccatcttcagagggcaactctgattggtggttacgtgtctaaagcaggagtctgcaatccacagcaggcaactacagactaaagtctttggatcatatccagccagtcacttgttctataaacaaaactttattggaacacagccatggtcattcattccatattgtttatggccgttcttcccctgtaacagcacagttgggtagttgcaacaaagattgtgtggttttcaaagcctaaaatgtttactatctgactttttatattaagtgtttgctgtgaccccaggtctaaaatattaggttatacaggctgctgaggccccaactaatctcagaaaaaacacatgctatgattgatttttcttctgtttgccatgttcatggaggaggagtgccatgtatttatcagccctgctttttccccttccccaagtaagagctgcatgatggaacatagagatgtaaaagaatagatacagcatcaaaactaggaatgagtagacattgaatagtatttcaaaagagttggtggcagctatttgggaggctgaggcagaagtattacatgagcccaggagtttgggtctgcagtgaatcatgtcacactactgccctccagcctaggtggcagagagacagatcctgtctctaaaaaaaaaaaagaaaaaataaaagagttggtagcaaggatgcaggaagtgatgtcagggaaaagtgatgaattgtcactgggaatcattgaaaagctgtaaaaccaaacctatcattacaaatataagcatattaagtttagttttctgttctatggattgaattatatttattgggaatataaaaaattcggaagaaaactctatgactttaataaagggaaggaaagaaggcatagtggtaggaaagagctcaccttacctttaaaaagagtggctctctctttctctgtatcatctttcacatccatacacatatagtcacacattcaatccttctcattacacaaagctgtggatatcctgggaataatgacacttatttgcattgagatattggagccagaactggaatatatctagttatctagttatttgtttgaagtgagcttaaatacagtacttgtgaatgggaaaagggaatattttcatgactctgtagatcctacaggcatattcctatacctcagaaagtcagaatagaacctaagaaaagacaatctaaaagtgtcttaatatttttagaatatggcgttagggatgcttgttagttgaaatgcaaaaatctcaacttgtggaaagatacaaatgatccatcgattagaaaattaacaaaataagagcagttgggaagtcagcaatacgccttgaggaggaatccggctaaataaatttaatttctttctttggcaccctgacaaagaggaagcaatagatataatatctccagacttcagtaaggcttttgaaccatttcacatgacatttcttttcaacaagctggtaatacatagcttggatcatagtgctgtcaagtggctgaagagttgcaatcaaagagtagctatcagtgacttcttgtcatcctgagaacatttatcagggggtgtccatccataagggctggttgtgggccagagttatccacagggtgatgaaagtaagagcaagttcaataaatttgctgataacaccaatctggagcagctgcttacacctggcaagatgggaacagctttcaatgaccttgtttaagctgggctggtagagtgagacgatctcagagccaggatacctggccaagacacagtgggcagattttctatgcaggaagacttatggcatgttgcagtaaaactgggcagtgttttatttctaaaattttctgaagcactataattaattaacaattctctatgatgccaagtggtttagaattacttttattatactagtttcccaatttgcaaagtagagactcaaaaatcttgtctcataatattattttgaatgttaaataatctctggaaagtacctaacagatattgagtgctgaatgttagtttccttcctcttccctattttcccaccctgttctagtgggaccagcactgggaagaaaaagccctaactacaatacagaaattcaaaagaaaaaaagagacaaaaacaaaacaaaagaaacaaaaacattggcattgaaccttaaaccacactctggcatacctaaatattactgcttaattaataacagtttaaccgtcaagtagaatacgtttgaaaggatatttcaaatttatactagtggttataagattttctagaagttcaccttcagcaattatggaaggtggagaattattgctttttttacatggtagatcctaaaaaaggttagttcctgcatgatgggcactcaatagctacttgttttattgccctgtgtgttgtcagagaaatgtattaaaagtatcagcacttgataataactctaaagcaggtgctcttaactcccttgggaatttgatattccttgagaacaagaaacaaaagccagtgcaacatttagatcacagttttactcacaggtccttatctaagtctaggtagagaaaggcaagataagtcttaagttgttttcccattagtaaatgtgactggacagaccctggtacttggagcaggagagtgacaggttaagtaatgggaaagctggctgaggttcatggtcaatgtcttgcaaaaataaactaaaagatatcttagttgtaaataccttctgcccaaacaagatgatgtgaaaaggatcctgctccaaattccttaaactcaactgaggaaaatagagagccacagtcagagaacaaagtttctagcctattaacgctctctcccttcatcctcacgctcagcttattgcttttattacactgaaacccattgactaatcaaaagggagcttccaggctgggcgtggtggctcacgcctgtaatcccagcactttgggagaccaaggcgggtggatcacttgagctcagaagctggagaccagcctggccaacatggtgaaaccccctctctactaaaaacacaaaaattggccaggtatggtggcacgtgcctatggtccccaagatggagtttcgctctatcacccaggctgtagtgcaatcttggctcactgcaaactccacctccccatttcaagtgattctcctgcctcagcgtctggagtcactgggattacaggtgcctgccaccaggcctggctaatttttgtatttttagtagagatggggttttgccatattggccaggctggtctcaaactcctggcctccagtgatccacctgcttcagcctcccaaagaactgagggccaccatgtggggcctgagtttcctatatttttgtctacatttcctcttgtctgtgtcactctttaatgtactgtaattagtctttttttccctctgctatactcagactcctattagcaagatactaacaacctccacatggataacaccaatgattaattctcagtccttgttctaattcacctgcccatagatcacttccccttatttgaagcacttccttcttttttcctcctagaccccattttctcactggcagctcctcctcagtcttctttgcttgatgcttctcttcttgacctctaaacattggtacatcctaagattgtcctcagacgtctccttttcaatctctatgattaccctctgggggattttatccagtctcatgattttataaaccacctactcactgacaatttccaaatacatattatcagctcagatctcactcctgaattccatacctctctatctaactgccttcttaatatatccatttagatgtctaagtgacatgcaacataacatgtccagaactagatccttggcccatacccctaattgttctttcccagaattttccatctcaataaagtcaacttcattcttctagttgttcatgtcaaaaaacatggagttggcctggcgtggtggctcacgcctgcaatcctagcactttgggaggccgacgtgggtggatcatgaggtcaggagatcgagaccaccctggctgacacggtgaaaccccgtctctactaaaaataccaaaaacaaaaaaaattgccaggagtggtggcaggtgcctgtagtcccagctactcaggaggctgaggcaggagaatggcgtgaacctgggaggcggagcttgcagtgagccgagatcgcgccactgcactccagcctgggtgacagagcgagactctgtctcaaaaaaaaaaaaaaaaaaaaaagcatggagtcacccttgacttctctattttcagccatgtcggctctacctttgaaacatatccagcctgactactcccactatcatcatttcctggtagaattttgcagtagtcttccaccagtttctctctctaacccccgcaccaacctctccccagccctaacacacatactctagtttccagagtagcctaaggaaacctactaaaacttaagttaaattatgtaaagtttctgctcaaaacactccattttctttccatctcattcagaacaaaattctgtcttttccctgatgcacaaggccctgatccacacagcccagttctgggaacttatctctggcttcatctcgtaccactctctctcattctggtgtctccattctggtgtctccattcagaatggtgtctctcattctggtgccctccttgtattcctctaacatcctgtacacacttctgcctcaaaacccttgcccttgctactctgagtgtctggaactcttttcattcatcaatctgcatgacttcacttcatttaggtccctgctcagatgttacatactccaaacaccctacataaaattgctcagatctacgtcatctcatcattctccatcctaaggtagggtaactgctttagttttattcttagcacttatcaccatctgactaacatacgtttatttgcttgttgtctatcttcttccactaggatataaacttcatgaaagcagggatcgttgtctcttttattcactttatcatgtcagcacttattgaacagaataggtattcaaaaaattttttttggatatggaaggttgcataagtgctgcctattgcaactgcttagagctacaacctttgcttctggagactgagctggaactagtattacttgaattactttaaaataaatccaaaacacccaaatttatatctggaataatacagaatgaatgtgcaaagtaagtataaattcttgaccaagactttttttgtggatatgacttccaaagaacaaaaccaacaggatgtgtgtatgtatagagagatttattttaaggaattggttcatgaaattgtagaggcttgctgagtctgaaatctgcagtacagactggccagctggtgacttagaaaagggttacaatttgaatccaaaggcagtctctggcggaattcctttttgctcagggggtggtcagtctttattctcttaaggcttacaactgattacatgaggccctctcacactatggagagcaactacttcactcaaagtccaccgattgaaatgttaatctcatccaaaaaacacatccagagtaatgtttgatcaaatatctgggcaccatagctcaacaaagttgacacataaaatgagctattacatgtaggttgttacaaatatgtattttggatttgcctgacttgtctccttatttatctataagttccttgggtacactggtttgcaggagagtaggtgatcagtaaatatgtgacatattttcatatagcaagatcaagggaatataacgcatgataaccaaaaattattctcaccactaaaggtctccattatattttaaaaaatgctaaattgctcagttacttaattttctaaagtgggtcatatttgattatttataccctttaaataagctaggagatgagtatggaaggtcttccaataacacttttactggaggttgcctaacagaatttggggacttgcattggcaatggcctacaacattgatgttataaatgaattttcttggcaggggggaacatacaaagctataagtattgggcaaaagtctcaagcctcacagaaagtctacacagagtcttctacaaagagtcttgtgatcatggctgtattagtccgttttcatgctgctgataaagacataactgagactgggcaatttacaaaagaaagaggtttattggactcacagttccatgtggctggggaggtctcacaatcatagtagaaggtgaaagtcatgtctcacatatcagcagacaagagaagagagcttatgcagagaaacatcccattttaaaaccatcagatctcatgagactcattcactatcacgagaacagagcaggaaagacccacccccataattcaatcccctcccacctggctcctcccatggcatgaggaaattgtgggaattacaattcaagatgagatttgggtggagacacagccaaaccatatcaatggcaaaccatgaaagtttagcaactgttctgatcaataatacaaacatataggtttggagatcattgaaaaatatgtaaattcccataataaaaggaaatatgggatatatgtatttatttatatatgtgtctgtgtgtgtgggacatgtgcctttctattttattgaaaactgtgctcttgaatagtgaactttgatgccacatagtattttgcagctaatccctaaaaggtaagatgtcataggctagggtaatggtttatagtcacttatgtgccaacatagatttggaagccaataaatgcctggcagtaaatgactaactaaataaaaaattttaaaaccctcatgtgggaaaatctaatgccagcattttcccagcagttgatacagagtttccacaatggctgtcttttatcaaggaaaaagttgatactaaatattctgttttagtgtagattccacaagaactgtagaaatatggggtgaggaaaataccagcaataagaacatgattatcctaaaagactgacaccagtagctttaattttatatttctacttttcacttagatctctgataaattgtaaatcagatatcagctgaggtcaccctgtcctttcagatttaaatacagttggcttcagtctctttgtcttctgtcctgtgggatgcataatgctctccctgatattttcatgaagtttttcgagctcatgtttctatggacatatctgctcagagtctcccttctggtgacctcttagttcactttcatctgatgtcctggacaggattctctagagagacagaactaataggatatatacagatatttgagacatgatttgttagataaattggctcacacaactgtggagactgagaagttccatgatatactatctgcaatctggagaaccagggaagctggtaacatggctgagttcaagtctgaaggcctcagaaaccaggaaagccaatgatggaacctcctgtctgaggccagaagcctgagaatatggggactgctggtataagttctggaatccaaaggctagagaacctggagttctgatgtctaagggcaggagaagaagagtgtcccagctccaaaagagagacagaattcaatttctgttgcctttttgttctatccaggccctcagctgattggatggtacctgcccatactggatgaaagcagaacttccttacttagtccactgattcaaatgctaatctattccagagacaccctcacagacatgcccagaaataatgctttcttagctctctgggcatccctcaatccgaacaagttgacaactaaaattaaccctcacacccccaacccttaccactgctcttgtcttttctcagccgtgtgctgacccagacaaaatggactatagtcccctttccttctggggaaaatcatgcagataaagcatttgggtgtgtagcagattttataaaagatgtggggaaacagagtggttaaatcacagcaaggcaaacaacttaaatatacatggctggagccgtctgtcgtagctctttttcctttaggatccctcacccatggcgtggctcctttcccttctctgctttaactcaccaccaaattcctattatttcttataaagagtggtcttcttacggattataccctctgggcctcatcttccctctgaaagggatctttcaaagtatagacttaagccagtgacagcaacactgtcagctgttaaaatggtgttttcatctggtatctgaaaagtacattggaagtttctattccaaatctctctctctctctctgtctctctctcactctctgtttctttctctctcaacatggatcttcatgtaccaaaatactgaaatattttctgtaggttttttttttttgtttttttgttttgtttttgtttttttttttttttttgcatttcatcttttccctgataccataagcatccacttttgaagactgtccttttaaaaattctaccattggctgggtgtggtgcctcacgcctataatcctggcactttgggaggctgaagtgggaggattacttgaggccagaaatttgagaccagcttgggcaacatagtgaggacttgtctctactaaaaataaaaataaaaatattagctgggtgtgatggtgtgcacctgaagtcccagctactcaggagagtgaggcaggaggatcccttgatcttgggaggttgaggctgcagtgagccactatcatgccactgactccagcctgggcaacagtgagaccctgtttaaaaaaaaaaaaatataccataatatttttatgcatttaaatggatcattgtgtaggttatttgtaataagaagcaattagtgtgtctaagtagatttatagatagacttatatttccaaaatattccaaaatattgttaaaaatgttctgcttacattacttaaattattatatatccagaaaattagaaagtaaagtctcaggtatgttggaaaattccagaggcatcaaagtttaaattaaaggtgcttcagttggaatgtccctcagtaggtgaggactatttgggtagcttcaacaacatcactaacaattagttattggtaaacccaaagacctcaattaaatagttgtttgaaataactcttttttgttggagcaaaaagtacatttcacttggtggaacatttgtatccagatggagctatcagatctcagagaattcatttcctttattttggcaaagattcctctaagtgtttactgtgtgacaaacactgtgttaagctatacatgaattaaataatttagtcctcctcatgactccacgaggtagctatttttatctccatttcacatacgagaatactgaggtttaaggttagctaactcatccaagatcacaagatgttggcacacccaggtgtatcagatagggcctggcaagaaacagttggcacacttcaacagggtacctgaggagagtttaatgaaggaagtacttatcaaggaataagtagcatcagccaggaatggtgaaacacacaagggctagcagcaggtctccaggggcacagggaggagcacttactggaacttggaaagacctgcagccacgggagaggagataccctgcagaagctgtagtcgtctttttttgtttgtttgtttgtttgtttgagacagagtcttactctgtcacccaggctggagtgtagtggcgcgacctcggctcactgcaacctccctctcttggataccagtgattctcctgcctcagcctccagagaagataggattataggcatgcgccacccacttggctaatttttgtatttttagtagagatgggatctcgccatgttggccaggctgctctcaagctcctgatctcaagtgatccaccctccttggcttcccaaagtgttgggattacaggcatgagccactgcgcctggcagaagctgtagtcttaggtagagcaaagctgatagtgccatactatggcccaaagagaactgacagattacattgctgagcaatttctcatcacatcttttcttctcctgctagtggctcctattgaccaaactcaatgagaaggcagagggcaaagaagcctgactgatctactctgtaaaggtgagcctccctgggcagagtaggacaaagaagtttggagagtgggtctggaggagaaacagaccattcagcataccaggtgcatctgaatccagagcctaagcccttgaccaccacactatcctcttgccttggtaggtgtgttgataatttccacagaagggggatgctgtataaacatgatacagtggaaggaatactagagtaggggtcaggaaaatcaaatactgtgaagtgtggaagtgcctggcacagagtagaaacttaatcaatgtaaatccctcatcccctcccattgtgcatcatgagcttcccaacacagcccataaaatctccaagttgtaatgctgaaagaagggccacaaccttgtcaatgacgcaaaagagctttcatcagactgtgcataatttagaatgtgaatctctgagaaatgagagctgatgagagcagactttagtaatcccctaaactctcaatcatctgtgttttggtaaaacaggagcactagcagatcatattctgctgtataccacaagtctggcacacttctgtgtagtggcctgtggtgggcagaataatggcctcctaaagaggcccatatctgaatcgctggagcctgtgaatatgttaccttacacagtcaaagaaaggctacagatttgattaaggttaagggccttgagatggggcaagattatgctggtttacccatgtgaatccaatctacctacatgagtctttaaaagcagagaaccattctcagctgtagaaagccagaaatatagcagcgtggaagcagattttgaagatggagaaaggccatgagccaggaaatacaagtagcctctagaaggtggaacaggcaaggaaacagcttctgcaccagaacctctgggaaagaatgcagtcctgccaacatctttcttccacaccagtgacacctatgctggatatttgacctacagaactgtaagaaaataaatttatgtgagttttgttttttgttttgttttgttttggagacagggtttccctctgtcacccaggctggagtacagaggtgcaatcacagctcattgcagcctcaaccttcccaggctcaggtgatcctcccacctcaacctcctgaggagctgggactattggcatgcaccaccacacctggataatttttgtattttttgtagagaatgggggtctcaccgtgttgcccaggttggtcttgaactcttgagatcaagcgatcctcccaactcaacctcacaaagtgctgggattacaggccgggcacggtggctcacacctgtaatcccaggactttgggaggccgaggcgggtggatcacctgaggtcaggagtttgagatcagcctggccaacatggcgaaaccccgtctctactaaaaatacaaagagttagtcaggcatgatggcgggctcctgtaatctcagctacttaggaggctgaggcaggagaatcgctttaactcaggaggtggagattgcagtaagccgagatcacgccactgcattccagcctgggtgagagagcgggactccgtctaaaaaaaaagtgctgggattacaggcgtgagccactgcacttggccttgtgttattttaagctactgaaattgtggttacagtagcaatggaaaatgaatgcaagcctcttcatctttttgtttcagggcaagagcacctcagtatgtaaatttcttgatatatgatgactgacactgaagtgttcaacaggctccaaacatcaatctttaagcattgaatctattcaagttctagcatagaagttttttattcaattgcataccagcgttacttgagagtagactgatgcttcacattgttgttgttgtttttattttttttaaataactctgcctcttcactagaaaaaggttttgttttggatatcattaaaacagtcaggggagcatagcccttgaaaagatctcagaactagtaacctacctcctgaccgtgcctaagtagaggaaccaaaagttttttttttttttgggggggcggggggtggggacggggtttcgctcttattgcccaggctagagtgcaatggtgcaatcttggctcaccgcaacctccgcctcccaggttcaagcaattcttctgcctcagcctcccaagtagctgggattacaaacatgtgccaccatgcctggctaatttgttttttttgttttttttttctgttttttgttcttatttttaatagagacggggtttctccatgttggtcagactggtctcaaactcccaacctcaggtgatctgcccacctctgcctcccaaagttctgggattacaggcatgagccactgcacccggccccaaaagtttttgaaaaccttcacgtcaaccacagagccttcagtatactgtatgttattttgtacccaacccatggttctggtcgcacacaaaaatgtctgtgagattcctggtcaactggtattcaccatggagttcataaagggctgatgttcctcaaataccagatgagtctaagtaagtactactttatgtagccatacatgaagtggaaattgagtttaagcccaagctacctgtgcctgaggggaacaaataattagaggggtttagagaagaccaagttatgcaggtgtttactgtaattctctcattatgtatatgtgaaggtagcccttagaccctcaagtgtattgggaggtattaataataaccacaaagatggtcctgtgctatggcaaatgcagaactttcaaagtactattcagcctggagaagaaagctcatttccagatccttccttctgtttttcaagtgacatcacataggaggatgagaatttgtctttgtattaagcttcctttgtcatgtctacttcagacatgatctctgagtttgaagtcccaggattttagatgaaaagaatctttgagttaagggagggagggggccactgcatgagaatgcctgtttctaatctcagagtacccacatgctgaatggctgattagacaaaagccacagaggggaaaatcagctactctgggttaggggattcaaatttcattgtggtggacacctatttatcttttattgtagtcaatttcccaagggagaaagggcaaatgtgtccctcctatgccaacattgtagcacccccaacggagcagacctcaggagtatcctacacagaagaaaggagcagtgaaacctatgacaactgatttttctctgaaaacaatgttatgtgtatatttcatttcttcatctctccaaaaacttttgtaacaagtatgttttttgcaactgtggcaggtatactagagaccagctcctataacctaatgatcatgccaagtatttctgttatatctcttaaaaatggcttttcttctcatctcccaaaacaatttttttttttaaacacagggccttgcctgttgatgattttctcacacttttgtcaagtatacttttttttcaactcaatgtctaatatcacaaaaacctggcactttaaacttcagtttctaccaaaggtataatgctttttaaaaagaattctgcctagtgttcctccagtgtagcaattagcattctcttagcggcaaacatcaaaatatccaaataaaatggtttcagtaatagggatggttattgtctctcataacaggaaatctggagggagctgactccaggtggattgagaggttcagccacgcctgcagtcttatccatccttttgctccactatcctctatatatttgttttcaatagctctaggtatccgctccttacacaaccaagttccacttctgcatgtgtttctcctattaggaggaaagaaaactatttcccagctggttccagcagagaagtctccttttaagtcttttgccaaaataagtctctaaaccagccccaggaaagacgatgagattgccttgtttgctttagattgatcttgattagtctactgagcctgagcacgattttcttaagcatctcattcccaacaggaaagcaacaaaatcggcattctattaataagacaaagaagagaatggctcttgtgtggacaatcaacaatgtcttccacatcacagaactctttagtatgcattagaaaaacctagggtggtggttacaagagcagattccaggtgtcaaagagattttgattacagatgaggtccaggagggtgtattttcaacaagaacccagatgtcttggatctagtcatccaccagccaaagtttaagacactgccctacagaaatgagaacaaactttccttaaaaaaaaaaaaactttggccggaagtgttggctcacacctgtaatcctagcactttgggaggctgagacaggtggatcacctgaggtcgggattttgagaccggcttggtcaacatggtgaaaccccgtccctactaaaaatacaaaaataagctgggtgtggtggcgggtgtctgtaatcccagctactcaggaggctgaggcaggagaattgcttgaacccagggggcggaggttgcagtgagctgagattgcaccactgcactccagcctaggcaaaaagagtaaaacttcatctcaaaaaaaaaaaatcttgttaatacatcaataaatattcacttttagtacctggatgttactgatccacacaagtacatctactgttagaaagtaaccattcttaagcaaaacaaaggacgtctgcctgcatagggtgatcagaataatgtccaaatgcacaaatgataatgagatgatgcagataaagtgcttagcatagtagactatgaatgtgccaatggaaaattataattttttaacctgtcgagttttgttgctactagatctttgcatcattatttcctgctcaatagttgtctttgttcaaagtgtcagtttcatagaacataccactacttgaaatcttctttatttgttcttttagtctgtcatcctcactaattatcacctccacaaggaagggctatgtcttgttcatccctattgcctaattctcaagtcctgaaattttaagcatttaagcagctgttttcaaatttctaaataagacacctttccatgtagatatgatctaaactatgacatacaactaaattgtaagaaaaatgtcaaaacatggtttcttttatcaatagtttactataggaagttaagagtaaaagtgaacaatctatgatagtgaattaataatgactttaggaaaaactaatagtacccaagtaaatcttccctttgacaacttaattctgaaaattatgtatgactttgaaaaattgaataaatcagcaatttccagaaactactgacaattagtatggttgcaacttgattccccaatccagggtgtgcctaggaaataattagtagaactggcctttaggtattcttttttttttttttttgagacggagtcttgttctgttgcccaggctggagtgcagcggcgtgatctcagctcactacaaccttcacctcccaggttcaagcgattctcctgtctcagactcccgagtagctgggattataggcacacaccaccatgcctgactaggttttttgtatttttagtagagatggggtatcaccatgtcggccagtctggtctcaaactcctgacctcaggtgacccaactgcctcagcttcccaaagtgctgggattccaggcgtgagccaccacgcctggccagcctttaggtattctaatgtgcattccttctgaaaggagtttatcactatgttgaaatttctgtgttctaaacccacgttatctgataaaactttctgtaatgatgaaaatattctacatctgcactgtttagtaaagtattacccactaactgtatgtggctactaggtacttgaaatagtatgactgagaaaccgaatttttaatttagtagccacacatggctagtggcttccacattgtagagtgatgttctggacagttttttgtaagtaggcacaatgtatagcaacacgttcctagagctttaaattttgaaaatggattttcccaccatcgcttatttcctatgactccaatttcccctttttacttttattcccttgtcagtgaactgcttagctgctggctcca

SEQ ID NO: 859 - DNA, 331116 bp, Homo sapiens
aatgtcactgaaagaagccttaacatcctcttctccttcattactacattactacagccacccattgtggcagttagacaaacgaagccagcatttggagagagggagtaggactgagaaattggccaagaaaaaaaaaatgtatttagttcatggaaaggaaacttgaagggaaatccatgattcttagaagtggaagagtttagggaggaatgtttgggaaaaccgtagtgctgacaatgactttgcttaagggtagcaagagtgaagaggaaagacaggtcagtagagttcagaatgactataagcccggggctttaaaaatttcacaaataagaaaggttgcaggcactgagagcaaaaagaaaactggatgaagtgttgccatagaggaaagaaatccagagtgaaatctctagctcagctatgacaatgtactctgtgagcaatgaaagttcaaggggtttttggaatactacaaaactatccatctttatggtggacaaaaagttgcaaatacaggaaaacacactcactctaccaggcattggagaaagtagaacaaaatgcagatctggccacctaggagctcaaatctaatgaaaagggagaaatgcaaattaatatgtgccatcagtgaaacaaggactgatgaggctgtttgtctacagccatgagccacagggtggagtgactgtgctgagggtaaggaagagcttctcagatgaatgagaggatcatggagaatggaaaggagtttgcaccgacagcatcacataataaaggccttgcaaagagaggatatagcttaccctatgacatgaaacagtgtggcatatgaggaggaaatgaaggaacacaaggcaggaaaggccatcaggatgcaattacagagggcttttagtacaatgtaacagcctaacaaacgacctcaaaatcgtatgatcatctaagcaggacaccctgtgaggaaaacaaaaacaaaaataatcagaaatcatcatttacaaaataattagcaatgtttccttgggaaagacctgattgaacagagaaaagcctttaaaatgatcagaaaatgaagggaagaggcaacactaaagttttcaagtttggactgaagtctatgaaatcatgatatcattaagggcgtattctctaaatttcagaacactagcttaaaggggaatcattgaaacttaagggagaaaaaaagcaattcagaatcatacaagaattacataaatgctcatgcaattcaattttcagtgctaagaacagacttccccaaagcagtattcccctggtcaaatcctctagaccctcaccaatcagaattcatttctccctcctcaagacttccacagcatatgatagcacttaacacagtctttcttgtgtctctccaactgtaagtcaatttcctgaggctagagaccacacttaattcatatttgtatacccaacagtatctagattcaataaatgcatatttatgtactgcaaaatattcacagggatactattaaatacaaagtaatgtgcttaatacttctgcatgataaagaatgagagacaacaataaccctgaaagtcctcatatctggtaggggggttatgtatgaaaaccagtcactataatccaaaaccaaggaagaaggttcaatcaaagcttacacttgtaggttgttatgttgtttttcattcattacctacaggattccaaaaggatttttgatagcttacagaagtacatacagtataacactaaaaagactaattattgagaaggcacacataaagaaaaaataataagagaagaagatggagtcaggacagttcacgaaaagtttaacagaagtacagttagagatgcacttggcatcaaaaccaacagttagaagattctcagcaacagttgctcaggagaagtttagctattcctgacactgggacaggacagttaagaactttctcctatggttgttcataagacaaagactatgtaatatatggaccatctccttaagcattccaccacgatcaacgcaataatgacttaactgagattgcgtattaatgaccctcaatctgtcaatgattacaccacactaccactcagtaaaagcaattctcaaagggccaaaactctacgatgatgtggcttgaattaaaagaaaaggtctactccctagcagaatgaacggattacatattcctcagaaatattatgcaaatattatcatagagaccgttttgataaggacaaagtggcatagagtttgagattgtggtctccgagaaaaaacaggaatataaatattctctgttgtcaattaagggcatattgaacttagagaattagcagattaacaaccaggtttgcattacttcatgaaaacaaaacagcagcatgtggagagtaccccactcctaagcaaaggaaggccatgatttctctcagaaaatggtcatggatcctctttaacacacccatcagtgggtgactgaggtcccagagatgtagagcctagtcagaatgatttagggatacacactttccaaggcaggcattcccaatcaccatgctgtaaaagaaaacatttgataagacacccttagaataattcaaattaggcaatgtttcaagataaactggctgcaaaatgtgctctccctagagaagtgagatgacttgctccatggggttgttactatgaaccataaaatatcagaggatctctgcaattgattttagagaaggtgctatgaaaccattcttacagccaataattagatatcagaaacaatgttctttaaagcccacctcaatcctgtctgtggtaataaattaatgataccagcataagaaacaaccttacttttctctacatgggaagaaaaataagaaggagcatatatcctgctcacttaagtgtgccaagccattacgatacaaaatgaatctctaaacgtacatattcctgctttacctgctcagaagtatttactaagcaatcaggaaaacatctgcaaaccctgattttgactgtggtattaagcatcataactgctacgtaaagccaccataaaggcttttgtattaaacaccataactgatttgtaaaggcaccatggatggagggcaaaggatggcactaatatcatggatacagatgtaacttacagtcttttgttccacaaaatcaagaatccacaccaaaaaaaaaaaataaacaaacaaaatatactttaaattggcaatatttttctcaaggtattgagtatgaaaatggctacgtcggcttgctagttttgttcaaagttgttatgaaattaaaaactgccatacattctgattcgggcccagagttggagggaattgatgattatccaataaaaaatgtatataagtctaattacagagaactagaaatgtaaagccaaaaagacagccctttgaaatagccctcaagcagtttcacagacaggagaacttccacggactcccttctgcatgatggatagttggaccaacagaaagaaatattggagtctataaagtttgcagcatttaatcttgcttcataaagctggaaaatataatctatccaaattccaatcaaagagaatctgggtttccataagctcaataatgaaatgccttgcataggtaaacatcaaaaattaccaacattacatttctaagagtcacatgacgattctcttgtaatttattacagattttttttggctggttttcgttcttactgttgtttccaatgcactaagatatatgttaaacaatgtgctatgagagtttcaaagacagcagagatcacattcaattgtagatatgcagccataagcaggaataaagatgtggtcaaagggaagagatattctatgaaagaaattcgtatttggtggatttaggttatttgttaataaaattaactcaagatggattaaagacttaaacctaagacctaaaaccataaaaaccctagaagaaaatctaggcaatgccattcaggacacaggaatgggaaaagacttcatgactaaaacaccaaaagcaatggcaacaaaagccaaaactggcaaatgggatctgattaaactaaagagcttctgcacagaaaaagaatgaacaggcaacctacagaatgggagaaaaattttgcaatctatccatctgacaaagggctaatatccagaatctacaaagaacttaaacaaatttaccagaaaaaacaaccccatcaaaaagtgggcgaagggtatgaacagacacttctcaaaagaagacatttatgcagccaacaaacatgaaaaaaagttcatcatcactggtcgttagagaaatgaaaatgaaaaccacaatgagataccatctcactccagttagaatggcaatcaataaaaagtcaggaaacaacagatgctggagaggatgtggagaaataggaacgcttttacactgttggtgggagtgtaaattagttcaactattgtggaacacagtgtggcgactcctcaaagatgtagaaccagaaataccatttgacccagccatcccattactaggcatatacccaaaagattgtaaatcattctactagaaagacacaggcacacatatgtttattgcggcactgttgacaatagcaaagacttggaaccaacccaaatgcccatcaatgatagactggataaagaaaatgtggcacatatacaccatgaaatactatgcagccataaaaaaggatgagttcgtgtcctttgcaaggacatggatgacactggaaaccatcattctcagcaaactaacacaacaacagaaaaccaaacaccacatgttctcactcataagtgggagctgatcaatgagaacacatggacacaggaaggggaacatcacacatgggggcttgtcagggggttggggggctagggaagggacagcattaggataaatacctaatgtagatgatgggttgatgtgtgcaacaaaccaccatggtatgtgtacacctaggtaacaaacctgcacattctgcatatgtaccccagaacttaaagtataattaaaaaaaaaaaaagcctggaaagacaagttggtggcaaattctgaatgatcttgaatgctatggtaagatttagtgcttaatttgtaaggtaatcgttatcatgatgaactgaacctggacctgaaattataatgagcaaattatctcaagttattctttctgtcgcttcaaagggatatataaatcaaaaggccaattctgaaaattttaggaaagagatccaagctattttgtagacccagaaataaactttatacctactgttctattttgttttgttttgttttgttttttaagatggagtctcactctgccacccaggctggagtgcagtggcgcgatctcggctctgcctccccagctcaaacttttctccagcctcagtatacctactgttcttatgcttggttgttgtgttttaagccttctgtgacctcacggaaattttgatgttgacacagctccaggttttacataaatttaaaggccatttgaattggaatttgattaatgaacataaaacctagtagtgaagttaacactctcttaacatccccaccacaaaagcaaagccttgaattgagtctcactctattcaaatcactcacattcttattgcaaatttcaaacctacttattatctggtagtgtcttctccccagtctgccactgcacatagaaaagaaggacatagtttaattgcttcccatgctcacagcagtaagtccacatcattcttaattttgttttataagagtttttcttcaaatacaaacatcatgctattgatccaccattaggtatcatgtgcattaagtggatttcctgggagtggggctgttgaatcctttcatactccattgcctatcaccctttacaaaaatccctcactgtgcaacacataatatgaggaataagaaaaattaggagaaatattctaaatatatagaagaaggtaaatagactgcctatatacttggtaaattctgatcatatttgtatattcgttggaatgttttaaatgccttcagatgtaattttaaaatataatctgtgtttatttaagcatgattgacttctttttaaaaaaaaaaaaaatgaatgatttaaatcctacagaccctacttatgtcagaggtcagcaaccttgtagaagtagtgtgtgccaagctgccagttcctatttctgtcaagcaagggagaaaagaagcagaagcccaaaataggcaactgagaaatatctgtgatacacagatatgtgaggcctttctgatgaatctattgcaaattgaacttttgaccctgtataaatcccctttttgtgcttcatgttttctgattgcacttatcactatttaatactctgtctctctttctctctctctctcactatatatatatatacaaacacacacacacacacacacacacacacacatatatatatatctaattttctatccacctcccaactagaatgcaagctccaaaacagtagagatttttgtctgctttatattcactatacctagaataatgcctggcacctagcaggatttctgtaaatatttgtgggaggaaagaaggaagtgtgttcaaataaagatcctatagaagttcttcatgtgcatttcataccttactatgtgactttaattagaaaccactccctcccttaaaatccaaatgaggccagctgcttaagaaatggatatcatttctagataaaaagaggcagtggaaagacacagatagtatcttgcaatttggggtgattcaatcagaaaagatcttttgagggaaaaaaaaagttcaacaagaaacaccaagaagcctttgcagaagaccagtggttgcagcagcagctcccatcatctaaatgtcttctttttcaaagggcagggccctcctgggcgatggcccacaaacatctcacagagtccctaaggagttctaccaaactgaatgagtctcctaattacaacattaaaatacctaccatccagtcttacttttgacagatgtccttgtacttttacagagcttagagtgaaagcatctaaaaaaatgtttacctttaacctggtataaggagtaatgtaccttttttcttccttcagtttaaaatccattccaccaaaacctggccgtctacacacaaaatataatgatggttatcaggggccacaggaaaaggatgagaaaaatggtgattaaagggtacaaaatttcagttagagggaataagccttagtgatctgatgcaaaatggtgactataataaataataatgcattgcatatttcaaaattactaaaaaggtagatttcaaatgttttcaccacaaaaaaatgacaagtatattagaggaaggatttgttaattaacagatttaatcattccacattgtaaacatgtatcaaaacataatattgtacccataaatatgtacagttatctgtccattgaaaataaaactaaaacaaaacaaaaaggctttgctaaaggaatctccacaagcttccaaggatatttgaaaagttctacctaaatcactactgtggtgatttaagctctttcttgcctgtccccctgcagtgaagaaagaacagctgctcatcatcactcatataatatctcttcacacacagtgaaaccaagaaaacaaccatattcaaaaatgcctgtcaaaagacaatcgtcctgggaaccactcatggcctctgtgtctatgatttcactgaacttgaagactgtaattaagtccctattcagacttcacttctctaggctaaataaacccaatcctttagactttcatcacatagcagatttctcaaaccttttaataatttctgttggattcctctggattctctccaaattctacataataaaatcatgaccagggcttcaggagaaaaagggaattgcctggcagcctcttaatgttatcctcttacatttgtacagtttgtttttcctccctatgtgaattaccctgcacacatttctacagagctatattcagtagatgtaaatgtactcagtttacatgtactagttcttccaacttgccatgattttttttttgaagtgtaatcctctttttgttttccagagtactggcatcctagcctggttcaaagaaattgacatattatgtgtcactaatgaaaaggaaaaacatcaggctaaagactgtcatctagagagtattattcagaatctacttccacaaacttcccagggtgggccaggtgggtttagatttcaactctgccatttactagtttcaggactgtggcaaatattgaacattttttggagaataataatgcctacttcccagggttatcatgaaaaatgaattgagttaataatggaaagaatatggcagagtgatacgtgctctgcataatactatatatattcattattttatcttctttatggaacaaccattataaccactttgaactactttcacagcacaatggtaaaggccaagagagctcattcctctatagaatgaaactcaatatgaaggatgaaaggctggtcaaaataataagtcaaaagacttaactcttagcatatacctcaccatcctgcttttcagtcagagcagcagcaaggacatgagatataagcaatggtgtacacctaagaagtgcagggaaactcaaaaaatgataacccagtatgagcaaaataaacttagaaaccaaacccctgaattcggctctttccccagtgtattgattgagcattagaccaaaagactgatcaggtataaatttagtattttattttagaaaagaatagcttactgctccaaagataatcaaaatattaatccttttcactttttgtgagagcaatttttgattctaatgtttttaaaaggcatataggtttcaatataaagaagctacatattatttcaaatgaaaaacaagatgaaaatcctaagtagaacagggcaaaaaattaataatgtatttttttcaacgactttcctgacatttgacctcttggtggggagtctacgcagctagcaaaccaaatacgtacctccttcacaaaactactataaaaatataactactgtttgacaaagcacttacggatatgcttcaaaattgctgattgacaaggatataatattatctgtagttttaaaatatttttaacaatgtggttcaaaaaactttccatgtattagattctatgtaatgtaatcttagcagagagaagtcacattcacaacgtgaataaataagaggagagctaacatgcaatttcttccatacaccaggtgctctgctaaacaccttatacaccttatctcatttaatcctcagaacactttaccacaagtgaatggggaaattgaagcttagagaaggtaaataactgttcagtgtaacaaattaagaatgatactcaggaatacataaatcaagatatagatttcaacccaaccctattctgatcatgcaatcaagttagtaggtcatcactagcatttattttaataggatattaatagaacagagaaagaccataaatagtaaaacagaataaacttctttgaaagtcactgctctaaaccactgctatattagaagcaactaaacatcaaagaaacattaatcttaaaagcattcaagaatattcagagatcatttacccttaccatttcactttacagatgaagaaacttaaagtttgggttattttctttacccatagtcatatggctagttggtggcaaaatcagaacaagagcccagggctaacaaaagtatattgatttgagagatgtattataaggcataatttactttgagttaaacagatttttctcaataattacaccaggaacatgggcataaacctaaactgtctcaggaaaaccagaatgagcagtatatagctctagaaattaaccaaaacttgtcaaacaaaagtaaacatggtgagaaaaatgatcgttcaatggaagttttttcaaaacaatgtagttttaatttacatacagagctataagtaaaaataacccttatatctaggctgtaattctttttccgtgttttaatgtttacataatttaaacacgaatctatcagtgaaacaagaagaaaagattataaattttgagcaaccgtggcaacaaaaccatcaggaccttgtcaatgactcacaatgatttcctagtattttccagtgttgataccaaaactggcaaggacagattcaaactaaattgctgatactgtgaaataatgctcaccagatgcaagcgccatgtaatgcaagtgacagtttctataaatataattcataactaatattaattttcaaaggacttagcaaaaactaaaaaaagaaatattttattttcatatgtaattttctcagtcagtatttcagagtgaagattagtatgggtatttcttaccccagctaagtataatgtagcaataaatggacttttcaataactgagaagaaaactaatattttagcctatgaaatcattatgtaaatttaactggcttatactgcagcccttatgacttgaaacatctgttcgatacaagttttctgataatatgtgaagtttcaaactgcatattacagcattttgcagcatatttgtaacatgatggttttgtcctttactagataggagactttcaaggtgtgacctgtaacaaggtactgaagttactacttacttcaccatctgctcatatgtattttcatctaaaattacatagcattcataactatattagaaaactgtcttcacacaatttggcacttaattttatgtgttgatatattgcctgaggtccccaatgcagtatcatgataaacaaggaccacagataagaaccaaaaaggagataaaagggtggtaagttggcaaaacacatatgacaaagcttaagtactgaaattgtggtacagccctaaagccttcacacatagactgtatactcatagtttagacacaagttgaacagattaagagtgcaggtttccctttccacaaaagattagaataagtaaaatggaaaagagtcacaagactgtcacagagaagcatgcagcaaacaatacacatgaaatatgaattgggaagccagtgaaaaagaaggagaaatcttattatacggttattcataagaagtccaaataaagccaacaaaactctctggctgttctagcaggcgtataaatgtgtgcaaccattgtactaccattttacatacacaagtaaaatttatatatatataaaaccacctagagatacttttccacatatcacatggagctatgtataatgaaattttgtcagtgttatttatgatagtaatccaaagtaacaatcacttggaggttcgataataaaaatgtggcatatcaacaaaaattaactctaaatggattttatacccaaatataaaacctaccactataaaactttcggaacacatagaagaaaattttcatgaattctgagtaggaaaggatttattagaaagaatgttaaaaaaaaaaaaaaaagcactaaaaatgaaagaaacaaattgctacactgaaattcataaaaatgaaaagcttctactcttaaaaatacatcatttaaaaatgaaaaaggccatctatataataggagaaaatatttgcaataagtatatctgacaagggagtaatatcaagatgtgaagaactcataactttataagaccaataaaccatcgttaaaatgggcaaaataatctgaacagatacttcacaaaagaagatggtcaataagcatttgaaaagatgctcacatcctaattcatctgaaaagcaaaaactgaaaccacagtgaaataccaatacatgaaattaaaacgactaaagttaaaaactgataatactagacacaaacagacatttcgccagagaggatataaaaatggcaaataagcacacacaaagatgttcaacatcactagataattaggaaatcgaaattaaaactaaaatgaggtatctttacacaactgttagaatagctttaaaaaatggtaatcccaatgctggtaaggatatgaagaaattatataaatcatacatttgctggtaggaatataaaatggtacagccaccccagagaatagttagaaattttctttaaaaaaaaatagaaaacaaaatttaacatacacttagtacacacttagcactcacaatactaggcatttatcccagagaaatgggaactgtccacaagaaagcatgcccatagatattcataacagactttttttgtaataatcaaaagttaaaaacaatccaaatgtcttttactggctgaatggttaaataaactgtgttatagccatactactcagcaatgaaatgcaaaaaactagaactctcaatacatgtaacacaacaccttggatggatatcaaaggcattgcactgagtgaaaaagccaacttcaaaaggttatattctatatgatttcacttatataatattctctaaatggcaaaattatggagatgaagaacagattagtggttgccaagggcccacaaaagtggagaggaaatggagaaaagggagccaaaagggatgcataagaatataaagggctagaatgaggaatctttgggataacaggaaagttctgcatcttgattatggtggtgtttgcatgaatctacaaatgtgacaaattccataggactatatatacatgtacactgaaatgaatccatataaaactagtgaaatctgaataaggtctgtggattgtaccaacatctcttccctgcttttgatacagttctaaaattacacaagatgttatcactggagaaaactgggtaaaagaaacacaggacctttcagcattatttttgcaactatgactctatttcaaaataaaaagcttaaaaataaaagactgacaatattccaagtgttgtcaagaatgtgaaggaactcaaactcttatttgttactggtgagactgtcacacaatcactttataaaacattttggcagttttagaaataaagttattatatacttatcacaagactcaggaattccattcctacgtatttaccaagagaaaagaaaacatgacaacacaatgacttgtgcataaatgtatataccagctttaatgatactagtcaaaaactagaaacaacgaaaatatccataaacaggtgaatggataaacaagttgtggtatattcccacaaagaaaaattgcacagaaataaaaagaaatgaactagtcattcaaacaacagcataaatgagtctcaaaaacaagctgaacaaaagaaaccagactcaaaaagtgtatactgtataagtccatttatacaaaatctagtttaggaaaaatgaatccactgtgacaaaaagatcagtgatttcatgcagccagaagcaggatttactggtaaggggtaccagggtactccttcacatcttggggtgaagggaatattctatatattgattgtgatgttggttacaaaaatgtattcatttgtcaaaactcactatacatttaaaatgacattatcttattatatatattataacttaataaagttgaaaatgtggcgtatgcttaaaacagaatatcaagtagcaattaaagattatgaattttatgtacacatggcaacatggaaaaggaggaaagaaccaagcaggatttatagcacaatacttcagcattaatggagagggagcttattatactggtcaaggaggtgtggactctagaaccagacagcctcagctgaaatcctggctccacacttatgagttacatacccttgggcaaattacttaatctttctgtgccaagagggatagcagtacttgccacacagggttcttgggaggatccgataaattaatgttgctaaaagcttaaaacagtgtctgggatttgaaaaatgctatgtaagtatttgttaaaaatatataataaaacagctgggccaagcacggtggctctcgcctgtaatcccagcactttgggagactgaagtgggtggatcacctaaggtcaggagttcaagaccaggctggccaacatggtgaaaccccatctctactaaaaacacacaaaaaaaatttagctgggcatggtggcaggtgcctgtagttccaggtactcaggaggctgagacaagagaatcgcttgaaccagggaggcataggttacagtgagccaagatcgtgccactgcactccagcagcctgggtgacagagcgagactctgcctcaaaaaaaaaaaaaagcagccgatctttttttcaaggatatacatatatctaaataaggtgatggagaggaaactgtaaggacatatattaaatactttacatacatattcaatgcaagaagaagaatgcaggcagtatgaaagaaaagtaataaactaaaataaaggggttaatattgatcagtaatgagtgtctgttataagcaaacatagtctgtgcacttgaagtcataaatgggagaaagtacagtcaaaaggcacaactatcaggactaactttatttaaggacaagcctacatacctcactatttgtcttgaattaccagaaccataaataactggtgtacaatgtcattgagacttaagaaaaagagacaaaggcaaagacagaaggcaccaagacagggtacagttaaaaacacacacagacaaatgccaaatacatttgagaaagagtttccatcatgttcataagtaggatattataacaagtcttggacagctgtcattatgcataaataatgtaccacaaaattgaaagctacatgaacatagaaccggccagaataccaaacagtggtggtacacaccagttatcactaaatagctgttaatctcattcaataaccatcactgaatgcctactatatgctaggtgttctagtaagctcatcaaataaataatcttcaaaatgcaacatagaattcagtggccattagaaaaatcaaacaagagtttgtcattttcagaagcaaatacaaaactattattagtggggttttcccagataattctttaaaggtagctgaagcagaaaaaaaaaaaaaaaaagaaatgcgtgattatctacttaaaaaggacacaaagtggatcttttgaaaaataaaatattaaacttattaatgagataacagtttactgtagtttctgatcataagcaacatgcacacaaaagaggaatctcatgtgtgaatttgtcttttttttttaataggaaggattctgcagctaccatgcaaagatacttgcatatggtctgtttacacatagaatttattgtctagccagggcccattttaaaaagaaaagagaacaaaaggactaacggcaatatacaagcacaaatgaacaagggctgcatccttgctgacgaaattgcagtaactacaagtaaggaaagtaattatttcaacaggtatctgaaataaaagctggatagaccctagagaagtggagtggaattacagtaaaacttattttgaaggaaaaaatattaagacatctatagacatataagtatctctgacattctcagttaagaggttcttagttgagtaagtgatactggtcctctgggatcaggtcacagacttacagagtcaaatgcctgtaacaagtatcacacacaacctaaaacactcctggataacatcctgtacttttaagtgcagagatttgtttgcagctttgctgaggtcctcaattctgtttgcatagcagacccacctgaagatctttctaaaagtacagacacggaccccaccagttaaatcaaaatcactagggctggaagtcatatgttgtctactaatcagccaaaataatgagtaaagggtttttctttaattaaattttttttattttgagataattgtagattcacatgcagttgtaagaaataatacatagagatcccatgtactctctagccacattgtcatagtagtgacatcttgcaaaaatatgatgcaaaatcacaaccatgatattaacattaacacagtcaaaatataaaacaattccatcaccacaaggatgccttctgttgtcctttcatagacacaaccaaactccttccgcacccatccccaactccaagtcctgactccgggcaaccatttcataattttgtcatgtcaagaatcttatataaaggtattcacttgtgacctatgtgcattagttttctttgatgcagaaaaattccctggagattcagccagattatttcatgtatcatacctttccattgctgagtaggattctaggtatatatgtgtacaattaatttcaccactgacagttgcagaacattcaggatgttgccagtttgggcccaccaataaagttgctacaaacattcatgtacaggtttttgttggaacataagttttcatcactctcagataaatacacaagagtgcaattgctgggtcgtatggtaattgcatgtttaggttcataggaaactgccacactgttttttttccagagtggctgtacaattttgtgtatcctatcagcaatattatgagtgatccagtttcctcacatcctcaccagcacttgatgttgttactttcttattttagtcattctgataggtgtgtagtaataacttattgtgattttaatttacatctctctaatgcctaatgatgttgtacgtcttttcattgtacttatttgtcatctgtatatcttctttggtaaaaagtttcttcttgtcttttgttcatttcctaattgaattgtttattttttgcagttaggttttaagagttatttatatattctagacactgggggtttgtttgttttgtttttttttttggcaggagatatggtttgcaaatattttctccaagcctgcagctttgtctttccattctctcttaacaagagtcttacacagaacaaataaggcccaatttatcaatctttccttctatggatcatgctttcagtgtcaagtctaagaactgattgcctagccctagatcctaaagattttaacctatttttttctaaaagttgtatactttcatattttgtatttaagccaatgatccattttgagctaatttttgtagaaggtatgaggtttaggtcaaggttcattattttacctgtgaatgtccagtttctccagcatcatttgttgaaatttctaaccttcctccattgaactatttggctcctttgtcaaaaattaagttggccacatctgtgtaggctatttctgtgtttcatatactatgccattgatctatgtgtctatccctccaccaataacacattgtcttgaatactatagctatacagtaggtcttatcaaaatggtttttaaatgtaaattacgccatgtcagtttcatgctttaaaaaaaaaaaaaaaaaaaaaaaaaaaaaaccttaagaattccctgccacaattagaatgatatcctgactccttatccaggctcacagagctgtacatgactagattcaccagcctctcaggtcacacctcacactgcacaggcccaggtcagtacccattagcatcaccagtctttttgttctctgagtacatcttagtaacttcactggaatgcccttgccccagatttctacaaggttagttctctgtcatcagttctcaactaaaatgttacctcctaaaaaaatacttccttgactatccaagctatacaaacacccaagtttaatcctctacatatcagttagcactacctgaaaattttatcatttatttacctgttgtattgtctccctgacctcctgaaccaaaatataagtttcatatgaacaggatccttgtctgccttgttcagcagaccagcacatagaatagtgcttgacgtccctatttatgaagtgtggcatgaataataataagtacagcaataacaaaaacacatctatacatagcacttgtctaaaagctctttcgataactctgtgtgtgtgtgtgcaggcacatgcgggctcattcagtcttcatgataaccctaggaggtgctattactgttcccattatataaataaaagaaattgaagcacggagaggttaaataaccaaatcaaggttacacatctactaaaagagcattagtcatcacacaaaaaaagtaatgaaataaagaatttgtttttctctttggcttatcttatggagattatgacaattaccaaaatctttattacctagaatcttttatttggtgacttatagtttaagttccaaagaaaaatattgccatataaggaaagggtatgacatagaatacacctgaaagagagttttcttaatatgactcgtttgtgagataatttctggggctaccacatccctggttttacactagagtccagtgacctgaacctccaatactgaagtcactaaattttcttcacaaaataactgtatcctactagcatcaagacagcacattacactgccatcttgcctccatccttgaaattttagaaagcaaaatatggcctcatacaaatatcatttggaattctgaaactgcaaagatacccaggactcaaatgtttaaaaacccaaatgcatttctaagtatacattttcccccttagattgccttgttctgctctaagtatcctcaaagtgctttgattttttttctctaagtgagctatagaaatctgaaaagttaaaatagcatgtattctttacagatcatttcatcattgtatcaactagtaagtattagcaatttataacgtatgaatatgttctcactctttccttaaagagaaaatcacacagacatcagaacaatgaatctctggctgaataaatttaaaagttcagtctcataaagcaaattttttgtttgtttacatatactcacagtttggaagcaatcaatcttgattatttatttctgcaatgcttttacttacctctataagtgctttgggatttgatttctatgatcatgactatgcaaagttagggcatcctatattttattttgtgggactcctttcatatttgtgaagaaataacttaaggttgattctcccattctttaaaactacacctgatccatatgtcagaaataataatggcaaaaacaaggcaatttttcaaaactgagttgacagtttttgaatattaagcttcccaaagatatgggcttcacacatttctctgtacaatttttaaaaaggaaacacaaaaatcaatctcaccacctttactagggttcttcagggatttcataaatgctttttggtgagacctcatcatttaatgtgcaataaaagaaaaaaaggtgtgatggaaggaacagagttgagggaacaactactaaaaccacaaacctcccaaacgaactttactctgaacagaataaaataccctattgaatactctaaccatcagttgtataggaaaagaaaaaaaacataaaaattatctcatacattaatggaaagtttattgcatcagaaagaaaatgaatttccatatactgttaatttcatacactaaaatgaattgaagaaactaattattcataacgaatattggcctttgggaaacactgcttcctaaaaggatttaatggtcaaagcttgtgtgaattattatcatgaattaaactaatgaaaggatgaagatattgttaacagaagttctgaaatgctaaccttgccatttctgtcatgagatgagaaatcaatgtccaaataacatgtgcagttaaagctttaacaggaaataagtgccacagaatctacagaaagaggtttttcctatctctcaacaaaaaatatatgaatggaggtaaggtggagaaaggggacaatagtaaaaatcatgccccaaatggaaatgaaattagcaccctgagaatgaattgagaagagtaaaaattaacgttcagccatttgtagaatattgtgagcccataggtgtgtatatatataaaatgtgtatatatacatatatataacgtgtgtatatatatgtgtgtgtgtacatatgtatagtgtgtatataaaacacatatatgggtgtatatacatatataatgtatgggtgtatatacatacataatgtatgggtgtttatacatacacatatataatgtgtgtgtgtgtgtgtgtgtgtgtgtgtgtgtgtgtgtgtgtgtgtggtgtatcctgtaaagaggaaattaaaccatctgaattatcagtgcccaaaatcaagatgacccacatgttactttaaaaaatatataattagaagggaaatttaagaaagtttaaaccttacctttcctattttcctcaacaaacaaaaagaaacaacaaccaacacattcaaaaaaattgatctacttgacactgatcaaaggaaagtctcggaaataagaatttgaaagtataatctacctaagagagagggctctttgttggagaaagtggctccagatttcagattttagttgatgacaggaagtgaaataagaaaactctttgacaagtgtatgaatagagaaactttgtcttgtttttttgatgaggtaggttgttttcttttgatttgctatgaaatggcatctccagagtcttgcaagggttaagaagagtgggaagctgggtaggaaaaaaaaatccaagaagagtacgagcagagttggagagagggctaaattattagaaaaggaatggcactttgtttagcaacccagaatagcagtagtgtgaagctcagtgggatcagctggcttcagggctttacaaagaaatccatttccctgagtgctaaatattttttttgagatggagtctcactttgtcacccaggctggagtgcagtggcgcgatctcagctcactgcaacctccgcctcccaagttcaagtgattctcccgcctcagcctcctgagtggctgggactaatggcaaattaataaattagcactctgatttatatatcagtaataccagaggctgcagtgcagtggcacgatctcagctcactgcaacctccgcctcccaagttcaagtgattctcccgcctcagcctcctgagtggctgggactaatggcaaattaataaattagcactctgatttatatatcagtaataccagataacatatatttatgaatttgtttggtgagtctatcctggaaaggctaataaactttaaaataatgaagaatcagctttcaggtcctgtgaagctaagaaccatatcctagaacctggtcttagaaccaacacactccctgtgagaatgtcactaacctggatgagttctccattctattgttctctatctgcattgctttacacaaaaagtggttgataattaggtaaactagcttctgaggaaaagtggtggaggccagaatagggcaagggaatggatggctgctgataccttctagaaactatcacaaatttttataataaatctctaaatatcatgaaatgtaaaaaagatggcccaaatttgcaaggatcactttgatatctttgtttaaataaaatttatatcaaaatgtgtgcaatgactatcttttcctcttcttcattctattttacatttctaaattttccaaagtacatatatacaattttaatcatcaaaaaaatttataaattcacagaagatttttagagcagtgaaactaccctatatactctagcagtggatacatgttattacaaacttgtccaaagccatagaatgtacaacatcaacagtgaatgctaatgtaaaatgtgaaatttgggtgatgatgtgtcaatgtcaattcaactgtaacaaatgtaccagtttggtgggggatactgataaatggggaagtctatgaatgtatgggaacaggagtaggtacatagaaaatctctgtatgttccgttcaatttctctgtgaaactaaaacttctctaaaaattatgtctatttaaaaaattctagcataaatctgtctttatttatttggtatctatgtcaacaaattttcagaaatatttaaaggcctttcatttttatatatgagatcacattgattatcactggactctgtgtgtgtgtgtgtgtgtgtgtgtgtgtgtgtgtgtgtgtgtgtgtgtccagttttaaagcagaaaaggggttactgactgggaagctgtaatgatgagatctcttgataaagtaatgcagtgtaagcaatctttagagactctttcaatttgatgatgttttctgacttttatcctttgggctgaatcaagaaaaataaaacaatttacaaaactaagactctgctacccacagcaaatgggggaggcagggaagactatattgattgtcaatatatagcaacattatattttttaaatttatccttatgaaaattatctctcattattaaaagagcttctctgatgtttaaagaactggttaactatattctatatagatatatattacattctaattatattctatatatatttttctatctattttctttatatagtccttagtttatcatttctgtccattttctacacaaataagatgggaacctcaaaaaaggaaataagcacctctattatacaatcttaaattgggttagaaaacttagtaccttacttttggatcctaaaaaatattttattgatatattccagaatttaagatcttaattttcttatatatttgctctaaatggcacttgaaataagaaactaaagagtgattaatatttggccaatgttacatgaatgttactatttatcttgttattcttattttaacagtatttaccaatactgtcgagtcactaagttttgatttttggttccactccttctagtttcacttatgcattttagtcctgatctttgcactaaacatgcttatgtgtaccatattctgtaataaaatataactaggcaaaaactatgattatctacctcgcagtaggtaaaaatatagaaggttccagagtgatacttctcaaaattatatctgctatatataacatataaactttgcataaaaacaatataccattataaaatataattacatacattttatatatatagtatttattaaatcgagaaaatattttcaagttactatgttccccataagttttaccatattcataatttacagtttgtttttattccttgagagaattttttttcttacttggaactatttcctatttgttccaattgtgtttccaacttccttagaaatggccatagcaatacaatttttattgatatactagctcatggggcattgtttcttgttgttaggtgtaaatccagtaataataaaaataagttccataaatacaaaacagtaaaattcaaccaaaatcaggcctgatattaaggggatttgaatacatatacagaatataattgaacactttaagcaattctacaaattttaagaaatagagatatagattgagattttcacaaactaaaacaattatagtgatatagttcaactcagtctcttaacttacaactatgcttgtgcgtatctgtccaaattcaattgtatttctggcctataagattatttgcttcaatcaaccaacatagagaaaaaaatcccaggctaaaaagtaaatataatgtctacactggcagtaccctatctcacagatatattgtgacaaaatcttactattaatatctgtaaatattatacacctttcatgaaaatatgaaagctaaataaatatataagggtaaacaaataaaatctaaaggtaaagttttatttggtgcatttgagaaaaatacaaaagaaaaggaaactttgggtcttattggtgatgtaggaatctggagattgaagacgtaggcagtggggatagtgcaggagtgaaaaaacaagcagttacaaaaaattatttaaacttgccatcttaatgtaatatgctttgagtcggcctttatttctatgtatggagaacaaaaagtttctaggcagaaaaatattataaaattgatagtacagacagtgaactactacaatttaaaaacatctgactctttctggccaatcttactttaatggtatcatcatacaaaagaaagaaaattacatggaacaaatgagaaaaaaaagtacctttgtcataaactttcaaatataacattataataaaaaattctcaggagaaattttgggggaaaaaaagatgtattcttcaataataatttaacttggcctaaattcatgagaatatcctccagttttgcaaactgccttcaatttgctgagaaccattcttttatgccagcttaaaataagcaaagattacacaagtaccatgtgccaccttaaataaggaaagggaaaaaagtacaatatggtatttaaacagctgtgtgaagatactggttaaaacaagaatcatttttcagctgagcttgtaatgcttcattttgctaaatttaaactagtgcatcattaacttaaccactgatttgtagaataaagtacagaaccgcacctgcatataatccaataaacacaataatttttcaaatggttgtgaaattgtcataatttgggatcaagatttgagagaaggaagaaaaaataagaagacattatttcacagatgtactggagaaaatacaattgttttcattatttgcagttttatttgagtgagctgacaaatgtacaacaaacagtacacgtggaaacacactagtaagaattctatgccaggcaattagtgaagatgattgcaagaaatcaattttttggaaataaacaaaaattttaaatgttatatggccagtttggatgagtattataagtaaatgagctcaaaccagttaacgaaatggaagaaaacagagtgtgtgctcaaaataattttgctcccaaaggtccataaggaaccatttagtatatcagaagtattcatttactatgtggtatctccctggtcaaagaattgatactttttcacatagattcactcagtcttgtctttccactatgttagaggttttaaaccccaccgaaaagttcaatagatacaatatagggaatatgattcatgtatttggatgaaaaaaagatcatatgcttattttcactaacaattagctaaaagtttaaatttccctttattaagaatgcagacaacaaatcacagtagtatttgttgtacttgtgaccgacagaaataatatatattttgaaatattgttacactcatcactaactccaaaattatagtacctgttagaagtaatgccgcatcccattactattactattcatgtattactattttagagattttaaaatattttgatggcactatttcaatttagtttatttcctttacaatcctatgcatttattttgtgcattaataacattctggccgggcacggtggctcacacctgtaatcccagcactttgggaggccaaggcgggtggatcacctgaggttaggagttcaagaccatcctggccaacatggggaaatcccaactctactaaaaatacaaaaactagctgggcatggtggtgtgtgcctgtaatcccagctactcgcggggctgaggcaggagaatcgcttgaacccgggaggtggaggttgcagtgagtcgagatcaccactgcactcaagcctgggcaacagagcgagactccatctcaaaaaaaaaaaaaatctaagacttttgagttcacatgcttaatttttttttttttaattctgagactggatccacgaacttcgccagattggaaaaggggtccatggcacaaaaagtattaagaacctctcattttcaatttggcacataagataagggaaacgtagggagacaagaaactctatagcttaaaattaacttttatgttaaagttttgtttctgttggtctttatttttaattctggaagagcaatcatcctaaattaagccaatcaaatacatattgctttaagcactaattaacaccttcttcttctaccttttattagttctaagaaatgttctttggtttaaaattttccactaataatggaaaaagtatgaaatttcttatccttatttaaccattttaaaattaactccaatatgtactacattatgacagagcagattttacatcgccctgacagtaaagtatactgcattcttggtcagatgaatgtaatgagcttcttgtaatcctggctaattgatataggaatgggggaaggatttgcaagatcaatagccgtataccaagtgccagagacaagaatgactggctctagtaaaaaagaacacatctagaagagtatctccaatcagaattgcaacctgattaaatttaaaacagagcattatggtttctaacgcctattctcctttgcgcaaggcaagtaggtgagtaaaatgagtatgtgctaaaaatctcttttaaaatttttaagtatttaatagcagcggtaatctctgacatttctctagtgaatttactgcttttgatttgctctcctggatgggagaacagttccagggctttccacttgtccccttctaccacaatatccttcattccatggttcagaaagccaatatggacattctgcaagctacagaggatatctagtcaaggtaagcattgaagaactggacaatgatcacaaggtagataaacaaactccctggaactacagtaagagtaattcaagttacaaagaaagaaaaaggaaaagaacatgagagaagggaaagaaagaaggaaggaaagaaggaaggaagaaaggcaggcaggcagggagggagggatcatttggtccccataaggtcacactttgacaagaacaatggtcaagcattttgggtctcccctccctgccaaggattagtgtcaagtaagagccatgtatggtaatccctgaaataactaagaatttccctttccacaatgtacaatcatcctggtaaatgactgagatcacactggggacaacttgaagaaagatttttggtatgtatttgtagcaatactcatgctttatcttcagagggatacagttgccctcatttcatttaagggctgtggctctgtgaactggctccggtctagaaactgagtgagaggccatgatgttgtatcagggtgaggaaatgagttttctgctcacgacatcaattatgtttctgtaccctagagtctgtattttagtgatatttcagccaccatcaaaaattaaaagtttggtgtcacaatagtctgattgtcactctggctcttccacccattatcgcaattgtactcactttgcttccagtgattacactgggacactcagcctctgccactccagaattccatcattccattaaaatgagagagtctattttgaaagtagcacctaatatcacatccaaggcaatcagaatacagccttcccagatttcttcaaggacactgatgttcccttcaccaatgcatttctcaatatttccatgaggaaagcatttgtgggtcacacatgataaacccactgcaacattcctatctccctaaggctttgggatattttcatgcaagactgaagtcactatggccattacagactcttcaagaagagggaatttaatctccttagagaaagaagaagaggttggttccacaataaagcactggggaaactgcagatgaagcatagaggaaactggagttcaaggctctgagatttaggtgagttcactcacataaatatattcatttcaattatcatgatccatgtctaccattcatgtcttatcttccatataagaaagctagtgaggctgtgaattcaacttgtactgtgattctataattctcagaactgaagtttggttcttattttcagctgcatcattactgcaatgataaaagacaagacaatttgtgttggcagtgggagtggggaggggatcatagatctctgtttacgtgactatccttgaactgagagaagtcctgaacccataatttcctttctataaaccttctagtgtagtcaaaaacagccaacaggagtcattattcaatccataacagtcaattacaacttccatttgatttcccaaaactttgactttagtaaacacttcatttctgataagaaaggtgatacattaagtaactgagctgaccctgcatggaacggcaattttccactggcaatgatatactattgtgttcaattgcagtatggtcagataaccaatctcaaattctcatctttgaaattctgtctcctaaaaccactcctggttattgttcactaaagaaagcagaaactactatagacatttccagaataggaaatttaataccagaaactgattatacagttgttgaaggggttagaaaaaaaaggaagaaataaatacttgaaggcacaaaacaaaaacagggtttcaaaccaaagtgagggtgctaccccactaggctggagcccacaagcctgcagtaattgctgagctcctggaaaaacttctacaggtgccactgggaatgctctgttattgctcaacagagcctatactgtccagcagcaggagtactgctactgctattcaagatgccaacactaatgcttctggaactcacagccaccagaggtcaccttcagtatcctcttctgcatgctgaagtacaccatccaataaaaggaaataaatagctgcttcttctctcctaccttacaatctttcaagattgccttgctttggctgtacctaatagaaaacttgctagcaatggaatctggcatgtgtggttcacaggttttatatctttgcagtagagtgtggaagggcagatatatagataagagataacagcactaactgtcacaaaaccaaacaataatggaaaaacagaatgtgatgcattttatcttctaaccatttataaaataaattaaatatatgttttatggtataataataactgtaaagaaaaccaaatactacacaagcactcaaaatgccattctcaatctaatcttaactttcttaataatcaacaaatacttactgtgtctatgttcctgacattgtgacaaatcccagagttacagatgtaaaatcaactataggagtttttactctcgtcaggaaatagaatcagaggaaacagacaaaatacagtaaataataactagactatgtgtatcaggtatacaggagagccaactacaacagccaagaagggtcatagatggtgtataatttggatatttgtccaatccaaatttcatgttgaactgcaatccccagcactggaggtggggcctggtgggaggtgtttggatcccaggggtgtatgtttaatggcttggtgctgtctttgtgatagtgagttctcgcaagatctagtcatttgaaagagtgtggcactttctgccctccactctctgtctagctcctgcttttgctgtgtgaagtgcctgttcccgctttgccttccaccatgagtaaaagctccctgaggcctccctagaagcagatgctgctatgcttcctgtacatcctgaagaactgagccaattaaacctctcatcttataaattgcccagtttcaggtatttctctatagcaatgtgagaatagcctaatacaggcggcttcagggaagtgacttggggaaaaactagggcttctaaagaatacaagaaaaaataatatttcagatcagaaaaacagcatgtatggaggcatacagacctgacaaagcataagatgtcctggaaagtagaattgtatataatttgaaatatagcaaatgaggagataatcaggaatatgccgaagaaaaggttagacaggcaaaaggtgagcaaagtatgattctattaatatattgctcatacaattgattgaatgatgttgcatttgaaattttttaatttaaattttagaaagataattgccagaggaatggaggattgactagagtgaataagatgaggaaaataagatcatttagaaagctgttctagtataggataataaaactgaagtaatgcaataactactgaagtaatacaataaactgaagtaattcccacttgtctaggaaaaagctagttctcctcctccttctctatgcaagttccccagcttctaatcaatctatcagttaagcccactttaataactattaatatgttttcaatgtccattttaataactgtgttttctacaagattaaagaaataaaattatcctatagatttttctaaacaaatagtggagacctatggaatataattgcaagggtagtaaaaatgtaacttaaattaagctgtgaaatatattctattttttgtctgctattttgtcatgactgtttgacagaaaatctacccttttaatatgccaaattcacacatattaattaggagaactagaagttaaccaaagtaaatcgggaggaaaatattttaaaagtatacgtgcatatctcacccaaagaaaaattccgatttaattctcacttcttttaaggtggccctcccccagaatatcgttgactttttaaaacatatcataaggcaaacatttgtgacgctatcacagtccatcttatacaaccaaccaggaaaaatatcctctttaatcaaaatcagtaattttgcgttaagcttcttttattgatatgaaaaatttgggcagtcctgcagagagaagtccaaataacacaggaaactagccctgacaggtggtaagacaataggaagaaactagtatttcctcaggatcttgcttatacatatggtacttatgatactttactaaaaagtatttatctgaatccttcagtagcctatgagtcccttaatggcaggaaatgactgaaaaaaaaaacaaataaataaagtgaagacagaaacgacatggatttctaaaaatatttctgatgcttctgcatttcttaaaaatttacgtggatattttccaggatggacaattatctgtgcacacaatgcaatttgctcttccaaatcctttctaccacagcttcagacttaagctctatttaatgtaaaccaatcatagtaataccttcctcaccgccacgtagtctttcagtaatgaatgagactacgtccatttaagcaaacaacacacaaggaaacatttcctagtggcttcttaaaaaaaaaaaaaaggcttcatttttcaactaataaaaaggtgagtattacagataataactacataggaatgtaaaaaaaaacttactctggctatggaagtctgaaaagacttcatgtaagagataaggcttaaaccacacctgaacaacaggaaagtacagttatgcatcacttaatgatggaaacacattctgagaaaagcatataggcaatttcataattgtgcgaacatcacagggtatacttacacaaacatagatggtatggccgactacccctagcttatggctcctagactacaatcctgtacagcatgtaactgcactgaattccataggcaattgtagcacaatgatatttgtgtatctaaacataaaaaaggtacagtaaaaacatggtattatcctcttatgggaagaccatcaaaaacacagtctatcactgacattatgcagtggcacatggctgtatctgagagtagacaggaattacaactgggtggatggtataaagaaaggcataagaagcataaagagtggaggatgttagatgtattcaaagcacaagccagccaccccaagtaaaagactcatagacaaagaaagaacatgcaggaaacaaaagtcgaaaaaagggcctgaaaaccagaatatatttcattatgttaagagccaacaaagtaaaattcttagttatgatctaaatgtatgatttagggatgaatacatagttagggagaaaagaaaaattatttagccatgaataaattaatccaggttcttattcatcaagattccattttgaagagggctgccgcttaggaacactcaagctacgagggccataaatttaacacacacatttctttatgaaggagtagagagaataaacaaattttttaaaaagtaaagggagaaaagggaaaataaagtaatatgcaaggacatccgatagtcaaaatgtattatctcataaatttatatgcttcagtaaaaaaattatcatatttacaatcaaaaaaggccatttgtaaagaatctcacatatattatctctgtcaaatctcacaacaacccaatgagagagatattgttggctccttttttttttctttttttttttttttttttttttgagatggagtctcgctatgtcgccagactggagtgcagtggcgagatctcggctcactgcaagctccgcctcccgagttcaagtgattctcctgcctcagtctctcaagtagctgggattacaggcacgtgcaaccacgcccaactaatttttgtatttttagtagagacggggtttcaccatgttggccagaatggtctcgatctcctgacctcgtgatccgcccgcctcagcctcccaaagtgctgggattgcaggcatgatttttggctcgtttgtacagacatgaaagtgtctcaacgtggttaagtgagtttggaagagccagattattatccaggcctctgactttacatcctgtacccactcaggcctacctcatttcattcaagagataagtacaacacaaagttcaacaacatctgaagccattctgaactagaaataaatgaagattctaattgtcagtatatcattattcagacataatgtagaaacaaaggattttgccaagcttaatatggtttggctgaatgcaagatttatatattaagatccaacattatatgggcaaagaaatactacctgactctctggaaattgaggtttatcaatcagactccctagatattcagtattttgaagatataataatactgaatcagagacagaaaaaaactagtaataaaatactcaaaggtctaaaaattaaaggcaaattttcttagcaaagagtacatggcattctatttaaaaatcaacaatttgtcttcattccccagatcataaacccaaggagaccattataaggctgctacaaacaatctgtcagtttgatttcacttggttagtgagggtgttgattttgttgttgaactgcttaagaaaaatttaagatgcttaaagaaagttctttaaacatattaataataagcttttcaaagtctgtgaatttaatatttcattatttccttgaacctgttagagttaagtgaaactttgaaaattccaggaaaggttcaataaaatttgttatagattctacatggtctcattttcctttacttaagaaaaaataccaaataggctgttatattttgaaatctacattttttcaatctgccctttaatgagcaccaattatggtaaataaatattaacagaatataaccacttacttataatgcaatccttataatgttatatttatccaagccatgaaggattagggaagtaaaaactacactagcttatgatttagcagttttattttccaatataggtcagaatctaaaaagttaaagagtgaaggagggccacggggcctttaaggagcccaaatatcagtgtaaatgaaagggtgattgattctctcctcaaagcagatggcgtcctttccccagatgcctggttaatacagatgtggaagccaatggagaactcaggttccttacaaagaacagaaaaggggttgagcacacaaacaattcaagagttcaagggctggtggtgaaatctggtagtaacagattgcagacacatacagatgtctaaaggaaacagcaaaaggaagatctgggaagcaactccccaggaaaagattttaccatagaaatcatcatcatcattaagaagcctcagatcagatgtaacctatagcagatctgaacatgactaaaccctagacaaaagtaattaattccaaaacagtggtatggatcaattcaaatgagaaattgattttctagttctgaggtgcaatggcaaacttgtaagtcaaatgatatcctagaagacagcactttttaaagacaataccttaccaagccacttgaagacggaataactataccataatgaagaaaaatttctattacttaatagattcttttaaaaatattttagatactaaattaggactattacataattggtattatctatatttcaactatggaagtaacagttcttcatttcaattaacaagctaatatactgtctattcatcatgattcgaccattagccagactttgctgaataattctaagattagcctgccatttagccacaagttagccaactatatagataagtgaactattttgctatcattaccttaaatgttgtccacacatcacaatgaccaataagaaaacatccctgtcctaccatcctggtaatcagaaaatcaccatgtggcttaatgtaaggctaagtaagcgttaccaaatatgtctgtaggagggcaagtctgagggcacgattacactttcaagactttgtgaggaatcatttgtaatcttgtcacactcaaaaaaagtgctgagagcattcttttttcaccctcacatcatccagagaactgttcagcaatataaagctgtgaccttgatgttctatatagcttaaagaccatagttaaagtcctcataagcactaaaagtcatctctgcacaggaagtagaatatccttctacactaatgtgctacatattatagatttctccaatatgttccaaatataatataatgttatttccaaaaccgtaaaaaaaattcatagtttagcagatctaagtagaactccttttggctggtgagatggtgggaagagattagggtagaaagtggaagaagcagagtcataagagaatagtaatcagtgaactaccaaaattttcatcattcaaaatttttacaaatcaaaattttagctttaaatcaattttatatgtttggtttcaaagatcagccctcaataacaaccctataatctgttttaatacagaaggctatattctatagcgataagttctattttagaaaagaagcaatttaaacctaagtttttttagaatgttagcataacatatagtatgaaacaggaaacaaacagattaaaggaagaccagaacattggctgaaaatacaccttcagggcccatttccaggtaatgcccaaggcctcctaggggataactaatagttaatatttcggctgccacattccatgggaggtcgtaacaatgactttatataaaaattatttctatttttctcttttatttttaacttagtactattaactggagctctttcttcccttgttaactattcattactgtatatttctgtgcattaaaaccactttaaaaaaaatcttcatccccacatcagcctccatcgtgggaagatatatatacacagaaagagaggaaaagtcattgatccccagccataagtcaagtgaggcttcaacaatagatcatacccaggctgcacactgttaggtcacagaacatgtggtcacactgtcctaccaagacagaagctaattctatgaaatcccaaactacaccttcttgtgtttctccattcacctcagtcaatggcttcaccaccatccatccaccttcttactcaaatcagaagctgaggagccactctgcctcttcccattcttacagtccaaattcttgttcactcatgcaactattcatttctctctcacttcctcagcatttgcttcagcccatataatttctgacctaggtgattttatcagtttcctaactggtttccctttctctggcctacaacccataaattctaaaacacaatctgaataatctttctaaaacattttaggaacaacccactaccctcagatcaagtccaaactctttaacactgtttacaaggcccttgataatctgactggttgctgctcacactgaactcttaccactcccactgtggtacccaacaatgccaaacaatttgaaattactcagttactcatattctctcagtactaggcaccaccattcctcatccagaacactaaagcaattgagtttgattcaggtgtaatcctcaagaaaacattgttagacttctccagtttctccaggtgacacatctgtgtgctctgaaagcaccctatgcttatagttatcataccatacagtactgtttactttgttcttcctcccccaatcactgattattagatccttaaagtacaagcaacttattcatatttgtatcataatgactagaatagtacttggaacaaaggagacactcactaaatgtttgctgaattaatgaataaagatataaatgaaaggcggtatgtgttccatgttttcttcaagaaaatatggccaccaaaatgtgtatgaactaagtattctccaatctgcccaatggaaaaataaataaataacagctaagagtttgtcataaatttcagggcaatcctaatgaatctaggaaagtcaattgatcaagaggctacatcatggccttttgatttgacttacccttatttgctcctacgataataccaaaaaagcatctgtccatacagtgagaatgtaagtcaacacacaattggctcagggtaagcagattacaactctattaaaataaaagaattataatcaaaatcctgcttccgtatatgatttaatcattgcacactgattaaataaatgacaataattataaagaaaaatctccatccattttgagtgctcctgagaagctagagactactcagatctctgatttgaggtaatattctcaatgtctcaaattaaatgcaaatattctcatggaaaaaaaactacaacaatctttttttttctctaaattattaatatttatctttgaggttgagattctcaggtttttgtagtacatcatgggagtgatataaaaggagtccttaactgcaaatcaaaattttagccttaaatccaaagcttgctttactatatagctatgctctaaatcaccaaattcagaaatcctttaaaatagacacttgaatgtggtttcaatgtaagcactctcttagcagactcactcttcaaagtccaaaatgaaagaaaaattatatgctcagcagtttatttaattaaaaggaatggaactacagagtgataagtatagaaaagttcagcatgtcttttcaaaggactgtaaaaaaaacttccaacactttacttatattcttgcccttgtgactaagttatggacaatgaaacaccttgagttatgatacaaatccttaaacctaaaatgccatatgttaaaactcaaattatgttaaagcccataactattttaaaaccctgtgtataatgtgatctactgcattcacagtacttaaagtactttcatttttgaacttttataatttctgcaagagaaaacaatgccaagagacatccctacagtaattaatgtaagataacagctttgaatttacagttattggtaatttaattagtcttgaacatagccactataagacttgataactactaaacaattattaatgaataaaaggctggcccccagattcttttatgccagacccatggaaatagtatgtgccagataaatagattctcaataaatatttattgaggtcgaattgaccccatgactggttagatgcagaattttagttcacatcatatagacattctgaaactgaatttaacacaagcataatatcagcataatattatactgaattgtacagacagaaccatgagtcactttctgctccaaatcaatgaaatgttgaagtagaaggaacagcataagaattctccattatgtagctaagtttgaaacaatggtagagaaatctccaggtcccaaaaaatgaaaaagaaattcgatatctgggtggtagaaggaactgaattttaaaaaaaattagaaatatactaatattagtaatattaatactaatatacaaatacatttaatagtggtgttctcagatcacgacgcaaaatctccccaagaaacctactaataatgaataataatttacatgagaaaaagaccttttcacctgcaaattaaaaagcaggttaacatttatgggtcatggtaaaagcacttctccaaagaaaatccatagcattaaatacttacatattttttaaagaaataaaatgaggaatgcatctatattttatatcaaagcctacgtctcccagctttgttcatagcattaaatacttacataattttttttttacaaaagtaaataaaatggtgaatgcacctttgttttacacggacggctgcatctcccacatttgcaaactcttcactgtaataaactctctttcttcaaaatgaaaaaaagaaagcaaataaaatgacttaaacatttaatttgaaaagctagaaaaagactgacaacagaaaacaaaagcagaaggaaattaataaaaataaaaatgaagtcagaaaaacagcaaaattaataaacagatcaaaaagctggttctttcaggcaacctacagaacaggagaaaatttctgcaatctactcatctgacaaagggctaatatccagaatctacaatgaactcaaacaaatttacaagaagaaaacaaaaaaccccatcaaaaagtgggcaaaggatatgaacagacacttctcaaaagaagtcatttatgcagccaaaaggcacatgaaaaaatgctcatcatcaccagccatcagagaaatgcaaatcaaaaccccaatgagataccatctcacaccagttagaatgacaatcattaaaaagtcaggaaacaaaagctgctggagaagatatggagaaataggaacacttttacactgttggtaggactgtaaactagttcaaccattgtggaagtcagtgtggcgattcctcagggatctagaactagaaataccatttcacccagccatcccattactgggtatatacccaaaggactataaaacatgcttctataaagacacatccacgcatatgtttattgcggcactattcacaacagcaaagatttggaaccaactcaaatgtccaacaatgatagactggataaagaaaatgtggcacatatacaccatggaatactatgcagccataaaaaatgatgagttcatgtcctttgtagggacatggatgaagctggaaaccatcattctcagcaaactgtcacaaggacaaaaaaccaaacactgcatgttctcactcacaggtgggaaatgaacaatgagaacacagggacacaggaaggggaacatcacacaccgggacctgttgtggggtggtgggagtggggagggatagcattaggagatacacctaatgttaaatgatgagttaatgggtgcagaacaccaacatggcacatgtatacatatgtaattaacctgcacattgtgcacatataccctaaaacttaaagtacaataaaataaaaaaagctggttctttgaaacactcaacaaaatagaaaaattactagccaacctaataaataaaaaggtgggggagattagggtgaaagcccaaaaacacaaagtgaaaaataacaaagaagaaatagtcatcaaaagagatgaactgaaagagaaaatgaagcacaaagaggaaaagaaatctattgtatatgcaaataaatctgaaacataggtaaaataaaatttcatttggcaaaactgaccataatagagagagaatgcattaaggaaatgcctaaaaagggaagtaaaactaattagtcaactacagaccataattcatcagaggttccttaaattaagttgaggcaagtcactctttttcaagttgagaaaagatgctataaaacatgaaggcatgtttgagaaaaccagtaaatatttttaacaatagttcctagagtcaaataaaaaattcattcaaaatcatgtgtaatataatgtttaagtgtaatatattcaaatgagaaattccaatactatattccctaacaaagggaaaaaaataaattatagctaaaaaataaatattcaatatcaaccaatatcaacaacaatctgtttattgacaaaatgtatttttagtttttaaaaaacaataaaaggtaaataaactaaaattcaaagtgcaaacaataacacaccaaagattttttttgaatactgaaaatctaggggaacaactgctcaacatttggttgcttcacaatctgttaatttttttaatcaaatatgactaagataagtctgccacatccataaaaacattaactgaaattaatatgcaaattatggtgcctgtgtgggatgccatttcattaatttcaattcactgacataattgtgttctctgaatttatgagatttgcaaatgccatctcatagagaatgcaatgttcagtgaatgttattttactagcataaaacccaataataggttaatccacaaaaaagaaatataagattttagttacaaaataatatatgttttcatagctgtatattctttgagctaattcttagagctttttaaaataatgtttaacttttaatataacactgattaatggtagcaatcttggaaagttcaaaaaggtatataaaatgagaaccttttaaagattagctatctttaaattataaataataacagtatttggtatattttgcttcaatcttcttgtatgcagataagtacaaatgtgaaagcgcgcaaaataaatataatgttttaattccattttttccacttaatatagctatagatattttaccatattagtaaatgaattccaaaatataattttaaatgaatgtatattaagatcatcatgtggacctaccaaaatatttttaatctttccattattttttggagtttaggtttttttagtgttttaatagtataaatccttctgtaatcgagcccttcatgtaattatttgtgtctctgattatttccttaacaaaaaaatccttgaagtgaaattcctgaatcaaaggatgtaaattttaatatatcatctaaatacctttcaaaaatattgaaactttacattccgaccacgagtatataacttctattcccttgaccccttttccatactacattctatcttttggcatcatcagtgtagtagatcaaaatggcatctcacagttgattcatttgcatttctttattagagaggttgaacccctcatgaaattttactgtagtaataatgttctggaattttaatttaaattataatgtagttttgcctataactgaattgtgagcaacattgctatttataatttattactgcttgaagttgcatactgtaaaacatgctgtgtttaaattatgtacagtatttttttatggttagatttcataaaatctcctaaaccaaacctgagtaaatttctgctctctttacttgctattactttcaggtctataaagatataaagaaaattacacttaatcgaattttatatattttaggtattttgaaggcaattagttcatcataatacctcaattgagatataaattatgcatttataagactgagattgccaaataaaaattaagatgcttagcaaataatgaatttgattaaatttttaaaattttctcaaaactacaaaaaagtttttgatcaataccaaagattataattgaaatatctttccatctcagatattaaagttacaataattccaaaattatgggcatgcattctccctccataagtgaaagctgtacaatgcctcaattctcagttgtctcttaaacaattccattcagaaatcttcttcagctgctaacatattcctcattaagattcctacttctcataaacatttctccaaagaagacataaaaatggccaataggaatatgcaaagatggtcaagatcactaatcatcagaaatatgcaatgaaaaccgcaaggatatatcaattcacacctgctaggatggctgttaccaaacaaacaacaacaaaagaaaaacaagtacagggaacactggaaaaactggaacccttatgcactgttggtgggaaatgcaacagctctggaagcagtatggaggttccacccaaattataaaaagaactaccatttcttggagcaatcccattttcaggtattatccaaaataaattttggtttttggtatttcaaaataactgaaatcaggatctcaaagaagtatttgtattcccatgttcactgcagcactattcacaatagccaagatatggaatcaacctaagtgtccatcaatagatgaaaggataaggaaaacgtagtacatttacatactctagaatattattcagcttctaaaaagaagggaatcctggcatatggatggggaaaaaggggaatcctgccagcatagataaacctggaaaacactgtgctacatgaaataggccagtcacagaagcgcaaatactgcatacattctacttatatgaagtatctaaaatagtttaattcataaaggcaaaaagggaatggtggtggtcaggggcttgggagagggaaaaatgagaagttgctgtccaactggtataaagtttcagttaagcaagataataattcttaaaattcatgtaagagaaaatattatcaaaatagaatgcctcatttaacctgctttatgagtgttcactcacatagatcattatatataaaaagtgtcactgtaactaaataatttctacaatttcattaacatgtactcaactccctttgctgcatgtctctatcatagctgttcctgcgaggtactgtaacccaccattcattcatccatgtacttcttacacttcaaaagactgaactatttcttttgtagcacttggcatgagcaaatacataatatattaataaataaaaataaatataggaaaattcagctcacaaatgtgctatttgtgcatgaaaaggaaaaatatttttaactattttcagaaataagttagaggctagaaagtaatcttatggtatattaataatttaaaagtcatcatcaaatcctgtggtttggccaaaataaatgcagaagtagaaagaaagagagccataaattgcttaaggtcagaaatgcaagctgaaaacatagtgtacataatacaagaaattcttaattctccagatttctatgtgtcaaaaggctcctgatttcagtgtggaaatgagggttttaactacatacctgaatcacctgtttggaaaataggtacgtatagtagatatataatatataagaatacatatgagaataaagtattataaagcagcataaccacccacatttcaccatcttttcatcattaaactaaaaaatatttttacaaaaccacatgacctctcagtcataatagaactaatgaaactacaaagatccaatcttactcagagaacttgtacgatttttgaaaacagcaccattaaaacagctctctcagagtattctcctataagctcttaaaagttattttgaaaactgtcaatacagctggggttcttttccacccagtggcaggttacaaaggaatattaaagatgtttcaaaaactgatataattcaggaaaaataatttaaacaatatgactgcaattatgacatattacaatgaaatacatggcagctagaactaaataggagcccacagaatgatacttagaaatgcatttacatggttactgagttttccccagtagaaaagcaactatcccttcttgctccttattggtacaaaaattatttcagggcccacaaattctaaaagcattacaaagtttgaagaatataaagtaaatggcaattataaaaagtaagggtttatattttacaagccccaatacagcaaggcttagaattagttataaaaactagaggtgtgttacgtcttagagtaggtaacagctggatactgtgtagaataaatgctcatgcccatgggtgggatgttcataatgctgaagggcaagagagagagatgtatagcttgagaagtgatgtggataattgcttgtcattaaacagcagagtaattgctgcagcaaattcccatgtaactattccacatgaaacttcaacgtgcccttggacttactaaacatacatagttttctcagataaaaagacagcagtcaatgatgcaccacacttaaaaagatcattattttattatttagtctcacaaaaaaacattgggaccctaaccattaataacacagagaaaaaaaaagccattgatttttacattagtaagaccttggtaagatctcagaatctactttttcctaacctgctcagactaggtgtctcataaagcctacaataatttaaaagatcgtcacatcttttgaaaagctttcatgtacaatcatgttattcagtattcaaattcataataagccaagatacgaaacatttaagttgctgcaggatgttgagcgctattaagaatgcattaatagagaggattctaggcagctgaagctgtggcagaggtataaatttgaaagtaccaaaatatcctgaaaagaaacagaaacaggaagaggaaaaaaaagagaaggagaagaattaaaactacacaccctatctcaacataactagaaaacaaggaaactccaaacttcaaagtacttgtaaatataaatataaacatcaagacctacctacctctctcatgtgctcctgccagtagccttcatggagaccaagagcagttcaggagaaactacacaaacgagagcagagaggagttaagggcaggttgaaccatgatttaaaaccactgctagaaacagaaagaaactcagcccttggccctatatatactgaaaagtgaacagttagctcagaacactgataacagaaaggagacttgaaaacgcacatgggacatgacaagccaccttgcaaaggcgtcactttggagagaaaagacagctaaaacaacaggagaggtttctttggaaactatacattagagagagaaaaaggggagaacatttcgaattacataaaacaaaagaaaatttaaaaattggaaggcatatgccatttgaaaaccatgccatccagtaaagaaacaatactttgcttacaataacaggagagggtgctcttgaactagaaatgttaagccatcccaacatacagataaacaaaaacctagcataaaaagaaaattgaaaataaggacccaaacaattaaggtgataaaaaattccaccctctcacacaaacaaatggcaagacactggcaagaacagtggcaaaacagaagaaaaccataacactcaaaactaataaatatccataaattctgcaattaggtagatttaaaaaacaaccttgaaataagaattaaaaactaagtagagaaatgaatgaccagaaaattttaaaaggaaaaaataaaacaccaattgattgaacacagaaagaaaagagaagaaaaatacaaaatcacatcagaaatggaacgtaaattacaagatgcccaaggaaaaacagatttgaaagaaaatgcaataagagacactggaaaaatagtagaaaatcaactaaatgaataaaatgaaatagagaaaaaagtaaaaagggtcaaagagaaagtggctgaaatggaagacaggaaaaagaagatacaatttatatataaatggaatttctgaagaagactttttaaaataaaatatgactaataatgaaattctaaccaagaaagtattcaaacacaaacaaccacaacttatatactgaaagggcccactagccacggggtggggggaaaaaaaaaacttgtaacaatcaactcagagacatattttagtaaaagtagtagacattcaagataaaggaaaaatcctcagggaatccaggcaaatgaattcaaacaacatacacaagtaaaagaattagactggcaatagatttatcaaaaataagattcatatccaacaagaggttagtatacaaaatgtacataaagctcaaatgactcaatagcaagaaaaccaaaaatccaatttaaaaatggtcaagatatctgaataaaaatttctcaaaagaagacatacaaatgtccagcagacatatgaaaaaatgttcaacatcgctaatcattagagaaatgcaaattaaagaccacaatgagatatcatcttacacttatcagaatggctattatcaaaaagacaaaagttaacaaatattgacaaggatgtggagaaaagggaatccttgtatactgttggtgcgaatatatattagtatatcgattatgaaaaactgtatggaagttcctcaaaaaactaaaaatagaattagcatatgacccagcaatcccacttctgggtgtttacctaaaagatttgaaatcagtttgttgaagaaatgtctgcattccatgtttattgcagcactattcaccatcgctaagttatggaatcaacctaagtgcccatcaatggatgaatggataaacaaaatgtggtaaatatacacagtgaaattctattcagcccttaaaaagaaggattctgtcatttgtagcagcatgtgtgaaaatggagaacattatgctaagtgaaataaataaggcaaacaaagacaaatatcacgttctcacttatatgtgaaatctacaataacctaactcatagaagcagagagtaggatggtggttaaagcagttcaggcagtaaggaatggggaaatgataaccaaagggtataaaatctcaggagaaatatgctttttttagttctattgcacagcatgatgattatagtcaataatagagtactgcacatcttaaaattgctaagagagtaacattcaaatgttctcaccacaaaaaaaggtatttgaggtattgaatatgttgttaactaacttgatttaattattccacattgtattcatggatcatacatcactttatactccataaatttatacaattataaattatcaatttacaatttttaaaaagattcaaagcaagataccaatggggcagcatttccataaggctccaggaaataaagggaaatccaaggatttgtatatagccaagctgccttcgagtatccaagctataaaaaaagtttttaacatgcaagaattcaaggaattctggatccatgagttcttaaggaatctactagaagatgaccttaacccaacttgttattaactgggaaagttaagcaaaaaaactaatagtatacatatatatatttatttgtaggtataagacacacgggaaaatacatcatgtgctatatgctatatattatgtgctgttttctcaaagtagaaataatgccacaaaaacaataagacaaaaaggctgttttataggcatgaggcaggaactaaagaatatcaataacagccgaataaccagatgttaaaaggtcataatgtttaaatggggaataaggacgttagtaaagaaataagtataaacacatcatctagaccaaaataaaaccttcctagaaaaaaaaacttcaaaaatcgaatagtaaaaaaggttactagagaaagaagccaagcaaatataatatagcgtgcataatatttataatatgacaaaattaaaatcaaaacatcagtcttttcaataattgtgcaggcacttaacctaccaactgaaagaaaatcatataaaatcaaatgcaagccaaaaagcattaaatgtaacaaagaaggacacgttttaacgctaaagccaaaatcacaataaagacatattaaatataaatatctatgtaccaaataatatagtacctttttgtaaaacaaaaactataagagatgccagaagtcccaaaaagaacactaataataggagattttaacatactacttagaacaaggcagatcaataaacatgtaaaatgaaaatttaaaaacacctacaatataactaataaggtagattttatgaatatatgtcaaactttacaccctaaaaataaacttttctctcaaatgcatgtggagcatcacaaaaactgatcatatattaggtgataaggaaaatatcagtatgttctataaaatagtaatgctataagaaatattttctaaccaaaattaaaataaaactagaaattatttaagcactttttaaaaaaggctccttgcgatggttaatactgtcaacttgattggattaaatgaaatcagtctactactccacaatggaggtaagggatatctggaatacaggagatcccttagggtgtctcttagtattaccatgccctctgattaaggtcaatgggaaactacaacagcccaatccagtcagggctacaaatagcccagaccctccaggaatgaaggtttgtgtcactccaccaggaaaaaaacaagacctgctgaggtgcttgctgaaggcaaagggaatacagaatgggtagtagaagaaggtagtcatcaataccagcacgtgaccagttgcacaaacaaggactgtaattgtaatgagtatttcctccttcttttgttaagaacatgtttgtgcatgtatatatttgtacaagaaaatatcttcattttatttcctttttcctttaaatgtgacataagattcattgacttgctatcagcatttaagtgttgttaaccttacataatagcatttgggttggggatttgtgcattcctggttgtacgaaggatagttttattatgttaggcataattatgatattattgtctttatttgaagactatgatttcaggaaatgtatatgggttcaagttgacaaggggtcgacttgtgatggtaaatattgagtggattgtaatattgattggattgaaggatgcaaagctccctaggtgtgtctgtgagggtgctaccaaaggagattaacatttgagagacaaaggagagacagacccaccctcaatcttagtgggcaccatctaattaatcagctgacagtgtagccagaataaaagcaggcagaacatgaaaagactagactggcatagtctcccagcctacatctttctcccgtgctgggtccttcctgcccttgaacattggactccaagttcttcacctttgtaattcggactggcttccttgctccgcagcttgcagatggcctattgtgggacctcaccttgtgatcatgtgagtcaatacaccttaataaactccgctttatatacacatctaacttattagttctctccctctagaaaaccctgatacactcttcaacctgtatatcttcttctagaaaaaaaccttttcttaaacaactcttaggtgaaggggtaaatacaagctaaaagtagaaaatatattttaaacaattataagcacactacatatcaaaaatttttatttttattgatgtaaaatatacatatgtaatttatcatctataccatttttaagtgtataatttggtggtaataaatacatattatatatatatatatttccccccttcatctcctcctcccctcttccacttcccagcctctggtaactacaaatctactctctgtgttcttgacagtcacttttttagctcccacatgaatgtgaacatgttatatttgcctttctgtgcttggcttatttcacttaacaaaacggccttctgtttcatccacgttgctgtacatgataggatttcattcttttttatggcagaataatattccactgggtatatataccacattttctttatgcatgcatcagttgattggcacttaggttgatcaagtatttttaaagcaatggtcagagaaaaattcatagccttaacatttctatcaatgaaattttaaaaataaaaaagaattaaattcccagctcataaaggcattcagggtaataagctaatttgtataacatggcatttcatacatgcatgactaaagaaacagtccccaggtatgctctaggttctcatccttttttcaacttggtcctggcagtgcaaaagacttccagggaatttagctccctagaagttgatggcactgattgcccaagtatgtaagataataccagactactaaaattattgttttttaaaccttcacttgtatttcttccatttccctcacttttcctaacgtctctcagtacacagaaaaaaacaagagaaaggttgattcggggtaatatcagtcaggtaacgatggaattcagaaatttgagacacatctcttctttcttgaggcatatcactcttatactgttaatcattccacagagagctctaacaagaagctttcattggtctttgaatctgtagcaggagcagtttataggccaagtcccataagctcagctgagattcacacttaccgatgctcttctggaatctaaaccttaacactggcataagaagcagaggagacagaaaaagagacctaaaaaaacttttctttatagaaaagatacaaactagagctaggtttcagcctccctcaccttctctttggaacagatcttacatatttaaaaccatatttgatgaaatggatgcatccctttaaatagtaacagatatgaggatgactaccaaatatctctctgttattataagcctggagagtcccaaaaaagtcagccagacaacatgaaatgtaaaatgtctaaagagtggaaatataacaaagctaaatggcaaatggacagggaggaaatatctacagcacaaagatgaaaggttaatattatatagaacaactcaaaataaaaataggtaaaagttatcaacgtgaaatttacaggtgaaataaacatgagaacatgaagatatctccaagatcactaataacttaagaaatacgagaaagtttattgaaatgctgtttatagcagcagtaagtagaaacagcctaaatgtccatcagtaagaaaattactaaaaagactaggaaatacacatatcaaagaacacaacaggacactttaaaagaatgagtttgagctacataaacaacatggaaagttctctaacatttattgtgacatgatgacatttattgtaaatcgtttaaaggtgtgtaatatgcacaagtttgatccttcttataaaacagcaggaaagtatatatttctacatgtatgtatataatttcatggaaatacacaggaataaagttatctgggatgatatacatcaaatgaataataattacctatggggtaggaattgctcttggctaaaaagggtaagaacgttcttgtactttgtacatcaatagatacttacttgatgtttaaattgttttgtcaaaaaaatggtttcaagtatacttaatttcatcttaagtttttgttgttgtttgagaagggatctcactgtgtcatccaggctggagggcagaggcacaatgttggctcactgcagcctcaaactcccaggaagaaatcctcctgcctcagccccccaactagctgagactacaggtgtgtgccgccaggccggctattttttttttttttaagttttttgtagagacagggtcccactatgttgcccaggctggtcttgaactcctgagctcaagcaacccacccacctcagcctcccaaagtgctgggattacaggtgtgagccaccacaccaggccttattttaaagtgaatggaagataaagaaataaaaatattatgtgtttaaaatgttttagatacttttagttatgatgacacttctcaacctaacttgtagtctcaaccatatttttatatgttttatctatctttgatttggggtggatctctcaatactatctttcagcttaaaaattatctctaacagtaaattttctagagtttatcttgtctacagtagtgttttaatttcaattacatttttcaattccacagtttctaataagttctctttcatattcatgcattcatgtttcattctgcctattttgttatataatttcttgctctttctcaatgaaagttctctcttcaattatcttcataataaagcacacttattttatagtattgatcagatctttctgctaaattaattttacccaaaatgaattcatgtttacattattgattaatcaagttgcctttctcagaagtagacttttttttttttttagaattttggtactcagtcttatttatactgaataaggtaaagtggcttaacagaaactagtcttgataaggtaaaccaaataagtgaaaatagtgccaaacacagattcataagcatcatatatatttaatgtcaattgttccaatcttttctcaactccaactttaaattttaatcaagttaatgaaaagcaagcctacattgttattatttaagtctgaatattcggccttcagaaattctgcaaaactttcttggttcagtaagatttctatattaagataaaaaatctatctaatgcaacgaacatccacagctgtcagctaaatgaaatgtctgggttttctttttttaaaaaaagcagagaattataaaaagtaatacactaaatagtttattttaacttagaaacacaaatagatattgatttgcctatcttttaaagttatttgaagatataaaaattatttaagaatagccaataatagaaattatgccataatcaccccattaattactttttttctatcttccatggctcccagcacatattttgcagtatctaactgaaggtattaattaagttatttggatggaaggatggatggatggatggatggatggatggatggatggatggatggatgaaatggaccaatgaatgggcagatggatggacagttgaatgggcaggtaggctgacaaataaaagaatcaaccattcagcaagatgagccaagtctgacctcaaattagttaaacctagagtgtcttagttacccaaggtaaacagagaaactaagtaccatacatgggcagatgtatggacagttgaatgggcaggtaggctgacaaataaatgaatcaaccattcagcaaggtgaaccaagtctgacctcaaattagttaaacctagagtgtcttagttacccaaggcaaacagaaaaactaagtaccatacattcaggattagattttccttcttttccatcaacattagcagaagcaaaaccagcaacagcatcaacaaacattcactaaaaatctgtcatgtgaaggcctctatgaggtttaccagagatacaaagaaataaaaaggactgcctctgcacataatccagttggagagttaaaacacacataaaaggatagattacgattcagggcaacttgtgaaaggtggcaagtaggtgagacagagaacagagtgagacaaaggaagaaggcaagggcagaagcacagtgaaagcacttcatggaggaggcaggacctcaactatggtagagaagagaaagttctgcagtcaaatgcacagtggcagagatgataactgtagggcaaagatgagatcagtttaacagaggagagtgtttgtaggaaagatgtgtagaagttatgtgtgattaaagaatagaagcaaactgtgaaggaaagaaatgctattgctattttttttctccttagcacgttcctccccccctttttttgctatgaatctcaatattttagataagaacattaaagttcaaccatctacccccacccctgtcattctagttacagtaaattgttattgcataaatggggactaggtattctcaataataaactacattggtaaaaataattaatggatatgccataaatcaaacaatcatatataataagtacacttaatagtacaagtttatgaaaaataaattgctttacctacttgggagttagtttaggatcttatagcacaaaaagcacacatgaaggaaataaaaattgttgatccttatctagcatcatttagccagacactgtagtatatgcctctgattatcatttcactaacacttactatatactctgtgaggtattattgtcttgtgaataaagaaatctaggtttgtaatttttatccattaatgagaaagaactagcaatagaaagaattagcaggaattccacattcttgtccctttgccccaatattgcatgcatgtgcacatgcttaagatttgcagttggcaacaagcttcaccaaaaataaattctgtcaatacaactatttatcctgagtctcaagaatattgtcccaggagtcaataactaccttttttcttgatcccagtacactacaagtgagctcctctggattttatttgtacaaacgattcttccttcaaactaaattactgtaaaaacacttaccacaaaggaaattgctaacaaaatcattatctacctcagtacaaactaatgttattactttcaggaaacagaagcaactgaattatataatagaaatattagtttaaaaggtcactggatgtcagaatgtatcattttgcagaagcctcttgagactattcatcagaaattataatgcttagaacatcaaattcaatgccatgattcagcagatctctctcctccctggttcatttagcaccagccatgaagctaagtaaagggaagatagttattctctctgaaaagagagagtatttctctctgaaataattccttccacttgcaattaagaagaattaaaaaaaaagagaggcccatgtaagttgttctttattaatatacacctaataccctacataaatatatagaacatacaccttgacattagctctaggaagaaccagcttagccctacaccgcattttacagatgaagcaactaagacacagtgaagtaaagagtttaaccaatcaaaattgcagaaatagtgactgaaaaaactggaagtaaggaggagtaattaaacaaactacaccactcctctcaactagataaaaactattcagtacaattgaacatgaaacaaagatacaaaagctagtaatgttttcagtcctctatctcattcaaagacttcaactcaactttttattctgtacctatacttgcatagtaaaagaattttggtgaaaattgactagttagccttctgtaatatatcaaaataccttccaaacaccatactgaaaggaactgaggctaaaatagcattcaaaagccatatcaaataaggatgctatgttccaaaacacatggtttaagaactgcacatagccccccagagtgctagttgggattctcaggcaaattatagttgtcaaagaaatatcaattctttgtagatcactgatactaccattctatatacagaatactctagaaacaattcactgtaacatattaaacataatcaagaaactctagtacatgtggaaaaaatagaaaaaaaaagttattgggtatcaaatgaactgaaatccgaaagttcctttttcctgacttcaagttttgtagcatacacagtgcaaaaagaatcattattattgggcaacaaatatatctatagtaattcaatatgatccctgaatatttgacattttttgttctgttacagacttctttgtacttcaaagagatgacagcctgataatacatccattcaactttttcctatgtcaaaggaaaagctgggataaacagaaaaatataaaagatgttattctagttgttcttaaaaaacaaagtaattatatcctatttagattctttaagaattaagactgtgtatgttttcagccaatatgatccctatttcctcaaaacacatctctaatgtccaccatactttcaaatatagaacataatagaaccactttggagaattctttagctgtatctcctagggcagaacatgtatgtacatatcctaggtcccaggaagtccactcctagatttataccaaagagaaattcacaaatgtacaggaaagttcaagcatttgtaatagccaaaaactggaaacaacccaaatgtctattaacaagaggatggaaacataaatcatagaacagtcttacaaaggaatactacatagcaaaaaaacattgaacttctgttataaatagcaggaatgaacctcacctgcacaatggtcagtgaaagaagtcaggcacaaaagagtacttactataagtacgcttttgattaatacacacttctggcaaatctaacctatggagacaaaagtcatctgggtaaagacaggaaggtcacatgagggaggaaatgttctttatcgatattgatcagtgtgataattacatggaccaatactctggaaaagttcatcaagctgtactttcaagatgtgtgcacatttctgtttgtatgatatacttcaatttttaattttcaccaaaaatattaagtatatgttagaatttttcaaagattacattctgcagcaatgaattcagcagagcaatattgagaataattggattctagtaataattcgtctactaatcagctgtgtaatcaatctttaatacaacctaacctctcagtgataattctggtagccaatacatcacacagaaaagttctcaagatattaaatcaattttattcatttaacaaatatttactatgagccactgttctaggcacctgtctcttgcattctaatggagggaaacagaaaatactcagcaaacataatgaatgaatatatgaataaatgatgtaaactgcaatcaatgtttaaaaaaacatagttacatacatatgaatttgtacgtgtatatatacaccaaatgagactttcaatccagtcttaacacacctaaacatatataaatacagaaaggaaactggcttgaaataactatttcattatgatctaaattaaaaccattcccatggtaaatgctcctgcataaatctttataaataattagccttgataacatatgaaatatttaaacatatccttgaaaccacagaggatagagctagaaccaaaaaggcagatttttcaaaggaagaaattagttcaatattgctatggtctgaacgtgtcttccaaaaagcaagttttagaaacttaatcccaatgcaacagggttgaaaggtgaggcctaatgggaggtgtttaggtcatgcaggctccacctttatgcggagattcacactaattacaaaagagtttgaggctgtgtgtttgatctctcaccctcttttgacttctttttgctcttccaccacaagatgaaacagcaagatggccctcaccagatgccagctgctcaatcttagacttcccagactctagaaccatgagccaataaatttctattcattataaattacccagtctcaggtaggctgttatagcggcacaaaacaggccaagacaggtatttaagaaagaactttaagtaaccaaaatattttaaaagacaatattaaaagagagatttgatactggattgtagaggagaaataacttttgtatttgggaggaaggttagatttgacttatagaaaacttccagaacttaaatttgtcaattgggagttttcaatatatactaaaatattatatttttataaaatcttttttgcatatatacaaaatacaaagaacaaaggttggctgggcacagtggctcacgcctgtaatcccagcaccttgggaggccgaggtgagcagatcaagaggtcaggagatcgagaccatcctggtcaacatggtgaaaccctgtctctactaaaaatacaaaaattagctgggcgtggtggcacgtgcctgtaatcccagctactcaggaggctgaggtaggagaatcccttgaaccagggagttggaggttgcagtgagccgagatctcaacactgcactccagtctggcgacagagtgagactccatctcaaaaaaaaagaataaaggtcatatacaattttacactggtaataaactgacatttgaatttctctgtattatcttattgatcttaaaaatgctattataattacgcaaatataattatatataattttctgttcattattcaacgagcattgtctagaagtattttaaatatgtcaactttcactgtaattctagctagcttaaaatttttgtagtagtaagtattcactctttcaaagatacacgaatctctaaaaagttatatgatttctttaaaatttaacacccttctaacataaaagttatgcaaaaccccagcaaactaccaaaacaaaccatgtatatgctaaactcaaattgcctaaaaatttaaataacagaataaagtagcaataagattcagtgaggacctgtttataccactccctggtagtttcaaacagtctcattgattaaacctaaccaagctgaaaatccttgcaactacctattatgcatactagacttttgcagaatattatcaacaaatatttattgagtggttgtatccctttccaatctattattcacactacaattacaaggatctttgttaaatgttaattgtatcaagtcatgcctcttctaaaaatcataaatggccccctgtctaccacaacattatatctaagttcttaaaatggctcttggagtattataacatgccctgctcacttctgtgacttttcctttctctagtctctctgaactaaactcttcaactacagggatccaacttcaactcctcttctgagcttttcagattctggctctaatcacaagctatcacctctgcctaccacactatatcctgtcctttctaacttccactcggccttcactattcagctgagacatgacattcacccagaatcctttcctggctcccggcgcacccagtgcttcactccttcagcaaccacatagtgtgtaatgtcccgtcttctccactatcagcaagagagggaccatttctctgtgtccctgctctatatacaatggcacttagtaaactcagtatctttttaatacatgagtgaaagatatcaatgccagccccatgctgagtccttgagacataacatagaataaaaatgtatttcctgcacagagaatttgatggtctaggtgttcatttacatttgaaaaggcagggtgaaacagaaagtaaccttgtgatcaccataaactcttcaagctttattttcctcttctgtaaagtgaggaaccttcaccaccccattttgtggtacaaccatcatttactgatcaaaacagaaaactgatcgtggtcattgtttcttctctctccctgaaacgctatttcccatacaacccaaaaagtctcggtatgaacctgcaaagggatattttgaatctgaccacttatctccattttttctatactcacagtaatccacttcccctctcttagacctctaaatgcattatttccattcttgccccatccaatttattttaatatagagctgtcaaactataaatagaagtcactttacttaaaatctctctcaatgacttcctaccatcctattaatgatctgatttctactgacctctccaaacatacctccaccagctttgtcctagtaaagctccagccacatggcctcctccagatcttgcaacatgccaagttttttccacctcagaacctttatacatgctgttcattctggctagcacattcttcccttcactttgtgtatgcctgcttccttttcttccttcagtttcaatgtaatacctcttgaaatagactttccttggacaccatatctaaactgaactctcaatctgtattcctgtttttctctattacccattcactgatctttccttctttgttcttcagcatattcccaatagatagagccatgtctggcatacagtagaaagactaaaaatgatttaggaaggaagcaaaaaggcagggaagctgtctataggtgtaatatatgcagactattttgatgtgaacacaaggttcttattttctctaaatttcaccttcaacagcctaacacccatcagtagagatggataaatgccttctgttttgaacactaccgttcatacataagttacctgagattaagtcatgtattaacatgtatcaatatagctgagtttttaaaagtagatcgctgttaccttaggaaggacaaacaggagaatggaggaaaagaagataaaacactggagaattttaataagagagaacaagtcgacaaagttctgaaaatgaagtggcacctaaaggcaccaggaagaggccacagtgataaatctctggaggagaatatgaggcaaaacaacatttaagtcccagaaacccagggactcaactcgggtataacagtagtaaaactgacagggcagaggtagtagtaaagataaaccctgagtaactcacatacagttttccttagagttttattgaacagatttattaagaatgaaaactggaaatttcatataatatcacataaaacattatccacattttaagattcaataaattcctttatcactcctgggcaaatctaatattactaaatgtgtaatattactaatttgaggtcaagtaaaaattccaagtagacagatttttacatcaaactattttagttgtgcttcattagaaagctcaacatgatcaggttcatttcctcttggtcacctgaggcacaatttgctacccaccactctgcaataagcagctgtttgcaataagccctatgttgcacacattggactgtctcctggggtttacaggatgttgattcctaaaggccagatttaacactttggggaaatataaaagacagcatgcaaatacagaagaagaaataatgtatggtatttgattatttgaggactgcaacatattacaggaattggttaccacagaaactgtgatctgtaaatggtccaggtggaatatgcttgaaaataacatgatatgcaaaaactgagttgactcatagaacatcagaggaggctagtgcaatggagattatctagtgggattctggctagtggctaacaagtctagctctgtattcaaagtactaatgtcccatttgacaatcctgactggtgaacatcaggcctccaccaaaatagctgctatactgtccaggtcattttaaggcagctctgttatggaattcttcatattgagtgaaaaacctacctaaactctttaatatacacccatgtggctatgctccttagagccaagagaataaactgaattcatcttccacatctccacaaatacttggaagcagctattgcatatcctcttgcctcagttttcttgtcttcagattaaatagctatagcttattcaatttcaaccattactgcaagacataacattgggttatttcaattacctaaccactctcttctaaatatgttgtcattgctatatttcaatgatcaaagacaaatacactaagtcaacgataagaaccatcatatgtagtaagtgctttgtatgtcttatttcagtaaagcctaatatggaagacattataatcaccaacttataaatgaagatactgaggattacagaaatagaaatacttgctagaggctatattgggagtaacaaagtcaggaattgaacccatgttgactccactatgccctaacccttgtcctgggctatttcaggagagacctaagcagagcagaggagagaagggggtaagagacactactgagcatctgttagatccagaatctgttattcaatatgtaagctgactcatatattcaaactatctatgcaatcaacataccaactacatttttctccaagtagtttggatggagccttccaaatgatccaggaaaaagtgtgaacttacctcacacttacaggcccactgagttttttaagtgataaaatttatactttcactatggtattttaaaagatccctctggaagtatacatggacagataaacagaaagccacactagagactgagagcttatagctctgaggtgagccaagacaagaagctgactagattacaggtgtgtagatggaacaatatttatgaattcaagagagatttttaaaagcagaactgacagtacttggtgatgctttagatttgtaagctgtggtatagcagtgacttagaatgtggctctggtcagactctgggctttaaattccagctacaccactttaatttgtgtgaatgaagctatactttggtttctgtaactgtgacataggcacaagagcacctaactcatagagatgctggcaaaattaactgtgataatagatggcagagggtttaaaaagtctctgtctcataagaaatgttcactaatcactaatgtgattgataaggagaagaaggaaaaaaaagaagagaggtgggaaaaggcagtctagaacgactgccaagtctctgcttaggtgaatgaataaactcagagagaacagaggcagaaaggctggcttgaggaagaagaattttgttctgaatgtgatgggcttgaggtatgtgacaggcatacagatagcaatagattgaagaatatggagtgtcagcagggtagtctagccttttaaagaagcttggttaagaaggaaagcagagaggatgtaagggccagaggagggaagtgacttatttttatgggtacacaagcaagttagagtttgaaagagaaatgccagaagacagggaggggttgaaggtaaaaacgattaagaagtggacgaaaccagtctccaagggacaaggtcaggaattaaactcatgttttgctccaaagcccctaccctaactcctgacctgactacttgagcagaaaccaagccagggcagaagagagaatggataaccagagaaacaggctaagagcacaagaataagcttcaagcaggactaagaggaacagtaggaaagagggaaggatggctacagagaggaagcctctctccggtgttcatatttcccaatcacctgagatcagctccaaggaggttggggagtagagggttgggcttgagtatgattatcagatttagaatatatgaaaaaaacaggagagaaagggacaaaagaaaagccattcctgcaatgagcttctactcaatctttcaaggcccaattccattgtgtgtcatctgtgacatagttccccacctttcctctttcataaatgaaatttatctctcacagaaaattttattttaaaaagttctatcaagactggattaagaaaatgtggcacatatacaccatggaatactatgcagccataaaaaaaaggatgagttcatgtcctttgtagggacatggatgcagctggaaaccatcactctgagcaaactatcgcaaggacagaaaaccaaatactgcatgttctcactcataggtgggaactgaacaatgagaacacttggacacagggtggggaacatcacacactggagcctgtcgtggggtggggggaggggggagggatagcattaggagatagacctaatgtaaatgatgagttgatgggtgcagcacaccaacatggcacatgtatacatacgtaacaaacctgcacattgtgcacatgtaccctagaacttaaagtataataaaaaaaaagttctatcaaagtatttatgaagatgaaatacttctaaagtgcttatataaaatctttatatgagaagattttatcttcataaatacgtctctccaactaggtcacattttgtttaatgctaaattctcatccactccctaaaacacagtagatgttcatgttttcttaaaaagactgagccagttttcggtccatctaactatactctaatacacttccttctccatttcagtatgttagaaaccaaatgatgcagtttttgagaataacaaataaagaaaacctgcaaaattgtcctaatagcaaacagttaacatgagtctgccctacgaataagatcattgcttccaaacgtttttaaaatactcccaatggtattattagtatcatttatagaactagacttgtgtgatagtctttagaaactgttaagatagcattaaaatatatctcataggtccctcgatgctctcctggtacaaaatgaacctgtgccatttacatattagctgactctgacatccaagggttctggtatctgaaagcaatgaatatgacttcttctgtccatcttatgtgtatctcataagctcctaaggactttcctggaaagattttagactagcaaagaaatattttcttcatcaaaaatcctttcaagtatttatttccttcccaagtagactgagttctgtgtgtactggttaatactttataagcttcagcttgcatgcagaacacatcagaggctgttttatttccagacatagttttcctgaaattttaattgtttgccatgaggaaaaaaatgatttcagagctcaaactacattacctacgaggagtctcccagagctctaattaccagaatcagaacataggattgctacttcaattccatttttcactaaaatattggcaaaataacaaattaaataaaattatggctaatgttaataacaataaattatttaacaaatatgaaggagcacctatgttgagcagctgctatgttaggcattgggatggtaaccaaaatgcatgaaacattgtttccactcccccaagaattttacaggcaagtgggatgcaatatacctcactatggaaaaaaaagtgagacagcaaaaaatagttttaaatttttgagcaaagtttaaccaaatgcaacccagttaatttacatcaggtgcctttctctttaaatttcaaatgataaaagtcagcttctccctctaaacttcaataaggcaaataaatatttcttggctttcatgaagccctaggagccttaactatgcaacagttcattcactaagaatgcctgtagaggaagaagggtagtcaggtggtaccagcaaggggagtagaatgaagtccctgctttaaagagagacaagagctagataaaacagccactgaaagaaaggaaaggaaggggaggccaaagaaaatacatggcttctcttagtagggccaaatcatgaggcccaatccagccttctagcttgacttcctctcctattgtctctcaggagccctctccctgttctagtcaaaataaatgtctcttctctgatgtagaataagagtccccgacccacacccaatatcatggctctcatctactgcatgtgagctcattactttatttatcaaaacaaagatggtccttttttttttttttgagacggagtttagctcttattgcctagactggagtgcagtggtgcgatctcagctcactgcaacctccatcttctgctttcaagggattctcctgcctcaccctcccaagtagcttggattacacgtgcacgccaccatgccaggctaatttttgtatttttagtagagagggggtttcaccatgttggccaggctggtctcgaaatcctgacctcgtgatccacctgcctcagcctcccaaagtgctgggattataggcgtgagccaccacacctggcccagatgttcccttcttaaaaggaatcctgatgttaactattaaaataataaactatattacatatcatcaagcttgcatatatacatatatatatatatatatagttggacttatctttattttttaaatattagtgtatattattataaattgttaggctatgaactcattgaacagggccatcttagtgtccccagatcctaaagcagtacacagtaggtgttcaacacactgtaatgttacaatattccttcctcagataggggggtctaggcatataataattatctgcattttatatgatcattcttcataaataatcatagccacaatagcagcttttatctgaagtcgtgtattgattcagagaaggtttcagcttgacctcaccatagaatatcaacttttcacttcctttctatagagtattttatactataggaaaagagactctaacacctcttccaaaaataatccataacatttaatagtttattcatagtcaccatgaggactttgacctctcatcttttgtatctatttttaattgtgttagaggccacattaccctaatttccttacaaagtttccacttagaccaaaaccgtgaatactgtaattgttggggatgatgaattagatgaaaaatagactatgcattttcaatcattgcatttagtattattagggtagatggccaactattacacagtaagagatgaaagtacaatgcaaattgatgaagaaatcataatcttaaaattttcaacaacaggctggtattgattttgatgtgaaagtaaaaagcttacttaatacattttttgctcaattcgctattgcgtgtacactgggaaaaatatcttgcattctataccaacccattaaatcaaaatgaatgaggggagcatttttattttatttatttatttatttatttttgagacggagtcttgctctgtcacccaggctggagtgcagtggcgcaatctctgctcaccgcaacctccgcctcctgggttcaagcgattctcctgcctcagcctctcgagtagctgagattacagacgcgtgccaccacgcccagctaatttttgtatttttagtagagacggggtttcaccatgttgaccaggctggtcttgaactcctgacctcgtgatctgcccacctcagcctcccaaagttctgggattacaggtgtgagccaccgcacccggcccatcttttttacttacactgcactgtgtaactcccaattcctgatgatagccagctacaggagcaattcatcaccaacatcattttatcatcaagttctttcatatctgataaaacctattcctttctgacatatgtaaatttcaaatgagtgctacagataaaaattgttaaataagtggctataatgtgattccaaaaacaaaaggcacccactcactgtactttgttatctaattacatgatcattctgttaaacttcaagcaatgtatttgaaataagaaagtgcagacatattgtccatctcaatttcataaatgttgtatcatatatccaatgcatatcactttaaattttttcaacctgcatatttcaagacagctgctacacagtactttaatttttcctgtttgatatattaacatgcagctgaatctgatttggttacaacttctcagtgaaaaagatgttcatctacttaaacatcagtttcaacagaatggcacttgacagagaatatttcctttttctgtactactttttccagttgcattttatatcagtatgcttcccattaacacaacaaatatatacataaaaccaagacatatgtgtaaaaggtataaatgcagtcaattagccagatgtttggaatcatggacacaaacatcagaagcattataaaacctacaggaatggtaatgcttgacaggatatgggagaagtattttttaagaaaaccttataaacatagtacaaagatgacaaagacacaattatagcccactgcagccctgaactcctgggttcaagcaatcccctggcttagcctcccaagtagctgggtaatgcaggtacatgccaccatgcacaactaactttttttttttttttttttttgatagagatggggtatcactgtgttgaccaggctgatctaaaactcctggccttgagtaatcattgtgcctcaaccttctaaagtactgagattataggcatgagccactgtgcctggtcatactgttttctgcaatagaacttacctcctctctctcatgcttctgtagcaccaagtatcagaaaacataatctagtcatttctagataagcttacatcattctgattttcctcagtaatttctgcatatgctcatcttaagaattcatgacttctcatccttctcttccctaaggtgagggttacgtggtgagggaagttcacacagcagccgcatggtatcggtgagaggcattggacctgtagcactctgatttggcacctgtcaagtctctagtcacagcatttgtgtgatcgggttttcagtgaactatctgtagtcttagtagactctaatcatgtattccatactaccattcctggcttcttctcaacattactgtgaggtcctttaaagcactggtcttgcatccagctcccttgttctgcccaaaagtgcatgaagtctcaactgccttcctgggcccataggagcctgctaactatcttctacctgctttatctacagacttctctcatatagttaaccatctccatctaagtgataccatgtcattcaatatgggacacacccatgacattgttgcttcacaaaattccagaagaagcaggctgtgcagccattccaactctgccaccagcacactatcatcagacaggggccttagataacgcttgccatcccctggctttcacctggagagtgaagcacaaatctccaatgctcaaatcttcaactaaagggagcttctatcattatccctggtctcaggctgtagaggaaagaaaggcagaacacagggctgccatgtctcctgaaccttgtttcaactccccttctaaccaaggcaacacttatttaataatgtgatgagatcatctcactctttggctaatttctttccaatctgttgttaaaagttaaaataaaaataaatttatgcactgatatcttcagagctttattttaaaaactcaaaacccttttctatttcatatagctcagctgcttgaaatacactatcttgtgtgtcaagattattaagccaactagaagtttcaggagcctacttagaactcagaaaaaagaaacttaacttttctttattgcattaacactcttctctgaaaaaacattgtaatggcaataaggttccgtccagttcagtgggaaaagggctatgggtattgaaaacatatacagactacatatatacataaatatacacatacacaaaaaaggactttctcagaatatacaacttaatatatcaaaagactatctttatacatttttatgatagacaccataaacatagtcagctatatatgttacataagttatgaatagaaaacactggttttatccacatatttcttctttctccttcttctgtgtcttctgaaaacatttgaaatatcaaccatagctgcctacatagggtcctctgacagaatattaggtgataaaatggtataaggagacatataattgaagtggtaagaccagatattactcagagagaatgtaaaatcaataaagagtagaacatcaagctttatatttaggaaaaatggggacagaataactctgataccaaaaaatgaaaaaagacatcaggaaaaaactacagaaccttatttataaatataggtacaaattttccaaataaaatcttgataaatccagctgaatagttaaaaatatgaccaaataagatttaatccaggaatgtaagacaggtaaatttaaagatacctattaaggtaacatatttaccacattaacagataaatagagaacatatatattaccatctttattgatacctagtatcaaaggccaaagtacttgaaaatctaatttccacctaaggtaaacaaacagcaaccgacaacgaaaataaagctcttgaccaactggaaatagacaggaaaaatcttatttgataacatatgaggagcctaagggaaatattacattaaatgataaatatcagaaggatgcccatgaaagtcaagagggacgagaggttctagtcaacaaagaaaaaaaattgagatgtataaggctttaaaaaaaaaagaaagaaaatgtgttattttgaataatatgactacctagaaacacacagacaataaacttaaaaatataaataagaatattctgaaatatggttggaatcaagatcaacattaatggccttcttatacacagaaataagcaactggaagacttattggaaagaatattttttaacaataacaaaaaaatatggaaaacctagaaataaacctaagaaggaatgtgcaaagtttatatgaagacaactataaaatttaaccaaaggaaatacaagaagttctgaaaaatgaagatacgccattcattcgacaaaaagttaaatccctaccctatcctggaccctaatctcaatagaataaacacagctatataggtactagaataaaatattagagaataaagagaaagtgaaggatctgaaaaggatactactggggaaacgtactaatgaatttagtttttcccaaggtaatctttagcagcagcatccatgaataacttttatgaatgtccaatttataatacagtactctaaaactgacagtttttattgaatataaagaacaatggttgcctgtgaaaagtgaaattaaattttcttcttaaaagttcctttattttttacaatgtacatcgaattttttaaaaatcaaaatgaataaatttttaaaagttaaaaatataatgtacataataatactaatgcatgacatcagtttggtgaaatatttttcttatataaattaattatgaaaattagcaatttatacactataaatctttaaccagatactgtataaataaaaagtgttattactcttcaaaacttcttcaatgtaaattgtaatattgggctttattacttaatgtatagaatctgtgtatatcctcttaattagtaatttcagatattttttcaaaatttctcttcttcagttattctcataaatacccaccagttttaagagcaattttgaaaacttctactcaaaacagaaaaacaataaaaaaacagggaaaaaatagaatagaaaaaccttctggtcactcataagatgtacagaaatgttgttcatgagtaatcttttaaatgttcacctctatatcaaatgtaatttattttctactctctgagcaatgatccaaacatatttgaagctatttttttaactaaggagaacatacaattagtctattttgattttgcttcatatttcaaaggtttgtgtttaagctttattaatagtgctctttaagttattttcctcccaataggtctttaattacatgtatctgaaaatacaaagtctaattctgttagaaaacttaatgattcttaaaatatttgctttcatgagtatatgattatctgaaaaacaaactccaaagggcaataattaagcgacatggggttccacataggcagaatttagaaaattaaactaattttctattttatttaatttaaacattaaatttaaatttagaaaattaaacatacaccatatatatatacacagaaaacttcatattgaataaaatacaatcagctataaagtagattaacagactcagattccttttaggctagtaaatttgactcattcaacatgttcagatgcagttggcccactgtatccatgggttcctcatctgtggattcaagcaaccaaggattgaaaatattcaaaaaaaaatttgcatctcttaacatgtatagactttttgttcttgtcattatcccccaaacaatatagtataataactatttatatagtatttacattctattaggaaatatatgtaatctagaggtgactttaagtataagaaaggatctacataggttataagcaaatactacactatgttatatcagggatttgagcatcctcggattctggtatcaagggaggtcctagaccagtccctcacagatacagaggaatgactgcaaccccttattcaacgttaaatcccaattgtacgctttttagtgtagcactgaaaagttttagaagaattctcatataaacaatgctataaagttaactttccagataaactgaaataaaactggtttttaaaaaaagaaagaattgacaattttatagttatttttattcataagattttaaaagcatatataggctgggctcagtggctcatgcctgtaatccctgcactttgggaggctgaggtaggcggatcacctaaggtcaagagttcaagactagcctggccaacacggtgaaaccctatctccactaaaaatacaaaaattagccaggcgttgtggtgggtgcctgtaattccaactactcaggaggctgaggcaggagaagcgcttgaaccaggaggttgcagtgagcccgagatggtgccattgcactccagcctgggcaacaagagtgaaactctgtctcaaaaaaaaagcacatatatgcaagctacaagattactatcaactggtacagtactttataaactacaaactcatctttgccctaggattaatcactaaccacttcaagaaggaatgtggacacagactggcccactgtagcatttaaagttttttggctaaatacacacatctgtgttgttcttttcaaaccgtcaagatataaaactcatttaaaacctatttttaaataccatgcagcaatgatcccttagaggcagcaactttagatgatgcttaaacaatgaattttttttccaacaataacaattttctttaaattcatttacaaaacctcaccacacagcatgaggtatactttcctggtaagcaactataaagtagaattaactatcctcaaatgaccatgaaattaagtcagccatatcagattaagatgaccataaatgcagttaaaaccatgctaatttacatagccccctaaccatgtttaattgccacattaaaaacccttcagatgctggtctgtccttttacaacttagaacagtgtcacctgaattaacttgttttgtctgaatgttgcactttgttttttcatttatatagctgggaacattcatgagctctagttattatgtctaaatatttttattaaacagaataaaataatcaaatctatcaaactggttttaatgaagtaagcaatgcatttttaaaaggaagtactctcttagccctaagcaacatgagtcatcatgaagaaattatatatatatatacttatccatttctatctggtacttttaaccatgtggggcatgccaatcttcccatgagcatggaaactgaaagtaacccaagggcactagccagctttggaattactgctataatgcctcctacaccacacccatcacactcccatactctgatttctgcaagccacagcaagccaaggttttcaccctagggcattctggactcttttgataccctatctcagagtagaaacccaatctttgtactgggctgtcaaccattcactttttagattcagagtacataatcatttggcttgtttttgctataccctctgggtgcctcacactctagaatgaactatttgatttgctgacatctagtatgtttagatttcccttcctttctggactactctttcacgtttcctcacctaccccacagcctcagatgcattatcttactaccctctattctcagctcctcaatgaccaggatataaccaggaactgaggataaatcatttattccacttgttacttaggcaaccccgaaacgttaatgaaagcatcttttgccatcatgtattatatagaatcttcagtaagcagcaatgcataacaagacaaaagtgactgattctgacctacctaaggaaaaaaaatcacattatcttgtgattatcttggcttcttccctaacacaataatctttggttaccataatgcctaagctcaattagaagtcagaaaccccaaagtatccacaccaggcagcaaagcaagaataatcaagattgacatatttcaacacacatatagttgcactgaaaggctcccttaaccaattcaccagacaaccccacccccaaaagaattatgcatgggtgaaatttctatagtttttgcactaaaagtaaagtcttcccatggctgccagaaatcaccaatatgaccgttctcattgttgatcttatgctgttatagcaaccaagggagacaactggaaatgggagaaagtctcttttagactgatgaaaattaacaagggacagaaatcaagatagtaaaggaaggagaaggtgctgtgatttagccagagataatcattgtcgacatactattatatttcattttagatctttttcctaggtgtgcagattagtgtactcaactccatttcagttgtgttctttcatgcacgctaagttagatagctagaacaaaagctaagctagaaagctaaagtttatttcctagacttcctgacagttagatgttggcacatcacctagctcttgccaagccgatacactggcattactttggaaggcaaggttaacacggtgagacagaggctggctgctgttgcctctgctgtttttactggcaaggtcagtgatacaaaaatttgatttttctgcaacgtagatctgaatgtccaaactctactttcatgaaaacaaaagctagggccagggcatccatgtgaggtggcctcctaattctccaggtttttgtttgtttgtttgttttaatgagacagagtctctctctgtcacccaggctggagtgcagtggcataatctcagctcactgcaacttccacctcccaggttcaacagattctcctgcctcagcctcctgagtagctgggattataggcacccgccaccactcctggctaatttttgtatttttagtagagacggggtttcaccatattggcccatctggtctggaactcctgaccccaagtaacccacctgcctcagcctcccaaagtgctggaattacagacgtaagtcaccgtgcccggcctctccaggttcataaacaccacagaaattgcagcttccttagccacctataaaatgagcagccactactccaagcagaaacatgctcattggttgttaagcaagaaataaactttcattgtgtttgaaccattatgcattttttaatctctttgttacataagctagtggttaccctaactgataaagagtccaataaatatttattgaatgaatgttaaagaagaggaaataaatgcaagaagtaggtggagggagggtgggaaagatggtgaaagataaatagatggttaaggatcttgattttttaaagaattaatgggataaatgttctcttggagtacagaattatttcatactattataattactaaattaataataacctatttgaatttcttttctattggtttttcagtataacatctgttcacaattcctatcctgttgaaatttatactctaatccactccataaattttaaaaaatggttttggtttctgattacaatttcgccataatgtgattacaatttcgccataatgtcattacaaatccaaaagtaagggaaagtcctccataatacatggagctaaaatcaaatacagacatcaacataatacatatgcaaaaactagatttccattttattacatgcatactaattattaaaatgtaacacttttgataatattttaaagcagtgtccccatagtgtgctctgaagacgccactctgatggtccccatgaaccttgcagggggtccataaggcctccctttcccaagtacatacctgtgtgagggaagattgttttcatacatactccaaatcaaataacattacacaacatattgaatgcaaaagcagatatgagaatccacctgtttgtattcggccagatattgaagagatttatgaaaatctaaaacaggcctggggcacagtggctcttgcctgtaatcccagcacttttggaagctgaggtagaaggattgcttgaacccaggagtttgagaccagcctgggcaacatagcaagacctcatctctacaaaaaataaaaaaattagtcaagcatggtggcacatatctatagtcccagatacttgggatgctgaggcaggagaatcacttgagcccaggaagtcaaggctgcagtgagctatgattatgctgctgcactatagcctgggcgacagagcgataccttgtttcaaaaaaacaaagaacaaagcaaaagtaaaatagtgccctcttctcactaaatatttttgttttgaaatatatagttatttttcataaaactgtcgtatttatgttgatacataataaatatttttatttttaaatgatgaatatatattttaaattttctcaatcttaatttccaatatgctaaatattgatgaaactaacccacagaacagaagctctttagggtcctaaatttttaagagtttaatgaaccataaataaactagtgaaatcctgtaacaatgccaggattccttttattaatagtaaacaataaactatatttaaatatagccaattttctatatgtacaaaatgctaggcagccttcctattgctgtagtagaaataacatggcattgaacacatgggtttaaataccagtttcataacttattaactgtgtgggcatctgttccctattattctcactgctaccattacaacaaactcaacgttatgcatatcaaaactaaaattgttgcattttgcaagcattcttgaagatttaattgtgcaggattatagagagtaatttatatataattatatacacttactaattcaattatctgggagtatattttagctaactcactattcagagttatactttctatagtagcagttgcagcataactgagtattcttaaagcaagcaattaataaactccaacataaaatttttccttgccaaattatatctgtcttgttctatcgaaactcaacaaaacatttacttgttcaagggactatgttgatccaaagatttcccttcaggaaaatgctggtgctgcctagggatactagtagctttccataaaaaaagtgttcaactaagagagctgtccaggccactcatctttgataacagaagttcagctttatcataacctgtatgtcaggcatccaaaacctaggaaactactcttcattactaacaagataataacctttcagtaggtattatctcaattctttttctcatctacattttacaaaatggtttgttgaagaaagttaggttctaaaaaggaagctctaaaacaatagtcttcattttttttctctcatattcctaaaagaattttctaaaaatacacaacatacattttcagttgacatgtaaaaattttcatcatgaatttaaatgattgcaaaggctataatttctagcatgttacaaatactgccatttttatataaaactgttataccagtcttttaagagtaccaaagaaatctaacttccacagtaatctgatatacaccagcaaccattttatcaaaaaaaaattcaagagttagaaaatttatacacacttttttgcttaaactcatttccagttatctccccataggattttaccctaatgtaatcgtttttatttctaaaagtttttaactgatcctctatcatacttctcttcaataaaaatgtaccttaaaattgaacttttaaattgtgtttaattttctaaaactgtaatgttcaaactaagaaatatatggaaatgtatttcttaatgagaagggctagatttttttcttttttaaaatagtttataggcctctgaatgaatgttactcattgctagtataaggtttcacatacattttttttctattttttattttctctgtttatgaaagaactgaaactgttcactaagtagatgagaaggatgttttgttatggcaatgttactaaatccttcaaaatcacatagcttattaaaaatatttgatgtgtgaaaactatcagctgttaactcaattacatctcccttaagtctgttgaaaccgaagaattagaaaccatatgagttgcaaaaggattttttaccttgagtttaggtcattcactttttcaataccaataccaataccaatacttctagctaatcctctgctatcatgatgcaagggaattttccatcctggagaagtgtacaatgagaagatctgggaggggcgagaagtctgccttgcttgttgtaacatgagtcaagagcaattctgaaaggggagttaggaaaggaaaagctgctttcactgtctttcacaggaggaccaattttaggacagactatggaaactgaggacttagattccttcaaaatcaactatgtgcaaccttggcaaacaatcatatacaaatttgaagacctcaaatctaagggacactattccttcactactccaagtgttttaaatcccttctctctgtctctttttttcatacacacatgaatgcaagccaaagcccattcacagaaaacaatcatataaggcacatctttgcatttattataaaattattgttggtgccacaataatcacaatactgaataagctctaaatccttgctactcaaagtatggacttcaggacaagagcataaagcatcataaccctgttagaaatgtggaatttggggccccattccaaacatactgaatcagaatctaattttaacaaaatctccaagtgatccctatgcagacaaaagtttgagaagcacggacctaagaagcagagaaataatttttaaaaatgtagtttgtaaaaaacatacctcttgtagaaataatatttcctcctttttgatcataataaagtaaccctcatgtttccatttttgtcaatcttactagcaccagccagtgtatttcctaagaccgttaaggcttgaagtaaaaaatatattggaaatgtatctcttcctcattatcctggatttctggagtgttagtctagctgatttgtctgcctacggtctttccccccttcaatccatcctctgcacagctgcaagagtagaatttatataacaaatctaatcataggactctcctgttttaaaaccttcaaggtatctccaaattaaaatacaagcatataaggacaagattacctgatccctattgacctctctagcctcatctcccaaccacctcccattttctcctgtacttactcttttagctccctgtacacaccacgtggttttatgcattacctttccatcatgttgtcccttaccagaatatccattccctatttattgcctagctgattatcacctgtgcctaaaggttcgattcagtaatcttcttttccagaaaactttcatgtaagatccccccccacacacacacatctacccctttatacacatacaatgggcaaaggttattttctttgtactgtcacagcacttaccattttgtatttaaataatatatttatatctctgtttctctatatagacagtaacctcttctaaggactaacaaaattaacagcacaaagcaggtgctaaacattaaaagtcaaattgaataaaacaaaacgtgattgttaatcataagaattgtaatagccagctcttataattagcatattcacttctctattcatatgcttttagtgttcttatgtcatctgctagttatcattttacttttattttggtttaaaaaaaatctacctcaattcttttttttgcaactaggcagagtatacatacgtatatagagcacagctctgtgactttggtgaaattacataatgtgtcttagtcacagttcctttattaataaaatggtaattacaggatcatattcagtaggtaggattaaatgaggatgctatagtcccagctactcggcaggctgagacacaagaatcacctgagccctggaggcagaggttgcagtgagtcaagattgcgccactgcactccagcttgggctacagagtgagactcggtctcaaaaaaaaaaaaaaaaggattcatgtgaaatattttatataaactataaacattggccaggcacggtgactcactcctgtaatcccagcactttgggacgccaaggcaggcgaatcacttgaggtcaggagatcaagaacagcctgggcaacatggtgaaaccccacctctattaaaaatacaaaaatcagccaggtgtggtggcaggcgctgtaatcccagctaccagggaggctgaggcaggagaatcgcttgaacccaggaggtggaggttgcagtgagccaagatcataccacttcactccaacctgggcgacagagtgagactctgtcaaaaaaaaaaaaaatctataaacattatatacataagtaataaaaattgcttattttattaaaatcatccattataacaaaaagtacagtggttagaactctaaacaacaggaaataccttaagaaataagataaactttaaataagaaggtcttaacctttctgctgctgaacttttaaaattgaattcagtataaaattaataccccgcagtggcctttgcacaatcctatatctccttagtttcctgtacttcacgaaagatgtaggagaaataagtgattatttgaaactgttcaggttttgaaacacaatctgctatcatgaatatttcatttcttgaaaatattttcatgcttatccttttcaataatgccacatcataatgctttatttcatctgcctgtgacagacatcattactaatcctatatagctgcttgtttcacgccacgctagagcagctattgaatttcctacaacatggcagccagtcctgacattcatatgaagaatactatgataaatatataaaggactataaataaggcaacaagaattaaaacatcataggttctgaaggtggcatcttgacttaattgaaagaaactcaatacataaccaaagctgaaggatgaaaaggagaaacaattaccaactagtttataaaccacaatttaatcaacttacagggcaaataaacctagcactcagatcttgttgaaaccgatttttatgaaacttggttttatgaaacttggtttttaatgccattcctcaccaaaaagaatcatggcttctggagaaatggctagcttcagggctagatagagaaggtacacaattatcctggagcaccttgctatgccaaaaagtaaggaaatgctcaaaaatgattttttaaaacctatcacaaagacttagaattataaaccaccagtaaaaaaattttctaataaaaagtagaaggaaatgaggaagaagggatgactggtagagcaggatgctgaagactgactagtaaatgaagaggaaatactggcactggtacatcatcattttgcaaccatgacaataaagcctggtccaggcaagaattattagtagatgctaaatcaagaagagaaatttacatgcacggtctctgagtatctccccatggattgctcattaatagcaaggggataagtagtaactaaaaaatagagaaactagacagtaccttgaccagataaatactgagagcttccagatgcgatgcctggaaaaggaaaatcatttatataatatcctggctaggaatgcaaaatctgaacttaactcatgagaaaacatcaaacagacctcaaatgagaagcattctattaaaaaaagaaagaaaaaaaaaaaaagaaagagcaagggcgctgtattcttcaaatatatcagtgttataaaagacaaaaaagcaagctgaagaattgttatagattaaagattaaaagagattaaagagacctgaaaaccaagtacaatacacggctccatgctggatcctgtactggagagaaacaaaaagcaaatgtttataaactacattactaggtacactgacaaaattcaaatatgaatggtaagttaggtaatggcaatatattaatgttaaatttactgacactggatattatactgtgattatataaataaaatgccttaatcttaggaaattgcattgcgatatttagaggtaaaggaaggcaataatatctgaaactttcggaagattctaaaaaaagaagaatatatacatatattcattctctctatacatatgcattctctctatatattatttcataaatacattcattgtctctgtatatatgtatacacacacgtatatatgtggagaggagagacagggagagagatcacatgataaaaccaatgggacaaaatactagcatgttaacacttgctaagtcctagctttagaagaatataggtattctttgtaccatctttgcaactttgatgtaagtttaaaatcatttccaaatacaaagcttgaggggaaaaaaagcaggcaaaagataaacacaaaattcaggtactgtgagagagaggaataggagagaggaggaacgcacagaagaatatgctgacagtgttctcggtgacacttgtggctgttcctcttattgttatgctttataactacctacatgctacatatattcctgtgtgggtaaaatattacgttaggaaatattacatcagaaagaagaataaagaaaaaaataatgttctgtaaattgttttaataatttcttcaaaactacaataagaatacgaagagccctcacaatgcaagcacaaaaggacatacgctaataggtatttccggagtaacaatcattaatttgtttttattcctactgggttaaaagcataatactatatttaggtccagttagttagttaccttcattcttcctcaatttggtagtacttgtttctctcagcaaaaaggctttttttttttaacacaacatgtagtacagttaacaagagttaatacacagaattatagctaacatttattgcttactaaatgccaggcactatgctaataagtacttgatattcattatatctttcaattttcacagttacttgagcaatatatatcctattattttccctcttttcgcatggggaaaaaacagaaatagaaaggttaagtaacctgtccaaagccacacagctagtgtgagtccaaatttgaacccagagactctcattctagacctcatacttgtaaacaacatgctccactgcacttgaacctgagattctgatctcaaatagttcttacattgaaaacagaggtaaaatgcccatatagtactttaaaaccagtggataagcaatagatgatagctattatttccattcactgagcaacaaacgctgtacataaaataaagactatcttagatttgaattctcctcttcgtttttccttttgaccactcattaaaaaaaggaaaaggtattattaagtaattaagatgccaccagagacaaaaggatagaaaaacttttaaaatattctcaatctatacacactagataatccacattttataaatattgaatatgcttatatggaaaatgctggttatattggatataggaaaaaagagttttccagcacaatagaattatcaggtgtattaagtggatatgtcattttacggcagcccagcatccagcccttttcctgacatcacccctacttcttttgggggaattttctctactatgcagtcctggtggaagcataaatccaaatacatgttctccattatggaaaccaaagatgtcttttaaaggctacttccagaaaactctctgctcagtccaatggtatagggaagtgaacatataacccaagttcagtcagtcagacacattctctcaagacttagtgtattaagcagaatcaatgcacataccaaagacgtggttagagtttatttacgccagcaacacagcctaacatttttgttgctgttgttcctgaaagttcttgctaccaagaccttccagatctgcctaattcttatctgtttcaagcataactctttagtctcccttcaatcctgtgagcttttcccatcccagataccagatatgtctaacaaactccttttttgcttttaagtcaatctgtttcctttactggcaacaagagtaacaacaacgacaaatctgtaaaataaaatataaaagcataaggggataaaattatataatcttatttagcagttctttgggtgacttttattcttttccaatggtttagtatactggaaaaagtactggccaaagtatttaaagagctaaaatctagtccaggctttccatcagctggcttcaacatctgaagtgtgaattcattctggtcctcattttttttaaatatgtaaaggaaaatggtttgaacttcaagttttgttatattcataaaatattatgttttatagaaaggaccaaagatttcaatgacaataccaataatacagaccttcttttaagaaattagcacatgaatgactgttacagtatttcctattcttttttaataatagttttcatagaaataaaatgttacagtagtttttcaatgacaaacaggaatcaaatactttcagaccatttccctaaagggatgacattacatatcttagaagatttagtggtaagaaaaaaattggtttgaaatattactctcagtaaatagcattacgtttgtaagatctacaggcaaaacaatgcatcttctataggtttttacattttgtaataccacaacattctcctgaaatgtaattcccttcatgttttcaaatgttttgctacagttgtataaaattcattggtataattactaaggaatatattcataatagtactaggatttcaattttcatgaaagggctaaaattactcgtgtcaaagtcaggcaaaattttgcaaactggcattaatcatggattggtgagagtctaaaaagccagtaggaaatcatagaataaggtcagaaggagttttaatgttgaaaccaatatatcaatagaaaagtattgctatcaattctttaaaaattaaaaaacaaagccattttcaaaagccaatcaagattaacatcattaaatcacatctccaagaataataattatttaattttaacacttatcaagcattaactgtatgcttgatttaaaaagcaatgagactttgttcttctcataaaagttttatctccctagacctaggcttagatatactatttgttaccacctctcacagcaattcaaaacacagaacaactatcatggcagtcattatgctaaattctagatggtaaagaggaagatgaattagtccttggtcttaagcactcaccgccatgaaatcaactcaatataatgtgatccatgctagaaaacaatggtatttagtataatctgttaaggaagcaattaattctgtttagggacagaggaaaacctataaagaaaaggtgacatattaaaattttataaaaaatatcaaaaactcttatccagacaaaggacttcattgtcggtcagatctgagtttaaaccccaactctaacctgtgttgtcatgtgaaactgagcaagttgtttggaaacctagaatctaggcctagttctgctgctcttaaaccatgccctcaggcaacatttaacatctctcagccccaatttcaatggagagagtcagtgagtcattctctatgatccttaatttcccctccagtaataacatgaatctacaccttatagtaaattagagaaattcctattgatattgaatgtgttcatttagcaaatacctctagaatatccaactaagtactactgggcttagcaagtggaatacatcattgaacaaaataagcaaaaatctctgttttcagggagattacacagaaaacgtctatggaaaaacttttaaaatactttattgcacccttgttcaaacgtaacttccctgtgcagttgacatagacgttaaaaatagttaacacttgaaaatttccaaataaccataaatattaacacagagaaagaaatctagatagtgatgaagcataattagtagcactaccatcaaaatcccgtttctctaaattcacactgagtcagtgagctttagtggcttgacaaaaaggcagcatgttaacgagattcccctaaaccagtttagtatatagccatattttttttctcatttaaattattccatagtttcttaagaactatgatacaaccaggtaagttttatttaaagataaataaaatctgcacatggtgagaaaatattaacacaaaaacctattatctcacttctttttcagacattccacttccatacctggtgtttttcagcctcattttaggctattttattatataagatttttatttgagttatatatcatcactgtttgaaaactgatttattattcaatagtcaagtgcaagacatccattcttaggcatctccaaagcagaaacacagtcagagtatgccaggtgatggaggggctacagaaaggatacatgatgaggtaaggaagaacagaatatagctgccctcaaaatacatagcaacttgaggagagtcgtggcaagtcttacaatcttccatgcttggactcttcttcactaatctactaatttctctgtacgacttttcccattctctcgtggtgatgtcttcttcatggctgctacagtatcctagattctgcagcctgccttctctcaaaatgtctgcatacttttgcatctttctattaattgcatccctttcttagaaaagaagatcttactggggttgtggtgactttccagtatggactataaagtcctcttgttcagcccccttaatggctgtgtgcttttgactgcctttggataatggggtcacaagatttttaaaaaacaaaatcttgttagcatatgcctaaggcatccatcaaaagaggactatagcataggagtaccagaaagtttctaagaaagacatgcaagtactttctgtggactgttcaccatgtaacgatacagtatcaccatagagactgtatgtacagagactgaacttaaaagtcactcccacaatgttaaggcattgcattaaaggcacaaaagtaaagtaaacactggcaaatatatatagcatatactaaaaatttaaaattctaaaaggtgtgaagaggtgggtgtagtcatatgtttatgtaatttaaataggctcagcttaggcaactattctttgaagcaaaacaaaacaaacatacaaataaaatattgtgaaaacactgtttttaaagctgagctggtcagcatcaaacacgcacttcaaagtagtgagtcttaagtttcataactggtattcttcaaactgtgaaactcagaatatattgacaaatggccacaattttgggtaagagaacaatcaccttgacaaacattttccaaagtttcagtattccaattttgtcaaggagaaacagccaggattacacaactgccagtctgaggttctgtgccaacatcatgcataaaaattgcaagcaatgaccaaacaaaatataaaatacaaaggacaaatgcttgaggaaatggataccccattttatatgatgtgattattatacattgcatacccgtatcaaaacatctcatgtatcccataaatatatacacttactatatatccacaaaaattaaaataaaaaatttgaaaaaaatacaaaacacaacaaagaaaactttggaataatacttcctttaagctgaatacttctataaaatactggagccacatgaaagaaaagaatacgtatctcttgttctccttccttctgtcagtgggcacatgataaatattccttcaccctccacctgccacccaccagatcccactggctactatcacacaaccacaaaatgagccaccttacaaggaagcagataccaaggaaggcagagaagagagatggagctgactgcctgtaaacattcaaatgatcacttgactttgtcacttcttctgatgagttctgttcttttttttttaacataagcaaattctgtttcataaaataaaggaaatgatgagcatggtacaggatggcagataagaaagggtatttaatctatctctttccctcctagtctacccaaaaggccatgaacataatgtatgagcaaggatgataagaaacactagttttgcactagcaaaacaaaacagggacagaataatatgagcagtcataattcctcatcagtttcatttttctatttcaagtgctgtagatcattgatcatgttcttgcaaatacccataaagtctacacattgaagatgaacaattagggtaaaagtgaacataaaacattgatgtaatctgttctgttacccactggaggaaggaacctataaaattatccaaagttttaattacggaggattaagagacttgcccctacaatatcttccaatgttttcattattgaggattaagaaactttccccaaaacactttaaagtagcattaagtggtgaaaaaaaaaaaactgtagagagaaagagatcacatgcctcccacagggtagttgttaaatgagtatttcttaaatttaactgaaaatatataaaaggaaagaaaaaaataagttttctatgaaaaggaaaaagaattcgagatgatcaaaaaggttaacatactggaagacagtgtggcatctgaggaataaaggttggtatcatctactgggcagaattgttttgaaaactggatgagatgtttgcaaatatactcagcaaatgtcacacagtaaatacattgaaattgagaaaaaacactgaataaaagagagaaacctgcttttcactgctactaagtaaggtgaagtggaaaagaggccatgcagttaggatcctctttcttggtcctttcatgatccaggagctgctgcttgtaaagctgctctggggcagacatttcaatttgtctgttttcttgacaacttcagttataagctttgctaatgtttataagttcccattggagaaaaattggttagtgaggattatgaactgaaggaaaatgccttcaaggatgggttggtaagattaggataaattctaatattatacaaaaatagtaagattatactctacatattttataccaaatttatttctcctgtgctgagtacagtaactcataaatcccactcactctgtccccaagcatgaatgaagaacacgagaaaatacatcagggatttaaatgaatgcatttttaagttaaggaactcatatttgacaagaatggcttatgttttaggaaatactattttgaatcaaatcgaagttgaggtgggtttttttcccctacttttttaatcgtggaggaaaaaaaaagccaaacatcaatttctaatggtaggtttgctctgacccttcccattttactctgcagcaaagacctcattcagttcctgaaaaaagccaagccttcatcatggtcacttcagattatataatgggagctgctctgaactatccaagcacaaagcaggtctccaaaaattgctcacatgctaaagcttgatattgtcaggtgtctataaatgcatactgaataatgtaaattggtaacctgctgacaatgcatttgcataaatcaagtcaatattcatgtaataaaatcaccactgagccttttatctttcctagtactgatcattctgtagctagtaaagtcctagactaggctggtaacttaaagttaatgaatggaaagactggcatcctagaagaacaactaagaaaaacctaatagaacttagtgatgagaagctagttctcaagaggaaaaaaaccaaaattaggaaaaagaaaatgacaagactcaacaattccacaaagtgagcttttcaaagtccattctttctcccacattattattgtccttatgtctaacaagtactctgatgaacaacatatcataaggctccttgcatttttcacagtataaaggggaaaaagccatatagctcttacaaagttaaacccaaaagacagtcagaccctgagagtcaaacaagtaaaatggctttggccttaaatcaaaagctaatagggcctgaccacataagtctgaccctttaatagtattctctcctagcttggcaacccaagtgagaaaacaaagtgttgaggttatctaagcctgtgtgaagacactggatgctgcattcaatgttagctacagctatcacattgctgagggaaagttacattaaatcagggaaaaaactattgtcactaagtctagacttttgttttcagagacaagaaaatgtgaaatttaagcatcaaatatgatatcacgatgtatcaagaagacttgaatatttttggtaaatatttacagttcctaccacagttttagctccttcatagcggggggtcttatactttagtgttgtctcccactatttaggaggtgctcagaaagagagtcttcactgattattaactcagcagaactctcaggatgtaaactatagactaaaagtactcacacactgatgccgtatttgccaaacattaaaaggaacaggcttgttgagtgttgctacaaagagtagaggcaggtcaaaagacaaaaactaccaggaaacagatgaaaagccatctaaagtaataataatagtagtcttatgagacagtaaaatatctgccaccaaaaaaaaaagtggtttttaatccaatccacttgcttaaattatgatgtcaaggtctggtactcaactggctcgttcataatatctgagtgaagcctggaaatgtgcattttcaacaaacacagttctcatgtaggtagaaaacaacatgtaatcctggctaagcaactgtaccttagcaaacctgtgaacagatttcctgagtttggtaaaagcgacttttttttttcaagatggagtcttgctctttcacccaggatggagtgcagtggtgccaactcagctcactgcaacctccacttcccgggtcaagcaattctcctgcctcagcctcccgagtagctaggattacaggtgtgcgccaccatgcctgactagttttatatttctagtagagatggggattcaccatgttggccaggctcatcttgaactcttcacctcaagtgattcatctgccttggcctcccaaagtgctaggcttacaggcatgagccaccaggcccggccaaaagtgacatttttgaactgagggtcatgtgaaatttaagtctttgtctctatgagattatgtagttgggtaaaataaagtaacaaccagagcaaaaacaataacaatagtaatacaagaaacctaaaaacatatattacttgagacatgttatagtaccatttttaaagaactcaggctctggatttaaaatgacctggattcaaatcctacacaatttactagctctgtgaccttgaacaaataacttaccttctctcagtcccaatttcttacaacagttagctaacagagaaattatgtagagtaacactgtgttacataacgcacactcaaaattataaacaatgaagagtaatggtacaaatatctaaacaaatctgacaagttttttggtaaaaaaaataaattccaaaagtaaaaaagccccataatctcattaacttaaaatacatatgtggccaataaacacataaaaagatgttccacatcattagttatcagggaaatgcaaatcaaaaccacgagatactacctcacatctactaggatggctacaatcaaagaaatagataataacagtgttgatgaagatacggaggaagtgaaccccatacactgctggtgagaatgtgaaatggagcagcagcttccgaaaacagtttggcatttcctcaaatgcttaaacacagagttaccatataatccatcaattctactcctagctatatatatatgagaattgaaaacagttattcaaaaatttgcaaacaaatgttcataaaagcattattcataatagctaaaaggtggaaacaatctaaatgttcatcaactgatgactggacacataaaatggggtctatccatacagtgaatattattaagacataaaagggaataaaaagtagtgatacatacaacatgatgaaccttgaagacatcatgctaagtgaaagaagtcggtcacaaagaaccacatatcatgtaattccatttatatgaaatgttcagaataggaaaatctatagagacataaagcatattagtggttgctagggacagagtgaatggaggtggcatggtggtgacagctaagggatgtggggttttctttgagggtaatacaaatgttctaaaattattctgatgaatgtacaactctgtgaatatactagaagtcattgaattgtatacttcaaatgggtgaatcatatggtatatgaattaaatttcagtaaaggtgtttttaaaataaatatatgtaatatatatttgcacaataaaaaatatagtatatatagttattttcttctaatattggattttccccctagaagtagctccttatcaccaagttgtataggtttttcttagtcattcttctataatgttactctttcctttccatttcatatgtaaatatatatatgtgtgtatgtgtatgtgtgtatgcgttcatatatataaagaaggaaaacatccctctatagtacagctctatagtatagtatccttctatagtacagctctatagtatagtatccctctatactacagctctgtagtatagcatccctctatagtacagctctatagtatagtatccctctataatacagctctatgatactcttcatgcccagcacctgttcctgtggtaaactgcttttccctccattctatgtcattctagtacggctgtcagtcacatgaaatccccaaatcccactcctgccacagaaactgcacaggaatttctgccaatgaactgtctcagctgtttatagttccatgcttccaggggcctatttattcggcttggcttttgattctgtgatataaccacattttatctaataaatcctcttcttattttgcttagataatctctgagtttaggctgcttgcaattacaaaactccatttgatatatactctaaactgttttaatctcttcacccgaagtaatgctatgaacaatttgctgttaatcctaccacagtattttctatgcatatacaactacacatccacatatatatcttatcataatactatacatagtattaatgtaccataattgattttagcatccttccattaataattctaacttaacttagttttacttattcatttttcttttaaaatcaaggggaatacggagaatccattaaaaaaaatcatgttaaaatccaagaaatatttatggaatagacttggtagctgaagatcgtgttttttaacacaactttagataatataaaaaaaactgaaatataatctctaatcaatttttgtttacaatgtagtttggcaggtaatatagaaaaattataaaacaattatatgtcaggatgtaagcaaaattgcatgataatcatcttataccagttgaagccatgaaaattcaattcaattttattaaatgtcaactgtataatgttttctgatatgtggattgtattggcactcaaaggaccacccaaaaagtttatagcttagcatacttataatccagttagtcaacattttataattgtcacaaatataaaaattgataaaacttccagcaaatttaaatatatttaagacaaaaatgttcatgacttttataataatacttcacatttattagtacttactaaatcttattatctaaattatttttcaaagcaattctatgaagcaggtattgttataatcacccaagggcaccgctgtagttgtaactggcaaatcagagaactgaagtcaagtctttctatctctaaaatccctttcttaatcaatatctgttatatcaaaattattttaatgactaaacagttgaactgaagagtgtttataatatccaattgcattctcacatcagtattaacaaaaaagctgttagcaacaaatccattgtctgaatcagctcaaagacttattaaacttgagatcttcttgttacatgataagttgcagtatcaatttcttcagctctatcatgaaggtgaattcagattaattcaagccacctagctgacttgcagtctttacaaacataaaaacaggttagtatactctcttaagggtgtagttattctgcatgagaaacaggtatacaattccataagaatacaagataatttgaaacatataataaccatgttgttacacagtagaccttcccatatttatgcatatttaattataatatttattaaaaggctaatgagaccattttgaaacacatttactgaaaggctaatccagtagtagaatacaatctgtttatcaactgaagaacacaatacgtgacatttgtacactgtaagagaagaccagaattgccaataaaatatcattgaaaacttcaagtaacccttatggtaaaaaaaaaaaaaaaaaaagtcctattaaagataagaaacatcatgtacagtatcacttcctctctcctacaacataattcaaacttaaactgatatgtaaatgaaaatttatattccagtcaaggaacgtacccaatgagagtacataaattatatatgtattatgcaagataatagttgttacagacatttcatcaaaagccattttaaaaactgcaaaatatgtcaagatgtttacatggtgaaatgaaatttcataatatggcaccttaaaacaatctcacattagattgctgcacctcagaaaagcactattgatatttcactgagccaaagaataatcataattcccttatcaagtgaatatagtggaaaggaaccaggctgaaagtcaaatagaaacaccattttctcaaataataatatattattaataatgatacatatctgaaggcttaagtttcaagatccgaaaattccagaagtataaaatgccacatattatcaaactctaaataacaaaattgtctaacatgtaactgcctactatttgctcatcaagtaaataagaactcattttaagattaagaaaactagcaagtcagttcgagtctgcaatttttagacgaaataacattcatgaacaactttattttctaacattaataacagatttcatacatccacgtaagtttaggtaaaaataaaatccatgtatacattgcaagtggcaactgttctccatagccaattcagtattatgaactatctaaataaaaatcaaaagtaagttactagaaaatagtaaaatagctccatcgaaaactcttctgtgcatattctgcaacattaattaacttaaaatgattaaatcactgctaatttatttgtcaggaaaaaataatattttattataatatctaaaaaatttgaaggcacttcacagtattacgtctttttgttaacaccatccaatggtatatttattagttgtcatatgaaggccccgccatgagagtttttaaacatttattaagaaataccctctatattcaaagttagatatttaatatctttaaggaatctgaaatagattatatattcattgactcctacaacatgcttcagccagataatgatcgtttgtcaaaatatgagcaagctaatcgtgtgatcctccacacacagactgataacaacactcagaatgcaatagaagcaaaactattcacctaaatggacatgaaaggactagtgctagggttcagattttttttctttaaaattttagtcccttgaaatttaacttcttgaattaacatgcagctattgaaaaagcagcagatatgtaacaatatttttactaacagctattccctagggttccttaattataagcagcagaggtatgcaagatggaaatacccaattaggttttcctggaccaatttagcttgtccagctattgaatattttcacaataaatagtcacagttgagtttgagagagaaaaattagccctttagttagcactaaaactagtctaaaattggccatctggcttgtctctgatatactctgatatcatattgtatcatcagacattgtaaaaagaaataccaggcataaactgctaaccttagaatacaatttaacctcagtattctccacaaaaaagtaacagaatctgtttctctaaggtacctgagttgattctaagtgaaaaatatcaggttattctcactactatctattttccatgtttccagaatgagagtgcaaatctgagcaccgtatttaaaaataaatagatctgagaataaagaaaaccatgttttcacccagatgcctgcatttccatcaacaagtgctgaaacaccacgcgaactgttgtagctgattaacccagcatatttctaggaagtacattagtttggtattagtagggtgcaaagtacaaaggtcagagagggaagtagagaagggccagaccacatcacaccttacagcagatactactaagctgagatttttttgacctgtaagacatgggagtcactgaaaaagtgaaaacagaggagcaatgtaagcagagactggatgagattttcactctgctagcagcgtagagctactttagtgaatatggtattccctagccacgtgtctactgagcatttgaaatgtgaccatgaccacaagttgaaagaatattctggataaactagatcaaataaactatattattataatcaataccacctgtttatttttatttttaaatgtagccactagaataggtaaaactgtatatatgccttgtataatacatctcaattggacagtacttgtatagatgaaaaactgtgaggaggaaaatacactaacaatgatgagaacaaggtagactattgcaatcgccaaggtgagagaggacagtctcagccagaatattaagaatggagaagaacaaaagagaaaagctcaaaagaagaaagaaaagatgcaggacttggtgactgactgagtataaggagtcagagagaaggcatttgttcattcattcattcattcaaacacatcattattgcatgcctaggatatgcaggtaccatgatggttatactataatgagctaaatggaagtcggaaatgcttaccaactctctggtttgagaaactgaggaaaggctgttatcacccattgaaatagcaaacaggaaagaggaacacttttattatcatcaaatgtatcaagtatgaagtgtgtgtaggttatttaagtggaaatgtctgggaagcaattggatgtcatgatctgaagtgtaacagaaatgcctacgctgaagctagagaatatggaaatagcagcagacccataaaagggtttgctccaggagaggttgtagagtgataaggtcaagggtccaagacagaacagtgacacaaaaattctgaaaaggagagagaggacagacagcaagttcactaacaaatagccatgtatgaacaagaaaaattcataaagagtagaatcacaaaaaccaaaacagaagaactttttaaggaagtaacattcaatagaatcaaatacaaaagaaaagtacataatttcagagaagcattgaaaagtatacacaatgccagaaaaaaaatcaaaaagtatttggcaagtcagagatcactgatgaccttcatgaaggcgatcccaatggtaagaacaagcaggactgccaaagactccaaaaggcgaaagagcaaaggagaggcaagaaagaccaagtataaacaactgtttctaaaatcttaactataataaaaaaataataaagtagtgagcacagaatcaagggatggtttggggtattgtcattttttattttggacatgagagagacctgagcatgttcaaaagctcagaaaagcaatcagtacagaaaagctgattaaaggggcaagaaatggaataactaatggagcaagagcctgaggaactgggagagaagacctagaacacagatggacaggcaaacctgaacagaagaaagaacacctcttcgtccagaaatgaaagtgaaggtggctcaagaggcaaagataaattcagaagcaggtaagaactctaggttctgtattaaaatattactcaggttatacagtaattaccgggcacctttagctaacagtagctgcaaatgtggttccatacttccaaggatttaatatttatagcaaatattcgaaagccaaggacacagattcatccaggtaggggagagtcatctttaatctactctgtggccagtcatctatactctactacacaaaaaataaacctgtgagaaatgattgccattagtcatggaggaagaaaatgtagactagagtgattggggacagggaacccacatatctctctacggtttctatctatgcacatggaagtagagagactgaagagaataaagagggtttctctcctgtctatataaccctaattagttccttcccaaggcaagagtcatagttatcatactttgccacagtttaaaccttttagatgaagttattgtgctttaaagaaatgagcccagattccccggacttctactctgcctgtttctgggagtggtaggcatgcctaggcaggatctggtcctccaggctgagtggtcataattattttgtgtgattaaaaagaatctcttggcctgcccatcctcatctctactctgcttcagtgtctccacctacaattgaatgagtgaagagtattgggcttcactggaccagaaaaccgagctacgcctacaaaaccaagactcatggttcaacactcctcattgaaaaagtcagacattgagggctatccagcctttgtccaccttttaaacagtactttatttccctgttggcttctatacatttttataaataatgcatcagtccagaatcccagaaggcaggaggggtaggtggaggattcaataatcaaaatctcaccttgaacctccaaaaaccctagtgacaaactaaaatgtgcactaagtttttctgcctctttctttttcatttttctttttctcactctgcccctcctgaaatccccctccttccacttttatatgttcaagcccatgaatattcagtttatatgtcaccttatcaaggaagttttctctgacctgtccagttacatttcagtatcactgcctcatctatgctcttgtgtcttatttatatctcaattaagcacttggttataattagttatttaattgtatctcccagccaggtgaggtggctcacatcttcaaccccagctacacaggacactgaggtgggggaaacatttgagatcaggagtttgaggttgtaatgagccataactataccagtgcactccagcccgcgtggcagagtgagagcccccatctctaaatgatgaagaagaaggaggagaaaggaggagaaggagaaggagaaaggagaaaggagagaagagagaggagagaggagaaaggagagaggagaaaggagagaggagaaaggagaaaggagagaggagaaaggagaaaggagagaggagaaaggaggaggagggaaaaggagaaggaggagggaggaggaggatgaggaagagaagagggggaggagggggaattgtatctccactaggaaatcaggtagagattgctgaattcagctttgtatctcaggccttgagtacattgtcaaggttggtccccactccaagtcacaattcattcctacttctcccaaactcctaaagcactttgtagggcagaaactgggccttgctgcactctatcagcactgcccctctattattgaaagaagacagaaagaaggagatcctgaaggcctttgtataataggtaaaaatcttttgactcttcagccaatcactgctccatttggcctctagctaaggaatctcttaagcagcaagcaaaaaatatgattcataaacaagtgaaaatgagtcacgtagcagtaaacagaactggggccagaaaggcagctttggagttgtccccattcatttcaaaaagagcattttacatactttttacatatttacattttatgtatttttttaactggataaagttaggaaatacataaattgtactaaatttagaatttctaacttgattaataatgacaaaacaccttataaagtatattacagcacacaaagtacttcctaacacttccattttatagttgaggaaatgaatttttagaaaaattaggtgggttctgtaaggccttattcatcaaccaataatgaacaaatgcctattttgtgcaatgcactgggatttcagcagccctgccctcatgcacctctttcttatagggaagacgtgtaataaataaaatgtatatgtcaaatggtactactgggaaaataaggcaaggtggaggtgggggggcaagggtacagttttgaataagatagccaaagaaggcctcactgacaagtggcatttgagcaaaaagggggtaagaaagtcaagtggttggtaccctaacctgaactattaaccaaatcttggatttgcattgcttacactcctttcaatacagcaatttgccctttataagagaaaaagatgctgacattcaggaaagcagcaggggaagcagtatcctgttctctacattttgggcacattagaaaagtggttcagaaaatcctgtacaagacccatagcgctaccctaggccgaagtgagtccacaaccacacattcggatactccaaaaagatgccaagtggtccttttcattgacaggactagcagtatcactccaaatggtaaaatgttaaagttgtaactagagaatgtttgatctttttattgctgtttttaaaggcagatgtcctgagtggttcattgtggtttctaccatataaacgtcattttactctactggttacttggctgtcataagacagaaaatgagctgccataagaaaagctgatggaaaaggaaaaaaattacaaatatctgatcccatacccaggtcactgtcttcatctaaggcataatttatcttttccaatgaaatatgtgtacatctcaattaattatccacttaccctctactaatcagaaataagatttggttcagtaaggcggggtgaaggaataaactcaacctaccaattgctccacatgaatttttttttttaatagaggcagggtcttactctgtcacccaggctggactgtgcagcctccaactcctgggcttaagcctcccgagtagctaggactacaaccacatgccaccactcccagctaattttttttttttaagaaacagggtctcgctctgttgtccaggctggtcttgaactcctggcctcagacaaacctcccaccacagcctcccaaagcagtgggataataggcataaaccaccactcccagcctgctccacatgattgataaataacctgatataataatctagacaagtcaatctttgctgaataaataacttccccatgagtaatccttcctatgcccagttttccccaatccttaatatcattgctctttttagactcatacattcattcacttaacaaacataaactgaatgtttaagataaggcaaatactttgtatgactggttttctatttgaaaatagagtgtgtgactatacaaatacatatatacataaaggtacatcaatttatatacattggccctatgtaacccccatttgagaatatttctaagcatgccagctactcaaattcaagtgtgaaggtatgtgtatttgggtgtgtgtgaatgaatgtatgtgagagacaaaggcagacagagagagggaatggataagaagcaagtaaagttacagcagacaaggacatgaaaactcataaaagactcatgataaactgtaaatacatttaaagaaaaagaataacacaagccttcactccccttccctgtgcgatcataatcactgcccatcaacttctctgtccatatcatgtgtgctccctgtgttccttgaaggttatgtataaccaagatctacctttaatgtgtttggcaaaaatatctgtgccataaactattagctgacaagcaattatattctaccttgtaaaagaaaattaggcataaaataaccccacaaaaagaagagaatgactgtttcacaaaagaggcaaaagagatttaaacaagataataccataagtttctatctcaccatccattaattttaaatttgattttgcttcttatatcacatagcacttattcaaaaatagcagaagaatacttctatctatctgttgtcctgtaaaaagaaaagaaaatactattatttgtatttcttgttcaaacactctaaggataaaagtactgttttcaaaaatgatgaggttcctgcagataacatttacccacaggatttgaggcttttttgtgacataaagtgcagagtactttgaggatggttacagatgcaatggcacagaaaaggcttttaactttggctcatttcctctgaccaccatgtctccattctaaattacaacctctcaagctacagatcctttaaaactagcttttaaaccagctttctgtggtatcatcacaaaataagaacactttgttacttgaaaataaaagcacaaaattattggactcaataactgttctcattattgcaaaccaataaacaaggttcaacaagaactcgttttagctattgcttatcaagctgccaaaaaataaatccaaaagaaaccaaagaaaaacctgccttaacaatatagatggtttcttattcataaactatctttaacatcaaaaatggctagcatgtatgccagtgttattgccttgcataacagaatcttaagctaagcactaaagttctgtcattcacatctagaataataattttttttacaaaaactaaaatacggccaggcgcagtggctcacacctataattccaacactttgggaggccaaggtgggcagacaacgaggtcaggagatcaagatcaccctggccaacatgatgaaacctcatctctactaaaatacaaaaaattagccaggcatggtggcgcgtgcctgcagttccaactactcaggaggttgaggcaggggaatcacctgaaaccaggaggcagaggttgcagtgagccaacatcacaccactgcactccagcctggagacagagcaagactctgtctttaaaaaaaaaaaaaaaaaaaaaaaactaaaatactaaataaccccatttttaatagaaatttgttttatgatataacccataccaaatgctacctgctcagccaaatcacttttagagtccacacagccctttatatctaaaagaaaataataaaagtgctaggaaacaagaagtatctgggccagttacccttggttaggactgagaaattagctggcacagacagcaagaccgggaccaaatattcaaccagttggctggggatagtgggttgaggtcaaggagatgacccatacagctgtaaaattaagtataaaaaggggaaattgggcaaacaaataaatatactgaggataatgggagccaggttttctaatgttggagaaggaacctacaagtacaaaaaggggaaggaagaataaaccctgtcgtttggaatcgaggagatcagtgggaacatatatttttagataatcactgatcaatagatagatagatggagatgtatatgtatatatgtacgtacatatatacatgtaatgtacatatgtattagtccgttttcatgctgctgataaagacatacccaaaactgggaacaaacagaggtttaattggacttacagttccacatggctgaggaggcctcagtatcatggcaggaagcgaaaagtacttcttacatggcagtggcaagagaaaaatgaggaggaagcaaaagcagaaaccccggataaacacatcagatctcgtgagacttattcactaccacgagaatagcacaggaaagaccggcccccatgattcaattacctccccctgggtccctcccacaacacatgggaattctgggagatacaactcaagttgagatttgggtggggacacagccaagccatatcaatatatgtatgtacatgcatatatgtacatacatatatacatataatgtgcaaatctgtatttcctaggtttgttcactgaaaagatctagaagcaaagacacctcagtagtaaagagcaatcttagacccagtagcaaagagcaaccttagcatccactaaaagaaaccagaagtctttggtagcgccagggctggggcaagaaaagtacaagataagcttgaaccacaccttttaacatgaggaactgagaacatagcatcgcttttgtggtaataatgcccaaaataacaacttattcataaggaaacatcagataaacccaagtagagaaacaaaacatagctgtactcttcagaaatgtcaaaatcattaaagataaggcaagattaatgaagattccagattgaaggagagcaaagagccagggcagctaaatacaaggcttagattctggacatataaagaacatcattgggacagttagtgaattatgaattgaatctgtgtaatagacggtaatattgtatcaatactagtttcctattttggtggttatactgagattatgtagggaaatgtccttatttttagaaaatagtcactgaagtactaagggagtactggggcatcatgtctccaatgtactctcaagccaaaaaaaaacttcaaaataataataatgtgtaatggtaagaggagagggagggcagattgagagagagagagagaatatgataaagcaactataataaaattttaatattgaaaatttgagtgaaaatcatatcagttctttgtactattcttgcaatgtttctacaagcttgaaatcattgtcaaatgattaaaaaacaaagacatgtttggccttaaatgcccatataactattaagaaaaaccttaactctctatgaagggccacaatctgctctgaattttgaatataaaaaagtatgcttgtgctagaggctaatacagcctatataattctaagggcactaaacaaataaaataaggatgttaaaaggtgtcttgaacgtgtctaaaatctgtaaaatgttaattctcacagaatacttggcttagaaagatgatgtacattggggaattataaatataaggataaaattgcaaaatttccctgatagtcacaaaataagacctatgtagacaacagtatgcatcacccagatcccccttcaaagaagcactcactcatggcccatatatgggcagtgcagtcagtagacagccgccaggtcagtagacttcaacatcgccacagctgcagagaaccgccctcccttggggtattcgacatcctcagacagggcaggggtaacttgagacaactctgaaggccacactgtctgagggccccactggcttgtctagggttctgtcaggcctgcctcacagtttggcttcctcccctgctcaatcctgtatctttcttcttcctttccccagggatgatccctaaaatacatctcacaccccaaactccatctcaatgtctgcttctagggaacccaacctgccacaggacctcttttgtgacttgacaaaacatagcttgatataggcacattttataattttgtcttgtgagtaggtaactttatttcctcaaaagacaggtataaatttttttcaggtaaattctgtctctaaatctcatccatttaccttctcatgcggtgtgacagaaaaagtgtactttccccttttcatgttagccaaatataaaagataatcattgtttaaacaacaaatttccctcttatggtccattagctcctgctgcttgttcctgtagtgaaatagaaatacaacaaacgatttccatggcaataggtaataatctagcaaatgtgaatttccgacttagcaacagaacaaagcaagaagaaattatggaactgcagtggggctaaatttcaatttctgtgtatttttagtatcacattttaaaacaaaaaagcacaaatgcagacacattaacacgtaactatgaagaataaaattctaattataggataaattcaagagacctcaataatcaacctgtaatatcactccttacttcactactaaaatatattcaactaacataaaacaccttaccttacaaatttgagaattcttacacttatttgaaagcctattatctactataatagcagtcccaattactgatatatcctgttattttcatttttagtaataattataaacatggcttattgctaatatgtaaacgaaagatgttcaaaggactaaagaatctctaggaagcacaggaatagaggaactggaaagactgcaagcatcaggagcagctctcttgctgatactccattagtcaaggctctccactcccttgtggaacatgcagcaccctgtacaggctactctctagtctgcacctgctcttcttcccacccctgagcttcacactcaccaagaggggttgttttgttcccacacttattaccatttcttcttgttatagtaattatatagtttaattatattattcacaatctgatgaaatatgagtgcagaaaggattatcgtatccaagaaagtaagtacaacgctttgcaaagatttgataaagatgaatcactaaaactatgaacaaattagatatgggcaatgttagactgtggacagttacagaaaaaataattcaaatctaggattctacactcagattgctttgtaagtgtcttaaatttctgcacttttaaataacccaacgtgaaaattataggtaatgcactgccttcgttttatacagaatgactatccaaagatgcaaattttttaaaataaaaagcttcagccttatacaatcagaaaaatggcaaaaagacaaacaactacgataagagtatgagttcaaggaaacctgaatagaggtccttaatatatgacaacacgaccatacctctctttcagttgcctccactctccagatgggattcctgccctctgttctaaaggatgacattgagcactgcccgccttgtccttgacctcagatatgcacttcttcaatcttaggctaactcttctcggttggcaacagaggttcagaaagtgtctccttgcttcaatgtcctctcctacctttgtatatgcaaattcttcattaccagcttgattgcatttatatccagcatacagcaatgtgcaaactatattttctctttggctattagcgacccaaggaggacctcagacaacaacatacttttagccccaaagtcacatgggcaatcacatttccaatcttttaagcacccttccaatggatatactgtctaaccaggaaaaagattaactggaccagtcaagtctctttttcctattctagccacatataaatgatcaatgcccccacccactggaaatgtacagaagctacaataaaaagaatttcctgcccagggccaagaatttatagatttagattctaaagcatctgatgtgactacttttttattttattgccttaacttccttagctacaactgaacacacttcccatcaacctattacttctttacctccctccagttttcctggcctttaactcaatgcctctcctaagtatgcttgagctgtgtttactcaagccacctctgacatcaagtgagaagtgtttttccttctaacaccaaccaattctgacacaaactcgaagtcccataattcaattaattctgataataacaaccaggagttagcatcagaatttttagtgctcagtcccacaaatcaaggtccctaggttacacacacttctgtccaacttggctataaagtctgaggtgggagggtcctcccctcacttcaggttcagtaatttgctagagtggtcataaaactccaaaaaacactttacttaccattactggtgcattaaaagtaccacaaatgaagagccagatgaggaggtaaatctagtgaggtctggaagggtccagagcatagtagcttttgtccccatggagctggggggtcccacccacctggcatgtggatgtgttcgccaattataaaagtctcagaacccaagcatttaggggtttttgtggaggctgcattacataagcgttattcattaaatcactggccatcagtgattagctcaatctccagcccctttgccctccccagaggttgtcacatgagattaaaagtcccaagctgctaatcaaggcttggtctgttgggcaaccagcctgcaacctgaagctttttaagggcccaccaagaataacctcactagaacaaaagatgctctcatcaccctaataactcaggaaattccaaggatttctgaagctctctgctgggaactggaaacaaaaaaagaaatatctttctacactactataatgctttaatctcttttttccactttttcacagatcttacaagtgaatagccagttacttgttccctggctctgcaacagctctcctcccattaccttttgtaaaaaacttgtcccatttctctttcccttccttcctccttcctcaagttttgcaccaaacaatgtgcagaatttagaacactgcatattttcaattaaattactctattgtctgctgtgctcagggaatatctgcagtctgtaaactctgcatgctaggaagagctatttaatcttgctcctgacattttacgtaggagggaatggtttacaggctcagtgtctctagaaagaacactccccaaggaacaacgtatttatttctcaatgttctttttctgttttactcttaaaatctttcctaccaccatccctcacgcccaagagtacaactttgaaatctaatgtataaaactagcagaaattaaagtttatcctatacttacattaaaagctactcctacttgaagatatgcagacccctccaaatccttcttttgattctctgctcacataagtgggttttatgtacgtgtgtttttttccacaaaggagaggcccaaagatagccaagagatcaggattggaacagtttcttaacatcatattctcacattttcaaaatttcctcctttattagtgataaactttttaaaaactgatttcaaaataggaaacagttgttcatcagtctgctagtctcactttcaccaatcaacatatttcattgatgataatataatttttaaaatattttatcatctctggaatcaagatatatcttacagtcgataatatcatagtttaactgacaatatttttgataaagtacatgaagaaatactttatcataaatacataagacaaagataaaataaatgacacaaagatgaatcttaggtttgataaatatattaagttcctctctcaacagtttctggcttacctcagatataacctatgtaaagcatttagcattaaatgtagtataacagattttcattgctgccatcattgatgacatcaacatcatcaacatcatcatcatttctaaacaaataacaaaagtctcagaaacaaatatgaatcaagttagggttctgatgtgttctccttattctatttcttttctgagtgccatttttgtttgtttgttttctatcctaattttctaaatttttcatttgtccccatattaaaaaactgtaaacactctgatggggttatgtaaggttgtgctaaatgacttagctcagagtattcaagccgaaataagttagttctttcatctcaaagaaataagtaaataaataaagtaataaagttctttcatctcaaagaactttaaatatccgtccctgtcactagctaccaaatcaaaaacctaggaatctcattggaaaatagactataagacaattccatggttatgagttttaaaagataactctaatcgatcatcctttttttgtacttattttttgtatatttgtaaaatagtagttacatgaagcaaatagtatcagtgtaaggcccattcacttttcaggctactcgacatgcagaaatggtggccattgatcaggtccttgattggtgtcatcgaagtggcaagggtctttctgaagtatttgaacacactgttatatgtcactgtggagctgtgcattatgtgtgcagctgttcgccacctgatgagtatcctttgacttcatgagttaatgtcttgtaccattcatgtgaacatgagagtggccaaacatatagcgcagcaggaagcagagggcagctgtgacgggactggccagcagtggttaggatggtgaaaacactaagaagccaaaggagtcaagagtagtcagacagagcaggtgtggccaattgcctcaatcatctttttctttcaaccaaaagtatcaagttatattttctattttttcttccacatcactcttctaccctctgccatttttttctttctccataaatggaaacctaaaatgtatttctaccataattagaaagcaatcaataaaaaattttagtccaattttgttcgtgtctccacacattactacatgaactcagttttactttatactgtattataatcatttgagcaaaatttctttatttcttgtaaatgaatgtgctagtataagaaatatctacattttaatgaaaatcatagtacaggtacaaaatttctaaaagtgagaaaatgaagcaaacacaatacagctttttggtacttttacatatgtaatctttctttattctgctgttgatagtttttgcctttcgcccatttaagtaagttaattgaaagcatagtataatttaatctctattgtactaaaaatacacaactatctatagtaatattattctgccacattctcaaaaaaactattgggcattaattccatctggactctccactaaataagcattagtaaacaaatttacttaaactataaaattcatattactgaatttgcatatatccagagtgtctgaagaagagaaaacaaacatatgagaaaaagctcatcatcactggtcattagagaaatgcaaatcaaaaccacaatgagatgccatctcatgccagttagaatggcgattattaaaaagtcaggaaacaacagatgctggtgaggctgtggagaaacaggaatacttttacagtgttggtgggagtgtaaattagttcaaccattgtggaagatagtgtggcaattcctcaaggatctagaactagaaataccatttgacccagcaaacccattactgggtatatacccaaaggattataaatcattttactataaagacacatggatatgtatgtttataaagacacatggacacgtatgtttactgcagcactatttacaatagcaaagacttggaaccaacctaaatgcccatcaatgataaaccggataaagaaaatgtggcacatatataccacggaatactatgcagccataaaaagaataagttcatgtcctttgcagggacatggataaagctggaagccatcattctcagcaaaccaacaaaggaacagaaaaccacatgttctcactcataagtggcagttgaacaatgagaacacatggatacagggaggggaacatcacacaccagggcctgtggaggctgtggggcaaggggagatatagcattaggacaaatacctaatgcatgcagggcttgaaacctagatgatgggttgacaggtgcagcaaaccaccatggcacatgtatacctatttaacaaacccgtacgttttgcatatgtatcccagaacttaaagtaaaataaaaatgaaaaagaatagataaatatagttagcaaattatatgtatatatacaatactatcataacaatatacaatgctagtctgtagtttgtaactttttctcataaaataaatgaagctttagaaaacatttttcactgggtgcggtggctcacgcctgtaatcccagcactttgggaggccgaggagggcggatcacaaggtcaggagattgagaccatcctggctaacacggtgaaaccccatctctactaaaaatacaaaaacaaaattagctaggcatcgtggcaggcgcctgtaatcccagctactcaggaggctgacgcaggagaatggtatgaaccagggaggcagagcttgcagtgagctgagatcgcgccactgcactccagcctgggcaacagagcgagactctatctcaaaaaaaaaaagaaaacatttttcactataagaaaataaaatcacttataatagacatatttccaatatttacattctctgtagtcctctagtcctttatctagacatatatactatatttttcaaatactggaattatagtatacatcattttgtaacttgcttttttgtttgacaatattataggagcactttcaatattcatagtcttcgaaaacatgatttttgaatggctgtatgaatattccatcatttgtaaatattgtagttgattttgctaacccaccactattggacagttactaccataataatgcagtagcgaacatccctttatctttgctctggtctctgatttatgtcttggaaaaaaattctaaaagttgaaagtaccaagtaaagacatgtaaatactgtcaagccttttgatgcctaccaccaaactgttctttctccaatatctataaaagtacagtttaaagaaaccatcaatattgtgttgctggtatgatggatgaaaaagtatgtctcatttaatttcatgccatttcatttacaagtaagattaatcactttaataaattcatttttcattttcttttttgaactatctgttcatgacctttgcctattatccttcggatgtatttgctttttattactattttgtggctgttttttatacaggagtgatatgtttgatgttgcaaatacttttccaggttctcattcactttatcatttcatgtttttttgacatataagagactttcattttgcataatcaaatttgttaaacttttccttcattatatgtccctttggttttatatcgaggaaggcctttctgggcctactatgaaataattcatttatactttcttctaagtattttatgacttacatttaatattatttctatatttaacccatctgaaatgcattttgtatacagaattggagagagctaatcatgtttttttcagacaaaagtattttaacacgtcaagtttaaaccataaacacttttcggattaatttttttccataagtttttggggtggaggtggtatttggttacatgagtaaaagaaaactactgactgatatccttgatcaacacagatgctaaactccttaacaaaacactagctaacctaatccaacaacatatcaaaaagatagtccaccatgatcaagtgggtttcataccagggatgcaggagtagtttaacatacacaagtcaataactgtgatacaccatataaacagaattaaaaataaaaatcacatgatcatctcagtaggtaagaagtattcgacaaaatccagcatccgtttatgattaaaactttcagcaaaaatcgacatacaagggacatacctcaatgtaataaaagccatttatgacaaacccacagccaacataatactaaatggggaaaagttgaaagcattccttctgagtactggaacaagacaaggatgccccctcccaccacttctcttcagcatagtactggaagtcctagacagagcaaacagacaagagacagaaataaagggcatccaaatcggtaaagaggaattcaaactgtcactgtttgctgaaaacatgatcatttaccttgaaaaccctaaagactcctacagaaagctcctagaactgataaaagaattcagcaaaatttccagatataagattaatgtacacaaatcagtagttcttctatacaccaacagtgaccaagcagagaatcaaataaagaactcaaccccttttacaatagctgcaaaaaaaaaaaaaaaatacttaggaatacagctaaacaaggagttgaaagacctctacaaggaaaactacaaaatgctgctgaaagaaatcacagatgacacaaacaaatagaaacacatcccatgctcatggatgggtagaatcaatattgtgaaaatgaccatactgccaaaagcagtctacaaattcaaagcaatctccaccaaaataccaccattattcttcttcacagaattagaaaaaacaattctaaaattcatatggaaccaaaaaagagcctgcatagccaaagcaagactaagcaaaaagaacaaatctggaggcatcacactacctgatttcaaactatactgtaaggccatagtcatcaaaacagcgtggtactggtttaaaaataggcacatagaccaatggaacacaatagagaacccagaaataaacccaaatacatacagccaattggtcttcaacaaagcaaacagattaatttttttttgacccagtatctctttctgttgcccaggctgcagtgcaatggcataatctcagctcactgcaacctccacctcccagattcaagtgtgcttcagccacctgaatgcctgggattacaggcatgcaccaccatgcctgcctaatttttttatttttattagagacagggtttcatcatattgcccaggctgatctccaactcctggtctcaagttatccatcagcctcagcctcccaaagtgctgggattacaggcatgagcctctgcacccggcctagatgtattattaatgcattattattaatgtatcctttcatactaacaacacctaagttgtttttaacatgtactaacatttcctaccttttaaacatgtagtagtatatcctatcatttaaacatgtactagcatatcctatctttaggctcctttaatatagagtcaaggttctccttctccttgcttcccatgctaccagcactataaagtaagagaatcaacaaaacatcctatattataaagagtagtttgacgttttggctctatgtagaacacatcaattatatctataatatattaatttaaaaagtgaactcaattcctctagctattgaaaaagatttgccccagaagtcttttctgagtccttagtcccactctccatctgaatgtgatacctctcctgtgtgttttccaagacctctcaacgtatctgatcacagcccttatcaccttatatttctgacttactagtcagtcccccaactaaaccaaaagaatttcagaagaactatgtctcagatattttatcactatcacctagctcatagtaagcagtctgtaaatatttgttaaataaatgaatgagtacaagactacaagacttttaattcctttcaggcctgccagtgactaacgattgcaacagtgaataagtcacttaacattttagactgtggtgaacaattcagaaatcagtaatttcttagcacaaagatctcttaagatttttcaatctcaaaattctatgatgacatgacctgtatccccagaaaccaattttacacaccctgctgctacatctcttgcttggtaatattcccctatccccaccagtctgacccttccagacttccttgaccttctccagcctaccccactgtccatttaaaatgttctcaccttgtgctccttaaggcttttctatggatcagccatctatatctgtagtctgaacaacagtgcattttactgtaccttccccatgttaaatttgtgtgtagatatactgcatggcttattcagaagatatcggtgatgtgaaatgcttaggtgtgaggttaaaaaggagctctcaatctcttgcttaccccatagacttatctttggaaatgcgtatgacattagatcaatgactgcatcctactctaaaacaaaatgcctcaagagtattagtattattttataattttacaacttttcttgtttccataatgatcaacagaagtgacatgattttgcagtcatgccaaaaaagaaaaaaaaaaggattatactgataatctcttcccaaatatattctggtgaggaaaggtttattttgttgctttttgctttttgtcatttccttgctctagtttagttgtttttaatatttccataaatgttgggagtaagtttactttggacagaacagatttgcttctatttttaagaatttgagagcatgtggtgagattgtttatcttgttgaaataccccaaaaactcagcctcttgatctaaaatgcaatccaataagttataacatgagttaaggttaatctgtaaataaaatacaattccaatttgctagtgaatacttacctgtaaatactaaagacagtattttaactcaaacattttctgattgccaacctattctaagtgttatgggggagcaaaggcaattaaagtcaattttctgcctccaaggagtgtattctgattaagacagacctgtgcttaactaacaataacacaaggcagaatatggttctttaaagaaaaacaaatcctgtagtagcaaaagaattttagcattaaaataatatatagataagtaggattaaaactgcagttctaatacctttccaaatttcaatgtacttctttgaataagagaaaaattaaccagtcatgtcctttccaaagaaacactacagattacacatcctgtagcactctggaattatgggctctgactggtagtagactactacttctgttcaagaggttctttaaatattcacgaagtctgattgagaaaaatgttaagcaagtcatggtcatactgagcaattcaactggtaaaccacggactgcatagctacgttcaacatcagatggaaggaataacttgagaggctattaaggaatagaattaggaagactataggctcattattaaaccattatttatttagcactgccaacattccaaacacagtggtaaatgcaagactggtgaatacaatccataaaaatattctctgagagactgtttatcatgttataaattcaaggttttaaaaaaataatagaagccaggtagggtggcatgcatctctagtcccatctactcaggaggttgaggcaagaggactgcttgagcccaggagttcaaggctgtagtgagctacgactgtgcttgtgaattgccactgcactccaggctggaccacatagcaagaccccatctcaaaaataataataataataataataataataataataataataataataatattaagttaggaaaaagcaatcctccattcattcacaatgtacatgtcctatatattcaaattaaaaccaagcaaaagccttctgttctgaaactaactttctatgaaacgcccaacttgtattcccagcaatatcaagtttccttattcatctctatagattacctcatataatgaaatggaatcatccttttccagaattaagatgctgcttttatcactttacttgctcaaaaaccttaaaagctttcatttacagatgggcacggtggctcacgcatgcaatcccagcactttgggaggctgaggcaggcagatcacctgaagtcaagagttcaagaccagcccaggcaacacagtgaaaccccgtctctaataaaaatacgaaaattagccaggcgcagtagcatgcaccagaagtcccagctactcgagaggctaaggcaggagaattacttgaattaccaggaggcagaggttacagtgagccaagatcgcaccactgcaatccagcctgggtgacagagtgagattctgtctcaaaacaaaacaaaaaaagcttcaatttactataaaatcaaattaaaaatcctcaaggtggcattcaagaatctgcatatctgtatattaaaactatttcctaataccttcacaatggaaattttctgttccagacacattgccttcatagtccacgaacacattatatatatttatgtctatttacatctattctttcttttctttctctgagacagggtttcactctgtcacccagtctggagtgctgtggtgcaatctcggctcactgcagccttgaccccccccccccaccccgccaggctcaggtgatcctcccacctcagcctcccaggcagctgggactacaggtgcaagctaccacgaccgtgatatggtttggctctgtgtccccacccaaatctcatctcaaattgtaatccccacatgttgaggaagggacctggtgggaggtgactgtatcacagggcggtttccccatgctattctcgtgatagtgagtactcacgagatctcatggtttaaaattgtttaataggtcctcccccctcactctctctctctctctcctgccaccacataagacatccactttgccttccaccatgattgtaagtttcctgaggcatttccagccatgtagaactgtaagtcaattgaacctcttttctttataaattacccagtctcaggtagttctttatagcagtgtaaaaacagaataatacagcccaggtatatatatatatatatatttttaaacagggtctcactttgtcacccaggttggtgcaatcacacctgcaatgttggtgcaatgtaccaggttggtacaatcactgcagcctcaagtagtaagtattcaaaatatatgttttgtttaaagggggtcaataaaataatctaagtcaactattttatttattacacatgaagaatcacaggaaaaaagttaagcagctattccaaattacatagtttgaaagctacatcccaaacacaaaacccaatattttttgggttgtaaagaatcctgcagaggattgtgaaagggtagaagtgaggatccctttctgtgtaatattgttaaagttgggatcctttgattacatgatagcttgaattctaaatacagagatgccatcagttaaatataaaataatattggggcaaaattagccatgccacttggaagtcttttgaaaggtttgtgtttatttttctaacctatatattactgtaagaggcatacttggaacaacccccccacaaacacatatactaattaactaatccagcagcggcataacacacagggagttttatcctttatgaaggcctggcatatgcatcacatttaacacagccctagctcacagtactttatctacttggctagaaaacaaatggccacagaaattcatgctagtcaatccattttttatatattttggagtaaaaaggatgtaaattcatctgagtagataactagcatacaaagaattcaggttgagtgtgctacaattaaaaatggtcaccacaagaagctgaaatattaggagtgttcaggggcattactgagagtcttcaagcaaaaagggttttcccagctgtcactgtaattacaatgaaaaaattttacttcctaaggatttcatctagaacacattatacataacagaatatacatgcattcaaatgtaatagacacataaggaataccaattttgactaccttcttcccacaaatcacaagcgacctctgagcacaactctcaagacttttaaatgctttctggaactctttttccatttagaaataagtaactacatacaacagttcacggaaaactcaaccacttaactatttcagtgaaaacaggtagaaagaaagtctataaactatactttttatccatttgaaaaaatttaaatttggaaaggaatcacttcattcttaaggtcccaacaccctaaaaataaagtttattctaaattttcacatttgtcaaagacaataatatcaagcagtagcccacaattccctaaaggaatgatgtcaattggtatttcttaaattaattcagtgacctacagtaatgtgagttcttggtacataatgtctgtcagtaggcaatacaaaaatttcagaatcacttctggtgtctgaactccaaaatgcaacccaaaaaatgtgtctaaagtagttccttaattcctacttcaccttgcatctgttacttatagcaacgtcagaaaaataaaaattacaccaggtgtagattgctagaactacagttctacaaattaaatacagtacaaatttaaccaagacttctggtaacatacaatcagttatctttctgagctaagacattacaagtctgtaactccttttaccgactatggtttagtgagtttcacatgtgcttacacagctcatttttagttacttactagacaatgtgcaatggtgtacttttataaaaatttcaaaggtctcaagaaatggaaatactcaaatttaaaggatttatctgttatctctgaactctctttctctgcttttactgctcccaagtatacaggcaccacgaacacagagaccagctaaaagttcaggaacagaaaattccaactacatcatcttaacaaataaccccacacattatagtttaaaaatagcatatttgaaaaaaatgcactaaaaattattattagaacttcacactcaaatctctaaaaagttatgaacattttatattgtaatacacataaattctaaagaatatcaaagtataatatcagagaaacaatatgtgtaagattataaaagattagagtattatctgtttggatttttacatgaattatttatgcacttaaaaacatagttgaagtgaggagaaacataaatgataacctaatcacattctctgagtttccctcctaggtcactggctgctccttctcattttcctgactcccattattcctaacctctaagtgttggactaccctaggaggggtataggacttttgtctttctctattcactgtctaggtcacaggtcagtaaactctacctgcagaccaaatgtagcttaccacctattaatttttataaataaagttttattggaacgcagccacacccattttcttaattattgtctacagctcctttcacaatacaaggtaaaaattgaatagctgcaacaaggactagatagtgcttctgatcctttacagaagaaaaattgccaatctctgtctaggtgatctcactaaggtgcatagctttaaatataatgtatatcctgaaaattacccaaattctatcttcagtcctgactcagatatgaatgacaacttctctacattatatttggatgtcttataggcatacaaatttaacatgtctaaaaggtaaaatttgctttctaccacccctgccactcctttgcctcttgtatctcaatacacaatttccattcatccaattgcttaggccaaaaacttcagaatcctccttgattcctctatttctctcatactccatatcccagccatcaaaaaagtacatctttaaaatatatccagaatctggccacttctcagccactccaatgctaccaccctaactcaagtcacaaccattttcacctggactattgtagtagcctccttactgggtccctatttctgttcttggtcccttacactcaatttttacagagcatctagagtgatcatggaattccattactgaaaacacttcaaaagccatgcaaggtgtggcctcttgttatattctacctttcctccctcttactgactctggtcactccccacatggtcttttactgtcaagcatggtcctgccttagatctttgcatttgctcttctgtctggaaaagtttcccccaacttatctaggtggtttaattcctcattttattcaggtctctgatcaaagattacctcaagttagaggtcttccttaatcactctctctaaattagtgactcctatcaattctatatccctgttaataggtggattccctagaaaacaggctctaagattctgggatttgcatgcattttggggagtgcccttaggaacaacatctgaaagggagtgaaggaagcaggacaggcagagaaagaagctgaattgcagtgtggttctaacagaggtttaagccacaggaacctctgcagtgggtatagtttttgaaaattatcccacatgaggaaaagagacagggtctttgagccgacatatacataatgaaattcccagtatccccagagttggggtgtaaccttgagtaagacacataaatatgtgttttagggaaatgcaaattaaatccaaaataagatactactttacacacactaggatagctaaaatcaaaaaagataaaaaataacaaatgttggtgaggttgtggggaaaatagaaccctcatacactgctcatgggaatgtaacatggtacacacagcagctccggaaaacaggtttggcagtctcttcaaaagttaaacataaatatatcacacaactcagcaataccatacctagaaatctgcctaagagacatgaaaacatatatctacggaaagaattataaaagcatattcatggtattattcataatacctaaaagcaacacaacataaaagtctagcaaatggtgtgtggattaacaaaatgaggtgcatctaaacaaaaaataatattcagcaaaaaaaagaacaaaatacagatacatactgtaacatggatgaacctcagaaacattacactcagggaaagaagccaacacaaaagaccatttattgtgtgattctttttaaatgaaatatccagaaggggaaaatcaatagaaatacaaaatagattactggttgcctggaggtaggggtaagaaataacagtaagtgcaaatggccatggggagtattttcaggatgattaaaacattccaaaattggattacagtgatggctgtacaaccctatacattcactatatcatcaatttctatacttagcatgagtgaattttatgaaatgtaaattacatataaataaagacataaaaaagaaaaataaatattactggctgattcttaaattgactaataataatggtgacaataactactactcactgaaaatttgcttaggttcaagaattgttctgagtgcttcatttgtattaactcatttaatcttcaacacaatcctacgaagcaggaactattttattcctatttcagagatgagataactcaggcatgggaaaattaaatagcatgctcaaggtcatagaactaaatatatattaattaacttataaaaataaaacattctaccttaaatgctaagcaacagcacttatctaaaacaaaccaaaaaagtagaagataataccatatgtgtacatacatggtaagttccctgtaagtagcgtatttaagattttccaataagtgaccaacttgcaacacttctgattatctgtatagccattgaaacaagtaataagtataatatttattataagacagcttggccagtacttggtgcatattcagtgagagacttaattactgtagacaaatataaagaatgctcatgatctaatctactgaatcactatgttcatacagacacagaaatatcactatgggtacacataaatacaactttattctgcaacagtcacgcataaacacacacacaaactctaagtcacacaatctctataataaagatttttctagtgcatcatatcacagaactgcaagcatatcattttgttcctgtaactgaaatgtacaatgggacaagatgagatgacagtgtgttttatctttttcatatgaaagttcagtaataaatttcacatggcagtaagccaatatgaatgaaatacttggagatactaacttctcatgtatctaccaataaaacactctcaaatttacagatacccctagaaaagacagctgataaccacattgtatgtagttaatattttttttaaatatgaaggcatataaatgatcagcaagcctgacatttagatatttgacaacaatgtattttaagcagtctaataaaacacaaagcacagatgtagaggaaggaagatatgtaactaaaaccacattcaccttcaattcctttgcagactagcactgaaaaacctacatcagcactttctgtctagatgatatattgatacaaagctagaataaaaatggtgataaaaagtaccatttgtaattgaaaataaatgttgctaagtgctgacaagcttctgtcagttaaattgtttttatttagaaatattttgcatttcctctattattcttaagaaactttgtaattaatttttgttccaaataatgtttttgtgtattgattacacaaactagtaatatttacatttaagacatccatttaaagttgaagaaaccatttcataatagaaagccaattcctacccttaattctcttaaaatttaacgtccacctagaaagcaatgcatcagtaataaatttatgattcaatatggttatcagcccacagctaaaaatttgcagatctgtataaccaagcatattaaaagtccccatggataacatataaccatgagtaactctcataattcaacatgcactacagtaagaaccattacaactgcatgttttcattgttaggtcccaatccatttttaaaagaagctgtacatgtacatcaccaacttgcacatacatgcaagtaaaattaaattacctaaagggtatcttctgaaaaacctgagagttttttttaagacatcagtataaccttggttaaataatcttatggtctctatataaagatttgaaatttctgaaaataaaaacatacagtaacataaagcttgcttctaagagtagccagattcaatattcagatttagaaaaattacattcattaaatttaagtgaaacaaataattatgctgaacttctacaggattgccctcaaaatcctatacataactagaaaagtggacaaaatatataaagctatttcagatagtggaccaatggcagaagaggcatgtgattattaacaaaagggaaacaaatcaggtgatatctaagactgcccctattccaacctagatgcaaagtccaaactgtggtataagaatggggaactcagagcctcatggtccaaataagttgagaaacagattagagtttgaagacactgggatggctggaatttgtgggacatattaaagataaaaagaacgctatgcagagattggcataagaatactcatgaggctttgaataggaatctgtgctgcatagggtgaaactccaagcagccaagtgaaaaatagcaggaaaagatcaatttcaggggagttataaagtgaacaattccaagaatgaagagcccttgttgttgaatacccagagtattctgtagagactccagaaagctcatgccttagtagtgagtctaaactagctctaaagattaccctagatcatccttgaaaagcacaaaaatagccttgaaatgagcaggctgatctgcaaataatttaaatgcctaccaaaaaagtggagggtggtggggagagagaccatttaaaagaaaaaccaaaatgtaattagtactacattagtaaccaaaaagaaaaaccaatgtaaattagtatgtacattgttcaaattcagctgaacaatgtaaatactaatattcaatgcctaacagtgaaaaaaaaaattagagacagacaaataaaagggaggaaaatgttgcccacaactaggagaaaaatcagtcaataaaaacagatccaattaacaaagataacaaaattaacattaaaaggccttaaaacagctattaaaataagttcaataagattaaagacttaaaggaaatatgaacataacgagaagacaaagagaacatattgagaatcaccaaattaagtgtctaaatatttaaaaatatttttgatacgaaaatgttgcagataagacactacagaaaatatcagtgaagctggaaacatagcaacataaattattttaaacaaagtatgaaggaagaaaatattttaaaaataaacagtcttggtaacatgtgagggcaacaacaatctaacatttttataattcaagcactaaaataagaggaaagaggtcaagaaaatatttaaagaaaacatgcccccaatttttctgaatttaataaacaatatcagcctacaaatccaagaagttcaacaaagcccaggaagaataaagaaaaaccatgacatgatataatcaaattgctaaaaaaaaaaaaaaaaagtaacaaagaaaaaaatcttaaaagtacccagaaaaaaaggcacataatataggagtaaatataataacacatgtcttgtcagaaattatgcaagctggaaggaaatggaatgacattcttagagtgctgttagaaaaaaactgtgagactaaaaatcatacagccagatcaaatatttttcaaaaatgaacacaaaggcaaagatgtcattaccgatatacccaggacctagccaaagcccacaacacccctgaaattctcaagatcaagttcaaaaaaaggggtccccgtgaaagtgaccatcaagatggcaccacctcaccagacctccttggagctcttcgtgtacctgaacgaagtcacgggcaagcacggcatgggctgtattgacattatggagaactgcttcattagaataaagtccagaggtatctacaagaccccagcaggcaccatccttcaacaggctgatttagacatcgaggacttcactatggatcgggaagtgcacaaaatcaaccctgagtgtaaatctgtccaccattgcatcaccaagtcccaggagcaaatggaaggaaaagtgcaggtgcccatcttcaagggccaggtgcacatcctcagccaggagtctctactctctctctacaaggaggagctggtgagcgtcaacgtgcaggggaattatgagccaatcgatgccaccggtttcatcaacatcaattacctcagactgaaggaatatcattatttccagagtaaggtcactgtcaaatagacccatgtacaatggagacctggggcctcctcactttgcagctctcccaactacaggtgctaattgttgtgacgatttgtaattgtgacttgttctccccagctggcagaatagtggggctgccaggccccaactttgttccctgatctccctgaagcctgcaaaattggtcatcaaagggaagggtggaggacaaatgcaggagtaagctataaaatgacaattaaaaaataacaattctaaatatttatgcacctaataatgaagcttcaaaacacatgaagtaaaaactagaactgaaaggaaaaaaaagaaacccataataatagctggagatttcaacactactctctaggtaattgacagaacaaagagaccagaaacagtaaggatataaaatacttcagtggcaccatcaacaagttgacctatttgatatttacagaacactcacccaacaatagcagaatacacataatttgctaatgcacgtaaaaaaattaactaaaatagggcatattccaggccttaaaaaaatggattgaaatcactcaaagtactttctttgatcacaaaggagttaaaacggaaatcaattaaggaacaagtcctgaaatatctggaagtcaaacaatataattctaaataatcaatggaaaaaagaaaccacaagggaaatttaaaaacatcttgaataaaatgaaaacataatataccaaaatttgtgggagaaaactaaagtactgctcagaacagtgtttccccaaatgtgctacacactaaaaatcacatagggagtttttaaaaatcccattgtacctcatatcaatttaatcaattaaataaaaatatctggggatgggagacagaattattaatttttaaggattccccagacaattccaattggcaacaaaatttgagagccactggtttagaagaaattttttttttaaataaacttctacgttaacaaggtagaaaaagaaaagcaaattaaaatcaaagtacatagaagggaagaaataataacaagcaaataatcgaagaaataaaaaacaaacccaaagctgctttttggaaaacatttttaaatgataaatagctagatgaccatgggaataaaatagaaaagacacaaattaacaaatatcagaaataaaaaaggagatattatccagatacttcagacatcgaaacaaaaacagaggactattgtgaacaattttataccataacttggataaattaaatgaaccaattgattaaaagacacaaattataaaactgaatcaaaataaacccctcatcaatctcaaaagtttaactcataattaacaatcttcccaaaaagaaaattcctggaccagatggtttcactggtcaattctatcaaatatttaaggaagaattaaaccctatacaaactttttttagaaaagaaaaaaagaagaaatacttcccagcttgtttatgaagccaccaagcctccaaatccagatagagattacaaaaaaaaaataaaagacagaccaatgtatctcatacatatagacataaagaaagatctttaacaaaatattaccaaatcaaacccagcaatataaaaaaaaaatacatcatgatgaggtttggcttatccaggaatgtgagatgggtttagcatccaaaaatccaatcaatgtaatttaccatattaacagattaaaaaacaaaactatatgacaatatcaatagttacagaaaagcatgtggcaataatccctcagtcctaatttaagaaaaaaaaaaaatctcagcaaagttgaaacagaaagtgtgccagttatcaacctcttgcctgtcagctccaaatttacccttccctgtcctgctttgtgatgtgggagctagaccctgtatcttttctttgccagctgctgtaacactaaattttgttagcagagggtgctggagagaacaatgcaagatgaaggagcttctctttctgcttccgatatgctttgttctcctgtttttcttatggcaatcagcatcacaaagatacccagtgatactcacatcccagcaagttgcagcagcacctccataagcaacttcccagccagttccactagcatcccaagtggtttcctggcaagtcgcaagatgttccaaccagcagtttcccggaaagtttcaaaaacacccccatgagaatctttgcagtgaacttgaccccctcctcaggggctggctcacttccaccacataccacagaagcaagaagagaataaagtacactagaaccagaaagagaagccccttcctcctgttcccctgcaggaagattccgagtgaatttcaatgtcacctctgcaggcaatttcccagcaagtctcaaaaagacccagagggtagcttcctgaatcaacaaactagggtgcatccatgtaatcaaatattagtgagtgatttaaaaaatcataacctataaagccatggaaagacatgaaagagtcttagccagcatactgctgaaagaagccagtatgaaaaagctacatattgtatgatcccaattaaatgacattctaaaaaagacaaaattgtataaacagtaaaaagaacagtagtaggagtaatgggcaggaggaagatagagatgaataggtaggagcatgggatttttagggaagtgaaactattctgtatgatatcacaatgatggaagcatgacatgcatttgtcaaaatccatagagctgtacaacacaaagaatgaaccctaatgtatagactttagttaataatattgtatcaatattggttcatcagttttaacaaatgtacattaatgtaagactatcataataggtgaaactgtgtacagggaaaaagggattatatgagagctctctacaaaaatataaaactgcactaaaaaatacagtctattaatttttaaaaaaacacattttcaaattttcccatagcttcctgtagtgggcagaattctaaggtggcatcccagattcctgcccactggtgcacacactctgaagattcccttccccttgggggtgggtagggctttaagtatgatagttttcactcccagtatgatgttacattatatgacaagcatgaaaagattgtattaacgtaattaaagtcccaaagcagttgtcttcgagtttgtcaaaacagagatgattctgggagtccttaaaagggagtgggtcctccttgaaggataagcctcaaagcttgagagagcttttcctgttggtcttaaagaagggggcctgtataggagccatgtagcaaggacttacaggaggggacctctagagaccgagagcagtctccagacaagagctagcaagaaaatgtggacttcagtcacacaatccccaaaaactggattatgccaacaaccacatgaacatgaaaaaggatcctatgagatcccagatgagattatagcccaggggagaccttgactttagtatataagaacttgagcacaaaattcagctatgcccagacttttgccctacaaaaagtctgagataattaatttatatttttacaagccactaagtttgtggcttattaaacagcaatagaaaactaatacagtctgttaccttcaggttgacaaatcaccaacgtcaacaaaataggctaaaagaagacattttggaattttgtacattttgacaattgaagtgaatttcatagtcataaaaatttacttattttgcatatagttggcatttgatattttgaaaagccaaattataactagtatatatgacacaaccacagcctatagaaaaaaattacacacctgagaataaaatgcaacaacaaatctatcaggaagtaatttaggaataaaattctcaatttcaaagaaatttcacataacaacttaaaattctacttaggattttacaaattgctaccaagtgataattaaatgtttttaatttttaaacatatacaggttttaaacaacaacaacaacaaaaaaacagaaaaaaaattttgaaacctgcaaataaaacatatcatgagtcctaaatttctgaaaagagatttgcataattttccttaattgtacactttaaaatggttcataatattatgtgaacttcatctcagttttaaaaagttaatctgagcattctaaatattaattataattattacatgtagatctacggagaacatctattcccagtttttgtcaacacccaactacgcaaataaaatcaacagcacataaacagaaaatcatcagctatcccattaaagtacatattgaaactttatatacgatgcttgaaaggtcacctgttcactgcattaaaaatttcttccccgtgctaggcatacaatgaataaaatatgcagtctttcagaaaactgtatgtaatgatatgtcatagcagttcacacaattgtactaaacaatatgcatgctttctgtttttctatcaattaaatattcaggaattactgtcaaatgccatgtcatagcatgacagagatttagcccagattttgaaatctggtttgaaccactagaattagcaaactaagcagcaacataaaatattaagcatgtcaaccaaataatccactttccctctgtctttggagatgccttattaaatttcctaagagaaaaataaaagtacttcatgtaaaaagttttaacccctgctttgaaaacacatattttagcccatcatataaggttttttaatatgattggttctaataatcatatttttaaaatcccaaccagaagaagcactttaaaagtattttttcagtttaatatgcacaggtctgccagcataatatttgtccataattaagaaaattgcttacttgctcagtaggcaatacatgaatcatatgtagtataaaattagaccacaattgagagtttaatccctaaacaacatccaaagttaagcagaatatggtatgatacataatacctttaatataattaaatgagccttaattttacataaatatattaataaattagatatatactatccaatacagtaaccataaactacatgtatctatttaaactgaaaataatttaaagtacataaaattaaagattcactttcttagttgcactcaccacatctcaagtattcaacaaactaccatattaggtagcacagatatagaagatttctatcattgaagaaacagtacttatttgacagagttgagtttaccataaaactcatcataaagcttaagcttcaggcctcctcatttgaaaatgtccctgcaggtaccctagcaatgtgtccatgattatatattttagtaaaatttgtaaaagtaagatactttgccaatgaaatatctttctccacttcctcttcttctccaccaatctcctgttgtcgggtggagggcgtcacagtgagcaacctggggatcatgcaaagggtgatatattcagtttgggtgatacattcagaattggtagcacattgtttttagtgggatatatgtaagtggttcttggtcatttctatgtgtaattagtttaccatctgttccagtataggaatggcttctaggaatacatccctttcccaactgtgctaactcacatggggtcctgatatgaaggttcgtagtcagaggtctatgaagacccctcaatgtgtaacctctgtcacgaatgtgtcccatggcaacgagaactaaagatttgtggcaaatgggagagaagcagagactgaaatttatacagccagaagctactctgtggaaaattcttccaataaggagacatgaaatagaataagcagataattccatttgtaatcaatgcctagtcaagttttctcttattaggaatagagttgatagtgcatatacaattataaatgtagcagacatttcttttttctttttgatgggactcacaatgaaatagaacttttcagacactgcgtttgcaaagcccaaatctgcagctgttctataaatactatgtctgtgagtgaagctgcacagtttatacagctcaattatcaataataaaaacaaaatcttcctaaccatagtacaggaaagtccaatttatctttctaaatctataaaaaattatattataaagtcattgtcatctgagaggggctcaaacattatgtatcctatagatgtggaaaaggtagtttaaaagtgtgatcagcagctatttttccaaatattattatgataatgtcactgaccatcttttacgaaattgtaatcagttgtgatttcttttctcattctaaatacatattgacttgtatataaatttgcatctgtaattttgtattttttttaggagggctgcctccaaatggtctgcctcctttcaggtccccaataaaaccttgatctgaccctgatgctagaaaattatgtcttgattaaaatatatattcactaattagtaatctctatgtattcctttcttcatcctagatgtactgcaatatcaataacccagtcacatcattgtcactgaattctaggatttaaaagggtaaatttgaaatacgtcccttctgctcactctggacctaatctgatatcttttcagccttcggtacaaaaagctcacacctcactagcactaatacaaatgtcattcctagtaattaggttacactgagtgcctttgagctttgcagtgctactgccagtgaagttcttaatacatttacagtcatggttatttaaaccactaaggcttttctttgagtaaacaatatattgatcaaatcaaatgctagcctgacaataccaattaatttaagaaaataaaaaatacacaaaaatttctgttatctaattatattgaagagattgctcctaaaacaaacatttgtaaaaccacctttttgtactatgaaaattatatttgtacacatacaaatataaaaatgcccaatagctaaatgccacttatgcaaatagtccctaagttttctttgatttacagtttatttcatactctttatatttcattaagccatccttcaataaactattttttcaatattgtgttgcgaagatattctcagcctgaaattacatcaaataaattacaaatcaaatttctgaaagccactgccataggtggaaatcaaatcaaatgcctagcttcacataaatggttaaagctttaaataaattgcatttatataattgccttacttgctgctgcctcctacagctgtagaataatgttattccaatatatgaagaatatattggcagacaagactaaaaaattttgaattattaattaaaaatgggaagttttattaaatacattaaagaactgaatttagacttggaatacatatattcctgtagctctgtttctctgattaggccctgactgttacacttttactaaagattttttttaaaaggaagaaaaaatttcttacctaagaggatttggagctgtgaaaggaaatgggccccaaaatcactaagctaaagggaaaagtcgatctgggaactgcttaggacaaacctgtctcccgtgctattcaaagtcactcctctgctcactgaaataaatgtgtatctgattgcctcctttggagaggctaatcagaaactcaaaagaaggcaatcatttgtctcttatctacctatgacctggaagtcccctccctgctttgagttgtcctgcctttctggacagaaccaatgtttatcttacatatgtttattatgtctcatgtctccctaaaatgcatgaaaccaaactgtgttctgaccaccatgggcacatatcgtcaggaccaccggagaccttgtcacaggcacgtgtcctcagccttggcaaaataaactttctaaattaactgagacctgtctcagattttcagggttcacagaacaaaatgataatttactgcccttactcaaaaaatattgtcctattcatagaaaaagaaaatgataaggtggtttccagacactggaagtagtggagaagtgttacatagttattgcttaatggatacacggcttcagtttgagactatgaaaacattctggaaatggatagtgaggatggctgcacctgcaccacaataagaatgtatttaatgtcattgaactgtacacttaaagatggttaaaatggtacattacatgttatatatattctatcacaataaaaatgtttcaattgttctaattatatttacatttttatattcattttttctgagattcagcctgaattgaaaagtgcttcattataaataatagaaattaaatacttaagttggtcattcaaactcacaataaaatggagaaaagaaatcaagttttctaagttgtgactctgtgagcactttactaccacacaaattgagagatcacaaaagaaattccgaacttctctgaccaaggacagttgttttgaaacaaataaaaaaactatctgtacaataaaggtacaggtgaaactttcttttttttaaacttcaagttctagggtacatgtgcacaatgtttgcaggtttgatacataactatgcatgtgccatcttggtttgctgcatccatcaactcatcttttacattaggtatttctcctaacgctatccctcccccagccccccaccccccgatagtcccccgtgtgtgatgttccccgccctgtgtccaggcgatctcattgttcaattcccacctatgagtgagaacatgcggtgtctggttttctgtccttgtgataatttactgagaatgatggtttccagcttcagccacatccctgccaataacatgaaatcatccttttttatgactacatagtattccatggtgtataagtgccacattttcttaatccagtctatcaatgatggacatttgggttggttccaagtctttgctattgtgaatagtgctgcaataaacatacgtgtgcatgtgcctttatagtagcatgatttataatcctttgggtatatacccagtaatgggaccgctgggtcaaatggtaattctagttctagatccttgaggaatcaccacactgtcttccacaatggcagaactaatttacagtcccaccaacagtgtaaaagcattcctatttctccacatcctctccagcatctgttgttccctgagtttttaatgattgccattctaactggcatgagatggttatctcattgtggttttgatttgcatttctctgatgaccagtgatgatgaccattttttcatgtgtctgttggctgcatagatgtcttcttttgagaagtgtctgtttatatcctttgcccactttttgatggggttgtttgtttttttcttttttttttttttttttttgagacggagtctcgctctgtggcccaggtgggagtgcagtggcgcaatctcggctcactgcaagctccgcctcccgggttcacgccattctcctgcctcagcctcccgagtagctgggactacaggcgcccgccatcatgcccggctaatttttttttgtatttttagtagagacggggtttcaccgtgttagccaggatggtctcgatctcctgaccttgatccacccgcctcggcctcccaaagtgctgggattacaagcgtgagccaccgcgcccggcctgtttttttcttgtaaattggtttgagtactttgtagattctggatattagccctttgtcagacgggtagattgcaaaaattttctcccattctgtagattgcctgttcactctgatggtagtttcttttgccatgcagaagctctttagtttaattagatcccatttgtctattttggcttttgttgccattgcttatggtgttttagtcatgaagtccttgtccatgcctatgtcctgaatggtattgcctaggtttccttctagggtttttatggttttaggtctagcatagaagtctttaatccatcttgaattaatttttgtataaggggttaggaagggatccagtttcagctttctacatacagctagccagttttcccagcaccatttattaaacagagaatcctttccccatttcttgttgtttttgtcacgtttgtcaaagaacagatggctgtagatgtgtggtgttatttctgagccctctgttctgttccattggtctatatctctgttttggtaccagtaccatgctgttttggttactgtagcattgtagtctagtttgaaatcaggtagcatgatgcctccagctttgttcttttggcttaggagtgtcttggcaatgagggctcttttttggttccatagaactttaaggtaccttttccaattctgtaaagaaagtcattggtagcttgatggggatggcattgaatcaataaattactttgggcagtatggccattttcatgatattgattcttcctatccatgagcaagggatattcttccacttgtttctgtcctcttctatttcattgagcagtggtttgtagttctccttgaagaggtcaccacatcccttggaagttggattcctaggtattttactctctttgtagcaattgtgaatgggagatcattcatgatttggctctctgtttgttaatggggtatagaaatgcttgtgatttttgcacattggttttgcatcctgagactttgctgaagttgcttatcagcttaaggagattttgggttgagacgatagtcttttctacaaatacaatcatgtcatctgcaaacaggaaaaatttgacttcctcttttcctaactgaataccctttatttctttctcttgcctgattgccctggccagaacttccaacactacgttgaataggagtggtgagagagggcatccttgtcttgtgtcggttttcaaagggaatgcttccagtttttgcccattcagtgtgatattggctgtgggtttgtcatagatagctcttttaattttgagatatgtttcatcaatacctagtttattgaaagtttttagcatgaaggggtgttgaattttgtcaaaggccttttctgcatctattgagataatcatgtggtttttgtcattggttctgtttaagtgatggattacgtttattgatttgcatatattgaaccagccttgcatcccagggatgaagcccacttgatcatggtggataagcttcttgatgtgctgctggatttggtttgccagtattttattgaggatttctgcatcgattttcatcagggatattggtctaaaattcttttttgttgtgtctctgccaggctttggtatcaggatgatgctggcctcataaaatgagttaaggaggattccctctttttctattgaatggaatagtttcagaaggaatggtaccagctaatctttgtacctctggtagaattcggctgtgaatccatctggtcctggactttttttgtttggtagcctattaattattgcctcaatttcagagcctgttattggtctatttagagattcaacttcttcctggtttagtcttgggaggctgtatgtttccaggaatttatccacttcttctagattttctagtttatttgcgtaaaggtgtttatagtattctctgatggtagtttgtatttctgtgggataggtggttataccccctttatcattttttattgtgtctatttgattcttctctcttttcttctttattaaacttgctagaggtgtatctttgggacacatttaaagcagtgtgtagagggaaatttatagcactaaatgcccacaagagaaagcaggaaagatctaaaatcgacactctaacatcacaattaaaagaactagagaagcaaaagcaaacaaattcaaaagccagcagaaggcaagaaataactaagatcagtgcagaagtgaaagacacaaaaaatccttcaaaaaaatcaatgaatccaggaactggttttttgaaaacatcaacaaaattgacagtgaaacttttttaagtaaaaagatagttaactatactaatggctacactgagcatgataattattgcagatggtcaatggtaaagcaagtgtagttgtttcagctgtagagataacgtaattaaatgaacagtatagacatctgatcaactttgaataatcaatcttatcacgtataccaacatgccctgttcttcacaaaatccattcacaaattctaggatgtatgattttttaagtgaattctgattcgttagaggttaatgtttacgaatgcaaacagcatctgtagaacctgatttacggtaaggtactttctactcatcacagtatctccaccgtttaacactgttacaacgcaagtgcacaacaaatatctgtttaagtagccaggaaggaaggagagaaggaagaagagaatgagggagagaaggaagatagatgggtggtttcggtagattcttaaaacccatccgttaatactcagtgtttggctgtggtatgaataaaagagagaggctagagactacaagtaattaacagactgcgagggccagtgtcccagactaagccatgctaatttttagatattactcgtgacttttttctctactgacaaaagctcagcatttaaatatattaggtgacacatatatcacaaggtacctgaataacagctgggattcattacatctgtataatcatctatgcatgatgtatagccatgctacttaaaactatatcttaaatatgaagactcttaacagagtaatttcatacattccaaaatatttctcttcattgtacattaattaaaactatattttcaacattttataataaatcattctaaaagccaaatattaagcaattctaccacaaaaccaaaacatttgaaacaatcaccatattttgactttgcaacttttgtaaaatatgtggttatttgggtcacagaattgtatcacatttgttgactaccaggcaaaattctttgacaagtgactttcaggtttacacagtctgctgccattatagcaattatatggcataatggaatgctagccatgtgtacttctgacattcctctaaatccaggtcattagtcattacatgaagtcattttaagtttccttcatcaattgccctctgtagttttccagctgtcatttcatttgttagtttcaactgaaatgtaaatgtaatagatgtaaatgtttatttagggattgcttcccctttctgtttttcacataaacacttacatacttcgattccttaaacacaacatgttttggcaaaactaatctatagtaaagggggaaaagtgagaaatgtggttccctgtgaggtgtgggagcagaaggtgactgagaaggaccatgagaggactttctgggatgatgttaatgttctgtatcttgatagagattagggttacacaacataggcatatgttaaaactagcaaatgttcacttaagatttatatacactattgtatttaaattttacctcaaaagaaaaaaaaactgtaaactattcttgaactctagttaacaatacgcatgttgaaagtatttagggggaagtgcctatagtttactttgaaatgcattataaataaataagatggactgatggatgaatagagggattaaaatatagatagataagataacagaaaagtgataagatatgagtggtgagtatactggtgttcactgtaattgtcttttgacttctctgtatgtttgaaaatttccataataaaatacattttcaaatttaaaaagtcatttctccaaaatccttttaattttcaaattcactcagtaaagaaagaggaatcagcaagtgttcccaaacattttgaaccataatcttagttacccacctgctggatcattcttagatcatttcttagtagtcagaaaaactggtccaaataattaagactcgataaaaatcttgctaaattaatcaaacatataatttattcatctactccttcatttattccacaaatacatgtcaaagacctctaagaagcagatgtctcttctaaatgctacagaaaaagagaactgaattgtaatacaacgtgatatacattaactgctataaaaacacgacagggagggcattttcgggaccatgaagggtgagtaaaattttgccagattgggtacagggagcagaaagttcatcccagggtatggactatcatgtaggtaaccttataatacataaactttgttttacagctaaaaaaggtaaattatatatttctggtagttgcttctcaaatatgtcaaaataatttaaaataaatatatgtacattaatccctcctttttgtatcttacatactgattttagaagattctgcaatcttttcaatcaccagtataatttaggttttgcttattcaccactaaatcacagcaacatgtatttcatttataataattaaaggtatgttcgttcacatttgatggtattaccactgagaggttttttgcaataacatgttttccctggaactcactttgggaaacaattctctaaagtcttgaaatcccaagagtgcatactcagggattagaaaggtttccctagaccaggatgcaaataaaaatgcaaatctttcacacagcaactctgcccccaaaaaactgacaaaggacaaatatcaaagtactgtgtaaattgtctacaatctatttagagactttaaatatgttatgttgtcctttttaaggcatgtggctggtcacatttcctttgatgagtagtttgcctttctaagcaacctaaccaaaattctggcatatgtgagtttactgcaatattatttctttatgatctgcaagatgtggatatcactgtctatctcacatgcttaacgtgaaggttatatgagatttttttaaataatgaaagtcagtgtttggtgtttaataaatagtagtaattaacaataaaaaatatttacccatatacctattcaggcaattgtacaaccatgcttttaaatttgagccaggaactgaggtgagccagaattcatcttattttatgagtatagttacaaagtcctaactcatagtctcattgcattactgatcactttaatgtcatgataatttttcatttgctccctttcagatccaaactccttacttcactgatcacccaagactggtactctttacggagttcgctagcgaagaccttagaattcttttatcatttatctgttagtggctgaggatagaaatatcagtggaccttcacctcaaataatcctctaaaaaaattcccagcgactgagttgggccagaagttcagactcaagatactttgtaatttgtttcaaattattttctgtaggtactatcaaatgatccctaagccaaatgaaatgctttgttctaatgactgaaaaaatcagttaagaaaggcaggattaatattagggcacttcttaggactggacagtgcattataaaagaaaatgaagaacattcagagatccaagagaaaagagacttctagaacaaaaaataaatagaaaacctgatttcatttgttagtacaaataataatgactgtcactatttaacagaaaactacattaccatattgaaatagaaagaagtgagaattcgaagctataactttgagatgcaattaagtgatccaactcaataaaccttaaacagaagactgtttctattcagagtgccagaacagtgtgaatctgggaacaaccttggaaaaggatcttgactatggatcagatattaatctccatgctatgtttccattatgccaaaaaattaagcactcttaatatttacgacagtattaaattataaatctagccccacatatcaaaaaattttaaaatagttacatctttaatgtcattaagagcaaatacagagcctcaggctcagttctattaggtaagttcatatcactgacattttcttcccatgaaacacattggacttaagatatagctatgaatataattttgctggaatactaatgatattcattttaaaatctgagtgctattagtacccactttcaatttttcatctttcatgatacgctcctggtacaagtgtagtctgtgtagcaacacactcatgctgtacacctcattggctcagtcctgtcagcagattgagtgcatttgaatctttatgttcctttttttagaatttgcaatattctaggagagtgattttctttattgttcccttatattgtatttcacccttacagaaaatgatagagtaattagaatcttattttccaaataagtcactctgtcttctttgtctaaaaaatatattttctgtttcacatatagatgataaagactaaagcagtagaaaaatgaataccaaaaatgtcaagagaaatagggggtttcaattgtaattttttaaagtaataaggactggaaaaaaattctatataaaaattgaatgattaaaaatactaaaatggttccttactgccctaaataaaacctttacaagatgcttcatatgtgaaataaattaagaatcaattcaaaagaagagaaacttttttcagtaaaatgggtaaaatcttttaaaaaccttttaaaattttctttgatacagtaactttctaaagaaatgttcaagtgtctatcaattttactttcacgaaagaaatctaactctgctttactgacaatgcagtttattttaaaactagagcagtacaaaaaggtcacaaaaagactttctgaaatataaaatcagtctaagataagcaaagctgaaatgactatctataccacctttccaaacctattaatgcttcaaactatattattatacaaccacaaacaaatatgtacatactctctactagaacatctccatagttgccgtgaatcattctttcattttccataagtacttacaaagctccataagtacttacaaagcagtatagtattcaattttaaaagtgtaaaaataaaatacacagagttttgacaaatagaaagtatcagataaaacgcgaatgaaggctagatggctaggtggatgggaggtgggtggatggacagatacataagtagttggatgaataggtgctcaggacatatgaatggatgaatatggtgctttctatcaaataaaagaacatgcaatccttttttcttctttcattaagtaacacttgtatattaatctaggtgttgcccatgagcttcaagagcagcttcatgaatctctgggaactgcatgtagggaaatgcatgttgatataggtacacacatgtggggcctggggaagggggtaagcatgcctataggcatcaacacaaaaaaaggccccttcttctaatctccagaaacaattaacctactcttttcaaaaactctactttgccagtctttcatctttcagcagaagaggcaaggcctgagtgaaaagtatgatgcctcctctggcttggcagcctaaacaaacaagctttccacacatagaccagggaagcttccacacccacatctggtgctaggcatggttcctgaattcaacagcaggataatacctgtccactatgtaataaaggcactaaaagttagctttaaaaaaaaaaatcaacatagaattcctgatttcatatttatgaaatagcatcctttcacaatagcacagaagaattaagtaaacaatttaaagattcacatctaattgagctccaactcagataaaatagcctgtgtttcttaaattgagactcccacaactaaattttgcctttcaaaggcaaaagaattttgaagaaatggtatcttcctagagatccctttggggaacatttttacaaacacttttcatgtgggcaaaataatttcactagtttgtttattggacatattggcctgtactttcacaaatgcagacccaaaaatcaaaatcagagatggaaaagggcaaacagtattatatagcaagtatgcttggataagaatcaaagtagaaggcttagggtttggctctaaaattagccaactagacatgagtttctgagcaagaatgatcataatgtagtttagttccctttcagtggctattgccacatgtatacaaaacaaacataaggaaatgcatcatattcttaagatactcatcctctcatccatctggttttatctcataaattacaaagtcctatttgaaattcttattataatattaaaattgggaaaagagcaaaattagagaatacataaggtaaggaatattgaaaattaataacaaagtaaagaaatacgtttgaattttttcacaatttctacaatatgcctcctgaataacctaactgaaatatgtctgacaactacagctatggaatctaaaagtaacagaatattattattttccttcctggtaaaaaaataaaaagcatataaatttatacatttttaggaaaagctaaaaatgtcatcaagtatgccttttagccttctttaacttcttttcaaaaatctaaatttataatagatctatagttctgagactatataatcctgttagcctaaaaagagataaataattataaataaaattattgtatttccttgatttatcagactctccatcctcaaaccaaaatccttacttaattaagcagggcaaatataagcaatcacttagaaaagtggtgtgataactattttaaactattaatctttttaaaagtaagcctttttaggagatctaagtagtacactcaaatattgtcttggatgctgggtgcacaaaataagaacctataccagttcatgaatatttttattgttttctcttttacccagggagagaaatagacaaaagacactattaaagttaaatataggctgggcatggtggctgacatctgtaatcccataactttggaagcccaagggaggtggatcacttgaggtcagcagttcgagaccagcctggacaacatggcaaaaccccatttctactaaaaatacaaaaattagtcagacgtggtggtgagtgcctgtagggccagctactcgggaggctgaggcatgagaatcgcttgaacctaggagacagagattgcagtgagccaagatcacgccactgcactccagcctaggcaaaagagtgagactctgtctcacaaaaaagttaaatacactgtgcccttttttatcttgaccacaaaaggtctccatctcagtaataggtatcatacttgcagtacctccgtggcatatgcccaggatttatagatcttttgttagataacaaaatccagataaattaagagagaaaatgcaacctgtggtacaataatacccatcattaatgaacttcggactttcccagtatttcactagtcagtgtaaagagaaattgttgtacgctcatgagcaagtcagtttgcttggtctcagttttctcatacataataaagtattttacacattccttttattaatctataaactctataagcaaggatcatggtaccctaacacccgcccaacataggcagccaaaaaatatgcatgtgcagaatgcaagatcacacaggttttttccagccaactttatcttcaattatataattttttaagtctaatatttgggtggataggtccataatgcatattaaaacaaaaaagagggtggttagggccacaaaaatgtggtagaaataattgaagatcacaaaagaagaaacaatttcctagagttcaagtggcctccatcaaactttaccaaaaccctaccaaaagctctaattctaaactttataaaaaagtcatagaagtataatttctctttcagaagtaatggcttttgttgttgttgctgttgttgttgtttctagttgagacctttgctgaatgtctaagaattggaaaaacaatgaagtcaaacctttcctaatttctattttaagatatttatactttttccaaactttcctcagatttaaaaaaaaaattgtattctttggaaaacaaaaagttagtactcagaaattcatatttggtaaaccactccagtaaattaattgaacccaaagagggggtcatgggaactgcaacttgaagccagttcatcagaagttccagagacctagacttgagactggtagaggaggaatagggaaaggtgcagtcttgggaactatgccctaaacctgtgggatctgacactatctccaggtaggtagtgtcaggactgaattagaggacacccagctggtgtctgctgcttggagtgtgggggaaaaaaaaccccacacatatggtcacagcagtcttctgtgttgatgattgttgtggtgttagagtagaggaaaaacacagttagagagagttttccttaaacaaatggtgtcagtgaagcaagattagctggaacaccatgatcaggtgggatttatcctagggaagcaaggatggttcaaaagacacaaattaataaatgtgatacattgcataaacagaattaaggacaaaacccatatgatcatctcaacagatgcagaaaatgccttcagtaaaattcagcatggcttcgtgataaaaatcctcaacaaactaggtatagaaggaacatacttcaacataataaaggccatatatgacaaacccacagccaacattttacttaatatggaaaagttgaaagcatttcctctgagaactggaaaaggacaagaattcccactttcaccactcttactcaatatcatactggaagttctcactagagcaatcaggcaagagaaaatattcaaaggcatccaaattggatgcctcttcactgatgataagatctagtatctagagaaccctaaagattccaccaaaaaaaccttagatttgataaatgaattcagtaaagtttcaggatacaaaattaatatacagaaatcagtagcatttctatacaccagtaacgacctagccaagaaccaaatcaaggaggcaatcccacttccaacagctacaaaaaaaaagaaaaaaaaaaacacacctgggaatatatttaacaaagaaggtgaactatctgttgtattagtcaattctcatgctgctatgaagaaacctgacactgggtaatttataaagaaaagaggttcaattggctcacagttctgcatgtctggggaggcctcaggatacttacaatcatggcagaagacacctcttcacatggcagcaggagacagaatgagtgccagaaggggaaatgccagatgcttatctcatgagaactcactcactatcacgagaacagcatgggggaaaccaccccagtattagtccgttttcacactgctgataaagacataccctagactgggcaatttacaaaagaaagagatttaattggacttacaggtcaacatggctggggaagcctcacaatcatggtggaaggcaaggaagaacaagtcccatcttacacggatggcagcaggcaaggagagaaatgatgaggaagacatgaaagcagaaaccccttatcaaaccatcagatcctgtgagagttattcactacaatgagaactgaatcatgagtgaaactgctcccataattcaattgtctcccaccatgtccttcctacaacacatgggaattatgggagtacaattcaagatgagatttgggtggggacacagagccaaaccatatcagaccccacgattcaattagctccacctgtcttgcccttgaaacgtgaggatattataattcaaggtgagatttgggtggggacacagaacaaaaccatatcatctctttaagaagaactacaaaatactgatgaaagaaagtgtagatgacacaaccaaatttttaaaaatcccataaccatagaatggaagaaataatattgttaaaaatgaccatactacatggagcaatctacaggttcaacacaatccctattaaattactaacatcatttttcacagaattagagaaaacaatcctaaaattcatatggaaacaaaaaagaccccaaatagccacagcaatcctaagcagaaagaacaatgttggaggcatcacattacctgactttaaattatactacgaggctacaggaaccaaaacagcatggtacaggtataaaagtagacaggtccatggtatagaatagagaacccagaaacaatgccacatacatataactaactaatcttcaacaaagtcaacaaaaatatacactgaaaaagttctatcctatttaatacatagtgctgtgaaaactgaatagcctagccatatgcagaagaatgaaagtggacccatacctgtcacaaagtcttatgttctggtctttggattaggcaatgattttatgaccaagtcctcaaaagccaatgcaacaaaaacaaaaatagacaaatgaggattaaatacagtaaaaagcttctgcacagcaaaagaatcacaatcagcagagtaaacagacaaactacagaatgttttccacaagaaaaaaaaaaaataaccccattaaaaagtgggcaaaggacatgaacagtcatttttctttttgtttttttgtcttgtttgttttttgtttttttgttttattgtttttgagacagactctcactctgttgcacaggatggagtgcagtggcgcaatcttggctcactgcaacctccacctcttggattcaagagattctcctgcctcagcctcccacccaggattacagctgggattacaggcgccttccaccatgcccagctaatttttgtatttttagtagagacagggttttaacatgttggtcaggctggtctcaaactcttgacctccggtgatccacccgcctcggcctcccaaagtgctgggatttacaagcatgagccactgtgcctggctgaacagccatttttcaaaagaagacaaacaagcagccaacaagcagccagtcatgacacaaggtgaaaaatgctcaccatcactattcatcagagaaattcaaattagaagcacaatcatacatttctcataccatctttcaccagtcagaatggctactattaaaaatcctaaaaacaatagatgttggcaaggatgcagataagtgaacacttataaactattggtaaaaatgtaaattagtacaagctctatagaaaactgtatggagatttctcaaagaattaaaagtgaaactaccattagatatactgatcacacttctgggtatctatccaaagggaagaaatcatcatattaaaaagatgcttgaaattatatctttatcactgcactagtcacaatagcaaaggtatggaatcaacctaaatgtccatcaatggaggatttcataaagaaaatgtggtatatatacaacttagaatactatgcagtcataaaaaagaatgaaataatgtccttggcagcaacatggatagaactggaggccattaccttagtaaaataactcacaaagtcaaatacttcatattctcacttataaatggaggctaaacaatgagtacacatggacatacagagtggaacaatggacactgcagactccaaaaggtgggagggtgggaggtgggtaagggtttaaaaattacctattgggtgcaatgttcactattcaggtgatgggcacactaaatgccaagactacaccactatgtaatatacacatgtaagaaacctgcacttgtccccactaaatatatttttaaagaaattcacaattggacaagcgattttaatatcccaaaatacaggaaaaaaaactatgagctacaaattatagaagcagccagccaatcacagctgccacagcttgggcatctcactttcatttagttagatccaccccgggcaacagttcttccagacccttcagtgttttgggggcatccctatactcctgcagtgggccccattcatcaaggatagcagctatcagaccccctatagatgtagacagccagcctagaatttcctccgcatacttcctctctcccaatcccatcatcttggcactcatgggattttcttcaacttattgccatgcataccaggtgtcctgccagacctctgtggacttcaattagatggcactatgtttgagaggccaaagaagagacccagaattagtaaaagagacaacagagtttattaagggaacatatgtactgggcagtccaatggcggaggctggacaggagaacctgtccagtaagactccagaaaaagcaaaaaatattaaaataaaggatttattacataaattatgtcatatccacttggccctctatttaaaatccattaggatattaaacataaaaaccaacaggcaacatggaaaagctttgtttacaaaaaaaaatgacattgggctggaaggaaatacactacactctaaaaaggtatacttttaaccaaacaatgtataaatacaaaaacaaaatttctcagcataatatttcataaactagaaaacttacataaaaatgtattcttaagtaagacagtacggacttgtctcccaagtctttttttcttacacacacacatacacacacacacacacaccccacacatatatgaatactttttaaacattttttctcattatgtaaaaaatcaaaataaagtaacccaaaaatttttaagccctaaatattttattatacttgtaatactgtcactaagttaaactcaaagaatctaacattaggtcattagacaaaactgcactgtgttaatctgtttgcactgctataaagcaatacctcagactgggtaatttataaagaagaggtttattttggcttacagttctacaggctgtacaggaagcagattgctagcatctgctcctggtgagggcctgaggaagtttccagtcatggcagaaggtgaagggggtgcaggtatggcaagagagcaagcaagagtggagaggtgccacactcttttagacaaacagattttgcatgaacttagagcaagaactcactcattatcatgaggaacgcaataagcttttcattagggatccgcccccatgacccaaccacctcccctaccttcatcattgggggttatatttcaacatgagatttggagcagacaaacatccaaactgtatataacgcacttattcttttttaatgaaaatcagtcaaaatatatctttaaaaaaatacatccacagccagacacggtggctcgtgcctgtaatcccagcactttgggaggccaaggcgggtggatcacctgaggtcatgagttcgagaccagcctgaccaacgtggaaaaaccccatctctactaaaaatacaaaattaaccaggcaacatgccacatgcctgtaatcccagctactcaggaggctgaggcaagagaatcgcttgaacccgggagacagaggttgcactgagccgagatcacgcccattgccccacagactgggcaacaagagcgaaactacatctcaaaaaaaataaattaatgcatcccactgctatcacagtttttaaaaacccaaagtgaaaacaaataactgtgtcagactatctttagcaacaaaacgcaaaaacgataacgtctagaaatatatgtaaaataattttaattataccatttataaaagattttattttttaaattaccagttcttttcattttactatttcttctaaaccagccatctggccgctttcaccttacaatgtatggtatctatttttatctgatatattcctatcttatttattgattatctgtctggcccactggaatgtaaactccttaagaaatttttttatcttgttcaaaacccagagtcactacatacaaatgtgtaggttttacacatgtgaatatcattacagttatgcagtgcacaacctgcagaactgaatatggtaggtctggctgtgaacaaataattatcagacatgtaataaaacgccagagatcttaacagttctgtgtcctccctagtggtgatgcaaaccctctctaggcatgcatgccaggaaaagctgttcctcaacattttcaattcctaaatattctttaacattatgttacacaagcatgtacaaattatttgctctttgctattccatgaaatctataacagcaaaatatttctgaggcagaaaccaactcaacggagttacctattaaaggccaatatgaatgaattataatagcagtaaatttttaaagtatttttcaccaaaaatactaaattgtttactattagacacatatcaattatttttaaaataacatgctgacagtctcaaagaatactgtaaatctatatatcattaatgtaatccatttttatgttcttaaacatctaaaattatagaactacatttttttataaactgtcatctcttttttattaaaaaaagaagatttttatgaaaaacctctgagtttaaattactattatattcaggagtcccacacccactgtttccaaacatagctctttttataacaacttctgacaatcctctagagaacaaaaattcacttttaatcaaagttaaatgctagaactgtttcctgggaaatttaattcaaggtaaacaatctacttgatattgtcttattcacacaaagctgtgttgttagaagaaatgataatgaaatataaaacctttctcttctaggttattgtttacaatctggacaaagctgataggcaaaagaaagcagagaaagccaatgtgaaaggaatgtgtaggattagtcacgcttcttcccagaagatagatgttgaccagtaagactatcagttactaaacacagccctctcattctacacccctaacacaatctcttaaaaaagaaattacaacttccaatctccatttgtcaagtatcttgaatttaaatatacaggtcttcacaaatatgaactaaaattcaacaaagttttgtctactatgtgctggacactaataggataaaaatgactaggaaacacttcttgcctcagaggaactttgcatgcaaatgacaacattacttggcaacaaaagaatgtggacacaatgtgaaatcaagccggggtccagcagttagaatcagcccttccttgactacaccagggacatactactacaaatcattctgtcttataccccagcatccagctatcctctggaaatgcttctccctgaagtttacatccttgcttagctatttcactcatctactccacggctaatcccttcatctctgcttctcagaaatggctctttccaatcctcccttccaatctctactccacaattctagtggcccagtctcaagcttcccctccagtgctctcataccttctcaaagctgcaattctagtcctgaagatctaggcaggggaaactggtactcacacattacatcaaggaaagacctcagaggtacacacaccagtggagataccataggttcagttccagatcacctcaataaagtgagtcacacgaattttttggtttcacagtgtatataaaagttacatttacactgaactgtaatctattagatgtgcaattgcattatggaaaaaaaagtacacactttatttttaaaatacttcattgctaaaaaaatgctaatgatcatctgagcctttggcaagttgtaatcttttagctgtggaagtgtcttgcctcaatgttgatggctgctgactgaccagggtggtggttgctgaagagtgaggtagttgtggcaatttcttaaaacaagacaatgaagcttgctgcatcaattggctcttctcttcatgaaagatttctctgtagcatgcattgctgtttgattgcattttacccacagtaaaacttctttcaaaattagggtcagtcctttaaaaccctgtcactgctttaccacctaagtttatgggatattccaaatcctttgtggttgtttcaacaatgttcatagcatcttcaccaggcatagattccatctcaagaaactactttctttgctgatccataagaagcacctcctcatccgttcaagatttatcacaagattgtagcaattcaatcaaatcttctgactccacttctaattcaaactgttttactgtttccaccacatctgcagttacttcttcccctgaagtcttaaaaccctcaaaggatcaacttcttccaaactgctgttcatgttggtattttgacctcctcccatgaatcatgaatcacaaatcccatgaatcagttcttaatggcatctagaatggtgaatccttttcaggaaattttcaacttaatttgactagatccatcagaggaatcgttatctatggcagctatagcctaacaaatgtacttcttaagtaataagactagaaagccaaaattattccgtgatccttgagcaacaggatggatattgttagcaagcaggaaaacactgatcgccttgtacatctccatcagagctcttgggtgaccaggtgcattatcaatgagcagtaatattttggaaggattctttgcttctgagcagtaggtctcaagaatgagcctaaaatattccacaatctatgctatgaacagatgtgctatcatctaggctttgttgttccatttatagagcacagtcagagcatattcagcataatgcttaaggggcctaggattttcagagtggtcaaggaccattggcttcaacttaaagtgaacagctacattagcccctaacaacaaagtcagactgtccttcaaaactttgaagccatgcactgacctctcctctgtagctagagaactcctagatggtatcttcttcctatataaagctgtttcgtctagcttaaaaatctgctgtgtagtgtaggcgcctttgtcaattatcttagctggatcttctaggtaacttgctgcagcttctacatcagcacttgctgcttcactttgtacttacatgttatgaaagtggtttctttccttaagcctcatgaactcagctctgctagcttcaaacttttcttctgaagcttcctcacctttctcaaccttcatagaattgaaggaagtcaggcccttgctctacattaagctttggcttaagagaattttgtggcttaatcttctgtccaaccactaaaactttctccataacagcaataaggctatttcactttctcatcatccatttattcactggagtagcatttttcacttcattcaaatacttttgctttgcattcacaacctggctaactgttcagcacaagaggcctacctttcagcctatctaggctttcaacacgccctcctcactaagctgaataatttctagcttttgatttaaagtgagagacatgcaactcttccttttacttgcacacttgccattgtagggttattaattggccgaatttcaatattgttgtgtctcagggaataggtaagcccaaggggagggagagagatggaggaactgcaggtcggtggaggtgaagtcaagtcagaacctagcacttactgattaggtcgggcatgttatatgagtgtgggtcatggtgcctcaaaacagttacaatggtgacatcaaaaatcactgattatgataatcatagcagatataataacaaaaaagtttgaaatattgtgaaaattaccaatgtaacacagagacatgaagtgagcacatggtgttgaaaaaatggtcccaacggacttccttgacacagagctggcacaaaccttcaacttgttaaaaaaaaaaaaaaaagaaaacacagtatctgcaaagtgcaatgagatgaaacacaattttttaaaaaagtgttcttgtatacaactaactggaaaataagacagtgtaaaactcacatgaaaagctctgcaagtagtccgggcactgtggctcacacctgtaatcccagcactttgggaggccaaggcgggcagatcacaaggtcagtagatcgagaccaccctggccaacatggtgaaaccctgtctctactaaaaatacaaaaattagctgggtgtggtggtgcgtgcctgttatcccagcttctcaggaggctgaggcaagagaatcgcttgaacccaggaagcggagattgcagtgagcagagatcatgccagtggtactccagcctgctgacagagcgagactccatctcaaaaaaaaaagctctgcaggtaatatagtctgaaatatttatcagaggaatgtccaaagccatacagttaagcgttcactgcaaagtagggattcctttttgggagccacttaccatgctccacaaatcaatctcacaatagtctcagtgtaactacactaagtatagttctacttccttagtggaactgtaggaagttatagccaaaaactattccaggttatttgccatttcaatcattggaagtagctatagagacatgtacttgagaacttcatcatttacagttgaatgattttctagaccttccaaatactggattttacccctttcatgaccctttgctccctatataaactttcatcaatgccagaatattgaatgaaatcaccctgaaatcagccatcatatcaaagatggctacaagatacatctcaaaccttcagaaaatggtctgtgctaatgagaaggccgaagtgtcaaccgcaatatgtctgtataggtacctcaaatgtgacaacaactaacaaaaaaaacactctggtacaaataaactagtactggatgcagctaataaagcacatgatactataatgttaaatacatacactaatagaattttctacaattctctgttacgaggtcctttgtaaatcacaggagagtaagtggttttaagattaaatttgcccatatagttaattgccacttcacagcaagtactgtgaataaaaaatccaaattgagctggtttggacctagttacaaataccatttaaacagaacagaaaaaaagcctctatgttgacagggataacaccaaagtggaacacaggcctcatacaaccatctagaatctctcagtttcaccttcgcttcagacatactgaggatttttcatttgagtttttctttccagagcatgtatcacaaacttcaaagataaattagtaaaaatacacacacataatagcataggttgattttatgttttttaagatgaaggttttaaggttatctcattcaatccccttcattttaaaaatgagaaaataaagctccaaaaaggtaattcacacatggctacatgatatatcagagacaataatttctctgttaattacttatacctctgttcaatacagtaatccaaattttcaaatgcaataagttattttacaagcctatcaaaggaacttgctactttaaagacaactggagtactacgaccactgtcttaagagaaggaaaactgagtgggctggttaaggatgcagaggaggataaaatcacagtcactctttgacccaaaatcaacttaatttccagaatgcctagtaagcttgaagcagcttggtgcagctaagcacaaagagctcaaacatttatcaagtctcctctgaagagttctaaatatggggacatcctagtgtgctgctttacatttcttcccagtccagactgcacagaacagaactctcctcaaaatatcccagaaggacttcagaatccattttttcaaatgttttgacacaacactgaaaaggtgcaattattaaaatatcggaaactattatattaattcaaatatgttcagctaccactcattcttcttcctatttttaaatgtggggatcactaagtatctttaaacttagtgtattttcaattttttttctctacagccacagtgaaaggggtggaaagttaaaaaagaaggaatttgattttttatctattagaaggaaggaaaagtttaggtggcattattatatgtgaaaactgaactgtaaagcatacagtatgtgcatcttcacagggtatataatttcaaaaggtgaaaaatgtttaaatagattttaaaattatttctctgcaaatatcacaaaatattaaaagtataggcttgctatgaaagtatctttaaatgttgtgtttctatttttaaaaaatcactttgtcacttgagagaaataaggttgttactttttttctattttccccattctcatatccttcatgtttttcttcattaattacattgtcctttttctgagggtttaaaatattgtgcatattcatgtatccgctgatacatatatttatggtctagctcagctaatgcattggtgaatatgttcacatagatgtatatgtatatgcacacacatgcacataacaagaaagatggcacagtggctaaggctctttctagagtaagactgcttggttcaaattctgcttccaccacttacaagcttggacaagtttcttaacctctcagtgccataattttcttatctataaaatggggataataacagtaagtgcctctaggggtacaaataggactaaataaagatttaatatttatagtgattataacagcgtctagcattgttaagtgcctgcaaataagtgttgaatttttttaaattattttttacttttcttcattctccttctcttcattttcctcatcgcttctactgctacatctttatcaagtatttaaccatcaaatccagccatacagacaaaatttatatacttcctacactcagaaaataaacaacaggacactgttaaccctgatgataatgaatatacctaaaacaaagaagtaagagagcaaaaatgataagcaagaacagaaactatatggcataatgcagtggtcttcaaattggagtagatatgcccctctaattacagtaggaaggtctgtcccttcctactgtccttcagcataatatctattggagacattacattattcagtgatacatgaaatactttagacttacgtttttcttgtaacagttatatattaatcaagatgcaggtttatagtctaatgttgagccttagaagatttttctaagaaacagctaggcatataaatatatttaaggaaatcaattgctagatctaaacgtccataaaaatttttcctaaaaatgacctatgtgagaaagtgcctctcaagtatgatatcctttcccatctctcttctcacaattatccttctctagatttatagggaaaaaaaagtcgtgctcttacacatccccaagaacactgcaggacattgttttgggcagacaaactgtggggagccaaaaaaaaatgaaatctcatatatttttccactacaggtgctctcagcttaagtgaggaccagctccccaagtcagaaaacatcttaccatctttactccttcctagcaatttattccccctttcctagaagaatgaaaaaaaaatagacacaaacatacatacatacatacatacatacataagtttaaactggtttggccttcaaaggaacaaaatcatacaagatcatgatgaataataaagaagtataaatgtgaagactgagaataacgaaactttaaaggactaatggagaattagaattcaagcacgttctctaagacatgggcattctcaaatatattctaacgttctaggtttcagattacatgatcccttttatggagtgctaaaagggcggagattgggaaatgggattaattaaagaacagggaagaggaggagccaagatggccgaataggaacagctccggtctacagctcccagcgtgagtgacgcagaagacgggtgatttctgcatttccatctgaggtaccgggttcatctcactagggagtgccagacagtgggcgcaggccagtgggtgcgcgcaccgtgcgtgagccgaagcagggcgaggcattgcctcacctgggaagcgcaaggggtcagggagttccctttcctagtcaaagaaaggggtgatggacgcacctggaaaatcgggtcactcccacccgaatattgcgcttttcagaccggcttaagaaacggcgcaccacgagactgtatcccacacctggctcggagggtcctacgcccacggaatctcgctgattgctagcacagcagtctgagatcaaactgcaaggcggcagcaaggctgggggaggggcgcccgccattgcccaggcttgcttaggtaaacaaagcagcctggaagctcaaactgggtggagcccgccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcacacagctggagatctgagaacaggcagactgcctcctcaagtgggtccctgacccctgacccccgagcagcctaactgggaggcagcccccagcaggggcacactgacacctcacacggcagggtattccaacagacctgcagctgagggtcctgtctgttagaagaaaaactaacaaacagaaaggacatccacaccgaaaacccatctgtacatcaccatcatcaaagaccaaaagtagataaaaccacaaagatggagaaaaaacagaacagaaaaactggaaactctaaaacacagagcgcctctcctcctccaaaggaacgcagttcctcaccagcaacggaacaaaactggatggagaatgatttcgatgagctaagagaggaacgcttcagacgatcaaattactctgagctacgggaggacattcaaagcaaaggcaaagaagttgaaaactttgaaaaaaatttagaagaatgtataactagaataaccaatacagagaaatgcttaaaggagctgatggagctgaaaaccaaggctcgagaactacgtgaagaatgcagaagcctcaggagccgatgcgatcaactggaagaaagggtatcagcaatggaagatgaaacgaatgaaatgaagcgagaagggaagtttagagaaaaaagaataaaaagaaatgagcaaagcctccaagaaatatgggactatgtgaaaagaccaaatctacgtctgattggtgtacctgaaagtgatgcggagaatggaaccaagttggaaaacactctgcaggatattatccaggagaacttccccaatctagcaaggcaggccgacgttcagattcaggaaatacagagaacgccacaaagatactcctcgagaagagcaactccaagacacataattgtcagattcaccaaagttgaaatgaaggaaaaaatgttaagggcagccagagagaaaggtcggattaccctcaaagggaagcccatcagactaacagcggatctctcgacagaaaccctacaagccagaagagagtgggggccaatattcaacattcttaaagaaaagaattttcaactcagaatttcatatccagccaaactaagcttcataagtgaaggagaaataaaatactttacagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaaggaacgaaatcaccagctaacatcataatgacaggatcaaattcacacataacaatattaactttaaatgtaaatggactaaattctccaattaaaagacacagactggcaagttggataaagagtcaagacccatcagtgtgctgcattcaggaaacccatctcacgtgcagagacacacataggctcaaaataaaaggatggaagaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcgtgagtgacctacaaagagacttagactcccacacattaataatgggagactttaacaccccactgtcaacattagacagatgaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaacctcactaaaagccgctcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactcaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacagacacctctacgcaaataaactagaaaatctagaagaaatggatacattcctcgacacatacactctcccaagactaaaccaggaagaagttgaatctctgaatagaccaataacaggagctaaaattgtggcaataatcaatagtttaccaaccaaaaagagtccaggaccagatggattcacagccgaattctaccagaggtacaaggaggaactggtaccattccttctgaaactatcccaatcaatagaaaaagagggaatcctccctaactcattttatgaggccagcatcattctgataccaaagccgggcagagacacaacaaaaaaagagaattttagaccaatatccttgatgaacattgatgcaaaaatcctcaataaaatactggcaaaccgaattcagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaacacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaagaatcacaagcattcctatacaccaacaacagacaaacagagagccaaatcatgagtgaactcccattcacaattgcttcaaagagaataaaatacctaggaatccaacttacaagggatgtgaagcacctcttcaaggagaactacaaaccactgctcaaggaaataaaggaggatacaaacaaatggaagaacattccatgctcatgggtaggaagaatcaatattgtgaaaatggccatactgcccaaggtaatttacagattcaatgccacccccatcaagctaccaatgactttcttcacagaattggaaaaaactactttaaagttcatatggaaccaaaaaagagcccgcatcgccaggtcaatcctaagccaaaagaacaaagctggaggcatcacactacatgacttcaaactatactacaaggctacagtaaccaaaacagcatggtactggtaccaaaacagagatatagatcaatggaacagaacagagccctcaaataacgccgcatacctacaactatctgatctttgacaaacctgacaaaaacaagcaatggggaaaggattccctatttaataaacggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaaccaaagccaaaattgacaaatgggatctaattaaactaaagagcttctgcacagcaaaagaaactaccatcagactgaacaggcaacctacaacatgggagaaaattttcacaacctactcatctgacaaagggctaatatccagaatctacaatgaactcaaacaaatttacaagaaaaaaacaaacaaccccatcaaaaagtgggcgagggacatgaacaggcacttctcaaaagaagacatttatgcagccaaaaaacacatgaaaaaatgctcatcatcactggccatcagagaaatgcaaatcaaaaccaccatgagatatcatctcacaccagttagaatggcgatcattaaaaagtcaggaaacaacaggtgctggagaggatgtggagaaataggaacacttttacactgttggtgggactgtaaactagttcaaccattgtggaagtcagtgtggcgatttctcagggatctagaactagaaataccatttgacccagccatcccattactgggtatatacccccaaatgactataaatcatgctgctataaagacacatgcacacgtatgtttattgcggcattattcacaatagcaaagacttggaaccaacccaaatgtccaagaatgatagactagattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacactgcatattctcactcataggtgggaattgaacaatgagatcacatggacacaggaaggggaatatcacactctggggactgtggtggggaggggggaggggggagggatagcattgggagatatacctaatgctagatgacgagttagggggtgcagcgcaccagcatggcacatgtatacatatgtaactaacctgcacaatgtgcacatgtaccctaaaacttaaagtataattaaaaaaaaaaaaaaagaacagggaagaacaagagaataaaggaaaaaagcagagagaaggcaaggcaaaatgatttattaggaaaggaagaaaccctttcaaacaaagaaatcctacgttttctctcgatatatcactagaagcatatgcaagaaatcaatatatacttttttaaaagaaaggattaagtagaagataagagaagatacacaggtcatagggaataaaaaattaatagtgcctttccacacagacttgaaacaattctggtcactgaagggcagtaaggctggggaaggtatctcccttcctactgtccttcagtgtagtatctattggagacattacattattcagtgatacatgaaatactttagacttatgtttttctagtaacagttacatattaatcaagatgcaggtttatagtctaattttgagccttactttagtttttatcagcaacaatcttgtataatctaccatgactatacatatgcatcaggtttagtaaagcaatttatgatacagtctccatatgtgaaattgaaagccagaagctaactattattttaacaagctgtcaagatatatagagttttgccaaagaaacattgattacactggtcttttgaaaagtagataaaacttagaattccctaagcaaaccatagttacacaaaattgtcctgagattcctatgaagcacatgactcaaatgctaccaaaatccttcataagtaagatttatttccaataaattatatatctctgttttagaactctgataatttgcagcccattttccagtaacatgtttttatcattttctactgctgaataaaaaagaaattaaaggacaaagagaagatcatgagtgaactatccaaattttattacaatcttgaaaaatacacatccgttgacttcctgttcctctgccactaaatctctgtggggaggtccaacttccaattctctgaagtcgcaaggtagaggaaataaaactaaggagcaggttgctatagctctccaattcaaaagcaaattattactctatttaatacagcaatctactataatctcctccaacactcctgatcctctttacagtactcttttctatagtacttatctcctaacaaaaaaatgtacatatttactatacctattatgtcacttgttgctagaaagtaagcttcaaaagggcagggatctacatcattttgttcactggccaatctcaaatacctagaacagtgtctgacacatagtaggagctctactgaataaataaactattactttaccagtatcaaactccccacctgaggtagcactacctaaactacatgttgttccgattctaattgcatgtgatttttctaatcttcgtgtcattatcatagataagtgtccattgctacaactggaagtaatctgtgcacactgcagccttcattgaaacccagataatacttctgttcgtagctgacctcatttttatggcatcccactgtatagcttgcttcttcactcttatttaggcagtgtcttcgcagtttcctgccttgaatacctcttgtatacatttaccaccttaattatttgctgtgtacattttccttgatgccttctccccactatgacagcagattccctcttctgattttccactgatcagcacggcccttcaaaaaccttcacaaaagcccgttagaaacagattgagagacgcatttgtgaagctatttaacaaatttaagtgtcatttttaaagtattcattgtaaattggagcattgtttcatatcggtatcattggagcattgtttgatatcggtaacttgctttaaactgattaagcacatgtaaagatacatgctaccaatagaagaggatgaaaccgagagatcatctttatggttaatagggagtcagtgacaggaaagtaaaaagactgaaggatgattttgggaagtccaggtaattgtctggttatccctcaccaatgtcttgatccaacccaagaatcactctaacacggcaaaactcaatccttcctgttattttatttgtggcaagagaaagatccctaaaataaaatgcatttataaaatgattgccttataataagcactcaataaatatttgctgaataagttaatggatcaatgagtatttccctatggtttgggaagtttagccaaattaaataccagactttcaaatgtaaagggttacgtctcaaaaatatacctcacccagctgatacacataacacttaaataactgtatctgcatgctcagtaagaacttcatgcattcatatatttaatacatcatcaaagcattgtgagacaactttctaacagtgaattgaaaccatataaaaaactttggactttttgagggtttttggtttttgttttttattagagatggggtcttgctttgtcagctaggctggagtgcagtgatgcgatcgcaactaactgaagcctcaacttgaaggtctcaagtaatcctccatctctgcctccagaatagctgggaccacaggtgcaggccaccacacgtggctcatcaagtgacaacttattctcagtcaaaattcatgggtaaaaataaagttaaaattttttattttaattttgaaaaagtatatattttgtgatcatagctttgattctgctctccatcaaatacatttaattttccatttctccatatttaagcgattaaccccattaaaaaatgggaaactattcattctcaactcactaaaggaagtataaaaggaattaaatacaaagacccactcaaatatagctaatttcattaatatttcctgtgtatcatttcaaaaaaaattactaaaaaatattcctaagattcttcttataatttttatagtttcattattaagaattattgagataatttattttaattagatgggcttttataaagtatataatcaataagtgtttgtagatcccttagttttaaagcttttttttaagtttctctttacccaaaaatataatctggattaaattcaatttactgacccaaagatataaatgagaaattcaaaaccattaacactctaacacagctagatggaatgatgaatgattaagggagaaaccataagaaaacatcaggtaatcatctttctagcatggtctgaatgaaatccttcccatgaaattaaaatttgatacaaagtctatcaggaaaacttctaaactttaagatttgtcaggaaaattgtgaaacactgaaatatgcaaaatattagtggatgtcctatctagtatacccttccagattatctgagtcagtcagaatatgagcctcacattgtctttctgctactttacaaccatgcagttgtaagacacagaataatacaaacaattcttttccataaaaatgcaaataaattgtgtccagtgaaatgaaatggataattggcctgtggctattaaccagttttgcgtctgtttcacattcatttcagcatccttgattgcccatatatgtgtgctcttaaaattctcctttgaattatttgtaacatcttactgatcccctcattaattaatgagcttaataaagtctttgatacccattctttttacatttgaataaaagacatgattttaacctttctttaaaagtatcccttgacagaatctatcactaaaagtatgacttttgatccaccttccataaacaggctttcttaaaatttccattaagtcataagtcatcccattcaaattactcaaaataaaatactgcagcatcaatattttgaatccaaatatgaatgaatccaaagcaccatcattatatgatataagtttactatttatatatccctagaagcaaaaaggctgccaattaaactaagacataatgcttttttatcaattagatttcattttttggatatctgtatcatatattccactgttctgccccatgcctctcatgtagatagatgagtatatattacttatccttctaagcctaaatcataggatttgggaatcatcagaatacctgaagtgcatataactcaattaaactttgacattatgaccacattcacacatgcacagataacaactccatcaaaaccaccacctacccaacatggattttgagtccatcaattcaaagaagcatcccagtttcaggtatgttcaaatatgaaaaaatagacatcttagaatgcataaaacaccacaaatataagtgcaaaaacatatagcaggattataaatggcaaatagcttacaatcagaaaacctgtcactagagggtcatcatttccttaaatagtaacactagaataatccacacagactgctagaaatttatgaatcttaaaactgatagtcaaaatctcaatgaagccaaataactctttagggcaagaaaaggtgagatccttgactgaactaaggttattcaatctcttgtttactaaaacagtggtaggggtggtttggtctctagcagaagggcaaacaagatggtatcacataatggagctggcttaaagcaaaataataaaaatgaaaaaacactcattcctctacttctaagaaaattatattcttcctttttgatgtactgctgacattcctttcctctcttcaatcctagattagttaacagcttgtaaaactgctgttattataatgacaatctcaatcaactacatcataaggctttttgcctaaaggatcatctctccaagttgtaatctctttgaagactaaggagacaaaagtctctcttgaacactaaggtcttttccaaattaaaaacaaaatattctaaatatttatgaacgatatcaatcagacttcctgctaaatattacttcttagtttttagccttttgtaatatgttataaaagtttccattgtctttgtattgttgaaggctacaatattgcctagcacatagtaacagcaaataaatgttggtaaactagaaactgactctcacagtggccttgattctcacagttaacctagaagtaagtaccgcaacaatgtttattcccatttcatatataaagaaactgaaggttggagaatttagggttttgctctaaaatcacagttaataagtggcattgtcaaaactgaatcccaggccctttgtctccaagaccagagcaattcttacagtaacagactgaacatcccatgcctagatttccttccctctctcttctcttacctactacatgatacttgactcaggattctggtttgctgaattactgaaaccacatcaacagtgagtcaatggtaattctctacctggttacatttacattttagcacagatattgtaagataaggtgcagcagagattattggaaatacacatattgacagtcagatagctcacttctagtggaactagaatatttaattttcctgtgtctcaagtcctttatctgcaaaagcaggtgaaatgcagatgatcaataaggtcttttcctaactaaaaacctaacattctaaatatttatcaattatacaaaatcagatcacctgctacattttacttaatactggccttgaaaaaaaaaagaaaactataaaaacctgtctgttagattctgcagtgggccaaaaacagaatatataaacaaaaatttaaatatattccaaccatactacttgactaaggacactgtctgtaccaatttaaaactagaaggttttaaggataaatgagatctatacaggcacaattgtcacagcagtccttctaggtatacaagatactgaaacattttactgacctataacttactttttcatacatggcaaaactatatttttctcattacaaatgccctagctctccccacaaagttattgtgaagtctccaaatattgctaatttgtcccttaaagcaaaaatataaaacactttgtgacatatgaaaaatgttcaccatgtcctttagttgcttcaagatatagcatataaatctttgagtttctaaacagaaccatactatctagatatttttgtctaaaagatttaaagcttaaatgtgctacctttttttctctcttgcagctttcaagtcacttagcctgctccagtctccaagatatacattatttttccaataaatcaataaataaaattggtatttttgactacttcttagtataaatcttgtctttgtatcaacaaatgttcgagtgcattttcattgtatgactaaatttctattaaaaatgtaaataatttctgcttactctatcgagtctttaattaaaagtggtttttaaagagtcaaaagactttgatcaatttttatagaatgcaccagggcacggtggttcacgcctgtaatcccagcactctgggaggctgaggcaggtgggtcactggaggtcaggagtttgtgactagcctgggcaacatggtgaaaccccatctccaccaaaaaatacaatttagctgggcgtgatggcgtgcgcctgtactccccagctactcaggaggctgaggcaggagaatcacttgaacttgggaggcagaggttgcagtgagccaagatcatgccactgcactccagcttgggcatcagaacaagacaccatctcaagaaaaaaaaaaacttatggaatgctatcattctgtcaaaaataaacataatatgctttctgttttaacaaatgaataacttaccattgtaccaccctaagttaccaggaaaactaccctaaattaccaataaaattgttcctcctatctttctcctctgcctctgctctacttcccttcaaaaagttctttactccacaatttccccaaacagaaaattttcctgattctcctatccctctgttctttctgtcactctcttcaagatccttttcctcttctatcccaccagcatccccctttgattctctgcctatattctccttcatcttgattcactccttcacagctcatctgcttccacaagatcaactaacatttccatactgatgaatccccaaagaacatttttagcctttatttttaaccagtctctgattctgtatttccagtttccttcaggatatgtctccttgaatgactggatacactattagaattcaaaacttctagtttctctacatcctcctaatctccttgtatataaactcaatacttggggacatataattatcctatgtaatcctaacaatctaaaatcttcaccatttgctagtccttacacccagaatgaactatgttatctgctttatgtcaccacaggatgctaaaatgttattgaaaatagccactaaaaaatgtagcaaatgtttctaatacaaactgatgagttcacaatattctatgagtaaatataatagagttccctctattttcctactagacatctgtttctgatttttcaatattacaaagaaaactgttatcttatcattatacatattttcatatttaataatatctccttagtgtagcagtccagaagtgaaattaatggggaaaaaagataaaagaattgttaaggttcttgataaatactgacaagcttatttccaaaacaatattatcacaacgttagctccatgagtgcaggaatcttgtcccttgtgcatatgataggcactagtaatacaacaatgataaacagtaagcattcaataaattttatttaaataaactaatcaatcaaccaatcagatctatgaaagtacttacaaatgataaacaaacattcctttatatctttattatatcattatactatatttacttactccccctttaagagtaaacatgtcactgctttgagcaatgaaatacaagcaaaagtggtatgtgatacttctagtcaaaagtttcaagtgccatttatcatgtcctttccctctgtcacagcaacctaaatgacaggcaaaagtttctgttactattatatatcatcgataatttcttatagtaaaatatagcttttcccttaaaacatatcctttttactgatcagaaattcaccgggaactccctcttcagtgcagggggatcctatggtaggaggattacaagtgtgcactgtcattcctaagaaagaatatggagcaataaaggaaattgctaaagtctggaaagcattcttggctttctgctttgaaatgaagctgacttggaaaatcagagaatttgaataaagttatcttagatttcaatgaaagaaaaatgcttcatggagtagctctttgtattactgcacctctagaggccccagaagacaactaaaaaccaggcaatatgctttattttgaaattcagctgtgtgggctgagatgtcaccttagcatgagggtcaaaggagtacagggagagagggtagccagagcctcagtcacaaattgtaactcacacttaaactcatttgaaatgcaataaacaaactaaacagaataagcacacaactacttgggcactcgaattgagttttttaagaaattttaactgttattatctaaatgctattagataaggaatatttctttcacaaatacagctgaacacattgatgtttaagagttttagtgcaaattccaagaactaaaagaaaatagaggaagacaaattagaaatgagaagctaacttaatgccaacaaattaacctttcagaaagttagaaagaaagaacaaaagagtcaggctattttattattgttttgtttatacttcataagcaaaggtattcgtgggagattttttaataaatgttttccttgtctttttttttaagtggttaaagaagaaaagttaactaggagaagataggaatgacagcagttatttgcaaatttttccacaaggaaaatcctatcaaaatccttctttgatattatttgtccttataatttgttcccacaattgccaaaaaaaaagattacagtcaggttgcatgattatctaaagcccaacatgatgttctatgtttttatcacaattcaagattactgcatttttcctaccataatattaattaatggtcaatataaaaatatggactatattgaaccccaggcaaaaggaaaaaatacacccacaaaactgtaagactatgacactagtaaatcattattcagcattttagtatagttccttctcatatttttccaagccatgtttttgcttgcttatttgattctatatacatgcttaaccatcttattcatttatttatttaacagcataatctttttccatgttaccataaactcttcacaggcttcactttaggtatggtattccatcaagtgtacattccacaatttatattttgacttagtgctggatagttgctttcaatttttgtaccattacaaataattctgttaggaacttattaaacataagcctttccaatatttcaaattcttttcctaaaatacgttcctcacaactgaattactatatatcaaaaacaataatcaaaattaaaagccaatatggtatctgggatttggtacaaaataatacagattggggaagcagatgggagttccaagtgaagcacatttaatttttttcaaaataaaacattcaaacaaaaaattaaaagcaaaaaaaatcatcctgaaatacacacacacatacacgcacacgcacaggaacacacattctagcaaagatgaaagtatttttatggctcttgctacacattgccaagttgcttccctaaagagttgtaatcatttttattcccaatatatagcttaaggtttatagtgaaggcttttttaactcctcttttctttgaagtctttgtttgtacattgactttggcatgtctctgcaacctactgcaaatttttcctattgagatatgttcctgagttttcactttattctggagactggaaatcgctcttatgatgctctttgctcatcatgcaaacttgattccatgtagaataatagttggataacagtacaatgatttacctacaggaatgtttttcatattgtttacaaggcaaaaatacatttaacataatgtttagtaaaaactggaaacaactgtttctgtatcacttgcaacgtcacagcattccttcaaaatgtatttactgtcatggaaaaaaataatttgccactataatgttgagtttttaaaagtaggctataagattgtttgtatgaacaattccattttatatagatcatacacacacacgtgcacaaacacagagataaaaaaaacctggatgtgtatgtactatagtatcttcttggggagttgataagtgatttttacaaacatctttatacttatttatatatttttattttaataataaatattctaaatgtataatttttaaatcatcaaccaaagtaagactcaaagtataaccagtaattgtttgagcaacttattatgtacacatgtcaatttccagcttgcttacataaatagtctcccaattggatacatcttagtgaatttataatcattaaacaaagtaatgaataacatgatcatcacctgaataagattatttttcttctaaattttcaaaacacagctttgtgcccaatggttttccaaaactgcctcatattaacaagaaaattttggttcaaagtagagattaggaaattaatgaaccaatgaaacacagttaattacatccagaaattaatgatcaggatattaaaacttggaaaatatagaaataatggttttcctttattaaaaattttttttgaattattgtgaatacataatagttgtatttatgaggtacgggtgacaatacaagcatacaatgtgcaatcatcaaatcagggtaactgggatatccatcatctcaaacatttatcatttctttgtgtgatagagcttttcttaactagaagttcaacgataaaatgtgcttacagacctaactaaaaccctatcatgtccacctctaagaattctaatacagttcgtctatagggccctagctctgcccctgccattaagtttgtgtgaccgatggcaaggtctgcatctccaaaatcagtattttacatcagttgatttctaaggtcttcgtggctctgtggctatatatacacttaaaaagaaactgaaaacaaatctgatcaataaagaactttttcatgacatatggtatgttattctgcagggttgccataacataataccaaacacgaggtggcttacaacaacataaaggtattctcacagttccggaggccagaaatctgaaattgaggtgccaggaaggctatgtccctctgaaggcagtaaggaaggatctgttccatgcctttctcctagtttctggcagcctcaggtgttccttgacttgcacatggccatcttctgcctatatctcttcacatcatcttccgtgtgtgtgtgtgtgtgtgtgtcccaatttcccctgtttataaagataccattcatattggattaggacccatacaaatgacacctcattttaacttgattacttctgtaaagacccagatcttcaacttttctgggggggatccaactcaacccataacatgtgacatgctggttaatctctgttgccctctaaatccattccctgctcctttctgctccacatcccagaggctaacctctgtgaactgcatcatccatgcttctttaatttctagcttcaagttggcaaatgggaggcacctgttcaagatcacaagacaacagaagagagaagggagggtatttgttgccactccatacccccaccaggccacttttttggtagcaactacattcagctatccacagtcctatttccctgtccactagccccgctcccataattctagctctcaccagaatgggtaattccattcccacctctttttccttctgccatcaggctatgatgacatcccactgttgctagtccctgggcacttcactattgttcaatggttgcattctgcactaccacccatccctctataatgaagtccattcattaaactctcttcattgtccccattgaatgtaccgtctgtttctcaccaaggccctatctggtacacagggataagtcaattctttagagtatttacataatttgtttatcaaaattctaaaaagtagtttagcctcagcatggctgccacaaattgagatttgaaataattggtagtaaagacatcactttctgtcatatatacatttgctactgttttgctcctttcctccttcacacttatatcttaatctagaaggatatggcagaggtcaggagcatggattgtgaaggcagactgcttcactttgaatctagcctctaccacgtactagattacataagtccagttaatttacctctctgtacactaataaaatgggcataaaggtaataatatacaaggccaggattacaggtatagcttacacctgtaatcccaatactttgggaagccgaggtgggagaatcgtttgaagtcaggaattcaagaccagcctgagaaaaatagcaattaccttgcctctgcaaaatatttaaaaatgaaaacattagccatgcatggtagtgttgacctgcagtcacagctacttgggaagctaaggcaggaggattacttgagcccaggagctgaatattacagtgagctatgaccatgccactgcactctgcctgggcaacacggcaaaaccatgcctcataagtaaataaataagtaaagtttacaagtcacaggacagctatgtgaaatatatgccaaattacttacattaattttttaactattaaatcaattaatctatataaagtgcttagaacaatacctggcttgtagtaagtgttctatgagcattagctgctattattatgattaatttttcctctgatgtttttcccttgacctacacattaagtcactctagcctcaatcatttttacacggaccctacccaaccaatcaaatgtatgctgggaatatacaaaaaacacagccaactcttttttattttattttattttttcccgaaacggagcctagcttgtcacccaggctggagtgcagtggtgcgacctcgcctcactgcaagctccgcctcccgggttcacgccattctctcgcctcagcctcccaagtagctgggactacaggcgcccgccaccaggcccggctaattttgttcttgtatttttagtagagacaaggtttcaccgtgttagccaggatggtctcaatcatcttctgaccttgtgatccacccgccttggcctcccaaagtgctgggattacaggtgtgagccaccgcgtccggccaacacagccaactctttaaattttcctatgtaaactacccattgtccaaaagatcagtaacacctgtcactcctgccataatgggctctctgacccctatatggtgtacatcctaagtcctcaagtgttttatttgcttacgacgtatttttgataattctgctctcagtcaagattctgataaatcatcaatcccctacctgggctatttcagctatatgtcaaacactacactcccactcacttcctggggtctattccggcttttaaaagacagttttcaaacccctacttcagccaaagaaatggtccttaatagtgattttcctcccaaaatatgtgtacttagttttgtttaattgtttggggatggggaggggtagtagtgtttgagaccaggtgtcactaaaaaaaaaaaaaaaaaaaaaaaattaaaaattaaaagaagacatttatgcagccaaaagacacatgaaaaaatgctcatcatcactggccatcagagaaatgcaaatcaaaaccacaatgagataccatctcacaccagttaaaatggcaatcattaaaaagtcaggaaacaacaggtgctggagaggatgtggagaaataggaacacttttacactgttggtgggactgtaaactagttcaaccattgtggaagtcagtgtggtgatttctcagggatctagaactagaaataccatttgacccagcaatcccattactgggtatatacccaaaggattataaatcatgctgctataaagacacatgcacacgtatgtttattgcggcactattcacaatagcaaagacttggaaccaggccaaatgtccaagaatgatagactggattaagaaaatgtggcacatatacaccatggaatactatgcagccataaaaatgatgaggtcatgtcctttgtagggacatggatgaagctggaaaccatcattctcagcaaactatcgcaaggacaaaaaaaccaaacaccacttgttctcactcacagatgggaattgaacaatgagaacacatggacacaggaaggggaacatcacacactgtggcctgttgtggggtggagggagcggggagggatagcattaggagatacacctaatgttaaatgacaagttaacgttaaatgacaagttaatgggtgcagcacaccaacatggcacatgtatacatatgtaactaacctgcacattgtgcacatgtaccctaaaacttaaagtataataaaaaaaattatcaaatttagtcgctttttaggaaagggtaaggagttggggagagaacatgggaaaagaaatcctcattgatctttgcaaattataaaccatctttttaaagtaaaaataaacacacacaaaacttatttaaaaaattcccttacttggcttagcagaaatatacctcagttacgataactataatgaacaaaaagtgattactgttactgtataaaatggccctgagatgtagttatgtactatatctgtgtatttatataagtacatttatcaatacatcagaaataactagatctcaagaaaggttcaacttagaaataagagtacagtaggccatccatatctgtgggttccacatccatggattcagccaaaagcagatcaaacatatttgggaaaaaactgtctgtactaaacatgtacagacattttttccctcttattattccctaaaaaatacagtgtaacaactatttacatagcatttacattgtattaggtgtcctaagtaatctggagataatttaaagtatacaaaatgatgtccataggttatatgcaaatactacaccattcacatcagggacttgagcatctttggattttggtacaattgagaggtcctggaaccaattccccatggatatgaagggacaactgtactaagtatgagctaagagtagtagcaggaaagttcataagtaaaaaaccagattgaccaaatagcagattaaatcactgatcagcagaagacccaagtggtcaaaagcacagcccctgaggcgagaaggccctggtgtaaatcctcaccccagcacctactgggtgaccttgggcaagtcacccaatctctatgtgcctcagtttcctcactgtaaaattacagttcttacctcacagtgctattggaaagattaaatgaggtaatatatgtaaagtatttagaacaattcctgacacatagtaagctcttaaaaacttttagttctaaaatttccaattctatatacagtccagaaatatattcagttctgtaaagatggtattcattttaaagggaatattttgttgcagtttttggcttcttttctcctacttatgtgagtcacactgctcatactcacttaagcataatacaagtcattttacagaataaatgttcaaagatggctggtatgtatattgaaaacaatatgccaactcctgagttcatgtctagacttcctcgggattacagagacggtaaggttaattacccttttaactatgatcattgtttattaccttgctttagttttgagaaaaggacaaaacattctgagtatatgcaaaaatattctagttgacaatatattcattactgtttatgacctctagtattctttcaaattaagtaattaagtatttaaacaaacactcccgaagtagaagcaaaaatcactttctcagactatttagcacttcttaaaggtctccaagaagtagtacactccaattaatatttatcctcttcctcagagcatcgatgcttacactgcctaagggaaacctgttgtcagctaaggcaaatgaggttaataacaggatttggctaagaagaaaaatatgttgcactttagagaactaacatctcatctcatctcaaatacgctaggagaataaagaggccaggaaacaaccaattgtaaaaatattagtaaataggtaacaattaaagtcattctttctcatcccaactagatatactaatggccataattactttttacttacattagtattacctcaggggatctattgttttcttataaaagtcagctgagctgtacagcttaaccaagataatctgctatattagtttccaagtatagaaagcatatgtgtaaataaaacatacatccctcattgttacctggatgttattaacccttgcttcccaacaactaaaatatccacacagggatttacttacaaaaaaaaagaaatatgcttattaacctaattatgggtatcacataaatacattgtatttgcccatttattattattatagcaaggctgtaggggccatactatccatattggatggctagtttctcccagtagccatcaagaagcctaaaatttcatcatttgaaatatttttaagtcttgacttttagaggagagagaactataaaagagaatgtctagagttaaagatagaacagcagtctaggactcatatgcaatataagaagaaaatggaatcagcagaagttctaagcaggaaagtgatattatccaaatcatgttggaaataaatctgctagcaatgtggaaaatgtactagagaaaacatatcatagtcaaagaaggagagatctatgtggcacctggacttagtaaatggagaaaagaaaaatattcaatagatatttttcaggtagacccaaaaagactctgtgtctaactggatacagatgataagaaaaacctagaagttaaagatggaagtgactctaactttgacttgtgactaaatatgatggcaataatcaaaatagtaaccagaagaagaaaaaaagtttggtatgggctaggttgggtttgagaagtctgaggaatatcatcatacacatatatccaatggagagctaaaattacaggtatgatgcttcaaaaagaaatcaggtaggcaagaagttaagagcagtggacaaagggaaaagagaagagggccatttctgagggctctgttctgttccactgatctatatctctgttttggtaccagtaccatgctgttttggttactgtagccttgtagtatagtttgaagtcaggtagcgtgatgcctccagctttgttcttttgatttaggattgacttggcgatgcgggctcttttttggttccatatgaactttaaagtagttttttccaattctgtgaagaaagtcattggtagcttgatggggatggcactgaatctataaattaccttgggcagtatggccattttcatgatattgattcttcctacccatgagcatggaatgttcttccattcgtttgtatcctcttttatttcattgagcagtggtttgtagttctccttgaacaggtccttcatgtcccttgtaagttggattcctaggtattttattctctttgaagcaattgtgaatgggagttcactcatgatttggctctctgtttgtctgttattgtgtatatctacaactatctgatctttgacaaacctgacaaaaacaagcaacggggaaaggattccttatttaataaatggtgctgggaaaactggctagccatatgtacaaagctgaaactggatccctgccttacatcttatacaaaaattaattcaacatggattaaagacttaaacgtcagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtcaacaggcaacctacaaaatgggagaaaattttcgcaagctactcatctgacaaagggctaatatccagaatctacaatgaactcaaacaaatttacaagaaaaaaataaacaaccccatcaaaaagtgggtgaaggacatgaacagacacttctcaaaagaagacattaatgcagtcaaaagacacatgaaaaaatgctcatcatcactggccatcagagaaatgcaaatcaaaaccacaatgagataccatctcacaccagttaaaatggcaatcattaaaaagtcagggaacaacaggtgctggagaggatgtggagaaataggaacacttttacactgttggtgggactgtaaactagttcaacccttgtggaagtcactgtggtgattcctcagggatctagaactagaaataccatttgacccagcaatcccattactgggtatatacccaaaggactataaatcatgctgctatagacacatgcacacgtatgtttattgtggcactattcacaatagcaaagacttggaaccaacccaaatgtccaacagtgatagactagattaagaaaatgtggcacatatacaccatggaatactatgcagccataaaaaatgatgagttcatgtcctttgtagggacatggatgaaattggaaatcatcattctcagtaaactatcccaaggacaaaaaaaccaaacaccgcatgttctcactcataggtgggaattgaacaatgagaacacatggacacaggaaggggaacatcacactctggggactgttgtggggtgggggggaggggggagggatagcattaggagatatacctaatgctaaatgacgagttaatgggtgcagcacaccagcatggcacatgtatacatatgtaactaacctgcacattgtgctcatgtaccctaaaacttaaagtataataataataaaataaataaataaataaataaagagaagagggccaaaaaaggaaccagcaaagcatacaaagctaaaacagaaccaagaaaaaaggatgtaatatacaacaaagggccagaaaacttcaaggaggaagaattcatactgtccatttctgctaagagatgaagaaacatttgtatcgtggccattggatttagcaatgagaagatttgagaatttttccaaagagtttttgtagaatattagagatagaagtctgattttactaaactaaggcagtaagtgacttaaggaattgaagaggactcacagatatttcttcccagaaatatctctttccagatgtttggaaataaacatcagtactctttccagatgcttggaaataagagcaaaatgtactgatttacccgcaaatcttgacagattctagggaatgcaagtctctgtcattattgtatagaagagaggagaaaacaaaaggtaattaaagctgactctaaagtctctaaatttgattcatgggtatagatataaagattccataactttagcagcaaggtccaatacagtagccaaaagccacatgtggttactgaacacttgaaatgcaactagtccaaactgagatgtgccaaatgaaaccaacaccagatttttaagaccttatttcgaaaaatgtaaaatatctcattaatattttaatattaattacatgtggaaatattttagatctattgggttagaaaatattaaaattaaaattacacttgtttcttttctcacttgtttcaaagtgttagtagacaatttaaaatcacatatatggctcacgttatatttcttttgaacgtccctgaacattcaaaatgttatcctctagaataaatactaaactggaagaacaggattcagaaaggttccatcacagccagcctatatatatatcatattagtgtgaaagttaatgaaggggacacccaggacaacatcatgactttaagaaaataaagtcctaactaattaagtggcttactcaggtcacctagctactggaaacaaaacccagactagaacctagtccgtgggtatttcctctattattccacctcttgaaatgtcagtgaaaatttaactgttatatacgatcttattctgtaccacattcaataaaatgacttgtaaaaaaatcttaaaatcataatctccataagagtatcctttgttcaccagtcaacttgtaatttaactaatattgttaacgtatgtcaactcacgattcagttttgttgtgttttactttgggcatgtatatatatactctgaatttatttcaaccaattccacatgaattttaaagagaatatcctcctttcaagtacacatctctttaaaaaaaagttctaagaaaacatatctggaaaagttcagagaaactactctcaaccattattatctgccatttgatagtggtaacttactaaggcatcatgttgctcattaatgtaatattcatacaaaattaaaagttatattcaaaatatagctatagtatatgatgatatactgtatttcaaattctggcaagatttaaaatcctgctttgcccaataaaatcttcaaagacactcaaccattatgttgtaggtaaaccacagttccagaatcaccaataattgtaaccaaccaaaatatttagctgtaatttcttcaatatactccaacaactataaatgtatttatgcttttcattaagaaaagacacaattatttaaaaaattagtcttttcatgctaactttccatgtgaaattgaaaagtaaacatcacttgaaactttaaaacttaattttatgagacatcttaataagctaataactgttgtagtcatggtagttatttcctttgtagaaatactgctccaaaaatagtgctatgctgagtgcagtggctcatgcctgtaatcccagcactttgggaggctgaggtgggtggatcacttgaggccaggatttcaagaccagcctggccaacatggcgaaaccaagtctctactaaaagaaaaaaaagaaagaaaaaagaaaaaaaatgcaaaatagtgctgataaaaatgaatgaagattatttgattaagcaacatgcttaattttgtacgtataccctatatttattttaacaaataaaactattattgtcattccaaaatgacattattaaaaataataaaaataaagaatatcagctccacttcttgaatatttgctgttatttcaatgttatcacatagataaaaggatggtgaaaatctagctaatagagttagctatgcacagggtgactatgcttccaaagaggagctttccatggcgatctgcatgtcttcttttctttgcctggctgtttgtggcccctcttcacataactggagttagtgtattcatctattccaaagttattccatctggactcctatgtggcagcctcccccaaaatacaaaatacaaaaaaatacaaaagtacagagccagatgtcactaagacctgagctttaccacatccttaaaagttttcaagttttccttggttgtatatgtccctttttggcttactatatagcagatgctaagtgtcccactgttgactgttcttagcaaggcgtaatccagcatggagctacagagaatcactgctccttcaatactggcagactgaatgacattgttggtgtttatgtcaacctacttcatgttaagaataactgacagttgatagtcatgacattgcataaacatctgtggtagattcaatatcaatattctagagaatatttgcaataagcagcatttaacagcatttgttcagccactatggaaagaagtttggagatttcttaaagaacttaaaacagaactatcatttgacccaccaaacccattactgggcatatatcaaaaggaaaataaatcattctaccaaaaagatgcacacactcatatgttcatcacagcactatgcacaatggctaagacatggaatcaacctaggtgcccatcaacagtggactgaataaagaaagtgtggtacaaatacaccatggagtactacacagccataagaaaggatgaaaccatgtcctttgcaacaacatgaacgcagatggaggccattatcctaagaataaattaatgcaggaacagagaaccaaatattgcaagtactcacttaaaagtgggagctaaacattggtcactcatgaacataaagatggcaataatagacactggggactacttgagtggggagggaaaaagggggaaaaaggttgataaactaactattggctattatactcactacctggatgacgggatcaatcataccctaaacctcagcatcacacaatatacccaagtaacaaagtgcacatgtgccccagaatctaaaataaaagttgaaattactttttttaaagtccacaatatgataaagtgtgctaaggaatcatacctccttgaaaataactaaaaacatcacttctcccatttataaagcaaaagtgaatattcaaagataactgcaggaggttaagttcattagccaatattcccctagcacctaaggcagttttccgcttttttttttcagtatgctcttattactgcctaattatccatattgcttttcttcctttttgttaaactgaaattcacccaagcagtttaacctttcatttagaatcattaaatacactcccctcccctcactgataattggcctctttctttattaactgatttccccccttgatttattacaaaccttttttgccaaatttggatccattctgttaatacattctttaccttcttgcaactcaattaacacagtgtcattgttaccaaagctttcctattatttcttcaagttcttattgctctttaaagatcatctagtagaataatgaatttttaataaacccggaatattttaatgattcttacttaattctatggtaaaatttatgtgagacatactattcttcacactgaaatgtttcctactgtactgtcataatactatacggtaactttctagcaatccaaatacacaaatccttgcaatataacttatgacttctaaaagtacagaaagccatattataattatcatatccatagctaaatcaaaccaagccagcttcttcaacagcagttccaacatccatacaatttttaataaagtgaaacttatacttgtgccatcagtaagtattaatgtaacctctgagtatgagtaaacctgtcactagattatgcaaaggaataacctttcatgggcccttgaggtttctccttaatggaaataaacaatttttttaaaaggcattcctgttctcttcttggaaagaaatactttcctgagctccaaggcactgataaaatttggtgggtgtcgttttaaggcctttccctttcttatcagctaccgacacatttcccagccttgccacctctactcaccaaaacagtgccttttttttttctaaaaggaaaagaaaaatgaaaggtatctactgaccttggatcaaataaggttatgtttaagtttagtttagagatttcttccacttttccaagacctaaaatatgaagcagaatatagactatggtatctttatttagcaagaaccagcggacactgtgtttaccagtgggaaacacatcttaagttgacaagagatatggagataaccagaacaaaattaaccattagaatattaaaaactctactcccagaataaattacaaggaacaaagaaacaaagatttctaccactatcttattttgagtaattttaaataaataggaaaggattttgatctcatccttctgtaaaacgtctacctgccaacatttatgtttgcaattttcaataattgcaactacagacataatctttataagtatatattcatttgatgtctttcaccaataaagacctggtgttccaagtctcctatctgttccagaatttctatttcatgtgccaatatagctcttctttaaaaaatttcaagtcagttttgactccaactttaaaactatgcaacatagttttctgatatcctgagggattaattcttatgttgaacttcctaacaattccattttgatccctaaagctattttcatgcattttttaaatgaaagagaccttaaagatcaactagtctgtacctcttattctgcagatgatgcaattgatccaaggaacagttaaagtaacctgtgcagggtcactcagccaattaaaaatgatgcaactcaaagtagaaacaagatgtcccaaagcctagacccatagtcttgcactgaagaactggcaaatagaggctttcagatttgtttcacagaaaagaaaataatactttttaaattagtcaattatgtaaataaaatcggtgttttcaaacacttaataatcttttgtaaaagtacatttccttgtacatagtaaacgtggttttagaactgtttgtattttttattgcttaagatgattttctattggcactgtaacaaattacagcaaatttggcggtttaaaataacatttgtttattatctaacagctctcaaagacagaagcctagtaggtttggctagatcctcttcttaagatctttcaaggccaaaatcaaggtgtcagtgggactaggtccttctatagaaatcccaggataatctatttccaggctcattaagttgttggcaaaattctgtgtagttgtaagaccgaggtacttgtttccttgctgatctttgattgaaggttattcttaccttctagaggcagcctgctttcctctgcccatggcccctgaatcttcaaaggctgtaacaatgtgttgcatccttcttgtcctttggatctctcacttcatatgctgcacttccctaactactacttctgcctctgtttctaagggctcatgtgattgcactggacctacatggataatccaggataacctttattttaaggtcaactgattagtagccttatttacatctgtccctttggcaatgtaaagtaacttattcatggatatatcatcttattatattcactatccagggaattagagcatggaatctgcttggaaaccaaagttctaattattacatttagctcatatttattgatgcatccttaaggaaatgtgactggttttctacagatcacgttgttcaaactctaacaaaataaataactttgcattcctaatatttatatatccatttccaggaatggctctgattggccctgcttaggtccagtgcccacccctctaccaaccaccagggctggcttcatggcaatgtgaccagtgcagtcacacataatcctgggctcagaagggaccccacatttggggcttaatgctctgaagctaccaacttgaaattcttaaccctttgaatttgttttgtacatgaagtccaatagaacaattgagcatgtgccaggggcttgtttgtctgaaaaagaatgcatttctctttcattttttaagaatatttccaacaggtacaacattctagattgacattttttttccttttaccactttatagagatgtcattcagttatctcctgtcttctatcagttgaaaagtaggctatatttttgcttctttgaaggaaatgtcttttttcctttgaagacttttatcggccggacacagtggctcatgcctgtaatctcagcactatgggaggccgaggcaggcagatcacctgaggtcaggagttcaagaccagcctgaccaacacagagaaaccccatctctactaaaaataaaaaattaaccaagtgtggtggtgcatgcctataatcccagctactcaggaggctgaggcaggagaatcgcttgaacactggaggtggaggttgtggtgagccaagatcatgctattgcactccagcctgggcaacaagagtgaatttctgcctcaaaaaaaaaaatagacttttatcttctttggttttcagtggtttgactgccatgtgccctaaatgtgctttcattgtatttattccaatagtgctttttcattctgtggattgatgtctttcattgattttagaaaactcttggcctgaatctattaagataatgcttcttcctcaattcctactctcctattctcctgggactccaattagatggtagtcagccttttccactattatattatttacactattgattgtgtgttccattcttttattcctcccatgcactattctatatattttctaattgacccatcatccagttcactaattctttcctcagctgtctaattttctaataaactaatctattgagttcttcatttcagtcacagtttttatttctagaatttctttaaattatttttatggattcttattctgtgctgaaattatccaccttttcatcactttaaaaaaatattgatcataatttttttctgtttttggagagagggtcttactctgtcacccaggctggaatgcagtggttagaccatagctcactgcagccatgatctcccaggctcacattatccttcctcccatctcagcctctgtagtagctagactacaggcatgcaacaccatgcccagcttttgtttgtttgtttgtttgtttgtttgtttgtttttggttaagtagagaccagggaagtcttgctatgtcacccaggctggtctcaaactcctgagctcaagtgatcctcccacctcggcctcccaaagtgctaggattacagacatgactcaccacacctggccaattacagttatttaatagtccatgtctaatcattccaatatctagattactgtgagactgtttctatcctttcttgttttatattgtttttcttggtcctggcttctaatatgcatggtataattttttattaaatgccaagtgttgcgtataaaaaaattatagaaactctgcatgatgtctcttgcttccagcaatgacagacagttgaagtaaaggcagaccaccttaaaatcaagattgggtttatcaaagaatacattttgatttttgtaagtagtggcctatttatagttcttcctaactcctaggatatagccccacaagaattccaatgaaaagcttagagtgttttaccagggtccttcttcctccttcctgaattttagcttgcaggcactgtgaaactgccaaaagttctgctcatcctgtcaccatcttagctattgctgcttggtttctcagcttggcctgtgttgcttgcaaattgacagaacccaaggtgaaaaatgacaccaaatacagggctcacttcagtgtgtttcctttcattcttagatctttagctcttggtagtgctccaatgcctttagatatatatatttttctaatccagtttttttcattattcacagtgtaggccttagtttgaaataaactagtccatttacagccagaaatagaaatcagccactgactgatctgtggcctatctttatgtatgcctctatatcttattaattccaaaagtatttaagataagttgacacccttatatgacggttgatttgccttgtgttctatttcctgcttgaaacctaaactgttcactactctaatatcctaattaattttgttgtaattattatgtaaacttacattcaaaatgcttctcctcgatagctaaatctgactccttacatataatatttaacgtgtatttgggaggtcctttgcaaatgccgtcttgtacttactcatttttttaaatataagaaacagcattctcagagactagattatttcagagtaaaaatgaaaacatttataaacataagcactagtatttaatagaatgttgcctgtataattttgttctttgaaaacttatagttacctctcaaaggatataaaatttataaaacaggatgagcagaagctatgtataactcctatggttacattaacacaaaatctcggtaattcaaaattgaaatttattaaacatttctaagatgtaatttgtctctgaactaagaaaatgtcttattacataattaagtgtataagcattgtgaaggcagtttatcctactttaaaaaataaattgctgttaaggactgtcttaaggataccaacttttttttttttttttgagatggagtctcactttgttgcccaggctggagtgcagtggcgcaatctcggctcactgcaagctccgcctcccaggttcacgccattctcctgcctcagcctcccgagtagctgggactacaggcgcccaccaccacgcccagctaattttttgtatttttagtagagatggggtttcaccgtagccaggatggtctccatctcctgacctcgtgatccacctgcctcagcctcccaaagtgctgagattacaggcgtgagccactgttcccggccaaggatatcaactttttgtatggctatgaacagcatttaaaaatcagtttaatctatatcaaataataagaataataatacctatactatctcattttatttattttaaaaatgtcacttgtacatatacttagtaatgactgcaaattactatggataattgaaagtaccaaaaataaactgcaacacaggatttccctccccagcattttactgtcaaaaaaaaaaaaaaaaaaaaaaaaactggaaacctaggtacttcatcctccctaaagaatctttcataaaagtcatggtctttctacatttggttcctaaatgtactacattaactacaaactcagaaaaatgtttggccatagattttaaaaattgggaatgagtacagatagaacagataagtatacacaattatattttcccagctcaattgataactggcttttaatacaattatgggtcattattcagtattattattactgtggccaaaacatgaaattccatttttagcaggttccaattaatttccttggttggtcaaggaacctttcaagatttacaagcactcaagacacaaagcatctttcgtttttcttttttcaaatgctctattctatttcatctatttcccttgctcaaatctttatgactctttgttcatacttatcgatagagaagcagccaccacactggccatctatcagaaagtggtaatgagtttagcatgacaaaaaccagctgttgaaactgctgtattatgcacactgtatgttcataatacagtaatattgctattaatgaagagactgctatgtatttcaggaaccactgtatcagaaattcaactacagaaatgggagtaaaataagagatgtagacataccagggccagaatgacttctttggtgagaatcaatgttattcaaccatagcatcgtaccacattatatggagacattataggatgatggttaagacacagctttgatgtgaggcacttcaagcctttgctctgccacttattaatatttactatgtccttaagcaggttatttagcctctctatgctttagtgttctcatctataaaaccggggataacaatacctactttactggtttttcttaataagaatcaaataaaagtgaagttagaactcctaacccagtggctaacaaaaaaataagcagtcaataaacactttaaaaatattatgttttttttttttctctccatagattatgtgtctttttctctctgcctttggacctgatcactccgacactcttaccaacaccaggtgtttattacctatctttagaagtctacctttgcttcataggaactaccttagtgttttccatctcagactttgggattttatcttagttcacttcagacatactccagggatacagcagtgtacaatgggaaaagatttagacgtagtgttatcaaatagaaataaaatgtatgtcacatgtgtaattttacattttctactaggcatatttaaaaaggaagaatcagccagatgcactgcttatgcctgtagtcccagccactcaggaggctgaggcaggaggatcacttaggcccaggagttcatgcccagcatgggcagcatagcaagacccaatctcataaactaaaactggaagaaaaagaggaaaaagaaacaggtagcattttagtaatatatttatttgcatgaatatatccaaattattatgattttaacaagcagcaatcaccacatttcaagtgttcagtaactataggtgcttgctatattagacagtacaggcttagagtcaaatgaatgtggattcaaattctggccttgctttttacttgccatgcacttgctgtaaatctgtttcattatgttaaaaattactatctccagatattgtgagaattaaataaaaacagcatactcaaagcacttagcacaatgcttacttacaggcatgctcattcaatgagaattccctcacaccaaccttctactatagaactgaacactggctcaatacagtgaaatctgtgatccagattaagaggaaaggaagagaaaggaagccccccatcgtccttcctttctagctctctataaactgtggccatttctcccactcacacagctctccttctttgcttcctagcagctataaatttgactcggtagacttatttctagaatccctgaacccttgtagtcatgacccaagtatgtggttccaagaaactaaaaaaaaacccatgcctgaaagagaaatcctaccatctctttcttctctgcccctgtggtatccacctccccagctggccctactgcctagtcagacagagtttctcctttattcaggggttctcactgctgcagcttcctcagcctcagcaactgccattaacgttagtgcttctctattgaaagagagtctggcatcaaacattaaagaggctgagcagcattctgcaaaataactggacagtacccttcaaaagtgtcaatggcataaaagacaaagatcaaggaactggcatatactgaaggtgactaaagagacataaaaaataaaaaatgaaaatatgggatcttgagtaggatcttggcccaaaaaaaggacattagtgggaaaacaggtgaaatctgaataaggtctagacctattcgtctaataagattagatctaataatattctactgatgtcaatttcctggtttcaatacttgaactatggttctatataatgttaatattaggggatttgtgggaactctctacactatttttgcaacttttcttcaaaacaaataaaagtaaaattaagttaaaacacttttaaatgtgattatttaggactttattatgaaagaacctctgtcccgatggacttgttaagtgatatattattgtgaaatagtgcaacttatgttaagccaggaaggccatcacacaggttaacgaaaagtcaattccaaggtatagaaaattcaccttactcaccactatgagtttgtaaatcactaagagagtatgatgccacctacatatactatagtgaggacttgatgacagcaaatcatattttgtgcaaccaataatgttattaaataaatgtagctactgaataacatacttaaacaataactccactgtgaccaactttttacagaaagaaagagacagtgaaaaataagaaagatatgcaaaaaaataatatgcacccacctccctctgccagatctcccatgctttaggaaacaacactggtcaaccaactctgaacaaaaccccttgcaatagaaaggacagtctgctttgctatatatgtgtttctgtaacatgaattaacatagacaattggtaagtggagaaaagatttcagtgtaatgcagaagttacattggttcctatgtaatttttttcccagatgattaatgttttgccttattagtacaggcaactgaaggctacgtatactaatggcagcaaaccaggaaggaatcagtattatacattcagcctttctctgagaagtgctactgcaaagttaaccctgatctttgtttataaataactaaataaataaaacaaagtaacacaaaacaatgaggagagcatacaactctggtatcagtacattttgtacaaagcttacaagcttttctctatttatgacttgtaatgataatgtctttctgcccttgcatccacagacagcctcaacccttccttataccacctaccaccaagctatcttcaccttttatgttttaagtaaaacactacttttactgcagtttaattattagaaacttcatgtcttttaaactgtgttagtatttttattgacattgttattgttttcatcagtgctctggttataaagttgaataagccctactgatttaagtaagaatttggaaactgcaaattttccagaaaagcacacataatattatagtagaaatggtgtattaccacacattctgaatacattgtctcaagatttttttaatataaaaaggttatactggtttgttttcaaagattacttatttatcaatgaagtatactgttaatatcaatttctaaacaaaattacgaagtgtattttatcatcagctttaaatcgaacattttaatatacacttctgtatgtgtcacacatttcttaaataaataggatgttccaatgtagtaacaaaaattatcatctatgttaaaaacaaactgatgcattgtataagaaaagcaaatattcaatatttgatataaattaaatgtatattatgaactgcaatcaaaccaacatcaatcttctaaaatgaagcagtttctaaattgtatgaaaatacatggatatggtctagaaagcatgtttcatcataagactaaaaagatactttttattaggcagggtctcactgtcacccaggctggagtgcagtggcacaatcacagattactgcagtctcgacctcccaggctcaatcgatcttcctacctcagcctcccaggtagctaagaactacaggcacgcatcaccaaacccggctaatttttgtattttttgtagagacagggtttcaccgtgttgcccaggctggtctcaaactcctgggcttaagggatccacacaccttgccctcccaaagtgccaggattacaggcctgagccacctggccctgacctaaaaaaatactttaaataatgctaaagaagaatttagcatcagattttttgtttctttctcaaagcaacaatattgcttcacgatcatctgttgttaaatatataatactagtaactaagcactcttttatgtaaatggctcctcctaagaacaagcacatgaaagtttgtgttatttgtacatgacaaagatatagcacataactgagtcattaaaaacacagttcaggccgggcgcagtggctcacgcctgtaatcccagcactttgggaggccgaggtggatagattatgaggtcaggagatcaagaccatcgtggctaacacggtgaaacccgtctctactaaaaatacaaaaaattagctgggcgtggtggtgggcccctgtagtcccaactactcaggaggctgaagcaggagaatggcctgaacccaggaggcggggcttgcagtgagccgagatcccgccactgcactccagcctgcgcaacagagcgagactctgtttcaaaaaaaaaaaaaaaaaaaaaaaaaaaacacagttcaactggaatagctataatttatatatcaatcccaatttgaatagaatatttttgaagttaatgtatataataaatatcaatcactatgaatatttatataaaatagtagtgtgctctttttaatatactccatgatatggtaggatacttttatggacccatgcaaccctgaatatcaagcagccctgttttatttttcaattatctatttaagtccacttggttagagatagtcagcatgtttctcacgggaaaaaaaaaatactgcacaattgtctgcgtatagtgtgacctctttcacttgggtgggtatcctttccatcaccaactaagtgaggatataaccttgtcaaaccaaaggcaaaagaataataagcatatgacaggctaacccagcatggaaaaggttgtttaggaggttgcaaaaatagtactcggaatgacaaaataaaagtacacttcaaagagcaggttaatatttttaaaagcactcaaaacctgagaagcatttaatccccctccttggatgtctgccatacaaaactccacttgaatttatttcattagtcactaacgagatttggttaatatgttttcaaatgaatactggtagaatagtctgaaagaaacacatttatagaatatctatttccacaaagcactagccaaaggtaagtacaaataagcagatgatgtcttgcttttaccaattataaattaccatccaacaagaaaaaaatccttccaattcaagaatcagaaatacaaatgggaaaagtatttacccagtagcaggtttttactgtctccaaatcaaatggcagtaacactgctaccttaattgctacccctaactggcataacagggaatcatactacaacatttttataagtatttgaaaccagaagaaattagacaagtttggctacagtcttcctagtgtaaatttacttttaaagcaaacaaacaaaaatctccaaaccatttaggcctgtcctaggactatgtattatatcattgtgtcagttatacacactttgacattccttttctacattaagactggaatgaaatttttgatcctgaccagtcatcatattataacagtgaaacagtgccaccttttggacccaaacagaagcatccagtgctagtctttcaaacttcctttttcagttaaactcctgatgtacataaatgtcaatgattttcatgtcataattatcaccttctaggaatactttttaatctatacaaaccaagaaaacattggggtaacaaaaaagttgcttaccaagatgcaaaatttcaaaatattccaaagtagtaccaaatgcatgtatttttaataatttctaatcaacatttcattaaatacatttcaccaaatccaaatatgttagtcaactaacatattttaaatgcaaaaaattctttttatagcattgttacactgcaaaattgattttttaaaaatgcattgtatttaacatgtattcaatttaataattggcaatatgatattaacagtggattaccagttaaatcagcataagtataaataattttatatacaaatatagtatgcttctgagttacttacaccaatgatacaatgtcaccacggtgtacttcaaaattcctcactttccagtggttcaaaagcaccacatcagatgactggctccccccaggattcaaagaaggctagaaaataaggagaaagagacacttctatcatttgtatttttcaatcttcatggttcttgcacttcacagctcgagtggactgaaataaaacatttctaatacagtacctttctataaattgctgttctaaagtaactgcaaatgatgagttttcaaaaaggctcactgggattcttcacagatgaaccagaaaaaaataaattaccaatgcttatttgaaaggaacgtgtgctagacattaaaatctttagtaaactccaataaagaggtatgaaaagccttaagaataatataaaaacatgaggaagaagtgagtcaaacctcctaacaaaatatccagataggatctaattccacagtagtacacatcattgttccatctggggaaaagaagaaataatcccaaatcacagtcatgtccacaaatcttcacagtcatatgaaaaactgaagggggcaaaagaaagatgtgataggattaccattataaaatgtatggatttcccactttgacctctcttttctcaaaagagcacatatcctaagggtcctggtcccagtttgagcctaataaggggctttcatcctaggattcagagaagtctaactgtgcctgagggttaatggatcaagaactgagaaacattttgtgtaagaatttttctaaaggtcaggaaccatacaggcacaaaaatttgactggggaactatgaaaccagcatacctgtcatttggacaggggtacagacaaagccaatgaataacaagcttgaggcaagaacagggggacaaaataattagaaaagctaagatagccttttcactgttttttaaattttttttcattttttatttcaataggttttgtaagaaaagacagtgttcggttacatgagttaagttcttcagcagtgatttctgagattctggtgcacccatcacccgagcaacgtacactgtacccagtgtgtaggcttttatccctcaccaccacccacattttcccccaagtccccaaagtccaatgtgtcattcttatgcctttgtgccctcatagcttagctcccacatatcagtgagaacatacaatgtctggttttccattcatgacttacttcacttagattaatagtctccaattcctttcagattgctgtgaataacattatttcgttcctttttatggctgagtaatatatatacacaccacattttctttatccactcgttgactgatgggcatttgggctggttccatatttttgcaactgtaaattgtgctgctataaacgtgcgtgcaagtacacatctttttcatataatgagttattttttcatataatgagtttattttcctctgggtagatacctagtattgctagggactgctggatcaaacggttgatcgactttagttatttaaggaacctcgatgctgtttttcatagtggttgtactagtttacattgccaccagcagcgtaaaagtgtttccttttcaccacatacacatcaacatctattattctttgattttttgattatggccactcttgcaggagtgaggtagtattgcattgtggttttgatttgcacttccctgataattaaagatgttgaagattttttcatatgcttattggccatttgtgtatcttctcttgagaattgtctattcatgtcctcaatccactttttttttttttttttttttttttgagatggagtctcacaccgtcgcccaggctggagtgcagtggcatcatctccgctcactgcaatctccgcctcccgggttcatgccattctcctgcctcagcctcccgagtagctgggactagaggcgcctgccatcacgcccagctaattttttttatttttagtagagacggggtttcaccatgttagccaggatggtctcaatctcctgaccttgtgatctgcccgcctcggcctcccaaagtgctgggattacaggcgtgagccaccgcgcctggcctcagcccactttttgctgcggttgtcctttcttgctgatttgagttctgactctccaataatgctaccatgggaagtggccatttctgtggtgacaggaaaggtgccaagcttcctctccgccttcactgaggggctgatgacagcagccagtggagacacaacaacaaccagggcagaagcaaggaaaatagtgaacgcagggcaacagccagtccctggagcagtaatgacgtgccttttgttaaagattcctgggattatttgcagattttctacaaagcaagagttgacaaatatgtcaaaattctgcatggaggctattatcttgacactatttttgatccagggttttgcagctgaaaaatactggttatccttgaacacctcaaacactttcagaactttcaccaactcctttagtgataatacctaaatccctaacttaaattccctgctactcatttcacttaactacctgacaaaaaattcaacaggattaaaatggaatttgttatcatttcaacaaataaatttttttttgagacagtctcttctgcttttctgcctcagcctcctgagtagagctgcgactacaggtgtgcgccactatgcccagctaatttttgtatttttagtagagacggggtttcaccatattggccaggctggtctcgaactcctgatctcgtgatccgcccgcctcagcctcccaaagtgctgtcattacacacgtgagccaccacgcctgccctcttttttttttttttttttttaagagggtctcgctctgtcacttaggctggagtgcaccggcatgatcatagttcactgtagccttgaactcctgggctcagtctcccagttccagttcccaggtagctaggactacaggtctacaagtgcataccaccacatccagctaagtcgggttttttttttcctttttttttttttagagatgggagggtcttgctatgttgagcaggatggtcttgaactcctgacctcaagcaatcctcctgccttatcaaccaaagcgctgagattacaggtaggagccaccatgcccagccctttcttattttcttacatccgggttacccttttcccagtcaaccagtttaaaaacttagttgtcttcttacttctcatccaaccagtcagcaagctaaagggatctttttttaatcataatgtcttctacttctggcacgttttctttcctctctagtatcatcatatttcaagcaccaatcattatgtaactcatgctatatctacactaatcagtctctcacctccaacttagaaatgattccatttctttctagttatatgatcttcagcaagttacttaacttcattatgccactcattactaggaaaatggtgatgaataataactattatctaattaataattaaataataatagccaatacctacgaagtacttaccatgtgtcctggtctaataataatagccagacatgttaagtgcttaccatgtgcaagacactgtttaacagctttacaaatatagttgacccttgaataacacaggtttgaactgcgtgggtccaacaatacacagatttttttcaataaaagttacactgagtgtgcctgcctctcctgcttccctttcccacctcttctacatctgccacccctgagacagtaagactaactcctcttctttctcctcctcctccttagcctactcaatatgaagacagtgaggatgaagtcctttacgatgatcctcttccacttaagaaacaaaaatatatttttctctttcttatgatgttcttaataacattttcttttccctatcttactttattgtaaaaatatagtatataatacatatagcatataaaaatatgtgttaatctcactgtttatgttaacagtaaggcttctggtcaggagcagactattagtagttaagttgtggggtgtgggacagtcaaaagttatatgcaaatttttaactgcatgggagttgggtccctcaccccctcgttgttcaagagtgaactgcgctaccttatttggtaagatcattcatttaaagtgcttatggtagttcttggcccatacttacctctcagtaacttctattattgatatttctacatcacaattttaattttaagcaggtctgtactctctacccccaggttcctcctatgtctctatctctagtgaggaacagagttgatatggtagcataagtccaaagggctttactgagccatggtgctgaggaatggagcttttgtcatcacaacagtaggtcagattattaaaaggtgagctttcacaagggtatgctctctatctcattcatatttctcattcaaattctctatctccctcttcctctctgtctttgacctcagtatccacaggtcctcttccctaatttatttgtattctttttcctatataactgacactgtaaaggtgacctggagggagaccatctgggctctggaccataaagagaaaatattcctattgaactttcactgcattcgttttttttttcttttttcttgccataatagtgaaggaacaaaaggtgatttaattatttctgactgttctccttggtctcttttactggtgttttttttgaagtttgtgaccacaactcataagatcaaaaatcccaagttcaccatcacagcctatgattatttctataataatatttaaatatgcattataatcactcccttgtctctctttccaagagtctataagctctttttttttctaagttttgagaataaattatttcctatgcctatatttttgagatcgagcactttgcaggtaattaacacattttagtggaaagaatttaaaaaaatcaattagtggaatttccaaagattttcaaaattaacaaggtcaaaacaaagatcctattccagcccactccagcccccaaatatacttcccctccttatttaacagtagtaccacttaccctatcccccatactagaagactcataagtcaggtccagtttctaacccgctctttggatgcctcattatcagacttcccctctgtcaagaatgttttttccccacttggaaacttctagtcatttgtcaaagtccttatctgatggggactcctctgtaaagcctttaaaaagaataaaaaacatgctgcagttcccttaaggaaattggaaaattatatcttggtgttccaacaatggggatagaaaaatccccactgacccaaattttaacttcgtctttcccttatagaatcactcaaatgcccaacttttctaattgtaattgttagaaccaaaaggtaaagcattataaacaaaagatttatgcaagggaagaaaacagaaggaagcatgtctaacttccaatagtgaagtaagtattagaatcaacagtcaacacctgaatgacattgcttgattttataaaggaagcaacagagttttcttttaccttttctttcctccacaagtttaaattagctactccctcatgtgcgctcccatagcaatgcaggtacttaataggtatctgcctacagataagactcttccactcaggtgtaagtttctcaactgctgaaaccgtgtcttagccatttttgtacacctaatcccagaacagtgattggaaaataatatttctataaagtctaaaagattaaaggtttttaaaagcgtatttaaatcagatagtttctagaatatacattatctaaataatgtatacatctctttcaatgaaaacatattctagataagtatagcaataaattttttgtgtctcatcaagttaggcaatttaagagttagaaatagttgaatagggctttgttattcataatgaaataatggtaatcacaacacaataaactatcttgtttatttattaatctaacacttatgaatatcaacaaaacatcataaagaaaaaccttcttgaattgggaagttgttcctatggcactataagaaccacagttttctgtacttcactaaaaacaaaagctttattaaaaagaaaaaaaacaggccgggcgcagtggctcacgcctgtaatcccagcactttgggaggccaaggtgggtggatcacgaggtcaggagatcgagaccatcctggctaacacggtgaaaccccgtctctaccaaaaatgcaaaaaaaaattagccgggcgtgggggcgggcgcctgtagtcccagctactcgggaggctgagacaggagaacggcgtgaacccgggaggcggagcttgcagtgagcggagatcgcgccactgcactccagcctgggcgacagagcaagactccgtctcaaaaaaaaagaaaaaaacagtggccggtcacggtggttcacgcctgtaatcccagcactttgggaggccgaggcaggcagatcatgaggtcaggagatcgagatcatcctggctcaacacggtgaaaccccgtctctgccaaaaaattagccgggtgtagtggtgggccgctgtagtcccagctactcgggaggctgaggcaggagaatggcgtgaacccaggaggcggggcttgcagtgagccgagaccacgccactgcactccagcctggggcgacagagcaagactccgtctctaaaaaaaatatagagcaagcaattttttcaaatcgatgaagttaaacacatcaagtagaaattaaaagtcataaataataatttgatatggccacagaatctgtattttcttgttatattgttaatatttaaatcctagattccaagagactacatcaaaatataactaacttaaaataataaagtgtttgaagaaatctcagagaatatttaatctaggagtttccacctgtatctccaagtatttgattgtatcagatattcctgctagtagtcacagtgatttccagtagcaaaaggaaaaacactaacaaagaacaaaaaaagccaaacatctgctctggactgagtaagaaagacccaccctcacccaaggtgggcagacaccatacaattagttgagagcttggaaacaacaacaaggaagaggaaaggtaaatattctctgtctgtctctctcaacaacttgcattctcacactcatctatttctctgcttctaccatggaccactaaagttaaaaatcaaacttggagaagtgttttgaatagtccttgccctaaacacagaaaactatgttcaaatcttgtctccatttcttattaaccatattactttaaacagattatttaacctgtctcatttcctcatctataaaatggggactgactgcaggaacactgatctcatggagttgctacaagaattaaatgagacagtctacaaaacattacagtcatgaaacagagtagcagtcaacaaataggacactaatgatgatggcaacaataacaaaataaagggaaacaatatcaggtacagtatcctttccacaagatttaagaaaaattaaacatttaaatattgccctgcacatttctcattttacatagtaaactgaaagtattcaggcagaaaattctacccctcatttctaaattctttgttgattgtttcctcacttttttaaagcaagtaaagttaggatgcttttatgtggggccttaattgttctgcctctataaattaatccaaaaaaatttaatatgcataattagttatgaatacctataaaatacctaaagaattttacacccgttatgttttacattcttatttttaaaacatatacacacatacagatatatataaaaacatatgcatttaaaaatctaacagttcttagctctggttgatgaaatgatttccattttctccctccctactgcttacccctccccacaccttgttttcctctggctcagttgtatctcacaaattgttttttataatgaacatatatttagtttgtatgctttgctctgacctaagtactatatagttcactctaagaaatacaatataagtcagcatatttcaacagatgttagtaagttatgctaaagctagaaatagccaatatctatcaaatctgcttttggaacaagcataacacaaaagttaggctttaatcttttctctgatcaaagactatgctgaaggatttttatttgtcctacaaacaaatattattgtcaaggtatcctaaatcctcagcttgtgtctaacctcaaatcatatgacaggtttggaagaatttatctttcggtttacgaaaataaaattctcctagagaattaagcacagtcacagtacacttcctgttttgtaagacttaactgaagccatcaatcaataaatgatattattctggctttttactataaattttttattcattttttaattttaaagaatctacagcctatgattcactgcctccaagatataaagaaagcctggttttgaccttacttctttgggtacaatgctttcaaccttttcaggcttataaaaagcaccactcacactggctacatacaatctacaacaggtaaatatcaaactttgtgcttttaagtgagatggagcccagctgcagccacaaggacccaacagtagccctcagacttcttttgaagaaccattactttgaagacatatctgtggaggcgggggcaataacagaagaaactgaaatagtactgttgatttagactttttaacactgcagcactggccaagaagcatgaagtaagtacagttaaagtaaatgtacattctgattaagaattattagatgtcacacctttgaaagaatgcggacaatatggtctacaatgccgtctttcttcccttgctattcaggggtctccataatttgcatggcttctagaattctcagatttgtctcactaggtgtgcataataaaatagactataatgtacccaggtctgtacaaagctgtaagttagaaatggaacattccttttatatcatgggtacttattacccataccccttctgatggttaattttaggtgtcaacttgactagattaaggctacccagaatgctaagaaagcattattctgggtatatctgtgagggagtgttcccaggagagattggcctttgaagcactggattgagtaagaaagatccaccctcacccaacatgggcaggcaccatgcaattagttgagggcttggatacaagaacaaggaagaggaaaggtaaatattttcatattctctctcgctctctctctcctgacgctgggacaaccttcttctctttccattgcaaatcttagaactccaggtcctctgacttttagactctgggacttgaaccagcagcccccaggtctcaggcccttggccttggactgagagttataccatcagcttctgtggttctgaggccttcagacttggactgagccaagctacctggacctccagcttgcacatagcctataatgaaacttcttagcctccatgatcacatgacccaattcccctaataaattccctctcatagatagatacatagatagatagatagatagatagatagacagacagacagataaatatcctattcgttctgtctctccggtgagatctaattataatataatttcttaatttttcttttaaaagcaagcctgtaaaactacattaataaaataaaagtgaacatataacatattgatttaattcagaattacactaggttgttaatttttcattctcctaatcttaactgcatgttctactatagaacgccccatcaaagtgtcacaggcacgctcacatactacctgtaggaatgaaaatctttataaactatcaacaaggtaatttgccaaaatatatttaaagtcttaaaagtgatcttgtccttagacttgaaaatgtcacatttaaaaagatttcctaagaaactaattggacatatgtgcaaaggaacatatacaaagatattcataatacattatttacaatagtgaatagcttcttagtcttttagctaaaatcaagtgaataactgagccaagctcaataccaataataggaaactgattaaaccttggtttagcaatggttaaactttatggatattaaaaaatgattgtaaaaattacattgtggaaaaatatatatttggatatgtctggagaataagtgaaaaatgcgacatagaaaaaacaaactgctatgatccaatttcaggaaagacaggacggaagaaaaaagggaaaaaccttaaaagaataaagtaaagaaggaaattgtgcagaaaagaaagagagtaacttataatggtttagaaatgcaaacttcaaagtcagaagctgggtttaaatctatgcaatcttcagtaagttatcccatctctctgattgtatttcttcatctgttaagtgggctaacatagtatcttcatcatacagttgtgggtgatattaaataaactaatatatataaagtcaatactgtaatgacttgaacatagtgatcattcaataatttttcactattagtattatataataatatatttaaaataaataattctgaaaggtggtatcaattatttattttccacatttttctatgttttctaagttttttgccaatcaatatgcagtgcttttatattaatgtaagcactaagcaatgaattgtttttgaaggggaaagcatctgatttttatatcctcttattactaatatttttaaagtttgtgttctttaaacaagctcttcagtatttaagcatctctttaattcaggtcgctacaactagattgcaaggttcaaatctgcaaagtttctgtttcaatgcactaattataaaatactaccattaaatacgtgcattgtgtttcctagctaataaaacatgttttgagatagctattctaatttatagttctaattaaccatatcagaaatagatcacatatagtcaatgaaatataaaatttatataaacatatctgcatattaacctgaagacagactgctatatataaaataagccagctacacggaaaaaccccagcaagatacatgcggaatctttaacttcctcataaaactgaataaggctttcctattcattgctaagtttttcttgctcagaaccacttttctgtctcctaacctaattaaaaaaaaaaaggtcatagtaaggtgtgtagcacagaaaggaagtgattcaacaaataacaaagattttaggaggctgcatgattccctcagaagcatgtaactccaaagaggccaaattccccaacatatacaatggtgtagcaatctattcacatggcttatataatatctgtgaacaaatctgtgaagataataccatggattttagatcctttagttcttcattgttgaacctgatgctgcattataaggaaaaaaataaaaaagaaccagtcagcatcctaacactacaaatgtgtatcaacaggaattttggtacctgggtaccctaaattacattgatcaaagctataagaacaaaggagctcaaatgcataggaaacagcttatcaaaaggaactgaaaagcattctggcagataaaaagggggaaaaaaggatatataccttatatcatttatctactgctacaaaacaaaccactccaaaacttaaaacaaaaatcatttattggttcatgattccacaatttaggctatgcttagctatgcaattagccagcttgtctggctgtgatcactcaggcagctgcagccatggaggcagcagtgttccaggagcaaaaactccctcgtgtaagcatctaccaagcctctgtttgcgtatttgctgatattccaccagccaaaatgagtcataaggccaagtcaagaatcagcataggtgaggatgacatagagctcagtaccgaggagcatgactcatgggggatggggtagacagggaatatcaatgtaataatctaccaaaactctgccctctagctccaatgaatcatatccctcacatatgcaaaatacatataacccttcctaagagccccaaggtctcctcagatgtttgcaataggattcatatccgttaattcatgatatgcatcaggtcccaggtcccagtatggaagaggactctagggtgcagctcatctcaaatcagagacttatgaagtgaaaagataaattatctgttccccaaacaccaaacatataatggaaagacagaaagaagataaccatggattttaaaaagcaatgaaaaaagcatagaagtcacttgtccatagaaagcttaaaatccagcagcatgtgttgtcaaggcctcccatctcatggagagaaatgtcctttaattaagattcttttctgttctctggaatggttccctaatttattggtctgcatggctcttagctctgccctctgggctttgggctcttttttaaaaaggaggcccggtggagccaagatggccaaataggaacagctctggtctacagctcccagaatgagcgacgcagaagacgggtgatttctgcatttccatctgaggtaccgggttcatctcactagggagtgccagacagcaggtgcaggacagtgggtgcagagcaccaggcacaagccaaagcagggtgaggcattgcctcactcgggaagcacaaggggtcagggagttccctttcctagtcaaagaaagaggtgacagatggcacctggaaaatcgggtcactcccaccctaatactgcgcttttccaacaggcttaaaaaaacggcataccaggagattatatcccgcacctggctcagagggtcctatgcccatggagtctcgctgattgctagcacagcagtctgagatcaaaatgcaaggcggcagcgaggctggggaaggggcgcctgccattgccgaggctcgattaggtaaacaaagcagccctgaagctcgaactacgcggagactaccacagctcaaggaggcctgcctgcctctgtaggctccacctctgggggcagggcacagacaaacaaaaagacagcagtaacctctgcagacttaaatgtccctgtctgacagctttgaagagagtagtggttctcccagcacacagctggagatctgagaaagggcagactgcctcctcaagtgggtccctgactcccaagcagcctaaatgggaggcatccgccagtacgggcagactgacacctcacatggccgggtactcctctgagacaaaacttccagaggaacaatcaggcaggagcatttgcggatcaccaacatccacttttctacagccaccgctgttctgcagccaccgctgctgatacccaggcatacagggtctggagtggacatctagcaaactccaacagacctgcagctgagggtcctgtctgttagaaggaaaactaacaaacagaaaggacatccacaccaaaaacccatctgtacgtcaccatcatcaaagaccaaaagtagataaaaccacaaagatgggggaaaaacagagcagaaaaactggaaactctaaaaagcagagtgcctctcctcctccaaaggaacgcagctcctcaccagcaacggaacaaagctggacggagaatgactttgacgagttgagagaagaaggcttcagacgatcaaactactccgagctacaggaggaaattcaaaccaatggcaaagaagttaaaaactttgaaaaaaaattagacgaatggatacctagaataaccaatgcagagaagtccttaaaggagctgatggagctgaaagccaaggctcgagaactacgtgaagaatgcagaagcctcaggagccgatgcgatcaactggaagaaagggtatcagtgatggaagacgaaatgaatgaaatgaagcgagaagggaagtttagagaaaaaagaataaaaagaaacaaacaaagcctccaagaaatatgggactatgtgaaaagaccaaatctacgtctgattggtgtacctgaaagtgacggggagaatggaaccaacttggaaaacactctgcaggatattatccaggagaacttccccagtctagcaaggcaggccaacattcaaattcaggaaatacagagaacgccacaaagatactcctcgagaagagcaactccaagacacataactgtcacattcaccaaagttgaaatgaaggaaaaaatgttaagggcagccagagagaaaggtcgggttacccacaaagggaagcccatcagacaaacagcggatctctcagcagaaactctacaagccagaagagagtgggggccaatattcaacattcttaaagaaaagaattttcaacccagaatttcatatccagccaaactaagcttcataagtgaaggagaaataaaatactttacagagatgcacatgctgagagattctgtcaccaccaggcctgccctaaaagagctcctgaaggaagcactaaacatagaaaggaacaaccggtaccagccactgcaaaacatgccaaaatgtaaagaccatcaaggctaggaagaaactgcatcaactaatgagcaaaataaccagctaacatcataatgacaggaccaaattcacacataacaatattaactttaaatgtaaatgggctaaatgctccaattaaaagacacagactggcaaattggataaagagtcatacatcagtgtgctgtattcaggaaacccatctcacgtgcagagacacacataggctcaaaataaagggatggaggaagatctaccaagcaaatggaaaacaaaaaaaggcagggattgcaatcctagtctctgacaaaacagactttaaaccaacaaagatcaaaagagacaaagaaggccattacataatggtaaagggatcaattcaacaagaagagctaactatcctaaatatatatgcacccaatacaggagcacccaggttcataaagcaagtccttagtgacctacaaagagacttagactcccacacaataataatgggagactttaacaccccgctgtcaacattagacagatcaacgagacagaaagttaacaaggatatccaggaattgaactcacctctgccccaagcatacctaatagacatctacagaactctccaccccaaatcaacagaatatacattttttttcagcaccacaccacacctattccaaaattgaccacatagttggaagtaaagcactcctcagcaaatgtaaaaaacagaaattataacaaactatctctcagaccacagtgcaatcaaactagaactcaggattaagaaactcactcaaaaccactcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgcagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaagatcaacaaaatcgatagactgctagcaagactaataaagaaaaaaagagagaagaatcaaatagacacaataaaaaatgataaaggggatatcacaaccgatcccacagaaatacaaactaccatcagagaatactacaaacacctctacgcaaataactagaaaatctagaagaaatggataaattcctcaacacatacaccctcccaagactaaaccaggaagaagctgaatctctgaatagaacaataagaggctctgaaattgtggcaataatcaatagcttaccaaccaaaaaaagtccaggaccagatggattcacagccgaattctaccagaggtacaaggaggagctggtaccattccttctgaaactattccaatcaatagaaaaagagggaatcctccctaactcattttaggaggccagcatcatcctgataccaaagcctggcagagacacaacaaaaaaagagaattttagaccaatatccttgatgaacattgatgcaaaaatcctcaataaaatactggcaaaccaaatccagcagcacatcaaaaagcttttccaccatgatcaagtgggcttcatccctgggatgaaaggctagttcaacatacacaaatcaataaatgtaatccagcatataaacagaaccaaagacaaaaaccacatgattatctcaatagatgcagaaaaggcctttgacaaaattcaacaacccttcatgctaaaaactctcaataaattagatattgatgggacgtatctcaaaataataagagctatctatgacaaacccacagccaatatcatactgaatggacaaaaactggaagcattccctttgaaaactggcacaagacagggatgccctctctcaccactcctattcaacatagtgttggaaattctggccagtgcaatcaggcaggagaaggaaataaagggtattcaattaggaaaagaggaagtcaaattgtccctgtttgcagatgacatgattgtatatctagaaaaccctattgtctcagcccaaaatctccttaagctgataagcaacttcagcaaagtctcaggatacaaaatcaatgcacaaaaatcacaagcattcttatacaccaataacagacaaacagagagccaaatcatgagtgaactaccattcacaattgcttcaaagagaataaaatacctaggaatccaacttacaagggatgtgaaagacctcttcaaggagaactacaaaccactgctcaatgaaataaaagaggatataaacaaatggaagggcattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcctgcatcaccaagtcaatcctaagccaaaagaacaaagctggaggcatcatgctacctgacttcaaactatactacaaggctacagtaaccaaaacagcatggtactggtaccaaaacagagatatagattaatggaacagaacagagccctcagaaataatgccgcatatctacaaccatctgatctttgacaaacctgacaaaaacaagcaatggggaaaggatttcctatttaataaatggtgctgggaaaactggctagccatgtgtagaaagctgaaactggatcccttccttacaccttatacaaaaattaattcaagatggattaaagacttacatgttagacctaaaaccataaaaaccctagaagaaaacctaggcaataccattcaggacataggcatgggcaaggacttcatgtctaaaacaccaaaagcaatggcaacaaaagccaaaactgacaaatgggatctaattaaactaaagagcttctgcacagcaaaagaaactaccatcagagtcaacaggcaacctacaaaatgggaaaaaattttcgcaacctactcatctgacaaagggctaatatccagaatctacaaagaactcaaacaaatttacaagaaaaaaaacaaacaaccccatcaaaaagtgggcaaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggtgattcctcagggatctagaactagaaataccatttgacccagccatcccattgctgggtatatacccaaaggattgtaaatcatgctgctgtaaaggcacacacacatatatattgtggcactattcacaatagcaaagacttggaaccaacccaaatgtccaacaatgatagactaggttaagaaaatgtggcacatatacaccatggaatactatgcagccataaaaaatgatgagttcatgtcctttgtagggacatggatgaaactggaaaccatcattctcagcaaactattgcaagaacaaaaaaccaaacaccacatgttctcactcataggtgggaattgaacaatgagaacacatggacacaggaaggggaacatcacacagtggggactgttgtggggtggggggagcggggagggatagcattaggagatatatgtaatgctaaatgacgagttaatgggtgcagcacaccaacatggcacatgtatacatatgtaacaaacctgcacattgtgcacatgtaccctaaaacttaaagtataataataataaaattaaaaaagaaagaaaggaggccaggctcacacctgtaaccccagcttcttgggaggcgggaggatggctccaggccaaaagtttgagaacacctgggcaacatagtgagactgcctccacacacaaaaattttaaaaattagctgtccaggacttcgaggctgattgcaccaatgcactccagcctgggcaacagagcaagaccctgtctctttaaaataataataataataataataatataaaaataaataataaatttttaaaaagaaatgctccttcataataaggtggacacaccccagaggtctctttctaaattgaccccattttagtacaagttaattcaacacccttaaaatgttgtagacttcccattaatctagttggggctcattccattccccccaaaactacatccatatcttccttcttttttctttttcttgccctgtcccccaggctgcagtgcagtggtgcaatctcagctcactgcaacctccgcctcccaggttcaagcgattctcctgcctcagcctccagagtagctgggactacaggcacatgccaccacaccaggctagtttttgtatttttagtagagacaggttttaccatgttggccaggatggtctcaatctcctaacctcgtgatccacctgccttggcctcccaaagtgctgggattacaggcgtgagccaccacgcccgacccttaatttttttcaaaccagatctttctttactttgaaagtgtcaggctgctgtggcacaaagccctgaagagtttacaatatattttgtctaattaaaaagatatactaagtaccaccttatatctttctgaggttttttttgtttttgcttttgtttttgtttgagacagagtctcacggtgtcacccaggctgaaatgcagtggcacagtcttggtttattgcaacctctgccttctgagctctggtgatcctcccacctcagcctcccaagtagctgggactacaggcgcatgccaccaagcctagctaagttttctatttttagtagagacagagtttcgccagttgcccaggttggtctcaaactcctgggctcaagttatcttcaagccttggcctccccaagtgctgggattataggcgtgagccactacacccagccctgaggtcttaataaagagtcttccagtcctgatttgatctctacccgaggctatttcttattttgaggatcttttgcctgctagatactgggaatgaaaaatagttttattttccaacccaaaaaagttctgggcaccctatatttcctctaatttctgctataagttcatttctctcttcccatatcttatataaagctatacgaagccagctgacaatttcaatattttcgcctggaaatctccttagccaaatctataagatcattaggtatatcttctatttttcaagttcttacagttcacatttttaaaaaatgtttaagtaccataaaacacagatcatcgtaattccagtccgcagtaacagatactttactatctttctgttttctattaacagttgtttgccatttgtccagcgtctgccaacactcccctcaccacattaccagccccaaactgccacccagtccccaaatcaatgctacatattttaggtttttgttatagtatcacttcactaatagtaccaatttttgtttcagttatctcttgcttcataacaaaccactccaaaactatatgtctaaaaagaacaaccaaaatgtatctgcttgtgatcctgcaattttggcttccctcagctggaaagttcaagatggcttcattgacatgtcaggcactcaactggggctggaaggccaggatgcttcatttattctccaaaatctccgtcatcaggatagcctgagtttttacatgtacccagctcacaagtactgaccaagctcctacttgagcagtatttgcttatatcctactgaccaaaacaagtcacatggtcagagtcattgtgggaggaaactacacaaatcaatgagggaggcctgattcactatggaatcattaccataaaaatctacacatatctcatactaaatgaatgggccatccattcagctgacaatcttgtgactgtgctttctgttgatcattttaaaagctacagaaataaaagatagtttatattttaaaaagaaagaaaaaaattcactgacaaaaaaataaaaattttaaagataactaaatagtcttaaaagcaaatgacaagctaaaaagtataaaacaggcattttaaaaaataaaattaaaaaagtttacgaagaaataaaaataaagttcataaaatagaaaaatgtttaattaaaacttaaaaattaaaaaaagaacataattataaaatgatatacccattggtataatattgttgtggtctttctactccttagctcaggtaggtccgagttcttgtcgcacaaccaggaagaattaggcatgcagacaccagagagtcagtaaagtagaatttaacaggcgaaaaaggaaagctttcagccaagagagggcacagagggtgggaggggtatggttcccctatctgaaggcagggaagtccccagtgtggctgggtccagggccttttatatactcagaatggggagagtgtgttgattggtttgtgagtatgcaaaaaatgttaaagcaaagacaccactcaaaggtgggcacgacagagtagaaaaccaattaggaaagggtaggtatatgtgaaataggtgaatggtggggatctatcagaggaaatcatgccaaataggcaagttctcaatccagtctgaggatgtaacttgtagcttggctttcaggctttaaactgtcttgggcttggaaggggggtttcactggggacccaccctatctgcctaggcatttggctgcttcctgccactctcaatattagaaacaataagctaaaattagcacaaatatatgataaataatttaacagacaaagagatgggaaataaaacaaattttttaaaagttataagactaagaattcaaaagtttagtaaacaaaggcaatcaggattttccaagcaaaagcaattaccatgtctagcaaatcccccaacaatttgccctcacccaagacatggagctctccttaagaaaatggttctcaaactttagtatttacagagtttgttaatgcagattccaaggtcctcacaaaacgattctaatttcataggtctgaaatggggctcattaatcttcattaataagtaccccagattatgtaataaaaaaggcccaaggaccacagcagctacaaaagggttttctcaaacaagggacagactatggggctccttatccttcgtgttgcacttattgcttgaagtgcttatgacaagcccacatttaaaatttcagaatcaaaagttaacatgctccactcccttagttatagctcaatttgagctgtctcacccttgtaagcttccctccagcaataaagcagcattttgcaaactacaggtcacaaccaatgagtgagtcagaatcatcaatttaataggttatgaccagaacagaaaatatcagagggcattgcacataatgatagtaattacaatttaagtattgttacatgaaacttttgttccagttgcatgtatgtgtgtatagtgcaaaatatattacttaatatgagtcatgagcaaaaaggtttgaaaatctctgccataaagaatatgatgaatttgtcaagaagctaaaaactttttaggagaatagttcaccagaaacaccctcaaagtctaagaaaaaaaaaattttaatgatcataatttcattttatcatatttctgtagggtttaattattcaggcatatcaatgcttcaaagaagaaatttcatatgcatttattccagcatccctctgaactagcaggtgagaggattatggtcccctttcttttagaaacttacagagtagagttattattaacccatgaaattaataattagagggcagtacaaaaggatttataatcatgagttaaacttacaatgctgtaggatttctaataagtgaatgacagaattaaagaaagttacatgaagaaaatagagcttgagtttagacttaaagggaacttcagaaaaagcagaggagaaaaggtataataatgagtcgtgttatacagtcagaataggctaaatgcttgtaaaaagaatttcaaaagctcagtggtataacacaatagtgagtggactgactccacacaatcattcagaaacccagttttttcgagcttgtacatctaccatcccctgcggcatcgtgtcctcaactggatcctctgctgtattgtattatatacatacatatacataaatatagatatagatattgatacagatatcaaaatcagtatagatatcctgtatattatgatgttttgacacgttaaaaaaaacattcctagctggggagacactgcctctgccagacctagccaattcttccagctagcaagagctcaaccagaagcatgcctttcatatacaaactaaccaatccagaaccatacctcctccagccagcataaccctggagacaatttcctctgccttcatcttcccaaggccaggtaccaggcaaccagggaccacccctacagcttagaatctgccaaaattattcaaactagccagtcctaaactgttcattctgccctgccttgccttgccttgcctgcacagaaaccccaaaaaggctttggcctagctgctattgtcatctgcttcctgaccactctggtgtctttcccatgtggccccacataccgtgctttaccttcctgtctctaggacctgtaagtctaataaactttgttttcctgagcctctcctctgtctgctctagtggccatacctaactaaccaactcataaaagaatacaaaacatctgccttcagccagcagacagaggagagagcatggaggatcacaaagatttttcatgggccaggcctaaaaatggcacttcacttcctcccattttccactggccagacctcagtaacctctgatatcaggaaagattaaaaaacaggacaagaaatcatccattcatcattagtcatccctcttacaactaaaacaccctgaacataacaccacacacaaaaatataggaggatctgcaaggtggaaagaagataaactagaggctaggaaccacaggacttgagaaatgacaccatcgctcccctggactttctttttgcttctcatatatcctagatcaggcactagggaatcctgcaacctgtagctaccaacaggccaagcaaaaaaaagggcctgaagacgtggtggccaacacctgtaatccagcactttgggaggctgaaacgggcagatcgcttgagctcaggagtttgagaccagcctgggcaacatggtgaaaccccatctctaccaaaaataccaaataaaattagccaggcatggtggtgcaagcctgtaatcccagctactcagggggctgaggcacaagaatgtcttgagcccaggaagcagaggttgcagtgagcggagatcgcgccactgcactccagcctgggcaacagagtctccctctgttgaacaaaaaaaaaaaaaaaggccttaagaaaagcctactctctctagccaaaggaccaggaaaaggaagacctagcagaacagaaacatttttgctaataaccatcctaatccagtcaaacatcaaaggaaaaactaccccaccccatcccccaacaccatggtgtcagcagggcccagcaaggagctggacttctaaccccactcagcaattaggagatggggcaagtaggcccttcacttccccgtatcaggtgtcaaagaggtggaatgagagtgcaagtggtgccagttagcagcccactttccccaccccagttagttgagcaatttctttagaagttaaacataaatgtaccatgccactcagcaaccccactattacgtatctgcccaagagaaatgaaatcatgtatatacacgtaactgtacacaaatatctatagcagcattactcacgataatgaaaacatcaaaacccaaacatttatcatctggtgagtggagaaacaaaatgtggtatattcatacagagaatactttttgcaataaacagacacaaaatgctaatacatagtacaacatggctaaacctcaaaaaaatctagtaagtaaaagagccagtcaggaaaaaccacattagtatggttctatttacaggaaaggttcagaaaaggcaaatctataaatcagatcagcagttgcctaaggaaagagatgggagtgaggattaacttcaaacaagcataaggttcctttctcaggtgatgaaaatattttaaaaccgggttatggtaatgattgcatgactccataagtttacttttaatactatttattgatattttattatataaaacataatttttaataaaaaattcaagtcatcccaaagcgttctacagattcaattgcactatctttaaaactctgatgtcatttttcgcagaaatacacaacacaatcctaaattcatatggaaccacaaaagaccctgaatagccaaacaatcttaagcaagaagaacaaagctggaggcatcacactacttaactcaaatgcaaaattatagtaatcaaaacagtatggtactagcataaaaacagacatatagaccaatgtaatagaatagagaatccagaaataaatgtacacatttatgaaaaatcaattttcaacaaagatgccaagaacatacaatgaggaaagaataggttcttcaataaatggtgcttggaaaactgaatatccacatgaagaagaataaaatcagacccttatctcacaccatatacaaaaatcaactctcaatggatttttaaagatgatgcctgaaactgtaaaactacctgaaactgtaaaactactagaagaaaacatagggagaaaagctccatgacactgatctgagcaatgatttgttagatacgaccccaaaagcacaagcaacaaagcaaaaatagacagctgagctcctatcaaactgaaaagtttctgaagagagaaggaaacaatcaacatggtaaagagacaatctatggaatggaagaaaatatttgcaaaccatatatctaataaggggttaatgtataaaatataaggtacacaaacaactctatagcaagaaaacaacttgattttaaaataggaaaaagacctgtatagagaattctcaagacatacaaatggcccagaagcatataaaaaatattcaatatcactaattatcagggaaatggaaattaaattaaatgtgcaatgagatgtcacctcatacctgttaggaaggctattatcagaaattcaagagataaatgttggtgagaatatgcagaaaagagaacccttgtgctctattggtaggaatgtaaattagttcaaccattatgaaaaatagggatatatctcaaagaattgaaaacagaactaccagatgatctaccactctcacttctggatatgtatccaaaggaaatgaaatcagtaagtcaaagaaatatcttcactcccatttcattgcagaattattcaaaacagccaagatatggaagtaacctaaatgctcataaatggatgaagggataaagaaagtgtagtcagtgtgggtgtgggtttctgtatatatatgagtgcgtgtggatattcttctgcaggtgtatatatacacacacacagtggtatatatactatgaaatattattcagcttttaaaaagaaggaaatcttgttatttgtgacagtgtggatgaacctagagaacattatgttaaatgaaataagccaggcacagaaagacaaatactgcatgatctcacttatatgggtaatcaaaaaaagctggactcacagaagcagagagtagaatagtggttgcaaagagctgagaagtagggaaaatgagaagatgttggtcacagtatacaaagtttcagttatgtaggattaataatttctggaagtctaatgtacagcaaggtgactatagctaataatactgtattatacactcgaattttactaagagagtagatcttaaatgttctcaccaccaaaaagaaggtaactatatgaagtaaagggtatgttaattagtttgtggtaatcatttcataatgtctacacatatcaaaatatcatgtatactgttctcactcacaggtgggaactgaacaatgagaacacttggacacagaatgggcaacatcgcacaccggggcctgtggtggggttgggggatgggggagggatagcattaggagatatacctaatgtaaatgacgagttaatgggtgtggcacaccaacatggcacatgtatacatatgtaacaaacctgcacattgtgcacatgtaccctaaaacttaaagtataataaaaatatatatatatcatgtatactttaaatatatgtaattgttgccagtttacctcagtaaagctggaaaacatcattacatcacttacaatgggtaaattcaatggtatataaattatacctcaataaaaatgtgttttaaaaagtagatggactggcataatgaaccaccatgtaatccatcacctagagccaacaattatggattcatagccaatcttgtttcatctgtaacccttctacttttattcttgccatattattttaaagtacatctcagctattatgcatttcactgcaaattttataatattcatactatgaggataagggttttttttaacataacagcagtaaataccattatcaccccaaaaaacaatgtatcaaagcacaagtgatataagtagtgctttgcttgaccattttagataatctcttgttgctttctgctattttcattctcctctctttctttcaactacatttagtatctgatagctccaatttctaaagcctttaaagtctagttcggctaatggttgcttctgactctcacttacagagctcattttctcatgcaatatttttactgggatataatgttcatcaaactttatctttgggattctataaggcctggttgcaagctgcatgtgcccagggaatttggtgcctgaggctgctctaaacccaggccactgtaaattaatatctcagtttagggtttttcaggtgcagtgaatgtgaattcaaacctcaattccacatcagggctttctctctcagagcctagacaatttttcttacagaacagatttttgctttagtctacccatttcctaaagatgtgtctcttctatggtcctgactttattaagaatttctgttccaatttcctgccttctatgagcctatggccttgtcttctgatccccatgtggccattgaaaccaaaagctctaaatgaccaggaattgacaaatatccatgtgacagctactgactttaatgtatacttactgccctggaaatgtattcccccttattgtggtctctgagaatttcccttgcttccctgcaagttagttacacatttttaaagtttttaatgttttgtttttaattttttaagagttttgcactgggaatatttcaagatgtttcatctgctatatttccagatagtctaatcccttcttataaactttaaaatctttagactttttataagagaaacgtatcttccatcaacctgagcggcacagtttaaaatctttttcccccattataacataaagcttaatttctatatttaagtcctaaatgtactacagaatcataccaaaattaaataacttactaagtacatcattccataaaccaaaataaaatggaataaaacatcactgtgagaaggaatagtataaacaggcaccaaaacagtgacaaggcacaacttttattagttattatttagtgaaatggacagcactgtcagagttggttcaagccagagttccaaaattcaatgattgtctgagcttacgtaaagtacctcaactgtctgagcctcagttgtttcaaatgtaaaatttagaacttgagtcatttcttaatgtatttaaagctctatactactatgaataaagtgttaaattttaaaatcagctgaagaaaagcattaatataccaatcagcaagcatcgtgactcaggaagaatgtacaagagtatcaagaattaaaggggcatgatgtatgcaacctactttcagatggtttaataagattttttgagggtatatattcatacacgcataaatacagagggagaggaagaggagggggaggaggaggaagagagagagaagagggagggaaaaaagataataaaataaatatactaaaatattgaaactggtgtatctgggtagagaagccataggagttctacgcactactcttgcaacttttgtgtaaatctaaatttacaacaagtttttaaaaagtgtaataaagttggtatttaaataacagatataaccctggctatataaaacagaaacacatagttattctatcatgggaagtgaagaaaaatccacaaagggacattacaaatttatcactcaccaactgtttcaggaacacacgtttgttgctataaatacaaagtctctattaatgacaggttacagaactatgtaaaaactcataactcatcctaaggggtaaaacatcaggtgagatttctgagccaaaagtaatttgggcagaaagcacgcaagtaagccaataaagcattccaacattaaatcctgacttcctttgacgtcagccccagcagaccaaggtgagtgacgacacagagaagtcagcacaggaggaaatgtgtgccagcttgtgcccagtatcttggaagtgcaaatttaccaggtaacataaaactccataactctatcttaaatgctggtatataaatcacaatgtatctcttttcttaagagtctgtatccagcttctcagagttcaaaataagttacaagcaataatgactgttgagtattattaagctgactgtaggttaaaattttttaaaaaaaacatagattgaaagagagcttgctttttgatgatacttttaatttcaaactcagcaggaaacaagataatcacaggtagctgaaagtcaagacaatttaaaacccataaatgtatgttattgatgaacaaagacctcaatgctaattaaactgcattttccttcatattctgtaatttcctaatatattctgcatacattatctctaaggtctgacctagagatacagtattgtgtagcagtgttttcaagtatttttgccctctggccatgcaaatgaaaaaaggaaaatggtacactatgtaaaaattatgtatcaattgcaaaaaaaaaaaaagataatgacacaaaattatttattttacttactttttaaagtcttaaatcttagttttaaatgtggaaagcatataccttttatcaggaccagtgaccccactgcaggaattctcactcaaataaaatctaaaactttggcatgaggtcattaaactattcctagggcacccttttacgctaaaagcctctgtaagcgattaaagttctaatttgaataattacattccacctacataaattccctctgtagtttcaactgtatgcaatatcagtcttcatttcctgaattaaattaatgtcgtgtaatgtggtgcttcttttttaaaaaaagaagtacatctactttcataggtaacctttcagcaaccagtaaaagtgattcatgtgcatgaggggaataggtcagtatgaataatcattaaccaacaatttgtgccagcatttattgtgtcgagcattgcaaaagggacaactcatataatgaaatgaatgcagctatacggctttataaaaatcaaatattttataaactaaatcctattttccattgaatttaccaatgcatcattagaaactttattttttatttatggcttgcctttaattagctgatacttcccatgtttgatcacccttatctttctagtcaaatacttaatgaattgcaaattaatactgaaaatcctaacttaaaaaaagaaccactgagtagtgtttaaaaagtaaataagtatttctcatagagggaatcttaaaaacatgcttcccctaatcacaaaccaacagaatttttgaaagaccgaaaaacaattcttacagcaaaatttgttactcaaagtgaatttccagtgtaaccaaaacagtatttattcaataaacccaaaagactagtattacacctccctttaatgagatttaatctttcgatccttggatatttcttaaataatgtgtctaccagttgctgagtgaccttcaagagtggcttttcccagagtaaagaaaaacagctgtgttccttgcaggatgctcagtgacttccagagatctccacaccatgccaactatttcagtccttgagtcattagagaaatttaaagagaagaatttatcccaattgtcaaaaattctgttgaaccccatgacataaacgtgtttagttgatcaaagctgtatagtagcaaagatgtcttcaaatatgttgaattagttaatccctaaatctcattattataatttctgctcttaaagaatttaaagtatgatttactggcatctagtgaaactgtaaattaaattatctattatacctagagttggtctcaaattcatgaaatatagatccaattgtaaaaacatattttcctttcttcctagaattccattctactttgattctgaaaatagcatcctctttcctctaggaaatgtcacctgtactccaatccccaattcccacagaacaatgtgattcaaagagatgctgtcattttcttacagatcacttggcctagccacaggcttggggtgtgtacttgttcaaagctggaccaatcacggtaccccattctggtggccaaagttgatctgtatagttgtatagataagggcatgtgacccaagctgaatacatcacagtccttccccaagatattccacactgaaatcaaggcagtaggagcaatctctctcaggcggtgaagaaactgggcatgcgagctgccagcagccatgtaccctgctatgcagagaaaactggtctgagagaactaagccaagatgcagagaagaacttaaaaaagacggagcactccagcggcatccaagtcctggctctagttgtccctgacaactgtctcactcgtgccttccttgtgtgtatataataagccttccaataaatcccctttataccaagctattttcctattaccagtagccaaggaaactatacaatataccaaacaaattctaacataatacatttgacttcttagggatagggcctaggaatactgcaagaaatcctaatacctctgcaaattcaaatatatctaatgcaaacctgggtttaatccatgaaccgacatttagaaataacatgatttaacactttcttcactgccttcttcactggggataagccttgtcctttcataaggcagtcaaggtcttgtgagcaagacctgtatcttatattttgcaatgaattgctctctcagcacaagccatgaacatagatgttcagtaggaatatattaggctaaaaatatgaagattgggatattatgattgccacatgatcctctggaatatcatcagatccaaagtaaggagattttgtgttctggaaaagtccttcttagaatagtgatagctgtatagcaagacagcagtaacaaaattgggggaaaaaaaatcattcttaaactgattatttgttaccaaaagatacatgcttgtgaatggattcaaagggatccttgggaccaaaaaggaatgtgggtggctgtgaagaaggcagttttaatctgaaatgaagaatctgactccaaagctcagcaaagaaagtctacgtttccctaaggattgagtctaagacaaggctgctaggaattcaagattaaagaggcaacgaatgtaaaatacattctatcttaaacatattaaagtgtatttaaagccatatgcctataaatctttctttctatgtttactgtacccctacattaagatattttggcattcaaagtaagtgaccagtttgctttgggctggtgatccactatggagagaacctgaaagacacggttgagagcagaatcttctgcccaagaaaaggccctaaccatgctcaaatgatggaagtagaatataaaggcagtcctgttttaaaaatgtagcttttcccaaagaagctaaaggatttcctgaccttctgtatctgactaccagaactcagggagaagttcaataccataattataataaataaagcaaactaattctaactccttaaagctgataactatgcccttaactagttctaactgaaacaaaaagaaaaaaaattaagctggttattctctgtataattttgattttttagaagcttatatattcattttagttatttgttttatacaactatttaccacaacgcatgaacttaatacatattgataatacaggaaaccaaatcctataacaaaatgcaaattctgcctaactgcttaaacttactaaaaaagctaggttctagacatcaactttaggacaacataattttctctaagttattccagaagactatttgcataaaacttttggaaatctccactccaaagttcttccactgtaaactgcacttaatcttttcaattagcaacatgcttaaagaacacaatacaatatctgggatcaatggtctagacatttctacaaactgaaatcatatacctatataacaagagagcaactgattgtgactcaaacccatcttgcaactacactaataatttggcattaaaaggatattctaatagagccatattcacagaaaacagtgtcatttagtataatttcttaagaatctccatttaaaattctcagaaaaatttaaactacagacccagagaactgatagttacttttattaacctctcctctgattataatacgactgtattagaagaccttaagaacaaattcagtaaagtaaaatttcatttcaatgcctttttataacctttcagttcccagaataggaataataattagcactctcatttctagtgcttgaaaaacaatgaagtatgtgctttaaagaacgaagttatatcattttcacctgcatcgatgctccttctactcttgccacacaggcgacccgatccaagaaagtcactgccacaggcaccgccacaaagaagcctttacaaaaggccttgatgtatcttttcacccacccttgtgactgtgccatacctaaaaatacaaagaaaacaactatgaaattagtctcaagaaaggtgaaaaacaaagacataaaaacagtacatgaaaagtaagagttaccgaagggcaatcttgtctcttaatatattacacactcattcctgtaaccattagaataaatctgacttacttaaagtcctaaagtgaaatacgtgaactcaggttaatgcttttccacaactcaagtccacttgctaacttcagtgggaaatttctccccacaaaacagtaagttagaaaaaaacaagcattccagaagtaaattcttttctgttgctattatgatgaagttactccttatacccctgatatctgttctcttctacagtaataaaagtttcagtggaacatgtggctgcccaactaaagactgttttccagcctcccttgcagctaattgtgaccatgtcactggatttgatcaacagcatgagtagaaaggatataattcttggttgcaccctgaaaaggaggatgccctcccttttcttccccattttataactgtaatactaacaatttggtggtaggagcaggggtggccatctcaaactatgagataaaagcttcaagtaaagatgacaaagcaacaaaatggaacgatcctaggtccgcaacaccatggaggcaccatactgtcctgcattgcttacatttggactgttaaatcacagataaatcacttgcgctgtttgtggtggcagtgttggtgttgttgttgtcgttgttgtttttagacagggtctcactctgtcacccaagctggagtcttggcaagacttttttggataagacttcaaaagcacagtcaatcatagcaaaaacagacaatggagattacatcaagctaaaaagtttctgtgcagcaaacaatcaacgtaatgaagagacaacctacagaatggaagaaaatataaggaaactatacttctgacaagaggctaatatccaaaaacgcataaggaactccaacaattcaatagcaaaaagacaacccaattaaaaaatgcccaagagcttaacaataatttctcaaaagaagacatacaaatagccaacaggtatatgaaaagaatgcgcagtcatgagggaaatgcaaatcaaaaccacatggatatcattccaccccagttagaatggccattatcaaaaggcaacaagtgctggcaaaggtggagcaaaaggaacccttatatctgtttatgggaatgtaaattaatatggccattacagaaaagagtatggaggttcctcaaaaagttaaaaatagaactaccacatgattctgcaatcctattcttaggaatatatccaaaggaactgaaatcagtatattgaagagatatttgcactcttatgtttatcacagcactattcacaatagccaaggtatggaattaatccaagtgtccatcaatggatgaatgaactttaagatgtgagatacatatatatatattatttcaccataaaaaaagaatgaaatcctgccatctggtacaacatggaaaaacctggaggacattaagtaaaataacccaggcacagaaagacaatattgcacgaccactcatatatagaatctaaatagttaaactcataaaagtagagagtagaagggtagttaccagaaggtggggtagttagtggggaggagaggttggggagatgttgctcaaaggatatataattatatttaggaggaatacatttcaggacatctattgttcagtaaggtgagtacagttaatggtaagatattgtattcttgaaaaatgtaaacagagtggatgttatatgctcttaccacaaaaatgataaatatgttaggtaatgcatttattaattagctagatttaaccattccacaatgtacatgtacttcaaaacattatgttgtatacaataaaactcacaatgttatctgttcactcataaaataaataaaaataaaaatactcaaccactaattccctcccaaatctttaacatgtcacaggaaaaagatgaatgataatctaaattggctaattctgaattacctactgtaactgacatcaatgagggctatatgtatgcaaggtaagtaagaccagtactcttgttttttatacttttatcaacatatattgcacataacattcacccaaaccagtaatctttttatacctaatcaaaataatgtaactcagactaactttagaatataagcaatttaaaaacatgttttcattcaaactcatctaacaactataatcttaagttaaattgcttatgagttcacacatctggtactcaagaaacgtgtttggcccaaggtactgattgtttctgcgagcagtcttaaccactatattcctaaaagagtaaacctgcttgacatgtttcattcattcatacccagctttaatgtgagcccttgagtgaaactaatttctcttcaatgacgtcttttgcctagaatcaaaacacctttactaactcattttatatatctctacaaaagatttaatatacttttccaatggactattttacaaagatcccatttatcatgtactacctccattaatataaaagaataaccttgacatatttatcaaatcagtaccttcaagatgcaaaagatgcattttcctcaatattagatttcattagctcagtctctctgaaaacacttctaaccacaggtttagcaacacaaacatcagtcttataataaatttaaaaacggaatgacctccacatctattctttttattgtttccaaaatatatataaataaataaataaatccaaagatttcagattataaaatatctgaatccacaaataatttataaaatgctcccatgtacataggaaaaaaaatagttactacgtagaagagaaaggaaacggctcaacagtaaataatcaattcctctttgaccagtttgatagcttcaaagttattttaagtggtctacacttatgtttaagtcatatacaactcccagataataattccagggtagtgttccccaagcttgccttgactgacatgcttaaaaatgaagatccccactccgactcagacctccaaaatcaaacacttcaggtgattcccttaatagagcaagtctggaaaatactgatatttgggtgtttaaaggtcagctgtttactcactcctcaagtttattaccttctgaaaatgaaaacaggggaaaagttagcaaagaaatatcaccctgaatgtctcctcacatttagtttacctccttactagattaagaaaaagtatctgcagaacaaacattgcacagaaaatgaacaccactaccagatcctactttgtaacctctacgtggttccatcagaaaatgacttccagtggattttctctttgccccactaaggcagttcaatcatccatccactcatctacccagtcacttactacctggctcattcattctttcaaccagtatttactaacggtcttccacaagcactgtgttaggtaccagggaatcataaaacagtgaacaaggccagtcccagtccctgatcttatcaagtttttacagtcaactatggagtgataagggtcaatctgaaaatcacataaacatacataagagttgtaataagtgctataagagagatacacagaggtcaggaaaggtctttgaggaagaggctgaactgaaaaatgaggagaacttctctagataaagaactgtgggtaggcaagggtattccagagagcagccatgtcacatgccaaagtccctgggtcaggagtggccatgttgtgatggacaactgaagggaggctggtgcagataaagcacacaggaagtggaagagcacagtgggacatgaatgggaggaggcaatgtaaatcccagagcagttaagacctcacaggccccgtaaggatttgcagcaaatgagaagtaactgaaatgttctaaaattgaggtgaatgatcctatctgcattttgaaataatcatctatctgaaagcctggataggacaaaaatggatatagggaaaccacattattctagtggtccagggcaagagatgatagttggagtagcatgatagtggagatggattaaaatgggcagatttatgtatatattttggaagttaaactgacaggatctggaaatagatggacaatggtgggagaaggaaggagataagaaagtgtcaaggggccgtggtagcctgtcaaagcactgctattctgttgttctcttgaattacatgtcaaaatatttaatactaaaattatgctcataattccattcctcaaactttttttttggcaaacaagcagatgtgctccctgccctcaaggagttacaatataccaaggaagactgcccttcaacaattatttccaatggatgagcattaaaagggacgatggccctgaagcatgacagcatgaagcaaggctgtctattcatcagaaaatgatcaaggaaggcctgccccactccacccccacccccaaaaaatggcatttgaggcaagacctcggcatttcaggtaaaagcagtaacatatatgaaggcctaggggcaaaataaaatgtagctgtttaagaaactaaaataagttcagtttggatagagtatatacagaatttattacgtgaatttttaattcagtaagcatttatttgctatcaagcagcaatgctaagtacagaggatataaagatggctaagcatacagtatagtaccattcaaaaactctcactaaacaataccttacatttcaacatacatttatatgtgcacataaaagtatttaaaattgaatatttatattgttttaattgtttaataaccactcatatgttacttgtgtaattattaaagtataccaaaagagggaagaaagcagcatcaaaatgctagcagtggttaattctatatgctaggaatggagacgattactattttcttctttgaatttttgctggtttctaaaacagaaagatggtatctgccctaggaagtcactatgatatacagataatacggggtaacactagtgttaatttctatcccatcacaatgaacaaaccacactctcaccccaatctctgctgctctaagtagtacaaataacactgagcaagattctttcctgtttatgcagcaatcaatatatttaactgactataatgttgtttatgtagccagtgcaggctatctatatttctggaaacttctggaaagttctgtcaaatattcgctacttttattttaagaggcacagaatggaaacatgtcttctctttgctgttcatcatgccctgcatgcatggaccttcacaaaacagctgaggatacctgcaggacagaaacggaatgcttccaaatatgatgccacagctatcttagttataaggtagtatgcatgattaaaatgtaaattaagggggaaacattaataaaagttgcattaaattcacatttcctgaattgtgagcctcctcttcttttccagtaatgctctcctacattacttctactccatgtagtcactggtccccaaaaaggagcatggtaatgagactcaggagacctgaggtagatatctgtctctgtctataaccagttccatgactttgaacaagtcacttctggcctgtttcctcatgtgtgacaagaaggggcttatttgggaggccaagcaagagggtcacttcaggtcaggagttcgaggccagcctgagcaacacagcaagacttccatctctaaaaatttaaaaattagcaaggcatggtagcatacacctgtagtcctatctacttgggaggctgaggtggaaggactgcttgagctaaggagtttgagactgcagtgagctatgactgtgccaccacactacagcctaggtgaccaaacaagaccctgtctccaaaaagggggggggggtagatttaatatctaaggttctttctaagccagaattctttatttctataactttttattgtcttttaactgtttcttaagaactttggcagatactaaaacaaacactgagatcactattgactaagaaaaagtgagttgcctttatggtttgagacttttttaagtattgaaaataaaagagaattaactttttttaaacaactggttaaaagacccaacagtgagggagctgaaaccagtgccaatgatgtaaaagaacattttaaatatagataaagacctgaacaccgttgctctttcacttctcatttccacaacctgactgctgaccagagcattgctaccatcgcctgcacaacaaagtcagggcaagtgtttttctgagagattataaaggagcatgtgggagatgtctcaatctgatatgtgctgatcctgctccaagccaaggaagcaagagcaataaaagctaccctggaaacaaggtacaagtggttgctattttcagaggctcaaaagaaaacgctcaattcagtcctgttttatctgaattgtgaggggcacctatatttcataataataaaacactgttaaaagcttctatcatgtaaatactaaagaagccattcatacatgaagaaatgaacacaacatttctatgttgtcatatccaataattttcttaaagttttatggcattcacatattggcaaagttaatgcacctccttgtctatgtaaattgccaaagaatcattcagatgatccggtcttttgttcacaccttaaatgtttaaaaccaccacagtaataagtacctagccccgacttcctctgggaaaatttcatctaagcaataacaatcaggtactaaaatcacccccagcaaaaagggaataatttttatcagttacctcattcttcttgtaactatggaagtcactgaggttcaaaacactgctcctgagaaaattattgcttaaaattgtaagtacacccagttcattgttgaagtgcttaaactgagaatattttttaaataagctttcagaatcaagtgaaaccatatttgccacctggcatacagcacttacaagtgagagtttcttggtgatgctgacctcaaccacataacaacccacactgtaaatttctctccttcccgtaacaacttgtggcttgatcatgcattaattcatctaaaattgttcttaagcctgcttatattttagcttgtacaaagtcaccaatcactcatccatggcaaccaggtggataaatccaccacaagtcatcctaattataaaaactatttaaaagttgtgtgggaggtttgaaggtaagaggaaaataataagttataaagcagtatcttatgtaaaatgtaacctttcaatcatcataagcctacacaaaatcaagattttatttataaagaggaaaccatcaaactatgaatatcagagaacacaagagtagggatccaagcaaatctgacacacaattcctgaatcagtcagtatatgtgtacctaccatgcaccatggaattgtgctaagagataaatatgtgttatagaacaaggtcagcatggtcctttctccacgtagagtttgcattttcattctttcaacattaagtgcctactttgtgctagacactatgttaagacaccagattgaccaagccatacttcctccccagagggacctgtgacaaggtcacaagaaacaagtatatgaccataaataatccagctatcatcctccacggatctttctagcagcccctggtaccaataacctggctcggcaaacagagcctaagcatgtgaaaaatcaggagacatttggatacatgtggtctaatacaaggataaaaaagaaaaactgatgaattacaacaattttggttccactggaagcagatcctggcaagtaatctatagaaagcaatttaaaaaattttttcaggactatcttgctcctttcacattataagtaaacaatattttataaacagacacttagtactctttagaacatgaataccagtatcaaattctttatctttagtcttgtctgacctagtagttctcacttgaaaattctcaggaaagaccaaaatggcacatacacaaaaaaagaaataagaaagaaagaggaaaaccagccaaaaataataaaggaggagaaatgtaattatgtaaggcataaagttagtcattttttggcaaagatacccaataaaaaagtcaacactgatacaatgatgaagctaagccctataaaattgcttctttcatggagataattgtgactttctgttggtaaactgataagcatctggatactaagagaagagaggttaaaactgatgtattcaatcttaagtcagcaatatgtaaaaacaaatgaatttgaaggtcatgctctagtacaactgatgtagagagaaaatacaaccaggaaacaactaggatacagaaattcataaaggcttcctgatttttggtaaggactccttcaacttgcaaacatcatgcatttatgcacacccttccctctgattcagtggaaaagcaggccccatcctatccaaggtgctcttcagaagcagcatcagcaaagagggaaagtcagtgaaaacctggtgggctttgaatccaagacctcagttcaaatcgtgattcaacagtgtggaaattactttatctcagtaagcaaaatttttcatctgtgaaaccttgcagggtttccagaggttcaaaatgttcatatgtgtttgttttcttttgtttacataagcatttgtgtaaagaaaatgactagatcatcaaataaaggatatttcttcagataaagcactagctatgtctaaggaagaggactagtaataacaaatcaaaaaaggataacagaattaaggatgtccattacagacaataaaccaataaagcccatcttctaggtgataagacacctaatacataatcattttgttctgctttgaacctcatgctgttctaagatttgaccagttaggggcaatcatatgtactgatattaaccagttaacaagaatgtattcagcactgtcttaggtgtcttgagatttttttaaaagcaaaataaaaggaaatataagacttagtgccagaattggaccacagggatagattatataatattcattgaggaaagaataaaaaggaagaaaactggaattacaggaaaaaaattcatgatgagaaaggctaaaaagaaaaaaaaaggaattagaatgtaggtggtgggtttaaaaatgttcattataaaattcttagaatgtttctgtatgtttaaaatttttcctcaaaactttggaaataaaagaataaattacatctgttaagtcactcagataaaagaaaaatataattagaatgaagatgcatacagcccatctgagatagcaagaatgctggccagatcagcgaacaggacctatattaagacaagtgagacataagactgaatattaattttttttttttttttgaggcagagtcttgctctgtcacccaggctggagtgcagtggtgtcagctcactgcaagctccgcctcccgggttcacgccatcctcctgtctcagcctccagagtagctgggactacaggcgcccaccaccacgcccggctaattttgttttggtatttttagtagaaacagggtttcaccatgttagccaggatggtctcaatttcctgaccttgtgatccgcccgcctcggcctcccaaagtgctgggattacaggcatgagccactgcgtccggcctgaatacgaatttttcttgttttagttgttttctttttttttttttcctcatcaatatggacatcttcatggctccagtatttttggaaaccatataaagcaaaatcctttaacaataatctaggactctctaagaactggctcaggccatcctaatcctataaattatccttatcctgtaactccaaatagacaccatttaacagcatttacaaccaaggcctaatctcaaatttcagttattaaaatgaaataaattctgcaaaaagtttaccataaaaattaataagacagtgaatagctttttacaggagaaaaatcctattaaatgataaccattagcacggagaagcttggtaagctttaaaccctaataaccacaaaatttggatttcaacactgtactttatttttttccaatttaatagaaaagcataactgctatcattaagtagaagctaaaggcaacgtgaattttaagctaacaatgtgaggacttaaatatgtatataaatgaaacagaccagctacttatccataacccaagcaaagcaattagaggatacttttcaccataagtccattttttcttgaagtaataatacagtgggttagtaaaaggatatattaccagcatcaggaatacttactgaatagctaagaagaaaatactgcattatttggcatttgggctgtgttcaaaattggctttaaaaaaattaagaaggcctataaatggaaaaagcactctttttagaaaaaaaaaatctcaagaacctttcaaaaatcaaaacttagaagaagtgagataggggaaataagaaaaaggtagtaacactcagaacctaaaaaaagaagggtacaaaatattagaaagtgggcattaggcaataacatgagtaatggaaaagtatcactagaaaccatgtgacagccagtttccaaagcacggtcatccaagtaccaagctttgctgttccttatctactttgctacctcacattttttcctactatctgacactgcttcatattcacttctcttacactgcagccctacttcggtcttattttagaatggtacaagggtcttattagggctcaacaataagcggaattgaaaaacttttttaaagaacatggtttctgggtctcatgaaaatcctatcctgatccctactcttcatgcctcaaatatattgctatctatactagaatgcaaatgcctttactagaatgccatatcaactcaagtcatacttacaacatggcttttcctttgatcagggttgggagtaaggagtaggaaggcttctcaaaagaatcaggccactagaccccaagggacaaaaatggaaagagaaagtcacaaaaaagtaggactgaaaaatacaatttaaccagcaaacttatagctagcccagggactattactactctttacaaaatgataaatacaaaaaaattagaaacacaggctcccccatcaggaaagcacattaaggctccaattagtctgtcaaaaataaaatctattcagactatggcttgaagatttggaaaggtgcccacagcccatgtatggcagctgcaagtccatggggagttcaaacagcaacagtgcagagtcagtactgaagatgcaagccagaggaaaagatttatgcaatttaaggtgaaagcaacagaaataaactcccttggaatgagtgcttatggtccttttagcttataagtgcaagtgtacccacaaacatgcatgcacacttgctgaaatggcaacaaaggccaagttagcagcatatgttaaaaaagaaaaagtaaaaataaatatataaataaatagaacagccaagaggccagagtataaagcagctcatcctgagtggcctggagataaaagcagatggagcacagcattacccagactcaagtgtctgttgcacaaaaagtccaggtattataacgagcctgtggtattacagcaaatggaactgcgatctcatttagattattctccactcttatatgccttgttttgatttctgcatacttgcctataaattggaagacactgttttaagatacctgtgaaatttcatcaactgtggctagagttgaaatcttaacttcaaccttaagagaaacactgaatcagaactacaaagctgacccgctcctaaatttctgatgatccatggaaactgtgtgagataataaatgtgttaagccactgatttgggtggttatttgttttgcagaaatgactaatacaatacaaaatgcacaaaaagacccaagggcgcaaagaaacttggtatttgataaagtcgacattcatattgggaagagaagttgaattaacaagttatgttgaaacaattagctacaatttggaaggagaataaaatcaaagctagatatttattaaattcattataagaaaataaattccagataagccaaacattatatgtaataaatagaaatataaaaataacaagagaaaataaaggcaacagtcttttaagggtagaaagaggtctttctgaacattttacaaaatccagaaaacatgaaagataaatactgatagatttcactacataaaaatcaaaacataccataaataatgttaaaagacaatcagcaggacataaaaaattataatatcagtatctctaaaattacacaattcttataaagtataagaaaaaagacaataattttgagagaaaggtatttcactgaaacaaaatatggacagtatataaagacataaaaagatgtacaaacacactaataataaaatcaatataaataaaaacaaagtactactttagtctatcaaactgacaaatttaatatggtaatatgtaccaaaatgttacatgaatataccttctgatgcagaaacaccactccaggaatttattttatggatgcaaagatatgatcaacgatattcaacataccatttttattgcagtgaaaaaatgaaaacaaccaaatgttcacaaatatgtaaataaattatgacatgcatacagtagagtaatctgcaatcattaaaaagaacaatatatcgttatattgcttgagattctcctccaaaaaagttggaaaattgcatttttaatatgaacccatttatgtgaaattttatacacacacagcatcatcctcatcgtcatccttatcatcatcatcatagaaagaggtcaaataataaagaatatgaaccaaaatgatgacagtatttatttgcaatgaaaggaatttcactttatgctttatatttttccatattacttaaatcttcagtaataggtatttagtatctttatatactaaaacaaaattaatattacagtcttttctgctacaatagctatttcttaatgtaaattagctcatatataggaaaatgacgtcagtcttatgtgaaagctatgctggttcatacacaattttccccagtacatgaaggttttgattcaaccaagagcaagtcttctcccaattaaagtgaaagtctcatttggtggcttcaagactttccactgttaaaggaggctgagcataccaacgaagaaatgcaaagatattttcccctgtgtttaaaatagaataaaatcaacagatcaatatcctagagcagattttcaactttgatgaaattggtctgtattagaagtagatgactttaaggacctacaacaaaggaagaaaaccagggtttcaagctaagactgatgtgatgctgggtgcaaatgcaaggagggagttaatagtgctcgtttttatgacaacttctattttctcagctctgtttacaaaatgtcactggtttcaaatgatctgttcctagccctattttctttataagccctaaaattttatggtttaattttgcagaattaaagatttttcaggaatgcatgtatgtcattaataggagaaatgcctctactattctgagtaaaatgcagtaaggtagagaaatgttccatatcaaaaagaaacaaaaaacaaaaaaaggaagcaaaaaggagaaatgaaggaagggagggaaggaaagaaagagggggaaaaagaggaagaggaaagaaaaaaactgcacacttcactttgttttagtgagagtgtctaacgaaagatattaaatgcagggcaaaacaatctcattaatattcttgatttataccacacattttgattctatatgagatatatctaaagaaatggtctttgccccatcggacacttaaaatctaaacaagggagtgaattaaacagtcatcaactatggtggggcaggaaaagggactaatccaattaactttaggacacagttatttaattatacccaacccaagggtatagagtcaaatactataggcggtatttgggctgggaagttggggggtggggaatgcaaacagtgagagaaacaattgtgaaactacttaagatacattgtaggactcagcaaatgagttgggagaacagtggtgactgtgggaaaagggagataaaaatacacagtgggaatcagggaagaatgctgtggggccctggaagcaaaaccatatagaagtagcaatgagtatatgtagtactcaattcttagggtctaataccattccctactccaaagaatcagcaatcttcagagtaaaggttgattctggggctgtggtggggaaggtttaagatgagcctgaaacattttctttggccactaagaagtgcttagaaaaaagatggaagtacatcaaaaggagacgggagcttgcctggtgatcccactggctaaatatgaaaaaaatttgattacttattaaataaagtcagtaatgagtttaaactactggaaaaacagctttgaatgtgctaattttctgaatctgagcaatactttaaaatatgggttttagcttcaaaaggtaaatcaggtaatttcattttatttaagtaataccatgaaaataatgttacaaactactaagttaaatacaatatgaaatattggtggtgggttgttttttgttgttttttggggtttttttgaaacaaggtctccctctgttgcccacgctggagtgcagtggcatgatcacggctcactgcagcctcaattcccaggctcaagtgatcctcccacttctgcctcccaatagctaggaccacagatgcacaccaccaggcctggctaattttttatattttttgtagagatggagtttcaccatgttgcccaggctggtcacaaactcctgaattcaagtggtccaccagcctcagcctccggaagtgctgggattacaggtgtgagctactgtgctccgcctaaaatattgttttaaaataagtcccctttatgatcattctcagaaatttgttagaaaagaagttcccttgcacatataaaaaatttttttcaatttataaattatccttctacactaatttccaaagaataatcattgagatgagttaaagcttttcactattctttgaatattatatcagcatatccaactgttaattgaatttgagatccactagtaaagcaaaaagcttgtgactttgaagactatttaaaatgtacaatgttttattaattatcattagtagtactattatacaatggttgtacccttgtaagtttgttaagaaacagctgacattgaaattgtctgcatctaaaggacatgtcaggaaaagcagagaaatcttaccaaaaaaaaaaattgaatcaacatctcttcttttggtatttacccctttcacatcaataaacatttactgaatatctgctaagtgccaggcatcatatcagtttctataccgaaagagtaaagacgtttctgtatagtatctatatagatattgaacattaagcattgttctttggaattattccagccttgagataaggctaaaagggccataaaaataaaatgaagaaagatggattttataaaggatagaggcaattggggatgttatggaaagacaaactacacagcattttatactctctggttcttctactttcagagaatgactctatcatccaaacagctgcccaaaggtcaacatggtagtgagccaaagtgagcattcatgaaaaaaatagaaatcatcctaactttctcttactttaaatcgttcaataactcctcattttctataggataatatcaagctgcttagatttagcatataaggctaattatgattagattcctagtctcatcacttccacttttttttttttttttttttttttttgagacagggtctcactctgtcacccaggctggagtgccgtggtgcgacctcagctcactgcaacctctgcctcccaggcacaagcaatcctcccacttcagcctcccaagtagcgggaaccacaggtatgtgccaccacacctggctaatttttgtattttttgtagagatggagtttcatcatgtttcccaggctaatctcaaactcctgagctcaagtgatctacccaccttcccaaagtgctgggattacaggtaccagccaccgtgctgggccagttcctctctttcacagcacatcatgcttcaaccaaacccacctccatacaatttctagaatatgccacacttttacttgtctctgggcccttatacatctctcccttctgtctacatcactcttcccacctttctttgttttggccagctttacccatccttcaggttagcttagatgtcactatcaggaagtccactccgactctccaaatctgacttagatttccttcctatgtgttcccataaaactctatgctccccctagcacagcatttatcacacctgattttctcatccttacccctaatcagttgtgagttctgcgcgagcagaaacacttgttcactactatacttaagtgctttgcacttaagtgctcagtgttcaatacagtttcattgaagaaattaattaaccacttagctgtccatataaactacatcatactcagaatgtgatataagttctggaggccttgattgaacagcactgcacaaccacatgccataaattttatgtgtgtgtgtgttagtttgtgtgtgtggtgtatgtacacacaaatgactgtctccatctcttacctgatagttttacttcacagctgaagatatttatgaagaaagtggtttttaaaagaaattatacttatgctgtaagtataaatatacacagaaagaaatatgtgggctggacacagtggttcatgcctgtaatcccagcactttggaggccaaggcaggaggatcacttgagctcaggagtttgaaaccaacctgagcagcataggaagaccctgtctctaaaaaaaaaaaaaaaaaaaaaattaacatagccagtcatggtggcacatgcctgtgctcccagctactcaggaggctgaggtgggaggatcacttgagccaaggagatcgagactgcagtgagctctgatcacaccactgcactccagcctgggtgacagagcaatgagaccctggctcatttaaaaaaaaaaaaaaaaaaaaaaggctgggcacagtggctcacggctgtaatcccagaattttgggaggctgaggtgggcagatcacaaggtcaggatgttcaagaccagcctggccaacatggtgaaaccccgtctctactaaaaaaacaaaaattagccaggtgtggtggcgcatgcctgtagtcccagctactcgggaggctaaagcaggagaattgcttgaacctgagagacggaggttgcagtgagcagatcatgccactgcactccagccttggcgacagaacaagactccatctcacaaaaagaaaagaaaaggaaggaaggaaggaaggaaggaaggaaggaaggaaggaaggaaggaaggaaggaaggagggagaaagaaagaaagaaagaaagaaagaaagaaagaaagaaagaaagaaagaaagaaagaaagaaagaaagaaagagaacatacgtcgattactacatatatatctgtatattgaacttcaggaagttgacttttctgtatttttcttcaataaatcataacacaacactcttgtccaaaagcagtaaagatggataagaaggatcaagtaactttcataatccacccaactataaggcattaagaatttttttcccaattaacagctgatttttaggaagtgtttagttagattttctttcaaagcaattatttttcagtctgtgcttcatggtctcctaatgattccctggagtctcaagggccagggggagcaggtgctaagtgaacagagttctgaactgcctcaatcagagccactctgctttttatctggttttttttttttcaataatggaattccaaccaagattttctttgaagaagggttcactacattaaaataagaataaaagaaaaaaagaaaaaggttaaaaaacactgccttaaagaatcagcagtggattgaggtttgcactatataattcaagctctaatgtatttcatatttcttggttagactaaattcaactgtcagctttataggcctttctttgtgctaaaatgagaaataccatttgaatacaaaaatatccaggtagagggaaaacaaaatgggtttttgataagtatatttattctctgatgcagctatttctaaatttacttattatttttaatggctttatttatgtaccaatcttcaagttaatgattcataacagaacaccaaaataatctaattgaacaacagaagcccactgtaaatgccagctgctgctatgtttcatatactgtaaacaaatacccacctcattttaatagtttcttagtagaaagattaccttaaaggaaaagatccaccaaactcatatttaaataataattttagctattttcgcaatctagaaacaacaggggctccgggtaactgaaactgggggtgctccatcataaaacatccagaagaccagtggggtgaatttgatctgctggtgaacacaatgaagactaataagcaaaaatgggcttcttccaacagaaacctcctgccaacctgtgcacaacattgtgcaattgcagaacggcacttcactggaagtcagggaaacacttgcaatcaagtccaggctctgtaacaagttaagtgaatccaaaacctttacagctgaacacataaaattattcaaaagctctaacgaggtgagaagcaaccaaacttgattttcatctctgggaaaccctatattagcactgtaacccacaaggccctcttccacttccaaactcctctggcattcactagccacaccttcatttggcacccaagagtgttagttaccgttttataggtaactccccaactaagttgtaagcccctaaagggtatacataggtcatgtctcactcttttctatacatcctaaaattcttagaattttgctaagcatttgcagatgctaaataaatgtatcttgactgtttgtttaattgtagatatggtttatattaccacccgtttacaatgttgatagtttcatatggttgtgtcagacgacattccactcctttaaatgccagtcaggagagtaacggagaaaataagcggccagatcaggctgtattgacagccatgcaactaatctgatactacctctccatgcatgcgtccctcccaaagaccaagtgcccactctgttctagggctaagtgttttctgttcctgctatgctttgtaccaagtcagaaataagatttggattcaagtcttagctatgccaatgagtaagcaatttgaatagatgaccttagctccaattatctatgattctatgattctaacttcaggcctttaccttccaatatcagaatggcccctccctcacagtactaaaattacttatcttccatgatatgtcccattatcatcatcaatacacccatgttcaaaggccatttctgacttctgctacaaggtcaacatactcatgaaattatttacacttctaaagataacactgttaaatttcttgtctgatctttacgtcatacctgcgttcatttaataaacacaagtgggtagttgggtaatatgggaaaagacactcatttagggaagtttctaacatattcctgctttcagcagcaaagataagttatggctccatttgcaaataagcaccaataatagtaaataaaactaaattatttttatactggtcactaggaaggttgttttcatcttaaacggcagcttagtagccttgagaataatctgatctctcccattttataagaaacttatttttattgtctcatcaacatcaaatgatattagggagtttcacaatgactgtgacaataaatggcttagaaagaaaattcagtaacaattttgataggttttaaggaatatatgagctagataaaaatatatgagccatatagagatttgatgcaatttaaattaatatctaccagttttgaaaaataaagtttctcagaacctaatgtagctttcttctgcaaaaaagacgaggcatatcacctaaaaagacctgtccctaaccaactgttatccaagtaattaaaaagaaaagtgaaaatttcacctcttcatacatgttaagcaaaaccagccataataaaatccctgatgaaaggtgagttttaaaaataaaagtgagacgtaggtaacagaatcctccaagaaatacttaaaaggttagttttcctcagccaaaatcatatcaacattttcgtatattttggatattaacctcagtacaaatattagattatcaaacataaaatataaaaatatttggctaatggtatagtaaggttttgtttcatttttaatagagtgattagccattcacaaaaatcagtcaatattactcctccataaattatgacaaaaaatatacaaactctgaatgaagcattaattgggaaaagaaaaaagctaaatatttttattgtgaaactaataaaataaaaacctcagtctagtagagaatatacactttgtgttgattaaaattttatatcactatgttaaacacagtaatactgaaaattgttattttaattacctcatttaatctctacattaaccttatttttatccccattttaaaagatataaaccgatgctcagagtgcttaaggaatcttcccaaggtcaaagaaacagtaagtagcagagctgaatccagattatttgaccctgtaaactaggtatttaagcactatgctacactgcctccagttattcataactcccaataaatattcaacactcccaataaaacacagggcacgatgagttattgatttcataactgctactgcagcattcagatactacttatttggaaaagtgttctgaatacacaattaattcaatccactatgtaaaaggtaaatgttcaagtctcattcaaatggagaaggggtagaaaaggaagaaaagtacaaagtctatatggaacatcaattaataaaaaatattatcagggttgtctttaaacttcacaattactgaaggtccttattatcttgctgtcatttcagcactctcaattgcctcttagaatttgaaatttcactgttgaaacaaaagaaacataaaatatatgtgcattctaaaaaattctgcccttttgcaatttatcttctacatttattacctggatcttctaacactcgactagaaactaaagcaatccaactgtatatacaaaatgtaaaactggaaatgccagaaaatcaacatgacctttcaaatataacattttccacaatcatttacttaatactagaaaaacattttacagtatttaaagcataatctttatgtgtaatactttcggcaaatataaaagcaaatacagaataaagtcaaccacatttttaaaccaaaactgcaattaattttaaactactactttttctccagtagttcattatctatctattaaaacattcataaccatattagtgtgctctccgtttcaaatacaaagctgatgttaaccactgtactagtcacctcctgtacctggtagggactgctagtataacaaacccctcccctgacaccaatttccctatattagtttgcttgagaacaaaaatatgtattgggcaaagaaatgagataagccttctctgtaagccagcaagaccactcttgattaatccccaacgtactggcctcaacagcatggcttctaaccaaccagaatcctcagtcaaaaatactttaaacaaagataaaaattagctagaagatcatgttaccctaaaattaaattttatttgagagcaaatgtatagcctttatattttctgatccaatcacatctttgttaaaagcaaaagatatgtaaatcaacactaataggatgttagattttccaagagagaatcacacttcagataaactactactcaaaatcttttttattccataatcaaatagcaatccttaagaatatacctttcattcccttttgactactttaagtatttccaaaagaagctgaacagaaaatacttttcttcagacttttttccgcacatctcctagcaggagagaaaaattagcaaaacaaatgaactcagaatcattaaaaggtgtggacagtgtccatcttatagctttaatacctaagaattaggaagaaaaagagatcaaggaaataaagcgaccaacataatacctggctgaaggacaaattctatacttaaaattaagtatggctctaaaaaaggatgagtttatgtcctttgtagggacatggatgaagctggaaatccatcattctgagcaaactatcccaaggacagaaaccaaacaccacatgttctcactcataggtgtgaactgaacaatgagaacacttggacacaggatggggaacatcacacaccggggcctgtcgtggggtggggggatggggtgggatagcattaggagatatacctaatgtaaatgacgagttaatgggtgcagcacaccaacatggcacatgtatacacatgtaacaaacctgcacattgtgtacatgtaccctagaacttaaagtataataaaaaaaattaagtatggctcctaccgactctatgaattcagttcatatttctttaatgcaaagagagaaagagcaaagttactgaatgaagagataaaagtgtaaaacatcaacaaagcaactaaattagatacctcacctatcacagagaaaatcaacaaggcccaatgaatttatatgtacacatttacctttggaataatacgtcatctgctttttgtattctagacatgttctattccattgactgggaaaaatcgaaaaggtggcctttgtagcagaggacaaacagaactcaggcttagtgtaacagagcagcaaaataaggtgagagaaaagcagctgagaaggggaggtttacattcaacatgtataaaaataatgtatattggctttttttttttcatgagggaaggaaggtaactggctaccctaagaatgaagcagaatcagcatggcaagaaacaaaacaggcagaaaattaaaggatccctgagaatggtttataccccaaacaaaacaaaagtgagacaaagtagaaaaaagaccaaaacccaaactaagacaaaaaccccaatcctctctcttacattgagagaagcagaataagacaacatcaagaacaaaatatctgcatccagaagtcagactcacacacacacatactctcagagcagcaggagaacaaaaggacaacatattttacaatattaagataaaactagtacaattatatttttaaatattaattttttttaaaaaagagaaagaacaggttggtcagctctgcccatagatgcttccaaaaaactccatagcagtcatcctaatggatgtgagacacaatttcactaggcctttgatatgcatttccctaatgattaatgatgctgagcatcttttcatgcccttattggccatttgtatattttctttgcagaaatgtcaattcaaaccatttgcccatgttttaatcttgttgttttttcttgtagagatgttcggagttttttgagacagaatcttgctctgtcacccagctggagtgcagcggcgcaatctcagctcaccgcaacctctgcctcccaggttcaagcaattctcctgcctcagcctcctgagtagctgggattacaggccaccattcccagctaactttttgtatttttagtagagacggggtttcaccatgttggccaggctagtcttgaactcctgaactcaggtgatccacctgccctagcctctcaaattatatactgtggatagtaaccccttatcagatacatgaactgcaggattctttttaaattcatttctctattccctaatttctcagagttggctatatgtaatgcagaagtacattttgagttgaatatatttcttctttgtttttattttttacctaatacaaaatttacaatactcaaaagaggaatacaatggaaaataacctccatccctgttcttcagctacgaagttccaatccccagagacatttttcatcttcttataattccctccagaaatattctatgcctatataagaaaatacatttcttaagtctcctccaaaataatctattcattgttctgcattttcctttttgatttactacatcctgaagattattacatttcagtatatataaactgccttatttttaacaacataaatatttcattatatatactataatttatttatccagtcccctaaggatgggcatttgtttccagtcattgccaagagtatccttaaatatatgttatttcacacaattacaggatctataggatacaatctagtagaaaacttaaatgctatatatatttcaaattttccaaactgacctcaatgaaaattgcacaaatccatactcccattagcaatgatcacacttgcctagttccctataccctcaatgacacattgtgttttcaaaatttgtttctttgccaattaggttttaaaaaaaggcatctcattagagttttaattttgcatttctcttattatgaaatattaatactctttgtatctttgtccatttttctatccaattgttggtcttcttcccattgagttgttcgtgctctttatatatttatgaaatcagctgtcttcctatgatatgaattgcaaacattttttcctagtttttctttgctttttgatatactttgttttcttaattctcaaatttaggaacaaaagtacttccactatgtctttgttcaaactatattccttattttgaatgttcttcccttccttcaaaggtcaattcaagttgatgtctctgctctctccctaatcactcaagatcaccttgattcaaaaattatttagtgagagcctactgcattatatttacaaataagtaaatccagtgaattttgtgatatagtagcacacagcaaggaaaatttatagaggccactaaacatttaaattgtatctgaaaaaatgagaagatatgatccaaattttaaaaatgaaacaaaggcccaggtaacgagaacttattgtctataaattagtctcattggggtacagaatgctaatgttgtagtgaaaaagagaaaaagctgaagaggcaagcagagccaggtaggataggtcttttaggccaatttaagtaagtttttcttaatctaagggcaactagaagccacagaaccattttaagcagcagaatgctggtcagagaagaattttacaaagaccactgactgcaatcttgagtttaaccagcacttcagtgaacagagttgaaactgattcaaatatcaaatatactcttatttattcaataagtgaattttaaaccactatggaatagaatgctacagaaaggtgaaataaggtactgtgctgctctacttccttaactgagggcttggaacaatcactgttgcaagtcaatttaaacaaccagacaatcagaccatgttaaagatgagacctctaataataaaaaatcatagttgattctcactttatcataaaatccaaaacggacaagtatgggcccaaattcatgcagttcactcaacaactgtactcttacttctccattgtaggctaaacaaactgtcataccccccccccctttttatcctgcttttttgcttgtttttttttaattttttatttatttaggttgggggagacagggccttgttctgtcacccaggctggagtacagtggtgtgattatggctcactgcagtctcaaactcctgggctcaagagattcccctgtctcagcctcctgagtagctgggactacccatgggcaccaccacaccagtctaattttttttttttttttgagacagggtctcactgtgttgcccaggctggtgtacagtggcatgatcacggcttactgcaacctctgcctcccagtctcaaacactcctcccacctcagcctcccaaggagctgggaccagaggcacatgccaccacgtccagctaattttttgtatttttgggagacacagggtttcaccatgttgttcacactggtctcaaactcccagactcaagtgatcctcctgcctcagcctcacaaagtgctgggattacaggtgtgagccactgcacctggcccatcctgctttcaacagatgacattaaatgtccagaaagaattcatgagatgttatgaccattgaatttccccacgtttagcctgggtagtgagaaaccagtttcagggagagaatattatctatcagggagagaatattatctatcttgtcacccaattcaatcctctaaaatgaccttctatgtgcttgctacaaaaaaaaagttcttccaaacaaatacattcaaaaaataaagtttgtttgactgcatgcttctctagaatgcttttaaaattttcttctccccattctcaatatcataaatcaggtaacacctaacaggaattgtctgtactatttcttatttgctggtgacaattcctttttgattccccatgtctactttaggggttagtggtttaacagtcattcttacatcttttgtcataggatattccaccgttctgtctttagatatatgatacactttgaagttaacagaagaaagtaaattagtataaatacaaaaagttgatattacaatataataagcatgtcaatggtactaacaggagatgacaattacacctttatctcgaagtaatcaccatcaaccattctcaaactcagaagtgtatagttttttttataattttaattcattatcatgtcacttaccatttttctctaagtattttaaactatagggacattttgattgaaactagaattgtattcaatacaacacctccctcaggaatttaactttacaagcctatttctattctcttcccaagaatctttccatctaattctaccttgccctcgtggcttaacccatacagagactggtcataagtgctttagaatctagcattttcttcctacaaacaggaaataatgtgtctctgacactatccaaaaatgtggcaacataatttatgcttttggaaggaagactaacatctcaagctgacaactaggtaataaatatgattaagacccaagcacacaatgagaatatcccaaagggtatacctttcagaagaagacaaggcttaatcagtgagacattttcagcaaaaaatacagtcatttttttctcagatgctcctaaataaccatctttttggcagtattgacttgttagccccaaatcattatttcccttctttactattaatcttcaaaacaaaaaaatttaagtctatgatagtaaccaagtctgactcattaaccgaacaattccccactattctctgagtttaaattcacataggattcttacaaacagcttatgaagtcctcaaaaataacccatgaagtatgtgttatctctgctttcccagaaggaaaatgaagttcacagacaaaaagtgacttgttcatgttcacataggtaataacagagctagcacctgaataaagatcttacatatccttttcactatatatcaccactttaacatctggatatttatatttaaagcctattttttaacttttaatatagaagttttaactgaatgtttagagtattagcataatgtagtcatatacatcagacaggtctcaaaaaatcttctaatatgttgtcataatccacatactcagactacaggatgtctcttaaacatgagaaatagtaagattctggccacgtgtggtggctcacacctgtaatcccagcactttgggaggccaaggcaggtggatcatctgaggtcaggagttcaagaccagcctggccaatatagtgagacctccatctctactaaaaatacaaagattagccagacatggtaacacatgcctgtaatcccagctacttgggaggctgaggcacgaaaatcacttgaacttgggaggcagaagttgcagtgagccgagatcacgtcatagcactccagcctggatgacagagcgagactccgtgtcaaaaaaaaaaaaaaaaacatagtgagactcataaaaagcacaagctaattcatttataaactgattcaaactgccctcacataataacagtgctaaatagttattaatatttaacaaaactaaataataattattcagtatttaaatctgacactaaaaaaaactcttattcaagcaactattaaacaaataagctcctgggaaaataccaagatccttagtaaataatctgcaataccaataaaactaaaaataaaggccaaaaaggctacatactgtatgattctaactctatgacattatggaaaaggcaaaaacattggagacagtgaaaagatcagaagttaccaggggttaggagaagggagggatgaataagcacaacccaagatttttaggcagtgaaaatactctgtatactataagcatacatacatggcattacacatttgtccaaacccacaaaatgcactacaccaagaatgaaccctaatgtaaacaatgaactttgggggataatgatgtgtccatgtagtttcatcaattgtagcaaacgtaccattctggtgggggatgttgatcatgcaggagaggctatgcatgtgtgagggcagggagtaaatgggatatctctgtaccttccattcaattttactgtgaaccaaaagaccctaaaaaaaagtctattttaaataaggcaaaatatctgcggcaatcttaatcttctcctatcaattattacttcacaggtcctctgttaactatttagtagaaagcatccttggctgtcaatgctaaccttctgcacagctcttatttacacacacattgctcctcataacatctgctctgcccactgtagcctgcttatcctctaatggtcatcagtatactgagtccaaagacagggaaggagtcaggtacaaatgagatggagaagacaggtagtggggctaaggaagcaaagaactgctaaagagggaagtcagcagataaatctgcaggagaaaatctgcagcaacaaggagaaaagaatcctgagttgatacaaatttgtttattggtttacataatgggaaaatcatatgaaatgaaattatcctaaaatacaaaacatgatgacattacaaacatttcccttctttaaaaaaaagtctttgctgtatacaattccgtaactagaacttgataatctgtttgcaatgtgtcccccagcgacaagcaagatgatttttcaaaagttgactgtaaatgctacatttttcaaaggaaagatatataaaagtgtgtgtgacaaagacctatgtctcagaataacttggaaaaaagtacaaatattaaatttttatgatttattgcctgaaagaaagttgtacacttttatattctgggtattcttaatctaagaagtcaagaacatactatgtattaccaaactgggcaagagttcaatgagattctgaaagttatacctaacgtactatgtattaccaaaaacatacaatatgtttagtaacaaatagtatgttaggtatgttaggtatgactgttagaggtgtgtgtgtgtgtgtgtgtgtgtgtgtgtgtgtgtggtcacttgcttgctttggtcatcggtgaggaagccaggctaagcaactaacaaagagtccaaatatctgagtcatttatgagaggctaagggctccagtggcaaatcagggacctataagacaggctcaaagatggttctggcaggatccaccaccaccatcactaccacctcagcaaaatacaaccttcttcatctgaagtttcagggaagcacaaaggctcgagttctgccagcagtccagctcagtaaacactgattaagcaccagtgaagtacaaagcattaggttaaaggtgataaaagacactgaataggaggaaatatagcccctactaccttaagaattttccagtaaaaaatatggtaagactataatccaggcaaggtagagcaagtactaaaagagaaatacaaagaaggcattcagaggtttcctcaaggagatgctctagaatgaaacctgaggctattactcagatgaccaacaagttcatgctatagccactgctcgtttataattttctcccattcaatgtactacttctacaccagagatgtgagaaacttgaaaaaggctattttgttctagctgattattaaagggggagaattcttgaatataaagtaagatataaggtaaagcaagcaggaaaggatttggagcaaggtgtgtcataatgctaacatggcacaaagcaaaataattcaacttccattcagttttactggtcaaaaggaatagcatcatttttgttttgttttgttttgttttgagacagagtctcactctgtcacccagcctggagtgcacgggcacaatctctgcccactgcaacttccacctccagggttcaagagatcctcctgcctcagcctcctgaggacctggcatcacaggcatgtatcatcacacccggctaatttttgtatttttagtagagacagagtttcactatgttggccaggctgttctcaaactcctgacctcaagtgatccacctgcctcggcctcccaaagtgctgggattacaggtgtgagccaccatcacttctataacacatttatatgctgctttaatggtttacaaaggactctcacataaatgcttacaatgaaactcaaagcaatcctatgtcaggtagagactgttatcctctcagagagcctaccctcacaagacagtccacaatgatccttgcctcatgtccttgtgtaatccactcccatactgaatcagggctggtctgtagaaccaattgaatacatctgaaatgatggtgtatgacttccacaggtaagtcataaagggcactgcagtttctactttggcagcttgaatctcgggaaagtcatctgccatctcatgagaatagtcccacggcaagcccattgtggaaaggaaccaacctgccaacaccaactggccagccaagtgagtaagccaccttggaagtgaatcttttagctccagtgatgctcctataaaacttccactcctgctgatatctgacagcaacctccagagaaccaagcaaggaccctcaaattgctgacccacagcaaccatgagataacaaacaatcattgttgttttcagccactaaggttttcatgttacaaaacaacagagaacccaattttacatatgaggctcagagaggttaatttaccaattatcatataggaatgagtagagaaaacagatctggaacccagtctttaggctttaggttcaatttgtcattaaacaataccactttcttctcaactaaaataaggtataatactgtaaggatgatcattcctacacgattatatgactgatactagtatgtcaagcttcctacagtacagagacacagtatatgtccctgcattcttaacgaatataatgggaatctccaaaataagtccatttgtggtgctccattgtgctctgtggagttgttactattttctggaaaatggctatttttaatgtgcatatcatgaaaataaacacttaacacatttagagaattttaatactaaaatattactgacactgagactacacacttaaatcttaattacaataagcatctgtgtaattttaaacaattagaatatatcagacaggaaatgctcaactgctatttctttaaggttctgcattttggctttaggtcttcaaccttgtagcattacacaaatgtagtaaaatatatcatcaaaatgctcgtgatggtaaaatattaaatcaaaatccataaagtagttcctatcttacaggacaaggtagccagctcttaagcctgtccacttctggagaaggtcaagagaacattttattgttataatcacatctgcatataatgttccttcacacaaatctcctcttttgagccatataactttgcaaaacaggtaggcaggacgggtatactaccatcctatttttcaatgatggccttagagaagtctcagtaacttaactaaggatacgtaactattaaaaggaattcaagaatctaatctacaattttttagctccaaatcccagccttttcttctaagccatgttttagcccagtggttctccaccctgactgccatgaggacacctaagatgctttgaaaatatcactgcctggacctcatcccccagatacttgatataattgcactggtttgtgttagctgtctaatatataataaaccagtgttggtaaattcacagaaagtttatatcacaagggagaaaatgctgatacgtctatatgtaaactgaaacatattaaccccctaagaactccctcaaacacaaaaatatcttgcaataaaatcacgcagaacaagaagaaagggaagatgagaaacccaagccccttctgctgctatcgtggggccattaaggaatattttattcccctaatcttactccccgaacctcaccatgccatatctcaagctatagctcaggtatcaccttttgtgagaccttcaggatcacaaaaataatgaagtccattttttgcatctatcttaccttgaactctatcatagcacatattgtccctcaaagcattgctttatttttattttattattattattattattatttgagatggagtcttgctctgtcacccaggctggagtgcagtaccacattctcggctcactgcaacctccacctcctgggttcaagtgattctcctgcctcagcctctgggattacaggtacatgccagcatgcctgactaatttttgtatttttagtagagacggggttttgccatattggccaggctagtctcgaactcctgacctctggtgatccacccacctcagcctcccaaagtactggtgctgctttatttatatatccatttttctcactgccctgaggggtccttaacccatttatgctggaggttgcaaattttttttgtgaaaaatcaggccttggcgatgaccttgagaagtaggatataaataactcccactagcttagcgctccaataatggagcactaggcataaatgcattaagatcagatccctatgttactcatccttcctgccatatatatctttgtatccagggcctttaccatagcagatattaatacatgttggctatgctgaatgatttttatgtttgttatcattatttcctccattctcctagcagacactcctgtgaaatttttcaacttttaataaaggaaaatggagtttttacgcacaactggattaggttagagaataatgtatgcaaaagggccagacgtagtgagagcaagacagcagtgaactgtggggcaggaaagaatagagtagaaaggacatttaaaattcatatctgacagttggggtcagatatgaattttgcaagccgggaaggagtaggcaaacaaagcgacaacctaatcttcattcacaaaaaaaaaaatatgacaagcaaggaatcaggcaactgtattttcaacatctccctttctatggtgtttctaactcacagcatacagacatgttgtttctctctcaaaaaataaaatctgaagcagtgatatgatttcactatgtatttgacttttttttaagattccacatgtgagataatacaatatttttctttctgcatttggcttacttcacttagcataatgtcccctaggtttacctatcttatggcaaaaagcagaatctatttcttttttaaggctgaataatattccattctatatatgtactgcagtttgattttctgttgtcttttgttggacagttaggttgtttccatatattcacacccatcaagatggctactaccaaataaaacaagagataagtgttggcgagggtgggagaaaagagaacccttgtatactattggtacaaccattatggaaaaagtagggaggttcctaaagaaattaaaaatagaactaccattacttctattttgtaccaattagccatccctcttctgtgtgcatgtatatatatatatatatacatacccaaagaaaatgaaaccgcaaccttgtaaagatatcagtcggaatttttaaaagctctctaggggattctaatatgtgtgcatacagagatggagaataaaacagtgatcccaggggagggggaaggaaattgagatgtaggtcaaaggacacaaagtagcagccatgtataatgaaagagtttgggaactcatgtacagcatcagtactatataatactgtattgtattcctgacttttgctaaatgagtagattttagctactcttgtcatacacacaaaaatggataactatgtaagatgatggatgttactatgtctcactacagtaaccattttactatttacatgtattccataacatgttattttccttaaatatacacaataaaatgtattaagtaaataccctgactgaagaacaattatctcctaagagggacccaagcatatctactctctattctcatgtccagcccccttcagcctcatctcctattcagtcctttacccacagcacgatagctttacctccaccactacaatgaaaccagtgacttctaacagtcattgatgattgtaactttacaatcatcatcatacttaatggccactctccttcagcatctttacatctttctcttttatggtttctcctttaaatttttacattctctaagactaatttttagcccttttctcttctctttctatacaattcctctatgtacttttatccgtatctatggatacttcagttactctccatatggtaagaacacacaaatctgtttctccagcctttgcaatctcttgtgatgttccaggatcctatatccaactgccttctagacatctcacacttgccaatgatatgccctgcgagcatgttaaacacaggtccaaagttgaactcattctcttctccctcataccttcttcctcttctcttttcccactcacaacccagaaacctaggaagcattctaacattctccctctcccatatcttttacattcaaacagtcacaaagaccagcaaattctccctcatcttacttttcctaaacattctcacttctctattcccactacttccacctttatctaagctttcaacctctcttatccctactgatgtactgtccttgaaagcttccagtcttgccatgaccccacacccaaccccactctaccctcaatctacccagcacactgctttcagtgatcttccatgacactcacaattcttcagtggctcactactacacatggtataagaagtgtaccctgaactggctatccagtttcatctaggaagtgtaccctgaactggctaaccagtttcatctcctttcactcctgaccttgtccttcacactctaatataactgacctacatatagttcccagtatacactatgttctcgtaatgccacacaactactcatgctgttagctttacctagaaatgctttctattgcttgtcaacatgcccactcctactcagttttcaagtctcagctcaaacacaaccactactaaaacccttacctggtattgcaggcagagatcaagagctcttgctagatttcatttgtacttgtacctacctctgttatagcaaatagcatacagtatttgaactattggtcaagatatctgtagtcctacagactataagatccttggtcaaagatgacttttcatctttatatcctcctaactagttcaattcacacagtcactagttccatgtacattactagctcaatgcagatagatatactaaaaaaaggaggggcgaggttaatgaataaggtacgagtcaatgaaagaacaagaaaatcaactggactttgagtatagaaaaaaaaacaccagatcttaagaacgtacagacatctttagtacagacatctgttactgtagtacagatatccattactaagtcctaaccattaaaaaaaatagaaaaatatggttattcaggtagtatgaagatgacaaagaaaaaaacttattattggactaagtagacattaagaaggtaagagtttccagcggaacagttgacaaagatcaacagagaagccagagaaaaagatggttctttctaggaaacaagtaattcattgatctaaattcatggactgagcaaaagactgccacctttctctcagttcacaacccctctcctttgtcattattctgcatgaccccttctgagtcctcactaccaaatccccaataccatgggtagttcccctccaatggagccacaggtccaggccagtgacttaatctggatgcaagggcaagggatagaagggtatctttgttcttgtgtctaggactttgaggaaaaatgaaacaactatttactgagaatttattttacggcagattctgtgccacattacactcactcactgaatttcacagtaatcataagtaattatcccatttatagatgaggaatttgtgtccaaggtcaacagttaagcaataacaggccctgcctgaaaacctaagaatgacaacctccagagctttttctatacccctcactacctcaaaatggagggagacgtggtccagccattctaggttggcactcaggagacacttacctccaaaacactattatatatgttgattagagtctacagtaccactaatatataataagcacacaatgagtttaaaaagctttccttagtacctttaggaaagtaagtactagatttcctggggttctgatctggaaatctaaatgctatttattcctataagtacattgttaactttacaaacaacagacttgaaaatgaacttgtggaatacaatgggttcttaagtaaggcttttctttaagaatattttcttgcttccacaaaaaatacaaaagccaccaaagatagaatgattttgccttgttaacttgtaagaacaatgacactagaagaaacctatgggaaatgtgcttatctgaccaggtgctcattttcggtgggctgtcatttgactaaaacatcatactaaaccctacagaccacagcttatgagagaaatgccacaaactatagcagtacagttaatatgcctataatctactgacaaaacatactcctcagtaaagtgaaaccagatgtctggtgtgaaatcagatgtctgtgaacttgtctttctcagtttccagagcagtatcagatatactaaatacacagctaagctgtatattaaatccacaacttggcaaaatcatgacagtttggacatgaagcatcagcatttttattgtaatccttataaaccaaagacatttccaaaatggaaatcctaagtttaagtactcagctaaatacagtaatatgtctttctcactttaagaatagtgtcagggctttttaaacacattatagaaattctttcccttcatttttcaagctgacactctttatccaaggctgtggaatgatctgataaggccacatcaggtgtcagtcctcgtcccagaaattctaggatcagatacaccaggtgaacccctgtgaaaagcaaatcccagggaggcttaacagctataggaaagttaggcactacatggctttccacaatcaaaaggaagatcataggaaagtaatgggtgaccacatagaaaaacagggagggaaatttaaaagtaagtacttctatgccaggcactgttttttcacacattcttttatatatactctttgttctgttttgatggataagaaatcaagcagcagagaaattttaatggcccaaagtgacacagctaataaaataagagccagaaatcaagctcatgtccaaaagactgtaaaagtcatgctacttctacatgaagttgtggggtggagtgaggaggggtggtaaatagccaagaagaaggagaaaaagaaagaaatttacaattttatcaaataacagtgaaatatatatatataaaacatgtattatgttccacatatgttccatatataatacgcagttaagatgtatacatgtttaacatatacttaagctgcatatttagtatgtgtatatatggaacaaaaagttgaagaaacaagtatcaaattgttaagtggtcatctgaaagtggactcataggaaactcacttattgccttttataccctcccagatttaattctaaataacttttttttgactttttattactcttataaccagaaaaagacaaagaactattctagcttagatcttttaaatgaggctaaatgcacagaaacccatgcaagttaaaaatggtctactttcgaatttatttttctaagtacatcatcctttacactctccatgattcctaatattaggtccttcttatggaacaactacaaaagttatcctcatctaattattatactcgtacactggaaaatgactataacattattcattataggaaacaaatcatcaaggtcagccatccttgtaagtttattactgaaagtactagaaaggcggaataataattctgttctcccacaacactgtatagacctgcaaaccactatgatcagtagtacagggaaagtcttgtaaattaacatgtaactattgagaaaatccacaaaactggtgaaaggcctaccccaaaacagccatctccaatacaatctcatcattctcaccatcctacttttatcaaagtgctgataaaagtgcgtagcacatggtaagagagaattagctattgaatcaatgaaggaacccattatcaataaacaatcacttcctgttttccataaattatgtggtcacctatcacttgagcacaaacaaataggcacgttcaggacacaggcagccagtatcagaataggcagcctatcacagagggcaattctacttttcctgtgtaagaatccaagaatgcagttttactacattcctgcttgtagctaatctgaatttcaactaatttaaaacggttatttatatgtgacatataggatgcataatgagctcccaaccttgtgagaggagctgtgtttcatttcaccatacaggggagagggaagcagtgtattaaagaagtgatagaaaagtcccacagaagaaccaatgaaatagaccacactgaaaatcacagtaagcctcagagaacttcagtgtcctttttggcaacttttcaaaagtgaatggaatgcttgccaggaggtaccaagagtgaaagcccagagaaaaaggcccagcctggtcatctctctcccctcaaaacatcttcttctgtaagcttgagagatcccaaagaacttcaacacttgtaatcttgttactaactttatgctttggggtcctaaaggattttttcaggagtacccttttaaaatgtaaacatccctaggggggttactgttcattatcaaacaggacctggattctttagtgctatggtctcagggattagtcaaagctggctaataagataggggccggagacagacaactagagaggaccaatgttccaaggtaaaaacaggtaaaggggaagtgcagttttctgtcgggtcaaggggctaaaagggatccacatgcccaagctgttaaactctatagactgtgtgaggctgaaaacagtccggggcctggagcctgtgactttgaaggtgggtcctccagttcccgatgaaaaggtagaatctgggcccaagttccccacgagcagttctggacatctagcccttctctctctcgctcgctctcaggataaagtcctaggtccttccacccctgaccattccttacttaccctttctcccgctcttcctcggtgagaaggggtaagtggttattttgtgccctcgcccaatttggccaaaaccctaaaagtaaaaaacgacagacagacacgtgctttaaaatcatgttgttcaagcctgacgctctcccaccacctgcccaacacttccaggcagaaggcagcgcgcccccacagcgctccctcacggccagagccgggggccggactaggcccctttgtgaggactgggagagggcgcgttgttggggcgccggctcggcggggaggagcgggccagctccgggccaggtgtgccgcctgtggcgccggtttctcaacctagttagccagtggcaccaagaagaggactaggctggggtggccgccgcacgcgcctcagataaacacgcgcacgcacacatgctcgcgatcacgcaggactcgcggccgcgcacccctccgcctcccggcaacgcccgccccgccggggccggggccgactcccagggaagggtccccagcccaagagaccaccaagggtcggcggctacgcgcccgccgacccctgccagcctcacagccccccacccgccgccggacgccgggcgcccgccctccgcacccgctgcgcagctcagcccgggggaagtccccgcgcagaccccgccctccgccggcggcaagctccgccccgctgccccgtcgcgcgctggccgcccgaagctccgcccccggcggaaaactggtctctggaccgcccgcccaggtcgggctcaaaatgcggcgtggatctgaaaggatcaaacacaacactaattcagcaagctattattgagcacttgccctaagctcagcaacgtactaatgggggagactacaataaagagccgaaaagtctatgaaactgtgtcttcagctcttcctcttgttttagaagccaggaaacagagaaccctcacagttacttaagtacagggcagtagtggcaaagcacctcactagcgatctctgggcaactcttcatttcattttttcctactcatgagcactcaggaaaactattcagttttgctgcctccaggtaaaacaaagtgagtaacacaggacaggcggtttacttgagagaaacgggaatttcatactgaagcttttgccctcaaatggtacaaactctttttttttttttcctgagacggagtctcgctctgtcgccagagcgacactgcaatctccgcctcccgggttcacgccattctcctgcctcagcctccctagtagccgggactacaggcccccgccaccatgcccggctaatcttcttgtatttttagtagagatgggatttcaccgtgttagcaaagatggtctccatctcctgacctcgtgatccgctcacctaggcctcccaaagtgctaggattacaggcgtgagccactgcgcccggccgaatggtacaaactcttaactgggttattacaacctacaaagaaaccttcttatccatgttattaattatcctaattcaatgtggtttaaaatgttgatgaaagtacccaaatcatggtgctccaacaagctggatgccaaccaggtactcgtaagtacttgcaattacaggtgcgatattttcattccatatcatcccaagatgcccttccttcacgtgaagcagccagaaagatcaactaccagattccgcatgattgaggaattgataaatagaaagggaagaccgaaaccggccaaattttcccttcgaagtgaaacttgagaaacttgcgtgcattttacctgagttcctttctcagcagataaactgtcagacctcccagatagtgtcaaggaaatgcaactttccagaacactacatctggacaatgaggtgcatctgctgcctgttcacaaactcctcttccttacccctccataattccctgctatagaaagccctaactttagtctccctaagacatgtttgagactggtctccctgccagcatcacctgcattaaagcctgtcttccctggcaatactcgttgtctcagggactggttttctttgctaggagcaacccaacctaggctgaagcccaggcatttagcagcagtggcacctagaaatactgaacagacataaaatactttttttctccttttcttactcctccagttgtatcttcattatttctgtctctattctccctctagatactgccaaactactctgtgcactttcagatcacttaatactaatgtaaataacagacattctggcactcttggttcaaaatttattctaaaggtttaagaatctactcagggtcttaaatagcctgataactaaaattccaagagtttcctaaagagagcaaaattgctctcctgtgaaggggatatgtcccagtttttcttacttgtcactgaaataattactgcaaagtaagctcttttcggccagtgcttaaggacttaatttcaagagcacttaggtgacaggaccaccctcatcaaatagcagtcaagaactatttggtaccatgaccccaaattgaatggagctcctggtcactaggaactgacagtctgggatggaatgtaggtgaataaacaacaaagacaggtgtttatggcctttattgtattgggaagtcaataaacatacaaaaagagttgctaggtctggcctgattttatcactaagattcatcaagtgtacttaaaaagaagctaatatctggaaagggcagaactatggtatattagtcagggtttcctagagggacagaaccaataggatagacatataaatataaagaggagtttattaagtattaacttacatgatgacaaagtcccacaataggctgtctgcaagcttgaggagcaagagagccagtccgagtctcaaaattgaagaactttgaatccgatgtttgagggcagtaagcgtccagcacaggagaaagctgtaggctgagagactaggccagtctctccttttcatgtttttctgcctgctttatattcactggcagcttattagatggtgcccacccaattaaaggtgggtctgcctttcccagcccactgactcaaatgttaatctccttggcaacaccctcatagacacacccaggatcaatactttctatccttcaatacattcaagctgacactcagtattaaccatcacatatggagacagtaaaaagatcagtgattgccagaggtcacagaggagggggatatgaagcacagatttttagggcagtgaaactattctgtatgatatgataatggtgatgcatgtcattatacatttgtccaaacccataaaatatacaacccaaagagggagccttaatataaaatctcaactttgggtgataatgatgtcaatgtaagttcatcaattgtaacaaatatactgctctggtacaggatattcatagtcagggaggctgtgcagatgtggggtacaggaatatataggaaccctatacttcctgctcaattttgctctgaacctgaaactgatctttgggagaaaaaagtttatgagaaaaagaagcagcagttagagcatcctattttattctaatttatcaattaaattctaagctgaatatttggctttatgtatctagttcaaatatatttgccttgtctccttatatattaaagcagacctctatttgttgttaataccatcaggggaaaatgaatcataaagtcctaactaaggtacaaatttaaactatagttaggcatcaaatctaatggtcaaagagatatttaaacaaagttaaaataattaagtttacagattccacaaatatagatattaaaatatattcctatctatacatacttaccattggtaagcaaataatagaaggtatcatagagtagcagttctcaaactactttttgatctcaagttctctttacattcttaaaaatgattgagaactttaaagagctgttgtttatgtgggttatatatgtccatatttactgtattaaaatttaagatagaaaaatgttagacatgtgtttgcttaatttaaacccattacatgttactgtaaaagttatttttataaataatgactactttttttccaaaaaattagagaaaagtggcatttttaacattttataaatctcttattatctggcttaaggagagcactggattctcatattctgcctctgcattcaggctgttgtgatatgttgttatacctaagatatgaagaaaattaactgtcatacgaattcatagttgaaaaagagaggaccttacaaagctccgggaagggtttcagtaacccctaggtgttctcaaacctcacttggagaattactgccaaatggccttttgcatttcatttgtttgaatgtcatatatttccacacaggcttctgttaacacctgaaattatagccctttacttatttcaagctaaaactcatatttgtcagctcatatcaaaccatgacatttcaataaagtttttaaaagcttttactatagcaactctgatgaaattgatattattatttgaattgatatgaaaacacttgagatttcatttatatccttcatctcaaacgttttggaaaattttgaatataaattgtaccatctggaaaaaatgtaagattggtatatagttattaatccaattttaggtatgcttataacaaggtatatccccttttataaaaataatttaaaagcgagcttaaaacaaaaacaaaacaagcaattacagttttatttatgaactaaatacttgattctaaacttactaccttggaataaaattttaaatatataacctttcatttttattacaaataaaaataatgtaaatcatccagtttggggttttttaatacaatttccaactaaaagaaactagagctgaccaaccaaatgtctgacttcagatctgggtcaggttatacacaagatgagcataggataacttgtcccacaaagccgggaatccattaacaacaaaatgtgtcaaagggacacagaaaccaatatcaaatagctcctttggccaaagatggacaatttaagcatcaaaaaaagtaatggatgcagttgttagaaacatactgaatatataaaaattcatgagttcttaatgatgttccaaaaaggggaggtcaataaaaggaaaaaaaaaatccactggacactattgcaagtagctagcattaagcccttattctaaaattgtccattaaaagaaaataattcaaattttctgatgtatctttcctgattaaactatatatcagaaaaccaaattggtgttgagggaaagttgttttttataataaatatgaaacaacagaattggaaacccaccatttagcaatcttgcatttaataaatgattcaggcaaccatcatcaatggatcaaaccaacagatgaaatgttcatgaggaacttcacaatggagatcagaccgtcactacctcagcctaataatctgtcattacaagtgggactccagacattgtgtgcttcctgatctaatgccatctgaagcactcagcacaactatgaaatgttatcacccaaaaaacatgaatgggatctaatcaagccttaaaactgacttctcacttacaggcttacaaaaaacatgagggttacaggaataagttaaatgacaccacaaagaggctgggcgcagtggctcgcacctataatcccagcactttgggaggtcgaggaaggtggatcacttggggccaggagttcaagaccaccctgggtaacatggtgaaaccctgtctctactaaaaataaacaatgagccaggcatggtggtgcgtgcctataatcccagctactcaggaggctgaggcaggagaatcgcttgaacccgggaagcggaggttacagtgagccaagatggcaccactgcactccagcctggatgacagggtgagaccctgtctcaaaaaaaaagaaaaaaagatgccacaaagaaggaaacaggtaaatctagaatggagtagaatggaggacactctctaggacaattgatgtagtctctacaacaagttaataactggacacacaggagagggaatgggtcaggagaagcctaggttaaaaaaaatacagccatgaaatgtaagatgtgaacctttatttggatcctgattgaaacatcacaactataaagacttgtaagacaatcacggacatttaactatggactggtgttagatgataccaaagaaatattattttattaggtgtaataatggcattgtgattatgtaagaaaatgtccataatttttggagaggcattctgaagtatgttgaagttaaatgacatactctctggaatttactttatacttcaacataaaaaaaaagaaggaagaaaaagagatagcataaataagaaaataaaatggataattattgaatctagatgatgaggggagttctttgtacttttccatggttttcgtatatgtatgaaattttgtataatgaatatttaaaaatataagtgacggccgtagctcagattttctagaaaacagtgcctgagacaagctcacatgttaaaattttcttgggggttgcagtactagaaaagcaataatgaaggaaaagggagaacagaggcagggacagagggaggaagatccatggtggtatgtttccaagctgattatagcatcccagtacatgcagttggttgcttagtcacacaggacatctcaagaaggctgtgtgaaaccactgggtaacaatcctccctcaggaggggaaaggttaaggcactttttttaactggatccttcctgccttctgtctctcattcatcaatgtttgttccataaagcagggcaagcatgtgggggaaaaaaggttgggggcagggaagtgaaaatgggttttatgaagtgactgagatttgtttaatctcacaatgtagaatttaaacaaatcagtgacttttgggtttagtgaagacttacctataattttagcctttttgaactagaataatcattctgcttgactttcttattacatcagtaaataatttattcaggtcaaagccattatttttgattaacagaaatcacagtcacataaatggctacagaaactaaatataggagaagggttctaccacagtgacctgaacatttgcatgcgcccttgcacatctccacaaaggccacatcagcaagacttgactgcagctgatctaagtcatggtggaattctgttgattctcctacaacatgagatcatgagaggcttgttaagagctgacccaaggccatttctcattcacctcccagtttctcattgcctcctgtgttttgaggaggtatgacactttctgcctcattctccctagaatacagcctcaggctgtaaaactgcttagctgaagcatgacattggttcctcaggaacagggtgccctatcatccaggttgtggtcatctggcctcctttgtatcagtgtcaccctgtgcaagggataccagagctggcatctttggctactcttgcttttgctttccaagtaagtaataaactgtctgaatctaaaaatggcaactcattgttttcttactagctgaatctatcacccttgccttaccttgacaaattctaggcaagaaatttttactttccttaatgctaaagaggtcctttactctttcctctttgtattttgctcagcctacaaagttagtagccagtaaacaaactgatatgaaaatatgaaagacttagattcacatttttagaaagagtaactgttctctaagtattttaggataatttttggccaacagttaaaggagccttccttctcctggccttgccttcaaattaattaataggctattcttacaaggcaggtcaagattcagtcctcttaaaaaataaagaccaatcagaaggattttcaacaaagtccctttattttctactcacacttaaacactatagttggtagggttcaaaaagtctgggaaagagggagacgaagcaagatggtgaaatacaaagctccacgaatcgttcccactaacccacaccaagttaacaactatctacatggaaaaaaacaccttcataagaacaagaaatcaggtgagcactcatagtaccttgctttaacttcatagtgctgaaagaggcaacaaagagagaaaaaatagtactgaattgccgatgccaccccctattcctccccgaccccaggagcagcatggtgtggagagtgtccttgggtgctgggggagtgagaacacagcaattgtgcggcgttgaactcggtgctgtcttgttagagcagaaaggaaaccccaaactcagctggtgtccacccacagagagaacatttaaactagccctagccagagggggacttgagtgcctgcaaacctcgccacccagggctacagctgtctgtctccaagtaaacttgaaaggcagtctaggccataaggactacaactcttaggcatatcctagtgctgaagtaggcccaggacagtggactggtggggcatgtgacatactgagacactggataggtagtcaaggaagtgctggcctcacccctctcctaacctcaggctgcacagtttgcagctccaaaagagacaccttcttccacttgaagagaagagagggaagaacaaggagaactttgtcctgcatctacggtacaagctcagccacaacaggatggggcaccagatagacttgcaaggctgcaaggcccctgttccaggccctagttcccagagaacatttctagacacaccctggaccagaagagaatggcttcaggtaacagcccagccacagtgggtagaaaatcaagcaagctctcgaggtccctgattctaggattttactcttgaacagcatttccggacctgtcctgggccagaggggtgtccactaccctgaagggtgagtcccaggccaggcagcattcatgacaagctgacttaagagctgttgggcattaagggaacatcagtggtagtctggcagtactcttcatggcccaggatggcagtggctatagggtaaggctcctctgcctttggaaaggggagggaagagtgggaaggacagcatcttgtggtttgtttaacagctcagccacaatacaatagaacaccaggtagacttctaaggtttttcactctagtctctgactcctagacaatggcacttctgtacccactggtgggctgggggaccttccctccctgaagggaaggacacaggcctggctggctttgccatctggtgatagtagagccccagggtcttcagcaaacataggcagtagccagggggtggttataggaggccttggtcaagtaccagtgctctgctggcttcaggtctaacccggcacggtcttagtggtggtggccacaggggtgtttgtgttactccatccctagctttaggtggcttggaacaaagacagaggctgtttgggagaaagtaagaagaaaggaacaagagtctctgccttgtaatctagagaattctcccagattttgtccaaggccatcaaagcagtactctgtgagtctgcaagaatcatagcattactgggtttggggtgctccctgaagtacatcacaacactcacgtccttgtagatcacaacacccaagtcctttcaaatatctggaaagccttcccaaagatggctataaataagcccagacagtgaagactatagtaaatatccactcttcaatgcccagacaccaaagatcatctactaggatcaacactattcaggaaaacatgacttcatcaaatgaactgaataatgcaccagggatcaatcctagagaaacagagataggttgaagaaactcaaaaacattcaagataacacagagaaggaattcagaataatatcagataaatttaagaaaaagattgaaataactaagaagaatcaagcagaaattctggaactaaaaaatgcaattggcagactaaagaatccatcagagtactttaatagcagaatttgtcggggaatttgccctgatattcacgtaggttcttttctatttttccgaagtgtcagccagtttgagaaataaagggacagagtacaaaagagagaaattgtaaagctgggcatccgggggagacatcacatgtcggtaggttctgtgatgccccacaagccacaaaaaccagcaagtattttttaaggattttcaaaaggggagggagtgtgcgaataggtatgggtgacagacatcaagtacttaacagggtaatagaatgtcccaaggcaagtggaggcagggcgagagcacaggaccacaggaccgaggtgaaattaaaattgctaatgaagtttcaggcaccattgtcattgatagcatcttatcaggagacagggttttgagatcaaccggtctgaccaaaatttattaggtgggaatttcatcttcctaataagcctgggagcgctatgggagactggagcttatttcatctctgcagtttcgaccataagagacaggcacaccttgcgggggctgtttataagcctaaaactccaggcgtgtattctctttctcagggatgttccatgctgagaaaaagaattcagcgatatttctcccatttgcttttgaaagaagagaaatatggctctgttctgcccggctcaccagcggtcagaatttaaggttatctctcttttttcctaaacattgctgttatcttgttcttttttcaaggtgcccagatttcatattgctcaaacacacatgctctacaatttgtgcagttaatgcaattattacatggtcctgaggtgacatacgtcctcctcagctgacaggatcaggggattaaagtaaagacaggcataggaaatcacaagggtattgattggggaagtgataagtgtccatgaaatctttgcaatttatttttagagattgcagtaaagacaggcataagaaattataaaagtattaatttggggaactaataaatgtccataaaatcttcacaatccacattcttctgccatggcttcagccggtccctccttttggggtccctgacttcccgcaacaagaattgatcaagcagaagaaagatttagggagcttgaagacaggctatttgaaaatacagccaaaggagaccaaagaaaaaagaaaaaccaatgaaacatgcctacaggatctagaaaatagcttcaaaagggcaactctaagagttgttgttcttaaagaggaggtagagaagggaatacaggtagaaagcttattcaaagggacaataacagagcccaaacctagataaagataacaacatccatgtacaagaaggtaatagaacactaagcagatttaacccaaagaagactacctcaaggaatttaataatcaaactcccaaaggtcaaggataaagaacaaatcctaaaagactggtggctttgcatggtggctcacatctctaatcccagcactttgggaggccaaggcaggcatatcacttgaggtcaggagttcgagatcagcctggccaatatggtgaaaccctgtgtctactaaaaaaaaaaaaaaattagccaggcgttgtggtgggcacctgtaatcccaggtacttgggaggctaaggcaagaagaatcacttaaaccgaggaagtggaggttgcagtgagccaagatcatgccactgctctccagcctgggtgacagagtaagactctatctcaaaacaaaacaaacacacacacacacacacacaaagcaagagaaaagaaacaaataacatatgacggagctccaatacatctggcagcagacttttcaatggaaaccttgcaggccaggagagagtggcatgacatatttagagtgctgaaggaaaaaaactttaaacctagaataatatattcagtgaaaatatccttcaaacatgaaggagaaataaagacttttctacacaaagaaaagctgagggatttcagcaataccagccctgtcctacaagacaagatgaaatgctaaagagactatttcaatcagaaaggaaagaacattaatgaacaataaataatcacctgaaaatacaaaactcactggtaacaataagtacagacacaaaaaaaaatgttgtaaaactgtaactgtggtatatgaactactcttaccctaagtagttgaagactaaacaatgaaccaatcaaaaataataactataacaacttttcaagacatagtaagtacaataagatataaatagaaacagcaaaaagttaataagtggggaaacaatgttaagtcatagagctttcattagttttctttttgtttgtttatgcaaatagtattaagttgttatcaggttaaacataatgggttataaaatagtattagcaagcctcatagtaacctcaagccaaaaagcatacaatgtatacacaaaagataaacagcaagaaatcatatcaccagagaaaatcaccttcaccagaatacaaataacacaagggcaggagtaagtctttacttatcaaaattaacattgtatgtaatagactaaactttccaatagaaaaacatagagtggccgaatggatgaaaaaacaagacgcattgatctgttgcctacaataaacacaactcagctacaaagacacacatagcctaaaaataaagagatggaaaaagatattctgtgacaatgaaaaccaagaaagaacaggagttgctgtactcatatcaggcaaaggatatttcaagacaaaacctagaagaaacaaaggtcagcatataatgataaaggggtcaattcagcaagaggacataacagttttaaatatatatgcacccaacagtggagcacccagattcataaaggaaatattattaccactaaagagagagatagaccccaaggcaataatagctggagacttttacaccccactttcagcagaaagacagatcttccagataaaaatcaacaaagaaacatcagattaatagacatttacagaccattccatccacgagctgcagatacacattcatttcctcagcacacggatcattctcaaagatagatcctatgttaggtcataaaacaaatattaaaacattcaaaaaattgaaataatatcaagcatcttctctgaccacaatggaataaaactagaaatcaataagaagaattttgaaaactatacaaatacatggaaattagaccatgtgctcctgaatgatgagcaggtcaatgaagaaattaagaagaaaattgaaaagtttcttgaaacaaatgataaaggaaatatgacataccaaaacccatgggacacagcaaaagcagtactaagagggaagtttatttatgttggtgcaaatgtaattgtggtttttgccattaaaagtaattaaaagtaatggcaaaaccacaattatgtttgcaccaacctaataactataagtgcttaaatcataaaacaggaaaacttcaaataagcaatctaaggatgcctcttaaagaactggaaaagcaaaagcaagccaaatccaaaattaggagaagaaaattagtagaagaaaagaaataataaagatcagagtagagataaataaaattgaaatgaaaaaaatacaaaagaccaatgaaataaaaagtaggttttttgaaaagattaacaaaatcgacaaacctttaaccaaactaagaaaaaaagagaaagaaatccaaataaataaaatcagaaatgaaaaaagagacattaaaactgatactacagaaattcaaaggcccattagtggctactatgagcaaccagatgccaatgaattggaaaatatagacaaaatgaacaaattgccagatacatacaacctaccaagactgaaccaggcagcaatccaaaacctgaacagaccaataacaagtaacaagattgaagccataataaaaagtctcccagtaaagaaaagactgagacgtgatggctacactactgaattctatcaaacttttaaataagaactaatgccaatcctactcaaactattctataaaatagaagaggagagaagacttccaacctcattctacaaggccaatattaccctgataccaaaagtagacaaagacacatttaaataaataaataaataagtaagtataagccaatatctgatgaatatcgatgaaaaaattctcaataaattccacgaccaagtggaatttattccagggttgcaaggatggttcaacatgtgcaaatcagccagtgtgatgcatcatatcaacagaatgaaggaaaaaaaccacatgatcatttcaattcatgttgagaaagcatctgataacattcaaaatccctttatgataaaaaccctcaaacaactggggatagaaggaacatgtctcatcataataatagctatatatgacagacccacagcaagcatcaaaatgaataaggaaaaactgaaagcctctcctctaaggtctggaacatgacaaaggtaccctctgtcaacagtgttattcaagttatactggaagtcctagatagaccaatcaaactagagaaagatgtaaaggacattcaaataggaaaggaggaagtcaaattatccttgtttacagatgatattatatttggaaaaacctaaagactccacaagaaaactattagaaatgatcaacaaattcagtgaagtttcaggatataaaatcaacatacaaaaatcagtagcatttctatatgccaacagtgaacaatgtgaaaaacaaatttaaaaagtaatcccatttacaataaccacacataaaattaaatacctgggaattaatttaaccaaagaagtgaaaaatctctataatgaaaatgataaaacaccaattgaagaaattgaagaggacaccaaaaaaatgaagaaatattccatatgcatggatttgaagaatcaatattgttaaaaggcccatactacccaaagaattacagattcaatgcaatccctgtcaaaatatcaatggcattcttcgcagaaatagaaaaaacaatcctaaaatttatatggaaccacaaaatacccaggttagccaaagctctcctgagcaaaaggaacaaaattggaggaatcacattacctgacttcaaattatgctacagagctatagtaaccaaaacagcatggtactggcataaaaacagacacagagaccaatggaacaaaatagagaacctagaaaaaaatccacacatctacagtgaactcgtttttgacaaaggtgccaagaacatacactgaggaaaagacagtctcttcaataaatagcactgggaaaactggatatttaaatacagaagaatgaaatttgacccctatctctcaccgtatacaaaaatcaaactgaaatggattaaagacttaaattgaagacctcaaactacgaaactactgcaagaagacagtggggaaaatcttcaggacattgggttgtgtaaaaatttcttgagccatactccacaagaacaggcagccaaagcaaacatgggcaaaagggatcacatcaagttaaaaagctcctgcacatcaaaggaaatcagcagagtgaagagacaacccacagaatgggaataaatatttgtgaactccccatttgacaagggattagtacccagaatatagaaggacctcaaacaactctataggagaaaaaaaaatctaataattcaatcaaaatatggaccaaagatgtgaatagacatttttctttattttttatttttttacttttttttaaaattatacttcaagttctagggtacatgtgcacaatgtgcaggtttgttacatatgtatacatgtgccatgttggtgtgctgcacccattaactcatcatttacattaggtatatctcttaatgctaaccctcccgactccccccacaccacgacaggccccagtgtgtgatgttccccttcctatgtccaagtgttctcattgttcaattcccacctatgagtgagaacaagcggtgtttggttttctgtccttgcgatagtttgctcagaatgatagtttccagcttcattcatgtccctacaaaggacatgaagtcatcattttttatggctgcatagtattccatggtgtatatgtgccacattttcttaatccagtctatcattgatggacatttgggttggttccaagtctttgctattgtgaatagtgccacaataaacatacgtgtgcatgtgtctttgtagcagtatgatttataatcctttgggtatatacccagtaatgggatggctgggtcaaatggtatttctagttctagatccttgaagaatcgccacactgtcttccacaatgattgaactggtttacagtcccatcaacagtgtaaaagtgttcctatttctccacatcctctccagcacctgttgtttcctgactttttaatgattgccattctaactggtgtgagatggtatatcattgtggttttgatttgcatttctctgatggccagtgatgatgagcattttttcatgtgtctgttggctgcataaatgtgaatagacatttttcaaaagaagacatacaaatagcaaacaggcatatgaaaaggtgctcaacataattaatcatcagagaaatggaaatcaaaactacaatgagatataatatcatcccagtcataatagcttacgtccaaaagacaggcaataagaaatgctggtgaggatatggagaaataggaatccttatacactgtttctaggaatgtaaattagtacaaccactgtggagaacaatttggaagttcctcaaaaaactaaaacttgagctactgtgtgattcagcaatcccactgctgggtatataccaaaaagaaagaaaagcaatacatcaaagagatctctgcactcctatgttggttgcagtactgtttataatagctaagatttggaagcaacttaagtgttcatcagcaagtaatggataaagaaaatgtggtacatataaacaatggaatactattcagtcataaaaaagaatggaatccagtcatttgcaacaatatggatggaagtggagatcatttgtgaagtgaaataagctaggcactgaaagacaaacatcacatgttctcacttatttgtagaatctaaaaatcaaaataattgatctcatggagatagggagtagaaggatggttaccagaggctgggaagtgtagtgggagggttgggggaggtggggatggttaatgggtaccaaaaacattagttagaaagaatgaataaggctgggtgtagtggctcacacctataatcccagcacttttggaggccaaggcgggcagatcacttgaggccaggagttcaagagcagcctggccatcatggcaaaaccctgtctctactaaaaatacaaaaattagccagggtggtggtgcacagctgtaatcccaggtactcaggaggctgaggcatgagaatcacttgaacccaggaggtggaggttgcagtgaactgagattgcatcactcactgtattccagcctggtgacagagggagactctgtctcaaaaaaaaataaaagaaaaagaaaaagagaaagtaccctaaaacttaaaatataataataataaaataaaaaataaaaataaaaaaagaaaaagagaaaagaaaaagaataagacctactatttgatagcacaacagagtgactcttaagtcaataataacaaacaattgtatattttaaagtaacttaaaaagtataattagattgtagctcaaaggataactacttgatgggatggatacaaaaagtttataggaataaataaagcaaattttgaactaacaaaaaaagataggaaaagctagaataaaaaagagaagcatcaaagatcaagctccatagacatgccctactcagattttcacaggtaggtgatctgcctctgtcttttatatacaagatgattgataatgatgttaaccaattacaactttgcctttcttatttggtacactgagaggcagggttcctctcttcttttataagcttataataaagtagaaaacagaaaaataagtgagggcaaaacataaaagctagtgaatatctcatctttttcatttctttatcacaacatatgtagattatctcttggtaatggaaatacataagccttgctaaatgactatcctagtaatagttgaccaaatccttagatccatgaatgaaggaagcagttatgtaggagacccgggcctgcctcacattttgtccagggatttcctggtactctacagtgggggtaaaaaaacgggggggactggttttgattgactttttattgataatcctgagatatctgaaagaattccttaaattatctaatgaattagccagataacaattacaaaccagcaatttatagtaactagtaatgggagaaacaattcaaaataaaaccacacatggtaaaaatttgttgaaataaaaaccaacccaagattcatatcttcatatcttcttaataactataaaaaccaaaaacactgagagagtagatttagctggaataataaacacaaaataatgaagcaatggctaagcctgcacatgatcaaaatatattattgactacagttaacaaattctattttcattcatctgagaatgtctttatttcccactgatttctgaagcaatatattttcatcagatagaattgacagttcttttctttcagtacttgaaaatgttttgttattaatacttccttttcgcctccagatgagaaatctgctctcactcaaattggtgtacccctctataagttatgtgctgtttccctctggatgctttcagtactttatttgtctttactattcaaaagtttaattgaaatgtcttggcatggatttctcctatttggggttcactccatctcctattgtgtccggaattggtgagttcttggtcttactgacttaaagaatgaagccgcggaccctcgcagtgagtgttacagctcttaaggtggcgcgtctggagtttgttccttctgatgttcggatgtgttcggagtttcttccttctggtgggttcatagtctcgctggctcagaagtgaagctgcagaccttcgcggtgagtgttacagctcttaaggcggcgcatctggagttgttccttcctcccggtgggctcctggtctcgctggcttcaggagagaagctgcagaccttcgcggtgagtgttacagctcataaaagcagtgtggacccaaagagtgagcagtagcaagatttattgcaaaaagcgaaagaacaaagtttccacagtgtggaaggggacctgagcgggttgccactgctggcttgggcagcctgcttttattctcttatctggccccacccacattctgctgattggtagagccgagtggtctgttttgacagggcactgattggtgcgtttacaatccctgagctagatacaaaggttctccacgtccccatcagattagttagatacagagtatccacacaaaagttctccaaggccccaccagagcagctagatacagagtgtcaattggtgcactcacaaaccctgagctagacacagagtgctgattggtgtgtttacaaaccttgagctagatacagaatgccaattgatgtatttacaatccctgagctagacataaaggttctccaaggccccaccagagcagctagatacggagtgtcgattggtgcactcacaaaccctgagctagacacagggtgctgattggtgtgtttacaaaccttgagctagatacagaatgccgattggtgtatttacaatccctgagctagacataaaggttctccaaggtcccaccagactcaggagcccagctggcttcacccagtggatctcccaccagggatgcaggtggagctgccagccagtcccgcgccatgcgcttgcactcttcggcccttgggtggtcgatgggactgtgtgctggggagcaggaggtggcgctcatcggggaggctggggctgcacaggagcccacggaggcaggggaaggctcaggcatggcgtgctgcagtcccgaggcctgccccgcgggaaggcagctaaggcccggcgagaaatcgagcgcagcgccggtgggctggcactgctgggggacccagtacaccctccgcagccgctggcccgggtgctaagtccctcattgccccgggccggcagggccggccggctgctccgagtgcgggacccgccaagcccacgcccacccgaaactccagctggcccgcaagtgccacatgcagccccggttcccgctcgtgcctctccctccacacctccctgcaagctgagggagtgggctccggccttggctagcccagaaaggggctcccacagtgcagcggtgggctgaagggctcctcaagtgccgccaaagtgggagcccaggcagaggaggcgcccagagcgagcaagggctgtgaggactgccagcaggctgtcacctctcattatatctataggtttatatcttttgccaaatttaggacatattaacaaattatttcttcaaataccttttcagtctcactctttctcctgtacttctgaaactccaataatgcaaatgctagctcttttgttattgtcccacaggttcctcagtctgttcaattttttgttctagtctattttctctattgttcaggttgggtaaattgttattatcattattattattgtagagacagggtctctgtgtgttgctcatgctggtataaaacttctgggctcaagggattctcctgcctgagcctcccaaagtgctgggattacagacataagccaccacacccagtcaggttggataaattctattgatgtgtcctgaagttcatcaattctatctttagtcatcttgactctactattgaacccatccagcaaattttttatttcattgctttatgttttagttctataatttctatttggttcttttttaacttatttatttgctgagatattttattttttatttgtgtcaagagaatttgtaattgctggttaaaacatttttataataactactttaaaatccatattagatcgttccaacatctgattcatcttgattttagcatctgttgattttcttttctcattcaaattgtgatcttcctggttcttggtatgaggaatgatgttcaattatattctggatattttggatattatagtataagactctggattctatttaatcttttttaatcaggtaggcctcctgttggggtgtagcaagaaggcaggtgattttgtatgtttggtctcccagtgggcccaccaacaccttccagacaaacatgcagtacttattcatcctgtccagatgtctatgggggggcggggtggggggcgggggggagggtattcattttctagtgctgccataacaaaatgcgacagattggatggcttaaaaaacagaaatttgaccaggcgcggtggctcacacctgtaatcccagcactttgggaggctgaggtgggcggatcacaagttcaggagtttgagaccagcctggccaacatagtgaaaccccgtctctactaaaaatataaaacttagcctggcatgatggtgtatgcttgtagtaccagctactcgggaggctgcggcaggagaattgcttgaacccgggaggcagaggttgtggtgagccaatattgcgccactgcactccagcctgggcaacagagtgagatccgtctcaaaaacaaacaaacaaacaaaccaaaaacagaaatttattttctcacagttatggaggctggaagtccaagatcaaggtgttgacagggttggcttcctctgaggcctctctccttggcttacagatggccacccactcaccgtatcctcacatagttgcccctctgggtacacatgccactggtgtctctatgtgtgtccttatctcctcttcttattaggaccccagtcagattggattaagggccaccctaataacctcattttaatttaatatttcttttaggaactatctgtaaatacattcacattctgaggtactggggattagagcttcaacatatgactttaggatgggaaacacaattcagcccacaacatgtgagttggaagttcagctaccccttgccctgttgacaccttcccagtcaaagtgagatattcgctcacacctctaagttcaggtgccactagaaaggtggaagcagatgattgattcacaccattttattacagcaggattggggtagaaattaggttctcaactctctgctgggcctccctgatgccagaggaggagagggagacaagcaaagtgccaactatccctgcctctaccgctttgttctgtctcattgatgccaggtggaagtgaagactcagcaacccactgggccctgcctacatggaggtgtgggggtaagtggagtactgaccagacttgagtcacacgacccagttcagttgttgatgctggatgggagtggagtctcagcttcctattggttaccactgacactagactgaagcataactgtgatgagccctgcatcccaccgtctctttgagtctcactgtgggtgcaagctcagctcattgctgcaccctgccaacacaaggtgagggatagaaaaccagatccctgctcagccaggcaaagccaccctgagtgggatcacagtgctgctgcctgcctccagtgagtggagtaaaaaatcagcctcctgtcctattctactcaaactttgagaaagggagggtgcagttgttacactggtatttgccctgagtagggcaggtatcgccaaaaagttctggctacggggaacgaacaggctcatcttggggctttttgtgtatgtttgttagtggctccaagttgaaagcttctgcaggaccctgtctggaatatatgagaggcaataaggaaatccagggaactcagtgccatgtcattccttgggtccccaggttcctaagtagttcaccttcttcttttcagtgttagagtcttcctgtgcttgtttgttgagttatggccagggtttttttagttgtaagaaagagggtctgggaggaatgaggctacttccatttgcccagaaccagaagtcctccttataaacactttaatagaagaaatgcaaagaagatagggatttttatggaatattccaacataaaatcagcaactgatctaaaacctgaattatcaaaaggaatatcaatttctaaaaccagggcaagctgacaaaataaagctgagctatataaaggtatgtgtgctgtaatactcaacttcaagatgcttttggatgagctcaattcaactaacatcaaaacaaaaggaaataaatttttctacattcggaatatttgtcacaaaacaaagaccaacactatcagatagggcaattcatgttttgtgtgttttaaatttttattttaagaataacttttaaatatttgtaacagctttcaattttttaattgattttatttggtgttagtgatacttttttagttttttctatcatcaggtatagatcatttttacatgttattaaaatacataatctcatcaaatgcagttaatattgtatttttatttttatagaaaacctctgaaacttttagcataattctatcatcaaaaatgacacaccactattattgtggtcacttatcaaaatttgaaaacacaggctcagcacagtgggtcacgtctgtcatcccagcactttgggagacagaggtggctggatcacttgacgtcagaagttcgagaccagcctggccaacatggtgaaaccccgtgtctactaaaaatacaaaaattagccaggcgcgttggtgcgtgtctgtaatcccagctactcaggaggctgaggctggagaatcacttgaacctgggaggtggaggttgcagtgaggcaagatcgtgccactgcactccagcctgggcaacagagcaagactctgtctttaaaaaaaataataaaaacatgtaaatatcacaaaaaaaaataggatgaattctgttttgagaattcccaggaatttgtattttttttaacctgaatcctgaagatatttgtcagggatttagaaacactataaaaggcaaatactgtcccaattaccttattaacaaagactttttctttttcaatgatcaagacttaatcaaaattgtttttatctcttcagtttatatgtccagacttacttggttattacaggcacagtgatgcagtgaaatcatgacctatacctaaacagcctgaaaatattcagcctataaaagaaaagacttaggtgagaatttaatagctgtcctcataaacttcgagagctctcctgaacaagagggattgcatttgttctgtatgacccaagaggaaagaattaggataaatgagatgaagttacaggaaagaaaattttgacttactatatatatccactttctagcaactagagaattctgaaatgagagcagactccctcaagcaatagtgatttcttgtcaaggtaaaaggctggacgaccatttatcggggatattatcaaaaagactcagtgtttgtgattttttttttttggtgtgtatcatctcattttgttctccaagtgacacacatagaaaatgtatttaaatggctatgtatgaatgaaaatagtaaagttcagagggtatattagttaggattctttgtaaattataaagcaatttgagctagcctgagcaaaaacaaaatacagtataagaataaatggtatttcacagaacctaaggccagtgtaatgcagctgtctctagggtcggactgaggccaaagctctctctctctctgtatcttcaccctgtttctctctaacaactgctttgttctctatttctgcagatgtattttctatgcttcccaaccacataatgggtaggagatatttatgccacagatccccaatttacatctctatcattcaagggaccagtccagaatgattgggtgcctaaattattctggactttatgcagccaattaatcacattattctcccttctgaatgctaagccaattaagaaatagccacagtaaaactggatgggataatgtggcttaaacttgaggccaaaatgtacttttctgcaactttcctttgcctttgaattgaattcagccagtccaggcagatatccagattgcatctcaggagatggcctgatctggcggcctgacctgacgagcttatcagatgggaaagacgtccaggaggtgagcacattgcacttgcacatatgcaaaaggagaataaaggatctggtcagacatgtgcaatgaccctttactgaaacctactaattaagtaagtcactccaccaactccctcagggttgagttgctgaaaaacggagataagggcagaaactttcctcataacattttcaaagatattttatacgatggactaaggtaggaatgtgcagatgggaagagaatagccttcccgcaattaccaattcttatttctggagatagggaagttaactcacccactttgaaccagttattcatctacgtccaatcaattatggttttaggagagtctctcgatgcataaacagcatggccaggggacaaccattacagataggacaggcgatttttggtaaaagatggctagacagatacatgaataagtacactcagaatgcatacacttcttcgtttacattataaagttattcttgactcataatatccagctacctcacgttcaaatgcaaatacacacaagtacacacacactcattcacacatgctctgcagtggaggactacccaagtaatgagtggataatccattacattaggaagtgatgttgccttgaggtcactgctcttcctgtgtaaaatttctggatgaggtccatttcctccccgaatccagttttaattttgttctcattttcttaaaatttagagattaaattacaaacgtaaccactctcaatatatctaatatacaacacttggggaaatggccatatagagaaatagcgacggaaagaaagctccacatagtggtcactggtctgtgatttattctgctggacagtggcagtttgaaaagcttgaaagaacaggtgacttatttgggcataattttgactcactcctttggcgtgtttcttgaccctatagtgaactttcagtttgtgttatttcttctttggattgtgtctgaaaatttcctaagaattgactcttctggtatgagtcaactatgggtccctttcaccagatttagtatttttcactgacattttcattcttgtaaaacatttctggttggctctcacatccattttggactccatttgctaaaatccagcaccacaaatcttgttaggtcatgctccaaattgaatagccaggacttgttcactctactcaggcgtatgttctgttttgttcgtttttgaagtaagtctgaaggtttcaccatccatatggtctttaatacatgaattaaaaactataaaattagctgggcgtggtagcaggggcctgtaatcccagccactcaggaggctgaggcaggagaatcctttgaacctgggaggcagaggttgcagtgagccaagatcacaccattgcactccagcctgggtgacaaggaaagattctgtctcaaaaaaaacaaacaaacaaacaaaaactatagcctggccgggtgcagtggatcatgcctgtaatcccagtactttaggaggccaaggtgggaggatcacttgagcccaggagttcaagaccatctgggcaacatagcaagaccccatctctaaaacaacaacaacaaaaaaaactatggcctgatacgaggtagctagcataacagaactccttcctttcttatcagctatggaaatattgtccctattctcctattttagctagtgagaaggactttggaaggatgggggtgggaggtagaagtatggtcagtctttctccactcttctgcttcttccaggatattcccattcctgtttccaggatcttgcgttttcttggtccagacatttatttatcctaactacaaaaaggagagtcaactcagaacttgactactgcaattcacatttccttgatttatttcttcatcagtacctcagcaattgattgattaattgattgagacagtcttgctgtgctcactggagtacagtggcatgatctttgctcactgcaacctccacctcccaggttcaagcaattctcccttccccagcctctcgagtagctggaattacaggtgcctgccaccatgcccagctaatttttgtatttttaagagagacaggctttcgccatgttggccagtttggtcttgaactcctgacctcaagtgatccgcccgccttggcctcccaaagtgctgggattacaggcgtgagccactgcacccggccagcaatctatttagaagctcagattttctctctgtgcttccagtcaagcaaatctaagttggtttttttcttctgcaccttatactgacagctacaaaaaatagatatatactaatattttctaccaaggccccccatggcttggtggagaatgatctgagatgtaagagacaatgagcaggttttcctacttacttcaatattgcagaaagactgtaagtttctatcctaagattggggtggtaggtgggagtgtgaggctcctcccaatctgacacctgccttaacttcactcattttatattttctgattaagaatctgttactccgaaccctatcacaggtagcactttgtatattaaataagattctctgttgccttaagctgtatgcaacagaaactgtatcgagccagcctaagcaagaaaagaatttaagaattcagaagggcactcaggcctaagaaagagatagaaaagttaccagatctttcttcatctctcatatcttcttctctctgcatgtttgctttatttatttattttctctgaagttaggctttctctgtttctctttccacataccaggtaagatcatggtcactcagcagcttccaacttcatatgtcttttctttgagaaaccaagggtagtatgccaaaaccattgttggttttttttcagatatgtccagggagaaaatctggttgaccagtttgtccttatagtgaaccttcatcagtggtgtgtgttcaatatcaaaacatctttctaattataaagaatcttcagttaggtgagcagatatttcatctccccaccttttggttcctaaaacaaagacatgtgacccaagtcccaccaatatgatgtttttgcctggaactttatcaagtgatacacacaatttggaatttttctatggctgtggcaccaatggcagtggcttctggttctggtggcagtagtggcttccagcatctgatgatacagtggtgactgctcggcaaagacagcagtcatgtcctaaccaggttctttctgcagcataattttaaatgtcctgagttatggcctcccttaattattgctcatttctttccaagcccaatcttcagttcttctcattgattctgtgagcgttcctaaactcttctaataatgttttttttcctcaaatataccagaatgattttatgttgtttacaactaagaacttgcctatattctaatgagctaaaccagtgggtaggggccttgtagagcaaacctgattgtcagaggtctacccctgtgaacaggaagaacagttcccagagaagacagaatcagtggacatcccaataagtgtctttttgcattaatattggaaaagttgtccaagaccatagaagagctgaatatcagaactttaagaagaatctgcacatctcactactcaatataggatttattcctttgtcccaaggattaattttaattcttgaattaataatggatggggatacctaaggttattatagaaaggccaacataagcccttcacaatctcaataatttgctatttcaccaaactgaaaaacctatttcaaaaaagaaaaggctgaattcaattaaacaacctggttctttcaaaataactggttacctaattaaaccttactattgccttaaactttgtaaacatatcttaaacactactatgctaagatggggcagaggaatgaattactgataaaattcatagttaattgaaaatgatatcaaaaacattttaatacttttcaccacataataaaataaaaactgtgtgatttgagtttttatctccttttatgggcctgtttaatttctgtaaaggagctttgaaattaagcaaaatagaaagggaaatagtaatttggataatcagtcccaaataaacaagaattgctaattgcatttcttgtacacaactaggagtaaattcaaaaactgaaagtaaattggacatgatgctcagagagtatccttgagcatgagtaactaaaattaaccagaattttaaataaactggggactcctagacttctgaagacatgaatgaggctattagaactctctttctcctactcatccattagcaatgtcgggaacagttcataaaagattaatgtttaaatgcttaagaatatatatttgaataccttgaaaacaccaagcaatgctttttaaattaattgataagtcattttatacttgtgatgtagacttagacttttttgtagtaacaagccagaaaacatctatccttctgagagataatatgtgaaagaattgtagaagaaatgagaaagatgattagtaatcctgtattgcttcttgagacagcaattctctcgtaagtggaaacttaggcaagcatcagtgatgagaaatagatacattttactctttacttcatggttgagaagtgcctgtaattcacctttcaaataagaggcaacatgtatagcataatcccacagtattatgaaattttggaggtgaaagggaccttgatgtatcggtaagctattgctctataacaagccattcccaaaactcagtggtttaaaacatttattattgttcaagcatctacagattagctaagggtaggctgagctcatctggggtgattctgctccatgtgtttctcattctccataaaccacaaacaaaataataataataataataatagtatttttttaagttctcacttgttgaaggcttactatgtgctaaaagcactttaaaatgttatctcctttacttctcacaaaaacattatgaggtaggtactactaatatcctaatttcacagatgaggaaacaaagaaggaatttccccaagctcaagaagctactgtatggtgaacctggagcacacagatgaaggtctacctgacactaaactttatgttcttaatcattctgttatattctgtttcatgaaatttactattccattttcagagagttctaaccactaagaagttattcttatattcagtgaaatgattttctctataacttttaatcactgatcttaatttggcccttgagtacatacaggataaagataataatcataaattaaatgatatagtaaaagtgcctgacaaacagaatgtgttccacaaaaattaatctaagtcagccccacaataggcataacagtcgttaataaaatgttcaaccgggcagggccagaattatttgcagttttacccagttggcacttatcctattatacagaaaactatccaacctaggataaatacaatgtttaagtccagatatactgtgtctataacatttcctttatctatcagcctagtaatcttgtcaaaaaggaaatgagccctagattgaataagcaacagacaattagaatttagagggtagagaggaggtaagggaacattaaataatgctttttaaaattaatcagcatatattttattaataagcaagcaggcaaaacctagtaaatgttgactttctttctatttggaaaaaatttaatttgttcaaaggtaaacttttgtttatattataggtttacctaagctgatgagagaactgagtacataatacctattgaggataataaacttgttaaaagatgattttcaaaatgacaaaatacaaatattaaaagagcatatgtgaaaatttttatttaactcattaattaatgaaggaccctgtaagatattacaagctattcaaaaaagaatagaaacagtcatatgtaggcaagcaggaatgttgaagtaaatgtgctaatatgtgcaaattaatagatcctataggtactaaattgtaatgtttggaatcatcttttctacagagaggaaatcaattatatctctatgataaaattcattagcatgtctatggaaaagaataatttgcattttactgtcagtcaattttttacaacttcctgagttgtaaaatagctcagtcaagggcagtccaaagcacaggttccaacagaatcagataaccttaccttggagagtaagccagacagtgtcagacgttccagaacacccagaattgtgcccattcaaaattcttcactagtcttcctgacaaagtttctagaagaacatcaaggagaaaaactgggggaagtgctgattacatgaaaatgtacactggttgaaacgttttacaattttttaaaaacatattatttgagactctttgagaaaaaagataatcccggaaaatcatgaaattatttttttttaatttttttgtcacatccttcaaataaactgttaatcatgatatacaaggtcagatggaaattgaaaaaaggaaaaattaacgttttttaatataccctcccatttgtctgccaaaattgtatttaaaagtagtgttatataattaatgatattttatattttcagatgattgctaacaagccaaagaaaaaaatttccctgatcgtatttggaattaaaaaaatcattgattgaatgaactagtaatattttatttagcatttccttgtatttagagtggtaagaatttctatgtcagctctgtcctctgcattgacaaatcagaaggtcctgaatcctctttactctgttatgagatcataaaaaagaaattaaaagtcaattgctctccactgaaaatcctagaattgagaatcaaggaataatcttctcttccaaccaaagtccctgtgtgactaaagatcagtgtaattttaaaatgtggcaacttgtatattaaaatgtcatatagaatttttaaaaatcttttattgagattcaaaaatagacaaagaaaatataataatggctaataagcacatagaaagatgttcaacatcactggttattagggaaatgcaaatcaaaatcacaataagacactactttacatccatcaaaatggctattgtttcttaaaaattgaacacactaggcattagtgagtgtcttacttcgttttgtgctgctgtaataaaataccacagactggataatttataaagaacagaaatttattctctcacagttctggaggctgagcagttcatgatcaagggactggcaagttaagaactggtctctctgcttccaagatagtgcctggaatgctgagttctctggagagaagaaacgtggtttcctcaactgacaaacaggcaggagagagagagaacctactcctgcaggcctgttttatagcagcattaatccattcataagggtggagcctcatgacttaaacacctcccatcatgccctatctcccaacactgttgccttggagattaagtttcaacatgagttttggagtggacgaaaacatttaaaccatagcaataaggatgtagaaaaattagaaccatcccatattgctggtaagaatgtaaaatggtgcagccactatggaaaatagtatggcagctcctcaaaaagttaaacatagaattaccacatgatctagcattctatttctaggtatatacctaaaataattaaaagtaggggctcaaacagatgcttgtacagcaatgttcacagcagcattattcacttgtagaatttaagacactctaccccaaaatacttatttaagctgaaagaatttgagaaaacagcagaatcaggaaggtcaccctcactttactccacccttcttttctgaagcaggtcataaaacttaggcaggattttctgaccttcccttgaagcaggtcatagcaccctcatgtgagaggtgccctctctaatacctggataaagcagccaaagacagagacacgaataatctgaacaggcaggccttgctaagtttccccaaattcattactggtagattacacccactatgtccaagtctacttctccacgtctatacatttattcatcaaacttggcataaaagtacacatgtttaatctgcttctttgggtcttcattgccttatgcaggctcccatgtcacataaaacttatattgaataaattcatatgcttttctcttgttgatctgcatttcagccatgaacctgggataagtgaggaaatacttctcttcccctatatcgcagtaggcaacaggtagaaacaacccaaatgtccatcaacaaatgaatggataaactaaatgtggcatatacatataatgaaatattattcagccttaaaaaggaatgaaattttgttacatgctacaacatggatgaaccttgaaaacattgtgttaagtgaaataagccagactcaaagggacaaatattgtgtaatttcacttatatgaagtacctaaaatagtcaaattcatagagacagaaagtagaatagaagttttcagggactgagaggaatagggatagggagttattgattaatggtcatagtgtttctgtctgggatgatgaaagagttttggaaatggagagtggtaatggttgcacaacaatgtaaatgtacataatgccactgaactgtacacttaaaaaaggttaaaatgataaattttatgttatgtatatgttatcgcaatgaggaaaaaaatcactagttggaagtcaagaatgttttaaagctttttcagagctccaagtgttacaggaaagggatcccgatccagatgccaagagagggttcttggatctcaggcaagaaataattcagggcgagtccatagagtaaagtgaaagcaagttttattaagaaagtagaggaataaaagaatggctactccatagacagagcagccccatggctgctggttgcccatttttatgattatttcttgatggtatgctaaacaaagagtggattattcatgcctcccttttttagaccatacagggtaactttcagatgttgccatggtatttgtaaattgtcatggtgctggtgggagtatagcagtgaggacaaccagaggtcactctcattgccatcttggttttggtgggtttttgtgggttttggtgggcttctttactgcaacctgttttatcagcaaggtttttatgacctcaatcctgtgccatcctcctatcttatcctgcgacttagaatgccgtagccatctgggaatgcagtgatgttgcgggaagtcagggaccccgaacagagggaccggctgaagccatggcagaagaacatggattgtgaagatttcatggacatttattagttccccaaattaatacttttataatttcttttgcctgtctttactgcagtcgctgaacataaattgtgaagatttcatggacacttatcacttccccagtcaataccctgtgatttcctatgcttgtctttacttcaatcacttaatcctgtcagctgaggcggatgtatgtagcctcaggaccctgtgataattgcgttaactgcacaaattgtagagcatgtgtgtttgaacaatatgaaatctgggcaccttgaaaaaagaacagggtaacagcaatgttcagagaataagagagataaccttaaattctcaccaccggtgagccaggcggaacagagccatatttctcttctttcaaaagcaaatgggagaaatatcgctgaattctttttctcagcaaggagcatccctgagaaagagaatgcgcccctgagggtgggcctctaaaatggcccccttgggtgtggccatcttctgtggtcgagctgtagggatgaaataagtcccagtctcccatagcgctcccaggcttattaggacgaggaaattcccacctaataaattttggtcagactggttgctctcaaaccatgtctcctgataagatgttatcaatgacaatggtgcccgaaacttcattagcaattttaatttcgccccagtcctgtggtcctgtgatctcgccctgcctccatttgccttgtgatattctattaccttgtgaagcatgtgatctctgtgacccacaccctattcatacactccctcccctttgaaaatcactaataaaacttgctggttttacagctcagggggcatcatggaacctaccgacatgtgatgtctcccctggatgcccagctttaaaatttctctcttttgtactctgtccctttatttctcaaaccggccgacacttagggaaaatagaaaagaacctacgtgaaatattgggggtgaattttgcccaatatctggctgaattttctgcgatacagcacagtatgtttcagccttattttacccagctcctattcaagatggagtttctctggttcacatgcctctgacacaagcactccaaactggtttccatttcaattttctctcattattttatttaattaataggcatttattaagagctttttttgctaaacactgtactaggcacagcaaaaaaattcaaaataataagatctttttttctctgaaatccatcatttagctcttcctaaactgggatttaaggaaagctgtttctttttttatggttttgtttctttttgttgggatgggttgttcataggtgtgctgaaaggaaaaacatttttcctctttgcaaataaatgagtgtttaattattaaacaaagttaaatggatttttttaactgtgaagacttcccataacctttaaaatgctaatgtattttttgaatctacaagactggatttagtaagtggcattcctaagcttatttaatcaagaattctttgtctctcagagcccaattaattaacatctccctttgtactgtggctgcagaagttgagctatgtggtggattctttttatactgggctaaatgtattatacaatctgtaattatggtataaatgtgtattttgttttatccctatgtgttctagaatgtgagtatgattttaaaagcatttttaaatttaaaaatgtagattaaacattagagacaataaagtcattataatttcttacctcaatttaccattttttttctcctttagatagcatttattattctggaaaaagggatattcttgttttggggagaaggatttgctaatggagattttgcagaaaactgtgatgctgactgtgatatgtaacttgtgagcatttttaataagaagaaacatagaatgccagtccttattcttttcttgataaaagaattcctaccgaattgtatccaatcaatagctttaaggacttgtgattttctctctgcctttgaataattgcaaatttttgatgctaattcttactccataagtttaaacgtccctatttttccgattactaaacttatactttaagtcacaacctacaataatatgcagacaatccctgacttacgatggtttgacttatgattttttgacattattatgatgtgaaagtgagatgcattcagtagaaatactgttgtatccatacaaccattctgtttttcacttttagtatacagtattcagtaaattatgtgagacattaaatcctgtattataaaacaggctttgtgttagatgattttgcccaactgtaaactaaagtaagtgttctgcacatgtttaaggtaggctgggctacattgtgatgtttggtaggttagatataataatgcatttttgccttacaatattttcaactgttgaagatttattgggacatatcccacattgtatgaacatctgtattcctgcatcctccatatattccttttttttttttttgagatggagtctcactctgttgcccaggctggagtgcagtggcatgatcttggctcactgcaacctccacctcccctgttcaaatgattctctttcctcagcctcccaagtagctggaattacagatgtgcaccatcacacctggctaatttttgtatttttagtagagacggggttttgccatgttggccaggctggtctcgaactcccaacctcaggtgatccactgacctcagcctcccaaggtgttgggattacaggtgtgagccaccgtacccagccctacatatattcttaattttgtgcttttccttcaaaattaaacacagtagaacaatttaagtaaagctaaagatatagcaaatttgagcctatttcatgattttaatattggtctcagttatattttcattagtagtatcattttcatgtgtctaaagtatcacgtaaaatgcattagaatatttaagtaattgcacaggcattacaaaggaataaaaatgataaaattgccaagatcaaccagctggtcatcaggcagaagcaccccgtgatactgtgaaatacttggttattggtgaaggatgaaagtctagattcagcataggaaagagaattgttatgtgtatatgtacactggatggaggtgctagttgtttgcaagtcaagcattctaaagcctaggactgcctgaactagagcaacaaataacaaagtatcagagttcaaggatttattctgaccggatgattttggaaaccttcctggacaacacattgggctgggttctgaagaataaataggattcccacaaatttttccagactgaggagagaggctaagatgtgcaaatagagggtctatctaggagtgtaattttggagtgcaaagtatagagtgcgtaagggatagtgaagtaaattaaactagaaaaaattattgaggccagatcattagtactaacaaatttagactttattctctaagtaactgagagctgaggaaagtttttgagcagagggcatggtttgtgtttcagaacaattactctggtgggcccatagggagcagatgagactggaatgaggcagggaagctaattaggatgttataattgtctagcaagaaaagatgaagacttgattgactgtcaaggaaacaataaataggagacattttgaaaaaattaactgagcttggtgaataaatcaattagaaatccctttggatgcaagaaacagaatttcttttgaacagagttgaacatacagagccttactttattcaagtagatgcagatagatgcagatagatcaagtagatgcagatgaatctactttattcaagtagattcaagtagatgctgctggtgttggtgcagaggcttgacaatatcagtgacatcatttctcagctctcttggtttttctttcatgttgttgaacaaccgtctcctccacggcctactttaggtgagtgattggctggagctgagtcacatggcagcctctagctacagtagaggctaggaaggtggggaatagtagtgtcttgatcacctgagactgatcatggtctgtaactatgggctgatcacactgtccttttgaaaaaacattattagcatggagtacatgggcattggatattaggtgaacaattaatagagtttgctacagtaactaattggctatcggagtgcagtgggttgaatagtgtccttccaaaattcctgtccacccagaacattagaacactacattatttaaaaatgtgtgttgcagatacaaataaagtaaggatcatggtgagatcatactggattagggtggaacataaatccaaaaagactgtcttataattaccaaagataaacaaagacagatactattaaagtgataaagacaggttttgttttgttttgttttttttgtctttttttttttgagacagagttttgttcttgttgcccaggctggagtgcaatggtgcgatctcggctcactgcaacctctgcctcccaggttcaagtgattctcctgcctcagcctcccaagtagctgggattgcaggcatgcaccaccacacttggctaattttgtatttttagtagagatggggtttctccatttggtcatgctggctggtctagaactcctgacctcaggtgatccacccacctcaccctcccaaagtgctgggattacaggcatgagccaccgcaccctgcctaaagacaggttttaattagtaattaactattgcaaaagggaagagaatccagtataaactgaactcaactttgatttgttttaaagagagaatgagagaataggaaaggggaacggtagggaccagagtcagggagtggaaatttacaaaaagtgagaagacgagtgtcttagtctgttttgtgttgctataacaaaatatcacagaccaggtaatttataaagaaaagaaatttatttagctcatggtcctggaggtgaaaagtccaaaagcatggtgccagcatctggcaagggccttcatgctgaatgataacatggtagaaagtatcacatggtgaaagaaagcaggagagtttgtgtacaacttcaagccgtttaaataatcaacattattccattagtgaaggtggagtatcaatgactaaaataacccccatatggccccaactcccaaaactgttgtattggtattaagtttccaacacatgcactttgggggacacatctaaaccacagcagtgagttggcccatgtaaaatcatctgagtttgctaactggtactggtcaaagttaggctcctaccctcccaaagaggcaaaaagacaggggccctatcttcaggtgttggccagaacaaacaatatgttttttgggcagccttgagctttcccaagcaggaacttaaagagactggagtggtgatactaaggatgggaacttgagctgtcagaaactatactaatgtttgttcagacttttaatgagaatggaggaggaggccaggcatgaaggctcacacctgtaatcccagcactttgggaggccaaggtggatggattgcttgagcccaagagtttgagaccagcatgggcaacatggtgaaaccccatctctaagaaaaatataaaaattagctgggtgtgatgacctgtacctgcggtcccagctactcaggaagctgagaggagaggatcacttgaacctgggagggcagaggttgcagtgagctgagatcgcaccactgcaatccagcctggataccagagtgagacaccatctccaaaaaaaaaaaaaaaaaaaaaaagacagagagagagaaagagagaatggaggaatggaggagggacattgtcgtaagagacaaagttaagaaggctatgtgaaaatgaaggcagagattggagttatgctgctacaaaccaagaaatgtcagaagtcatcagaagctggaagagacaaggaaggatcctcctctagaaactttggaaggagtgtggctctggtgacaccttgatttctaatttctggcctcctgaactgtaagagaataaatttctgctattttaagccactcagcttatgataatttgttatagaagccctaagaatctactacatggggtgaaggagagggggaggtatctaaacataatagcctggaagaggatattgacagggctcagaacatgataccccaaagtatggcgccctgggatgctgagtactttgagctgaaggacattggaagggcctcagaagcaagtctctctaaacatttctcactctcctgtctctcatccttttttctcctccaggtgagtcatagaaatcagaatccctcttccccaaggtgggtcatagaaattagaacccctctcccacaaaacaagccataaaacctggaaagataacaagggccttgctgcattctgggaggaaggaattctacatggagagaccaagaagaatctaaacagacaggtgttactgagtattccccttcagtctattaccattccatcatacccttttggccaataacatttctacatggctgtccattcttcatagaatccaagcataaaaacaattttttccttggtctttgggtcttcatttctaaaggctcctgtgtcaagtaaaaccttttttttttctttgagacggagcttcttgttgcccgggctggagtgcaatggcacgatctcagctcactgcaaactctgcctcccgggttcaagtgattctcctgcctcagcctcccaagtagctgggattacaggtatgcaccaccacacctggctaattttgtatttttagtcaagatggggtttctccacgttggtcaggctggtctcgaactcccgacctcaggtgatccacctgcctcagcctcccaaagtgctgggattacaagtatgagccaccacgcctggaccataaaactttgattaaataagtttgttatccttttatcttgttaatctgtcttttgttataggagtgtcagccatgactcttacaatgggtgagggaaggtatcacacttttctgctcctacaatattaataccatgagtagaacatgttgtctgtgagacatttaggaaatattcatatgaggatgttaggcaagaattgggattatggatttagaattgaggaatgaagtaaggaataaagaaactgcagggaaaagaaaaataaacttcaccaagcaatagttaataacataagataaagtataagttagtatttaattgaccacttgaacacaattctttccctcttatttccaaattctattcctgtgtagcaggaatagaagaaaaagccagcatcattgagggttaatgaatttggcctataagggctaataaatatctacaaacaaactttggaaagagtcattaacaggactttgatttcccatttgccttagtagcaaatttagcagcactttttaaactgcctcatggatgactatctccattagtttttttttttaataagaaaacagtaaacactatgcatggtagtgttgtatcctcagtgcttctaatataatttcttcatatttctagtattacatttatctcactgcattctaattattgttctgtctcccctgctagactgggagcttcttaaaggtaatgcaccatttttattcatatttgtatttcaattacttgacacaatattcagcacttaagcaatttatgtaataactactggatggattgtaataacaataatagttaaggatgcagatctagagctagtttagttgggataaatcctggctttactgcttatttgttttgtgaccttgtgaaattactaaacctctctgtgccccagttttttcatcacaatgtgaaataataataagacctttgtcttggtcaatttgggctgttctaacaaaaatattatgtaccgactggcttaaacaacaaacatctgtttttcgtagttctgtggctgggaagtccaagatcaaggtgccagcatattcagtatatagtgagggctctttttctggttagcagacagcctccttctttctgtatcctcatatggctgagagaaagaaaggtcatctctctggtgtctcttctcataagggcactaatcccgtagtgaaagctccaccctcatgacctaattaccttccagaggatccatcttcaaatatcatcacattaaaattagggttttagcatttgaattttgaggacatacaaacattcagtccatagcaaacctcctcaaacaattgttgtgataattaaataaattaatctatttaaagcacttagaagattgctagacatacagtaagtgctcaatacacacatatatgttattgaattattaaatagaataatgcctctagcattcattactgctgttcaattttgtcttcattgttattttattttatgtcttcctgtgtaattcccttgtggcaatttcataattgctatagctttttttgtttgaccctccacatctcatgttcaaatttgatccccattgttggaggtagggcctaatgaaagctgtttgggtcatgggggtggatccctcacaaatatcttggtaccgtcctctggtaatgagtgagttttaactctattagctcccatgagagctggttgttaaaaagagcctggcacctccccctgcattctctcttgcttcctctctcaccatatgatctctacacatgccagctcccctttgccttccaccatgagtggaggcagcttgaagccttcatcagaaacagatgctggagccatgctttctatacagcctgaagaaccatgagccagtttatttataaattacccagcctcaggtattcctttatagcaacataaatgaactaagacaataatctacaaattcatttacttgattactggcaaattactcccatgagagtgagaacgttttctgtgaagttctctacccattccatgcataacacagcatctacacacagcagagattagtaacagtttgttaaaggagtaaattgatccacttttaccttctgtaaagaccaatttaaatctttcttatattgctaacactgaacctcctggttcaaagttaaaaaaaagataaggcgcagtaacaacagagtttcaggaagatctgggaaagaaagatttcctattattttttatttatttatttatttttgagacagattctcactctgttgcccaggctacagtgcagtggcataatctcggctcactgcaacctctgcctcccggattcaagcgattcttccacctcagcctctcgagtagctgggactacaggcacgtgccaccacacctggctaatttttgtattttttagtagagacggggtttcaccatatcggacaggctggtctcctgaccttattatccacccacctcagcctcccaaagtgctgggattactgacgtgaccccctgcacctggcctatttcctattaattctaggactaactacctgaaaataggataataccttgcatcactacattaatatactcatttttattgtcccctgtttctgagagtaacaacttcaaatctcctaccttctttcctgactttgacttcctataccgtcagctcttcagggcagtcttgacattggaataataataataacatcatgttcttagacaaagactgatccactctcagaaatcaggttaaaggttattttatgtgattcttttttgttttaatatgatttataaagagggagagtcaatgttgaagaatcagctattttaaaattgatccctctactggagtactaaaaagtatttgtgaaatgaacacgaataatctttataacattaaacattgcaaaacccaaatgcaaaatagtcctatttaacataaagtctttcatattgttctgttctgccatccttctatacatttgcccagacaggacagcaacaaggaaagaatatgtaaacactaatcatttctaacttgccatctgtgacagttcactgtgctgaaattagaaaggatggaatcacttttccatttccttaaggtcaccaaggacagacaagctcaggacatactgtatttgtcagaagaaaaagagatgactggtgaggtggcagtgacaaatctgttctaggttcagctcattttactgaagaatgtgtgtccccttctgacatttatcaaaagaaattcaattttataaaaagaaggatgtcaaataatagtacattgctaacactcattttgttgctgtcagaagggcagatgggggcaaaaagggaaaagggtggatggaagagaaagttattccagcaagaaacaaacaaagtcatgctaataatacacttataggcttgaatatatttctgattaaaacacctatttttgagatccatcttagtgcctggctcacactttagaataccagttttcacttcttccagacagaaggaacgacacaaagcaggttgatttgtgggttttgtgtttgtttttggttttgtattttgttattgtttgagtgccattctgctgcaccaggaaggaaagaaagctaatgaaacctggtaaaaccccaggtacaatgacatgcaccctgtgggcatgcaatcaatagttcttatggtgatgatgatgtttttctctggcagaaaagggtattttgggtcaaaaaataacccaaaagttgtgacagaggtaacggaaaaatagaagtcagattaaaatcaaaggaagaaattctaacccaaaagttgtgacagaggtaacggaaaaatagaagtcagattaaaatcaaaggaagaaattctatcaggagactaataatgaagctgacaatatactgtaacaagtaatagtgttttaccatactgcataaaaatattggattaagatacaaattaaatctctttctcagtgagggttttctgcagaacataaacaattaagctgctttctggagaagacaggaaacttgattaacagatccaaaaagacagcatagggaagatgggtttaacactaggaggtgaaacaccaactgttatccaaattgacttttccagaaacgttggataatttcaatcaaggactgaaatatactcttttctttttaagcgtcagtgttctctggacttaaacaagtcaaaggaggttcttattaaataaatgctactggtgcatatgttccagtcacagtctcctgaggtgagtatggagacactacagaaaattgaaccatgaaatagggttttgtgtctctataccaaaatttcaaatatctggaggtgtcctagctcatggtggctaagcaggcagcttgtgggagtacaggaggctacaggagacgccaggagtaaaacgacctattctgagtcctgtagtctctgtaaggtgcctatttgatgcaatctaagacagtcttatttagaatagggacccttagaagctgctaatataagtcaaagaaacaaatacttctgtgcatttttccccacaaataagggattgtcctaaacctctaagcattaaaccaggaatccagtaaaaaccaggcttattgtactccaatccccaactcacgtactgtcttagagattttcagacacaaggtgctaaaagttatatagcatattttaaaatttatctgttatcaagtgcctttcattgaacaaaaaaaaaatcaaattcaatagtacataaacaagatctttctgctccttcttggaagatttttaggagaattaaagtcatagagacaatcatctacatgccattaatattgtcatcttcacatattattaccagtattattaccagcacagctttcaaggtttgaaattttgcattgggctggccttaacatttggacaaatcctttttaaatatagggaataaataataaatttaaaaataaaatacgttaatatgcaattttttttttttgagactgagtctcacactgtcacctgggctggtgtgcagtggcaccatcttgacttactgcaacctccgcctcccaggttcaagcaattctcttgcctcagcctcccaagtagctggattgcaggtgcctgccaccacgcccggctaattttttgtattttttagtagagatggggtttcaccatgttggccaggctagtcttgaacccctgaccttgtgattctcctgcctcggactcccaaagtgctagaattacaggcgtgagacactgtgaccagccaatatgcaaaattttaacgctttaaattagaggtcagcaaacttttttcattaacagagagtaaaatatgttctgctttccattccatacactctcacacaactaatcaactctgctgttgcagtacaaaagcagccatagacaatacaaaaacaaataggggtggctgtgttccgataaaattttctttacaggcctctgcctctgcctctgcctctgcctctgcctctccctctcccctctcccctctcccctctcccctctcccctctcccctctccctctcggtctccctctccctctctttccacggtctccctctgatgccgagccgaagctggactgtactgctgccatctcggctcactgcagcctccctgcctgattctcctgcctcagcctgccgagtgcctgcgattgcgggcgcgcgccaccacgcctgactggttttcgtacttttttggtggagacggggtttcgctgtgttggccgggctggtctccagctcctagccgtgggtggtccgccagccttggcctcccagggtgccgggattgcagacggagtctggttcgctcggtgctcggtggtgcccaggctggagtgcagtggcgtggtctcggctcgctgcagcctccatctcccggccgcctgccttggccgcccagagtgccgagattgcagcctctgcccggcctccaccccgtctgggaggtggggagcgtctctgcctggccgcccatcgtctgggacgtggggagcccctctgcctggctgcccagtctggagggtggggagcatctctgcccggccgccatcccgtctgggaggtggggagcgcctcttcccggcagccatcccatctgggaggtggggagcgtctctgcccggccgcccatcgtctgagatgtggggagcgcctctgccccgccgccccgtctgggatgtgaggagcgcctctgcccggctgcgaccccgtctgggaggtggggagcgtctctgcccagccgccccgtctgagaggtgaggggaccctccgcccggcagccgccccgtctgagaggtgaggagtccctctgcccggcagccaccccgtctgggaagtgaggagtgtctccgcccggcagccgccccgtccaggagggaggtggggggtcagccccccgcccagccagccgccccatccgggagggaggtgggggggtcagccccacgtccgggagggaggtggggggggtcagccccccgcccggccagccgccccgtctgggagggaggtggggtcagccccccgcccggccagccgccccgtccgggaggtgaggggcgcctctgcccagccgcccctactgggaagtgaggagcccctctgccgggccagccaccccgtccgggagggaggtggggggctcagccccccgcccggccagccgaccagtccgggagggaagtggggggatcagcaccccgcccggccagccgccccgtccgggagggaggtgggggggtcagccccccgcccggccagccgccccgtccgggaggtgaggggcgcctctgcccggccacccctactaggaagtgaggagcccctctgcccagccaccacctcgtctgggaggtgtacccaacagctcattgagaacgggccgggatgacaatggcggctttgtggaatagaaaggggggaaaggtggggaaaagattgagaaatcggatggttgccgtgtctgtgtagaaagaagtagacatgggagacttttcattttgttctgtactaagataaattcttctgccttgggatcctgttgatcggtgaccttacccccaaccctgtgctctctgaaacatgtgctgtgtccactcagggttaaatggattaagggcggtgcaagatgtgctttgttaaacagatgcttgaaggcagcatgctcgttaagaatcatcaccactccctaatctcaagtacccagggacacaaacactgcggaaggccgcagggtcctctgcctaggaaaaccagagacctttgttcacttgtttatctgccaaccttccctccactattgtcctatgaccctgccaaatccccctctgcgagaaacacccaagaatgatcaataaaaaaaataaaaattaaaaaaaaaaagttaaaaaaaaaaaattttctttacaataacagcataaaactttggcttcaggtcacagtttgttgacccctacttcatattatcatgtcccccccacccccatttctttcattcaccttctatcacagagtcacagctttgcactcacagtgtagccaagttgtagctacagaccaaacattgtaaagaaatacctccggggaacttgagaataagttaaaacttgtgctaaatcatgagtgaaatatacattgggaaacacagttaacaacccattccccaacctgcttactgggccatctttctaaaaatgcaaatttgatcctgcagctccctagcttaaaaggcttcacctgcaacagaaagccctggctttttagtttttcaccataggcttatttatggctggtcctgctttcttcccctccttatttcttctcatcccttccttctcacattctatgcttcagctacatagaaggacttataatttccagaatgatacctgctcccttgcctttcaacccatacacttatttttttttttcttcttagatggagtttcactcctgtcgcccaggctggagtgcaatggtgcgatctcggctcaccacaacctccatctcccatgttcaagcaattgtccttcctcagcctcctgagtagctgggattacaggtacccgccaccacacctggctaatttttgtagttttagtagagaaggggtctcactatgttggccaggctggtctcgaactcctgatcttagggaatctgcctgccttggcctcccaaagtgctgggattacacgtgtgagccaccatgcccagccaacccatacacttgttactcattctccttgaagcactcttctccacacatccttggccttgccaactccttgaaggctgagcttaggtgtcttaaggacttcaactcccagacacttctgtatacctgcgttataatatttttactgctggctgtgtgtggttgctcacacccgtaatcccagcacttcgggaggccaaggcaagaggattgcttgaagccaggcattcaagacagcctgggcaacatagtgagaccccatctctaccaaaaaattagaacttagctgggcatgtggtacatgcctgtactgccagctacttgggaggctaacatggtagaatcgcttgaacccaggatgtcaaggctgcagtgactcgtgattgcaccactgcactccagcctgggtgacagagcaagatcttgtctaataataataataataatattcttaccactatctacagatgattactggtgcagataaatttaaaattcttcttggccatgtgtggtggctcacacctgtaatctcagcactttgggaggccgaggtgggcggattgcttgagctcaggagttcaagactagcctgggcaacatgattaaaccctgtctctaccaaaaatacaaaaacttagccgggcatggtggcacatgtctgtggtctcagctacctgagaggctgaagtaggagtattgcttgagccctgggtggtagtggggagactggaggttatagtgagctgagattgtactactgcactcctgactccagcctgggtgacagagtgagatttcatctcaaaaaatatataaaaaataaaaaatttaaaatccttgaaagctgaaactgcattttcttgtaagcacatgatatccctcttagggtcctgctcccccatcccctgagcatgggaataaagaaaaaatcttgactccctttaggggaaaattccaggcaccccactatccttgagaaataaataaataacccactaatcaataaggtaataataagcttaaacaatagccacccaagtaatctagagtcataaaatgtttggttccctataaaaactaaagataacatcttgacatatttccctgagttgtttttcagaaacctgtacccccacaagatggaaaatgctgaccactgtcacacagacctcaaataagggagagctaaggactgaactctaatcgttgtcccttgttctaaatgtcttcatgaggggcctggagagggtcatcatgcccatagatcaaaccttaacattcctttcttctgaccccaagtttttagacaaagcattgcttccctaaccaattgtaaatcaaataatctgtgaacctctctatgacttgtaagcccccacttccagatattctgccttttgaggcaaaaccaatgtgtaacctccatgtattgaattacatatgattttgcctgtaacttctgctttcctgaaatgtaccccttcctttaaagacccttgcttgtaagccgtgggagagtttgggtcttaagtgttagctgcccaattctccttgcttaatgccatgccataaatgcctcactttctctcactgcaaatcttggtgtcaatgtttgcctttgctgcaccaggtgggctgaccaaagttgggttggataacacatggtatctggtacattgagaataatccctaatgcttattaaatgaagccatcaattatttaatgtctttaataagcttttggcctttctacttcagaatataactttagttattcccagctatgggcaatttattttcttttgcatattgtctataaatgatacccaaagaactaataggaaaaaaaattattagtcagttaaacaggtaatttaatatcaaaccatagaggaggaaaaataattgtctctctacccttcagagttcgtagctgagactctgaaggttaacaggagaaaaataaataaaagatgaataacgtgtgtacctccagtatacatggaaggcatactcagcgaaatctgaaagagtaaaatctccaggctaaatctcaagagatctcaaaagggttgtttaaacttcaggcttataccatcctttgttgaaacaaaaagagaagtttattgggaaaggctgattatgggagataggaagagtacagtatacaagaacagtttgttatgcaaacttaagtcagtcccttctccattgattaagagtatcttggatttagtcattctcttcctggtactaagagagagagagacacccttacaaataacgattttctttatagacataaatttctcttacaaaagggtaccttctactctagttttcagagcttctcctgtgtctgctgtttcccaaaataattcaattcaaaaaattctatgtcaaagaggcttatttggggtggtgtattctggtcttttacagtcacactttgagatgacgtgttctgaacgccatcaatataaaaatcttcttaacttgatttaaaatttttttcaggttgaaattagacatatagctttatgttgtcattattgttttgtttctttagagtgttaacttaaaaggaagaagctgaggaaaattaatatatgtagagagtttctttgggccaagcttgcagattgcaacacaggagcacagattgaagttgccctgaatataattcaacaagcagtagttacaagtgaaaaaaagtagttaaaggcaaaaaggggagacacagagtgggctgatacaaagttgcttgtcaggaattctcattgtttcatggaaatgacgtggagtagtgattggctatacatttttggctatagtgtgtgggttatagtgtctggtgtggcattattagcttaatttatagctacttgtagcaatagcaagcagtttcaagagattaatatatagctcaaagtgggaaataggacattattgcagtctcattttaatgtctctttgggcctggtaagtactgtcttcttttttttctttttttttttttttcttttttgagacagggtctcactctgtcacccagactggagtgcaatggcaccatctcggctcactgcaacctctacctcccagcctcccaagtagctgggactataggcatgcactaccataccgtgctaaatttttgtatttttttgtagagatgaggtttccccatgttgctcaggctggccttgaactcctgagctcaagcgatctgcctgcctcagcctcccaaagtgctgggattacaggcatgggccatcgcaccaggccaggacctgataattaaaaggcctcagataaaagttcttttctcaagagacaatcttaggaccacttgctgcattatctatcagtattaataaagccactttacatttaccctataagtggaaatattttctcaactaat

SEQ ID NO: 860 - DNA, 14432 bp, Homo sapiens
aattgaccacttgaacacaattctttccctcttatttccaaattctattcctgtgtagcaggaatagaagaaaaagccagcatcattgagggttaatgaatttggcctataagggctaataaatatctacaaacaaactttggaaagagtcattaacaggactttgatttcccatttgccttagtagcaaatttagcagcactttttaaactgcctcatggatgactatctccattagtttttttttttaataagaaaacagtaaacactatgcatggtagtgttgtatcctcagtgcttctaatataatttcttcatatttctagtattacatttatctcactgcattctaattattgttctgtctcccctgctagactgggagcttcttaaaggtaatgcaccatttttattcatatttgtatttcaattacttgacacaatattcagcacttaagcaatttatgtaataactactggatggattgtaataacaataatagttaaggatgcagatctagagctagtttagttgggataaatcctggctttactgcttatttgttttgtgaccttgtgaaattactaaacctctctgtgccccagttttttcatcacaatgtgaaataataataagacctttgtcttggtcaatttgggctgttctaacaaaaatattatgtaccgactggcttaaacaacaaacatctgtttttcgtagttctgtggctgggaagtccaagatcaaggtgccagcatattcagtatatagtgagggctctttttctggttagcagacagcctccttctttctgtatcctcatatggctgagagaaagaaaggtcatctctctggtgtctcttctcataagggcactaatcccgtagtgaaagctccaccctcatgacctaattaccttccagaggatccatcttcaaatatcatcacattaaaattagggttttagcatttgaattttgaggacatacaaacattcagtccatagcaaacctcctcaaacaattgttgtgataattaaataaattaatctatttaaagcacttagaagattgctagacatacagtaagtgctcaatacacacatatatgttattgaattattaaatagaataatgcctctagcattcattactgctgttcaattttgtcttcattgttattttattttatgtcttcctgtgtaattcccttgtggcaatttcataattgctatagctttttttgtttgaccctccacatctcatgttcaaatttgatccccattgttggaggtagggcctaatgaaagctgtttgggtcatgggggtggatccctcacaaatatcttggtaccgtcctctggtaatgagtgagttttaactctattagctcccatgagagctggttgttaaaaagagcctggcacctccccctgcattctctcttgcttcctctctcaccatatgatctctacacatgccagctcccctttgccttccaccatgagtggaggcagcttgaagccttcatcagaaacagatgctggagccatgctttctatacagcctgaagaaccatgagccagtttatttataaattacccagcctcaggtattcctttatagcaacataaatgaactaagacaataatctacaaattcatttacttgattactggcaaattactcccatgagagtgagaacgttttctgtgaagttctctacccattccatgcataacacagcatctacacacagcagagattagtaacagtttgttaaaggagtaaattgatccacttttaccttctgtaaagaccaatttaaatctttcttatattgctaacactgaacctcctggttcaaagttaaaaaaaagataaggcgcagtaacaacagagtttcaggaagatctgggaaagaaagatttcctattattttttatttatttatttatttttgagacagattctcactctgttgcccaggctacagtgcagtggcataatctcggctcactgcaacctctgcctcccggattcaagcgattcttccacctcagcctctcgagtagctgggactacaggcacgtgccaccacacctggctaatttttgtattttttagtagagacggggtttcaccatatcggacaggctggtctcctgaccttattatccacccacctcagcctcccaaagtgctgggattactgacgtgaccccctgcacctggcctatttcctattaattctaggactaactacctgaaaataggataataccttgcatcactacattaatatactcatttttattgtcccctgtttctgagagtaacaacttcaaatctcctaccttctttcctgactttgacttcctataccgtcagctcttcagggcagtcttgacattggaataataataataacatcatgttcttagacaaagactgatccactctcagaaatcaggttaaaggttattttatgtgattcttttttgttttaatatgatttataaagagggagagtcaatgttgaagaatcagctattttaaaattgatccctctactggagtactaaaaagtatttgtgaaatgaacacgaataatctttataacattaaacattgcaaaacccaaatgcaaaatagtcctatttaacataaagtctttcatattgttctgttctgccatccttctatacatttgcccagacaggacagcaacaaggaaagaatatgtaaacactaatcatttctaacttgccatctgtgacagttcactgtgctgaaattagaaaggatggaatcacttttccatttccttaaggtcaccaaggacagacaagctcaggacatactgtatttgtcagaagaaaaagagatgactggtgaggtggcagtgacaaatctgttctaggttcagctcattttactgaagaatgtgtgtccccttctgacatttatcaaaagaaattcaattttataaaaagaaggatgtcaaataatagtacattgctaacactcattttgttgctgtcagaagggcagatgggggcaaaaagggaaaagggtggatggaagagaaagttattccagcaagaaacaaacaaagtcatgctaataatacacttataggcttgaatatatttctgattaaaacacctatttttgagatccatcttagtgcctggctcacactttagaataccagttttcacttcttccagacagaaggaacgacacaaagcaggttgatttgtgggttttgtgtttgtttttggttttgtattttgttattgtttgagtgccattctgctgcaccaggaaggaaagaaagctaatgaaacctggtaaaaccccaggtacaatgacatgcaccctgtgggcatgcaatcaatagttcttatggtgatgatgatgtttttctctggcagaaaagggtattttgggtcaaaaaataacccaaaagttgtgacagaggtaacggaaaaatagaagtcagattaaaatcaaaggaagaaattctaacccaaaagttgtgacagaggtaacggaaaaatagaagtcagattaaaatcaaaggaagaaattctatcaggagactaataatgaagctgacaatatactgtaacaagtaatagtgttttaccatactgcataaaaatattggattaagatacaaattaaatctctttctcagtgagggttttctgcagaacataaacaattaagctgctttctggagaagacaggaaacttgattaacagatccaaaaagacagcatagggaagatgggtttaacactaggaggtgaaacaccaactgttatccaaattgacttttccagaaacgttggataatttcaatcaaggactgaaatatactcttttctttttaagcgtcagtgttctctggacttaaacaagtcaaaggaggttcttattaaataaatgctactggtgcatatgttccagtcacagtctcctgaggtgagtatggagacactacagaaaattgaaccatgaaatagggttttgtgtctctataccaaaatttcaaatatctggaggtgtcctagctcatggtggctaagcaggcagcttgtgggagtacaggaggctacaggagacgccaggagtaaaacgacctattctgagtcctgtagtctctgtaaggtgcctatttgatgcaatctaagacagtcttatttagaatagggacccttagaagctgctaatataagtcaaagaaacaaatacttctgtgcatttttccccacaaataagggattgtcctaaacctctaagcattaaaccaggaatccagtaaaaaccaggcttattgtactccaatccccaactcacgtactgtcttagagattttcagacacaaggtgctaaaagttatatagcatattttaaaatttatctgttatcaagtgcctttcattgaacaaaaaaaaaatcaaattcaatagtacataaacaagatctttctgctccttcttggaagatttttaggagaattaaagtcatagagacaatcatctacatgccattaatattgtcatcttcacatattattaccagtattattaccagcacagctttcaaggtttgaaattttgcattgggctggccttaacatttggacaaatcctttttaaatatagggaataaataataaatttaaaaataaaatacgttaatatgcaattttttttttttgagactgagtctcacactgtcacctgggctggtgtgcagtggcaccatcttgacttactgcaacctccgcctcccaggttcaagcaattctcttgcctcagcctcccaagtagctggattgcaggtgcctgccaccacgcccggctaattttttgtattttttagtagagatggggtttcaccatgttggccaggctagtcttgaacccctgaccttgtgattctcctgcctcggactcccaaagtgctagaattacaggcgtgagacactgtgaccagccaatatgcaaaattttaacgctttaaattagaggtcagcaaacttttttcattaacagagagtaaaatatgttctgctttccattccatacactctcacacaactaatcaactctgctgttgcagtacaaaagcagccatagacaatacaaaaacaaataggggtggctgtgttccgataaaattttctttacaggcctctgcctctgcctctgcctctgcctctgcctctccctctcccctctcccctctcccctctcccctctcccctctcccctctccctctcggtctccctctccctctctttccacggtctccctctgatgccgagccgaagctggactgtactgctgccatctcggctcactgcagcctccctgcctgattctcctgcctcagcctgccgagtgcctgcgattgcgggcgcgcgccaccacgcctgactggttttcgtacttttttggtggagacggggtttcgctgtgttggccgggctggtctccagctcctagccgtgggtggtccgccagccttggcctcccagggtgccgggattgcagacggagtctggttcgctcggtgctcggtggtgcccaggctggagtgcagtggcgtggtctcggctcgctgcagcctccatctcccggccgcctgccttggccgcccagagtgccgagattgcagcctctgcccggcctccaccccgtctgggaggtggggagcgtctctgcctggccgcccatcgtctgggacgtggggagcccctctgcctggctgcccagtctggagggtggggagcatctctgcccggccgccatcccgtctgggaggtggggagcgcctcttcccggcagccatcccatctgggaggtggggagcgtctctgcccggccgcccatcgtctgagatgtggggagcgcctctgccccgccgccccgtctgggatgtgaggagcgcctctgcccggctgcgaccccgtctgggaggtggggagcgtctctgcccagccgccccgtctgagaggtgaggggaccctccgcccggcagccgccccgtctgagaggtgaggagtccctctgcccggcagccaccccgtctgggaagtgaggagtgtctccgcccggcagccgccccgtccaggagggaggtggggggtcagccccccgcccagccagccgccccatccgggagggaggtgggggggtcagccccacgtccgggagggaggtggggggggtcagccccccgcccggccagccgccccgtctgggagggaggtggggtcagccccccgcccggccagccgccccgtccgggaggtgaggggcgcctctgcccagccgcccctactgggaagtgaggagcccctctgccgggccagccaccccgtccgggagggaggtggggggctcagccccccgcccggccagccgaccagtccgggagggaagtggggggatcagcaccccgcccggccagccgccccgtccgggagggaggtgggggggtcagccccccgcccggccagccgccccgtccgggaggtgaggggcgcctctgcccggccacccctactaggaagtgaggagcccctctgcccagccaccacctcgtctgggaggtgtacccaacagctcattgagaacgggccgggatgacaatggcggctttgtggaatagaaaggggggaaaggtggggaaaagattgagaaatcggatggttgccgtgtctgtgtagaaagaagtagacatgggagacttttcattttgttctgtactaagataaattcttctgccttgggatcctgttgatcggtgaccttacccccaaccctgtgctctctgaaacatgtgctgtgtccactcagggttaaatggattaagggcggtgcaagatgtgctttgttaaacagatgcttgaaggcagcatgctcgttaagaatcatcaccactccctaatctcaagtacccagggacacaaacactgcggaaggccgcagggtcctctgcctaggaaaaccagagacctttgttcacttgtttatctgccaaccttccctccactattgtcctatgaccctgccaaatccccctctgcgagaaacacccaagaatgatcaataaaaaaaataaaaattaaaaaaaaaaagttaaaaaaaaaaaattttctttacaataacagcataaaactttggcttcaggtcacagtttgttgacccctacttcatattatcatgtcccccccacccccatttctttcattcaccttctatcacagagtcacagctttgcactcacagtgtagccaagttgtagctacagaccaaacattgtaaagaaatacctccggggaacttgagaataagttaaaacttgtgctaaatcatgagtgaaatatacattgggaaacacagttaacaacccattccccaacctgcttactgggccatctttctaaaaatgcaaatttgatcctgcagctccctagcttaaaaggcttcacctgcaacagaaagccctggctttttagtttttcaccataggcttatttatggctggtcctgctttcttcccctccttatttcttctcatcccttccttctcacattctatgcttcagctacatagaaggacttataatttccagaatgatacctgctcccttgcctttcaacccatacacttatttttttttttcttcttagatggagtttcactcctgtcgcccaggctggagtgcaatggtgcgatctcggctcaccacaacctccatctcccatgttcaagcaattgtccttcctcagcctcctgagtagctgggattacaggtacccgccaccacacctggctaatttttgtagttttagtagagaaggggtctcactatgttggccaggctggtctcgaactcctgatcttagggaatctgcctgccttggcctcccaaagtgctgggattacacgtgtgagccaccatgcccagccaacccatacacttgttactcattctccttgaagcactcttctccacacatccttggccttgccaactccttgaaggctgagcttaggtgtcttaaggacttcaactcccagacacttctgtatacctgcgttataatatttttactgctggctgtgtgtggttgctcacacccgtaatcccagcacttcgggaggccaaggcaagaggattgcttgaagccaggcattcaagacagcctgggcaacatagtgagaccccatctctaccaaaaaattagaacttagctgggcatgtggtacatgcctgtactgccagctacttgggaggctaacatggtagaatcgcttgaacccaggatgtcaaggctgcagtgactcgtgattgcaccactgcactccagcctgggtgacagagcaagatcttgtctaataataataataataatattcttaccactatctacagatgattactggtgcagataaatttaaaattcttcttggccatgtgtggtggctcacacctgtaatctcagcactttgggaggccgaggtgggcggattgcttgagctcaggagttcaagactagcctgggcaacatgattaaaccctgtctctaccaaaaatacaaaaacttagccgggcatggtggcacatgtctgtggtctcagctacctgagaggctgaagtaggagtattgcttgagccctgggtggtagtggggagactggaggttatagtgagctgagattgtactactgcactcctgactccagcctgggtgacagagtgagatttcatctcaaaaaatatataaaaaataaaaaatttaaaatccttgaaagctgaaactgcattttcttgtaagcacatgatatccctcttagggtcctgctcccccatcccctgagcatgggaataaagaaaaaatcttgactccctttaggggaaaattccaggcaccccactatccttgagaaataaataaataacccactaatcaataaggtaataataagcttaaacaatagccacccaagtaatctagagtcataaaatgtttggttccctataaaaactaaagataacatcttgacatatttccctgagttgtttttcagaaacctgtacccccacaagatggaaaatgctgaccactgtcacacagacctcaaataagggagagctaaggactgaactctaatcgttgtcccttgttctaaatgtcttcatgaggggcctggagagggtcatcatgcccatagatcaaaccttaacattcctttcttctgaccccaagtttttagacaaagcattgcttccctaaccaattgtaaatcaaataatctgtgaacctctctatgacttgtaagcccccacttccagatattctgccttttgaggcaaaaccaatgtgtaacctccatgtattgaattacatatgattttgcctgtaacttctgctttcctgaaatgtaccccttcctttaaagacccttgcttgtaagccgtgggagagtttgggtcttaagtgttagctgcccaattctccttgcttaatgccatgccataaatgcctcactttctctcactgcaaatcttggtgtcaatgtttgcctttgctgcaccaggtgggctgaccaaagttgggttggataacacatggtatctggtacattgagaataatccctaatgcttattaaatgaagccatcaattatttaatgtctttaataagcttttggcctttctacttcagaatataactttagttattcccagctatgggcaatttattttcttttgcatattgtctataaatgatacccaaagaactaataggaaaaaaaattattagtcagttaaacaggtaatttaatatcaaaccatagaggaggaaaaataattgtctctctacccttcagagttcgtagctgagactctgaaggttaacaggagaaaaataaataaaagatgaataacgtgtgtacctccagtatacatggaaggcatactcagcgaaatctgaaagagtaaaatctccaggctaaatctcaagagatctcaaaagggttgtttaaacttcaggcttataccatcctttgttgaaacaaaaagagaagtttattgggaaaggctgattatgggagataggaagagtacagtatacaagaacagtttgttatgcaaacttaagtcagtcccttctccattgattaagagtatcttggatttagtcattctcttcctggtactaagagagagagagacacccttacaaataacgattttctttatagacataaatttctcttacaaaagggtaccttctactctagttttcagagcttctcctgtgtctgctgtttcccaaaataattcaattcaaaaaattctatgtcaaagaggcttatttggggtggtgtattctggtcttttacagtcacactttgagatgacgtgttctgaacgccatcaatataaaaatcttcttaacttgatttaaaatttttttcaggttgaaattagacatatagctttatgttgtcattattgttttgtttctttagagtgttaacttaaaaggaagaagctgaggaaaattaatatatgtagagagtttctttgggccaagcttgcagattgcaacacaggagcacagattgaagttgccctgaatataattcaacaagcagtagttacaagtgaaaaaaagtagttaaaggcaaaaaggggagacacagagtgggctgatacaaagttgcttgtcaggaattctcattgtttcatggaaatgacgtggagtagtgattggctatacatttttggctatagtgtgtgggttatagtgtctggtgtggcattattagcttaatttatagctacttgtagcaatagcaagcagtttcaagagattaatatatagctcaaagtgggaaataggacattattgcagtctcattttaatgtctctttgggcctggtaagtactgtcttcttttttttctttttttttttttttcttttttgagacagggtctcactctgtcacccagactggagtgcaatggcaccatctcggctcactgcaacctctacctcccagcctcccaagtagctgggactataggcatgcactaccataccgtgctaaatttttgtatttttttgtagagatgaggtttccccatgttgctcaggctggccttgaactcctgagctcaagcgatctgcctgcctcagcctcccaaagtgctgggattacaggcatgggccatcgcaccaggccaggacctgataattaaaaggcctcagataaaagttcttttctcaagagacaatcttaggaccacttgctgcattatctatcagtattaataaagccactttacatttaccctataagtggaaatattttctcaactaatcacttaacagccaggttttatttgagaagcaattaaacatttatggggtctacagaagatatgaacaaatgctatataaagacatccctaataacagactataggaaaaaaattgtgctttaatgcattatccacatacagcatgtcactctgggttactagattttagcctttcatgatctttgcattttattgcatatttattttatgactctttgcaagttaaaagtgacaaagaccctccccttaggctcctttgaatcttctttttgactaactctcactcttggtctcatccttgccccacctagtctagttttagcaagaatcctcttgaatcaatatggcaaaaatcccctgcccttggcatgtgatcactattgatgactgattaggttcctcttacttcatcctctatatcttttcacagtgggctgccttcagcaagaatcctaagtcagtgtagccataatccccatagtcttgatgtttcctcttagtaattttctatcctctgatctccgccctttaccttggccataaatccccactttttcttgttgtattaagaatgggatttcattctatgctgagatctctttttccctattgcaataattcctgaataaaatttgcttttatcactttaactttctgtctggctgtggtttgctttgacaatagacatgcatattctgtcttacagagtggagttcaatcgacttcccatctcctatgggggaaaaaaaccagttttgcctctatttgtaattccatttctttactccatagaaatgtgtgactttggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaagaaatgtgtgcctttgaattttcctttcaaccaattataatatctacccgccttccttactgaatgagtaaaataaacattttaacacatgcttatttgtatgcccacatgacagtcatgatcttaccttttcttttttctttttttttttttttttttttgagacggagtctcgctctgtcgcccaggctggactgcagtggcgcaatctcagctcactgcaagctccgcctcccgggttcacgccattctcctgcctcagcctcccgagtagctgggactacaggcgcccgccaccacgcccagctaattttttgtatttttttagtagagacagggtttcaccgttttagccaggatggtctcgatctcctgacctcgtgatccgcccgcctcggcctcccaaagtgctgggattacaggcgtgagccaccgcgcccggctgatcttaccttttctagaaaattatcttttaacaattttggaagttccactgaaatgcccagtggatttacctaccaaagccaggtaacctttgcaggcagagaaatgcacttcatgggcagtgtaagcccaggtagatcttttcttggctcacagaattgaatccaagatggcaagaaaaccttgctcactctgtttttctcattctaattctcctctatactaattttacatttttggttttgggttgtttactgtcagtaagttagtccccgttgcaggaagtaatggttgggaattcacttttatgatctgattatttgatgatctctgtaaatgaattaatagttaacagagatctctgctaggtgagagatagcagagaatctagtgggttagtcttttctgtttatctgttttctattttgaactcttgcagaaaccaaattaatgttttaagaaatcaagttcagctgggtgcagtggctcacgcctgtaatgccagcactttgggaggccgagatgggagtatcgcctgaggtcaggaatttgagaccatcctggccaacatggtgaaaccccgtctctactaaaaatacaaaaaaaaaaaaaaaaaaaaatagccgggcatggtggcatgtgcctgtaatcccagctactggggaggctgatgcaggagaatagcttgaacctgggaggcagcggttgcaacgagtggagattgggccactgtactccagcctgggcgacaagaacgaaactctgtttcaaaaaaaaagaaaagaattcaagttcacataatttagataaatttttggcaaatgatacaagcttaatattattggtttaacaaaaaatacctatgtcttctttgatttactagagaatgagaataatataatgtaggtgcttatgctacttgggtatgtttttcctaatcttaaacaggttaatagattgaataagcttgccttacttctacttcatgtttaagatgtttataaatataaatttatatttactcatactgaatcattattgtgataaactttatttcaacaataattatgttttgtgtatgtcagcttcaggacaattttcaaggtctgtaagtaacttaaaaccttggaccaatggtaagttgagttaattaatggagaatcattagatagacagacagtatttcaagatagtaagatagaatactcattactactcataatttcaagtttatatccctttacttcttattttcataagactatctctttgggtctgtactgaatgtgctgctcatttctgccactttggggagtgtataaaaatgatatgtgtggctaaggcaagctgtattgtgtgtattcacaagttctgctagtctgctgcaaaatgctggtgtgacagtgaacaattatccactctccaggtctctctgtgaaatagaag

SEQ ID NO: 861 - DNA, 308002 bp, Homo sapiens
cggaaagtttcaaaaacacccccatgagaatctttgcagtgaacttgaccccctcctcaggggctggctcacttccaccacataccacagaagcaagaagagaataaagtacactagaaccagaaagagaagccccttcctcctgttcccctgcaggaagattccgagtgaatttcaatgtcacctctgcaggcaatttcccagcaagtctcaaaaagacccagagggtagcttcctgaatcaacaaactagggtgcatccatgtaatcaaatattagtgagtgatttaaaaaatcataacctataaagccatggaaagacatgaaagagtcttagccagcatactgctgaaagaagccagtatgaaaaagctacatattgtatgatcccaattaaatgacattctaaaaaagacaaaattgtataaacagtaaaaagaacagtagtaggagtaatgggcaggaggaagatagagatgaataggtaggagcatgggatttttagggaagtgaaactattctgtatgatatcacaatgatggaagcatgacatgcatttgtcaaaatccatagagctgtacaacacaaagaatgaaccctaatgtatagactttagttaataatattgtatcaatattggttcatcagttttaacaaatgtacattaatgtaagactatcataataggtgaaactgtgtacagggaaaaagggattatatgagagctctctacaaaaatataaaactgcactaaaaaatacagtctattaatttttaaaaaaacacattttcaaattttcccatagcttcctgtagtgggcagaattctaaggtggcatcccagattcctgcccactggtgcacacactctgaagattcccttccccttgggggtgggtagggctttaagtatgatagttttcactcccagtatgatgttacattatatgacaagcatgaaaagattgtattaacgtaattaaagtcccaaagcagttgtcttcgagtttgtcaaaacagagatgattctgggagtccttaaaagggagtgggtcctccttgaaggataagcctcaaagcttgagagagcttttcctgttggtcttaaagaagggggcctgtataggagccatgtagcaaggacttacaggaggggacctctagagaccgagagcagtctccagacaagagctagcaagaaaatgtggacttcagtcacacaatccccaaaaactggattatgccaacaaccacatgaacatgaaaaaggatcctatgagatcccagatgagattatagcccaggggagaccttgactttagtatataagaacttgagcacaaaattcagctatgcccagacttttgccctacaaaaagtctgagataattaatttatatttttacaagccactaagtttgtggcttattaaacagcaatagaaaactaatacagtctgttaccttcaggttgacaaatcaccaacgtcaacaaaataggctaaaagaagacattttggaattttgtacattttgacaattgaagtgaatttcatagtcataaaaatttacttattttgcatatagttggcatttgatattttgaaaagccaaattataactagtatatatgacacaaccacagcctatagaaaaaaattacacacctgagaataaaatgcaacaacaaatctatcaggaagtaatttaggaataaaattctcaatttcaaagaaatttcacataacaacttaaaattctacttaggattttacaaattgctaccaagtgataattaaatgtttttaatttttaaacatatacaggttttaaacaacaacaacaacaaaaaaacagaaaaaaaattttgaaacctgcaaataaaacatatcatgagtcctaaatttctgaaaagagatttgcataattttccttaattgtacactttaaaatggttcataatattatgtgaacttcatctcagttttaaaaagttaatctgagcattctaaatattaattataattattacatgtagatctacggagaacatctattcccagtttttgtcaacacccaactacgcaaataaaatcaacagcacataaacagaaaatcatcagctatcccattaaagtacatattgaaactttatatacgatgcttgaaaggtcacctgttcactgcattaaaaatttcttccccgtgctaggcatacaatgaataaaatatgcagtctttcagaaaactgtatgtaatgatatgtcatagcagttcacacaattgtactaaacaatatgcatgctttctgtttttctatcaattaaatattcaggaattactgtcaaatgccatgtcatagcatgacagagatttagcccagattttgaaatctggtttgaaccactagaattagcaaactaagcagcaacataaaatattaagcatgtcaaccaaataatccactttccctctgtctttggagatgccttattaaatttcctaagagaaaaataaaagtacttcatgtaaaaagttttaacccctgctttgaaaacacatattttagcccatcatataaggttttttaatatgattggttctaataatcatatttttaaaatcccaaccagaagaagcactttaaaagtattttttcagtttaatatgcacaggtctgccagcataatatttgtccataattaagaaaattgcttacttgctcagtaggcaatacatgaatcatatgtagtataaaattagaccacaattgagagtttaatccctaaacaacatccaaagttaagcagaatatggtatgatacataatacctttaatataattaaatgagccttaattttacataaatatattaataaattagatatatactatccaatacagtaaccataaactacatgtatctatttaaactgaaaataatttaaagtacataaaattaaagattcactttcttagttgcactcaccacatctcaagtattcaacaaactaccatattaggtagcacagatatagaagatttctatcattgaagaaacagtacttatttgacagagttgagtttaccataaaactcatcataaagcttaagcttcaggcctcctcatttgaaaatgtccctgcaggtaccctagcaatgtgtccatgattatatattttagtaaaatttgtaaaagtaagatactttgccaatgaaatatctttctccacttcctcttcttctccaccaatctcctgttgtcgggtggagggcgtcacagtgagcaacctggggatcatgcaaagggtgatatattcagtttgggtgatacattcagaattggtagcacattgtttttagtgggatatatgtaagtggttcttggtcatttctatgtgtaattagtttaccatctgttccagtataggaatggcttctaggaatacatccctttcccaactgtgctaactcacatggggtcctgatatgaaggttcgtagtcagaggtctatgaagacccctcaatgtgtaacctctgtcacgaatgtgtcccatggcaacgagaactaaagatttgtggcaaatgggagagaagcagagactgaaatttatacagccagaagctactctgtggaaaattcttccaataaggagacatgaaatagaataagcagataattccatttgtaatcaatgcctagtcaagttttctcttattaggaatagagttgatagtgcatatacaattataaatgtagcagacatttcttttttctttttgatgggactcacaatgaaatagaacttttcagacactgcgtttgcaaagcccaaatctgcagctgttctataaatactatgtctgtgagtgaagctgcacagtttatacagctcaattatcaataataaaaacaaaatcttcctaaccatagtacaggaaagtccaatttatctttctaaatctataaaaaattatattataaagtcattgtcatctgagaggggctcaaacattatgtatcctatagatgtggaaaaggtagtttaaaagtgtgatcagcagctatttttccaaatattattatgataatgtcactgaccatcttttacgaaattgtaatcagttgtgatttcttttctcattctaaatacatattgacttgtatataaatttgcatctgtaattttgtattttttttaggagggctgcctccaaatggtctgcctcctttcaggtccccaataaaaccttgatctgaccctgatgctagaaaattatgtcttgattaaaatatatattcactaattagtaatctctatgtattcctttcttcatcctagatgtactgcaatatcaataacccagtcacatcattgtcactgaattctaggatttaaaagggtaaatttgaaatacgtcccttctgctcactctggacctaatctgatatcttttcagccttcggtacaaaaagctcacacctcactagcactaatacaaatgtcattcctagtaattaggttacactgagtgcctttgagctttgcagtgctactgccagtgaagttcttaatacatttacagtcatggttatttaaaccactaaggcttttctttgagtaaacaatatattgatcaaatcaaatgctagcctgacaataccaattaatttaagaaaataaaaaatacacaaaaatttctgttatctaattatattgaagagattgctcctaaaacaaacatttgtaaaaccacctttttgtactatgaaaattatatttgtacacatacaaatataaaaatgcccaatagctaaatgccacttatgcaaatagtccctaagttttctttgatttacagtttatttcatactctttatatttcattaagccatccttcaataaactattttttcaatattgtgttgcgaagatattctcagcctgaaattacatcaaataaattacaaatcaaatttctgaaagccactgccataggtggaaatcaaatcaaatgcctagcttcacataaatggttaaagctttaaataaattgcatttatataattgccttacttgctgctgcctcctacagctgtagaataatgttattccaatatatgaagaatatattggcagacaagactaaaaaattttgaattattaattaaaaatgggaagttttattaaatacattaaagaactgaatttagacttggaatacatatattcctgtagctctgtttctctgattaggccctgactgttacacttttactaaagattttttttaaaaggaagaaaaaatttcttacctaagaggatttggagctgtgaaaggaaatgggccccaaaatcactaagctaaagggaaaagtcgatctgggaactgcttaggacaaacctgtctcccgtgctattcaaagtcactcctctgctcactgaaataaatgtgtatctgattgcctcctttggagaggctaatcagaaactcaaaagaaggcaatcatttgtctcttatctacctatgacctggaagtcccctccctgctttgagttgtcctgcctttctggacagaaccaatgtttatcttacatatgtttattatgtctcatgtctccctaaaatgcatgaaaccaaactgtgttctgaccaccatgggcacatatcgtcaggaccaccggagaccttgtcacaggcacgtgtcctcagccttggcaaaataaactttctaaattaactgagacctgtctcagattttcagggttcacagaacaaaatgataatttactgcccttactcaaaaaatattgtcctattcatagaaaaagaaaatgataaggtggtttccagacactggaagtagtggagaagtgttacatagttattgcttaatggatacacggcttcagtttgagactatgaaaacattctggaaatggatagtgaggatggctgcacctgcaccacaataagaatgtatttaatgtcattgaactgtacacttaaagatggttaaaatggtacattacatgttatatatattctatcacaataaaaatgtttcaattgttctaattatatttacatttttatattcattttttctgagattcagcctgaattgaaaagtgcttcattataaataatagaaattaaatacttaagttggtcattcaaactcacaataaaatggagaaaagaaatcaagttttctaagttgtgactctgtgagcactttactaccacacaaattgagagatcacaaaagaaattccgaacttctctgaccaaggacagttgttttgaaacaaataaaaaaactatctgtacaataaaggtacaggtgaaactttcttttttttaaacttcaagttctagggtacatgtgcacaatgtttgcaggtttgatacataactatgcatgtgccatcttggtttgctgcatccatcaactcatcttttacattaggtatttctcctaacgctatccctcccccagccccccaccccccgatagtcccccgtgtgtgatgttccccgccctgtgtccaggcgatctcattgttcaattcccacctatgagtgagaacatgcggtgtctggttttctgtccttgtgataatttactgagaatgatggtttccagcttcagccacatccctgccaataacatgaaatcatccttttttatgactacatagtattccatggtgtataagtgccacattttcttaatccagtctatcaatgatggacatttgggttggttccaagtctttgctattgtgaatagtgctgcaataaacatacgtgtgcatgtgcctttatagtagcatgatttataatcctttgggtatatacccagtaatgggaccgctgggtcaaatggtaattctagttctagatccttgaggaatcaccacactgtcttccacaatggcagaactaatttacagtcccaccaacagtgtaaaagcattcctatttctccacatcctctccagcatctgttgttccctgagtttttaatgattgccattctaactggcatgagatggttatctcattgtggttttgatttgcatttctctgatgaccagtgatgatgaccattttttcatgtgtctgttggctgcatagatgtcttcttttgagaagtgtctgtttatatcctttgcccactttttgatggggttgtttgtttttttcttttttttttttttttttttgagacggagtctcgctctgtggcccaggtgggagtgcagtggcgcaatctcggctcactgcaagctccgcctcccgggttcacgccattctcctgcctcagcctcccgagtagctgggactacaggcgcccgccatcatgcccggctaatttttttttgtatttttagtagagacggggtttcaccgtgttagccaggatggtctcgatctcctgaccttgatccacccgcctcggcctcccaaagtgctgggattacaagcgtgagccaccgcgcccggcctgtttttttcttgtaaattggtttgagtactttgtagattctggatattagccctttgtcagacgggtagattgcaaaaattttctcccattctgtagattgcctgttcactctgatggtagtttcttttgccatgcagaagctctttagtttaattagatcccatttgtctattttggcttttgttgccattgcttatggtgttttagtcatgaagtccttgtccatgcctatgtcctgaatggtattgcctaggtttccttctagggtttttatggttttaggtctagcatagaagtctttaatccatcttgaattaatttttgtataaggggttaggaagggatccagtttcagctttctacatacagctagccagttttcccagcaccatttattaaacagagaatcctttccccatttcttgttgtttttgtcacgtttgtcaaagaacagatggctgtagatgtgtggtgttatttctgagccctctgttctgttccattggtctatatctctgttttggtaccagtaccatgctgttttggttactgtagcattgtagtctagtttgaaatcaggtagcatgatgcctccagctttgttcttttggcttaggagtgtcttggcaatgagggctcttttttggttccatagaactttaaggtaccttttccaattctgtaaagaaagtcattggtagcttgatggggatggcattgaatcaataaattactttgggcagtatggccattttcatgatattgattcttcctatccatgagcaagggatattcttccacttgtttctgtcctcttctatttcattgagcagtggtttgtagttctccttgaagaggtcaccacatcccttggaagttggattcctaggtattttactctctttgtagcaattgtgaatgggagatcattcatgatttggctctctgtttgttaatggggtatagaaatgcttgtgatttttgcacattggttttgcatcctgagactttgctgaagttgcttatcagcttaaggagattttgggttgagacgatagtcttttctacaaatacaatcatgtcatctgcaaacaggaaaaatttgacttcctcttttcctaactgaataccctttatttctttctcttgcctgattgccctggccagaacttccaacactacgttgaataggagtggtgagagagggcatccttgtcttgtgtcggttttcaaagggaatgcttccagtttttgcccattcagtgtgatattggctgtgggtttgtcatagatagctcttttaattttgagatatgtttcatcaatacctagtttattgaaagtttttagcatgaaggggtgttgaattttgtcaaaggccttttctgcatctattgagataatcatgtggtttttgtcattggttctgtttaagtgatggattacgtttattgatttgcatatattgaaccagccttgcatcccagggatgaagcccacttgatcatggtggataagcttcttgatgtgctgctggatttggtttgccagtattttattgaggatttctgcatcgattttcatcagggatattggtctaaaattcttttttgttgtgtctctgccaggctttggtatcaggatgatgctggcctcataaaatgagttaaggaggattccctctttttctattgaatggaatagtttcagaaggaatggtaccagctaatctttgtacctctggtagaattcggctgtgaatccatctggtcctggactttttttgtttggtagcctattaattattgcctcaatttcagagcctgttattggtctatttagagattcaacttcttcctggtttagtcttgggaggctgtatgtttccaggaatttatccacttcttctagattttctagtttatttgcgtaaaggtgtttatagtattctctgatggtagtttgtatttctgtgggataggtggttataccccctttatcattttttattgtgtctatttgattcttctctcttttcttctttattaaacttgctagaggtgtatctttgggacacatttaaagcagtgtgtagagggaaatttatagcactaaatgcccacaagagaaagcaggaaagatctaaaatcgacactctaacatcacaattaaaagaactagagaagcaaaagcaaacaaattcaaaagccagcagaaggcaagaaataactaagatcagtgcagaagtgaaagacacaaaaaatccttcaaaaaaatcaatgaatccaggaactggttttttgaaaacatcaacaaaattgacagtgaaacttttttaagtaaaaagatagttaactatactaatggctacactgagcatgataattattgcagatggtcaatggtaaagcaagtgtagttgtttcagctgtagagataacgtaattaaatgaacagtatagacatctgatcaactttgaataatcaatcttatcacgtataccaacatgccctgttcttcacaaaatccattcacaaattctaggatgtatgattttttaagtgaattctgattcgttagaggttaatgtttacgaatgcaaacagcatctgtagaacctgatttacggtaaggtactttctactcatcacagtatctccaccgtttaacactgttacaacgcaagtgcacaacaaatatctgtttaagtagccaggaaggaaggagagaaggaagaagagaatgagggagagaaggaagatagatgggtggtttcggtagattcttaaaacccatccgttaatactcagtgtttggctgtggtatgaataaaagagagaggctagagactacaagtaattaacagactgcgagggccagtgtcccagactaagccatgctaatttttagatattactcgtgacttttttctctactgacaaaagctcagcatttaaatatattaggtgacacatatatcacaaggtacctgaataacagctgggattcattacatctgtataatcatctatgcatgatgtatagccatgctacttaaaactatatcttaaatatgaagactcttaacagagtaatttcatacattccaaaatatttctcttcattgtacattaattaaaactatattttcaacattttataataaatcattctaaaagccaaatattaagcaattctaccacaaaaccaaaacatttgaaacaatcaccatattttgactttgcaacttttgtaaaatatgtggttatttgggtcacagaattgtatcacatttgttgactaccaggcaaaattctttgacaagtgactttcaggtttacacagtctgctgccattatagcaattatatggcataatggaatgctagccatgtgtacttctgacattcctctaaatccaggtcattagtcattacatgaagtcattttaagtttccttcatcaattgccctctgtagttttccagctgtcatttcatttgttagtttcaactgaaatgtaaatgtaatagatgtaaatgtttatttagggattgcttcccctttctgtttttcacataaacacttacatacttcgattccttaaacacaacatgttttggcaaaactaatctatagtaaagggggaaaagtgagaaatgtggttccctgtgaggtgtgggagcagaaggtgactgagaaggaccatgagaggactttctgggatgatgttaatgttctgtatcttgatagagattagggttacacaacataggcatatgttaaaactagcaaatgttcacttaagatttatatacactattgtatttaaattttacctcaaaagaaaaaaaaactgtaaactattcttgaactctagttaacaatacgcatgttgaaagtatttagggggaagtgcctatagtttactttgaaatgcattataaataaataagatggactgatggatgaatagagggattaaaatatagatagataagataacagaaaagtgataagatatgagtggtgagtatactggtgttcactgtaattgtcttttgacttctctgtatgtttgaaaatttccataataaaatacattttcaaatttaaaaagtcatttctccaaaatccttttaattttcaaattcactcagtaaagaaagaggaatcagcaagtgttcccaaacattttgaaccataatcttagttacccacctgctggatcattcttagatcatttcttagtagtcagaaaaactggtccaaataattaagactcgataaaaatcttgctaaattaatcaaacatataatttattcatctactccttcatttattccacaaatacatgtcaaagacctctaagaagcagatgtctcttctaaatgctacagaaaaagagaactgaattgtaatacaacgtgatatacattaactgctataaaaacacgacagggagggcattttcgggaccatgaagggtgagtaaaattttgccagattgggtacagggagcagaaagttcatcccagggtatggactatcatgtaggtaaccttataatacataaactttgttttacagctaaaaaaggtaaattatatatttctggtagttgcttctcaaatatgtcaaaataatttaaaataaatatatgtacattaatccctcctttttgtatcttacatactgattttagaagattctgcaatcttttcaatcaccagtataatttaggttttgcttattcaccactaaatcacagcaacatgtatttcatttataataattaaaggtatgttcgttcacatttgatggtattaccactgagaggttttttgcaataacatgttttccctggaactcactttgggaaacaattctctaaagtcttgaaatcccaagagtgcatactcagggattagaaaggtttccctagaccaggatgcaaataaaaatgcaaatctttcacacagcaactctgcccccaaaaaactgacaaaggacaaatatcaaagtactgtgtaaattgtctacaatctatttagagactttaaatatgttatgttgtcctttttaaggcatgtggctggtcacatttcctttgatgagtagtttgcctttctaagcaacctaaccaaaattctggcatatgtgagtttactgcaatattatttctttatgatctgcaagatgtggatatcactgtctatctcacatgcttaacgtgaaggttatatgagatttttttaaataatgaaagtcagtgtttggtgtttaataaatagtagtaattaacaataaaaaatatttacccatatacctattcaggcaattgtacaaccatgcttttaaatttgagccaggaactgaggtgagccagaattcatcttattttatgagtatagttacaaagtcctaactcatagtctcattgcattactgatcactttaatgtcatgataatttttcatttgctccctttcagatccaaactccttacttcactgatcacccaagactggtactctttacggagttcgctagcgaagaccttagaattcttttatcatttatctgttagtggctgaggatagaaatatcagtggaccttcacctcaaataatcctctaaaaaaattcccagcgactgagttgggccagaagttcagactcaagatactttgtaatttgtttcaaattattttctgtaggtactatcaaatgatccctaagccaaatgaaatgctttgttctaatgactgaaaaaatcagttaagaaaggcaggattaatattagggcacttcttaggactggacagtgcattataaaagaaaatgaagaacattcagagatccaagagaaaagagacttctagaacaaaaaataaatagaaaacctgatttcatttgttagtacaaataataatgactgtcactatttaacagaaaactacattaccatattgaaatagaaagaagtgagaattcgaagctataactttgagatgcaattaagtgatccaactcaataaaccttaaacagaagactgtttctattcagagtgccagaacagtgtgaatctgggaacaaccttggaaaaggatcttgactatggatcagatattaatctccatgctatgtttccattatgccaaaaaattaagcactcttaatatttacgacagtattaaattataaatctagccccacatatcaaaaaattttaaaatagttacatctttaatgtcattaagagcaaatacagagcctcaggctcagttctattaggtaagttcatatcactgacattttcttcccatgaaacacattggacttaagatatagctatgaatataattttgctggaatactaatgatattcattttaaaatctgagtgctattagtacccactttcaatttttcatctttcatgatacgctcctggtacaagtgtagtctgtgtagcaacacactcatgctgtacacctcattggctcagtcctgtcagcagattgagtgcatttgaatctttatgttcctttttttagaatttgcaatattctaggagagtgattttctttattgttcccttatattgtatttcacccttacagaaaatgatagagtaattagaatcttattttccaaataagtcactctgtcttctttgtctaaaaaatatattttctgtttcacatatagatgataaagactaaagcagtagaaaaatgaataccaaaaatgtcaagagaaatagggggtttcaattgtaattttttaaagtaataaggactggaaaaaaattctatataaaaattgaatgattaaaaatactaaaatggttccttactgccctaaataaaacctttacaagatgcttcatatgtgaaataaattaagaatcaattcaaaagaagagaaacttttttcagtaaaatgggtaaaatcttttaaaaaccttttaaaattttctttgatacagtaactttctaaagaaatgttcaagtgtctatcaattttactttcacgaaagaaatctaactctgctttactgacaatgcagtttattttaaaactagagcagtacaaaaaggtcacaaaaagactttctgaaatataaaatcagtctaagataagcaaagctgaaatgactatctataccacctttccaaacctattaatgcttcaaactatattattatacaaccacaaacaaatatgtacatactctctactagaacatctccatagttgccgtgaatcattctttcattttccataagtacttacaaagctccataagtacttacaaagcagtatagtattcaattttaaaagtgtaaaaataaaatacacagagttttgacaaatagaaagtatcagataaaacgcgaatgaaggctagatggctaggtggatgggaggtgggtggatggacagatacataagtagttggatgaataggtgctcaggacatatgaatggatgaatatggtgctttctatcaaataaaagaacatgcaatccttttttcttctttcattaagtaacacttgtatattaatctaggtgttgcccatgagcttcaagagcagcttcatgaatctctgggaactgcatgtagggaaatgcatgttgatataggtacacacatgtggggcctggggaagggggtaagcatgcctataggcatcaacacaaaaaaaggccccttcttctaatctccagaaacaattaacctactcttttcaaaaactctactttgccagtctttcatctttcagcagaagaggcaaggcctgagtgaaaagtatgatgcctcctctggcttggcagcctaaacaaacaagctttccacacatagaccagggaagcttccacacccacatctggtgctaggcatggttcctgaattcaacagcaggataatacctgtccactatgtaataaaggcactaaaagttagctttaaaaaaaaaaatcaacatagaattcctgatttcatatttatgaaatagcatcctttcacaatagcacagaagaattaagtaaacaatttaaagattcacatctaattgagctccaactcagataaaatagcctgtgtttcttaaattgagactcccacaactaaattttgcctttcaaaggcaaaagaattttgaagaaatggtatcttcctagagatccctttggggaacatttttacaaacacttttcatgtgggcaaaataatttcactagtttgtttattggacatattggcctgtactttcacaaatgcagacccaaaaatcaaaatcagagatggaaaagggcaaacagtattatatagcaagtatgcttggataagaatcaaagtagaaggcttagggtttggctctaaaattagccaactagacatgagtttctgagcaagaatgatcataatgtagtttagttccctttcagtggctattgccacatgtatacaaaacaaacataaggaaatgcatcatattcttaagatactcatcctctcatccatctggttttatctcataaattacaaagtcctatttgaaattcttattataatattaaaattgggaaaagagcaaaattagagaatacataaggtaaggaatattgaaaattaataacaaagtaaagaaatacgtttgaattttttcacaatttctacaatatgcctcctgaataacctaactgaaatatgtctgacaactacagctatggaatctaaaagtaacagaatattattattttccttcctggtaaaaaaataaaaagcatataaatttatacatttttaggaaaagctaaaaatgtcatcaagtatgccttttagccttctttaacttcttttcaaaaatctaaatttataatagatctatagttctgagactatataatcctgttagcctaaaaagagataaataattataaataaaattattgtatttccttgatttatcagactctccatcctcaaaccaaaatccttacttaattaagcagggcaaatataagcaatcacttagaaaagtggtgtgataactattttaaactattaatctttttaaaagtaagcctttttaggagatctaagtagtacactcaaatattgtcttggatgctgggtgcacaaaataagaacctataccagttcatgaatatttttattgttttctcttttacccagggagagaaatagacaaaagacactattaaagttaaatataggctgggcatggtggctgacatctgtaatcccataactttggaagcccaagggaggtggatcacttgaggtcagcagttcgagaccagcctggacaacatggcaaaaccccatttctactaaaaatacaaaaattagtcagacgtggtggtgagtgcctgtagggccagctactcgggaggctgaggcatgagaatcgcttgaacctaggagacagagattgcagtgagccaagatcacgccactgcactccagcctaggcaaaagagtgagactctgtctcacaaaaaagttaaatacactgtgcccttttttatcttgaccacaaaaggtctccatctcagtaataggtatcatacttgcagtacctccgtggcatatgcccaggatttatagatcttttgttagataacaaaatccagataaattaagagagaaaatgcaacctgtggtacaataatacccatcattaatgaacttcggactttcccagtatttcactagtcagtgtaaagagaaattgttgtacgctcatgagcaagtcagtttgcttggtctcagttttctcatacataataaagtattttacacattccttttattaatctataaactctataagcaaggatcatggtaccctaacacccgcccaacataggcagccaaaaaatatgcatgtgcagaatgcaagatcacacaggttttttccagccaactttatcttcaattatataattttttaagtctaatatttgggtggataggtccataatgcatattaaaacaaaaaagagggtggttagggccacaaaaatgtggtagaaataattgaagatcacaaaagaagaaacaatttcctagagttcaagtggcctccatcaaactttaccaaaaccctaccaaaagctctaattctaaactttataaaaaagtcatagaagtataatttctctttcagaagtaatggcttttgttgttgttgctgttgttgttgtttctagttgagacctttgctgaatgtctaagaattggaaaaacaatgaagtcaaacctttcctaatttctattttaagatatttatactttttccaaactttcctcagatttaaaaaaaaaattgtattctttggaaaacaaaaagttagtactcagaaattcatatttggtaaaccactccagtaaattaattgaacccaaagagggggtcatgggaactgcaacttgaagccagttcatcagaagttccagagacctagacttgagactggtagaggaggaatagggaaaggtgcagtcttgggaactatgccctaaacctgtgggatctgacactatctccaggtaggtagtgtcaggactgaattagaggacacccagctggtgtctgctgcttggagtgtgggggaaaaaaaaccccacacatatggtcacagcagtcttctgtgttgatgattgttgtggtgttagagtagaggaaaaacacagttagagagagttttccttaaacaaatggtgtcagtgaagcaagattagctggaacaccatgatcaggtgggatttatcctagggaagcaaggatggttcaaaagacacaaattaataaatgtgatacattgcataaacagaattaaggacaaaacccatatgatcatctcaacagatgcagaaaatgccttcagtaaaattcagcatggcttcgtgataaaaatcctcaacaaactaggtatagaaggaacatacttcaacataataaaggccatatatgacaaacccacagccaacattttacttaatatggaaaagttgaaagcatttcctctgagaactggaaaaggacaagaattcccactttcaccactcttactcaatatcatactggaagttctcactagagcaatcaggcaagagaaaatattcaaaggcatccaaattggatgcctcttcactgatgataagatctagtatctagagaaccctaaagattccaccaaaaaaaccttagatttgataaatgaattcagtaaagtttcaggatacaaaattaatatacagaaatcagtagcatttctatacaccagtaacgacctagccaagaaccaaatcaaggaggcaatcccacttccaacagctacaaaaaaaaagaaaaaaaaaaacacacctgggaatatatttaacaaagaaggtgaactatctgttgtattagtcaattctcatgctgctatgaagaaacctgacactgggtaatttataaagaaaagaggttcaattggctcacagttctgcatgtctggggaggcctcaggatacttacaatcatggcagaagacacctcttcacatggcagcaggagacagaatgagtgccagaaggggaaatgccagatgcttatctcatgagaactcactcactatcacgagaacagcatgggggaaaccaccccagtattagtccgttttcacactgctgataaagacataccctagactgggcaatttacaaaagaaagagatttaattggacttacaggtcaacatggctggggaagcctcacaatcatggtggaaggcaaggaagaacaagtcccatcttacacggatggcagcaggcaaggagagaaatgatgaggaagacatgaaagcagaaaccccttatcaaaccatcagatcctgtgagagttattcactacaatgagaactgaatcatgagtgaaactgctcccataattcaattgtctcccaccatgtccttcctacaacacatgggaattatgggagtacaattcaagatgagatttgggtggggacacagagccaaaccatatcagaccccacgattcaattagctccacctgtcttgcccttgaaacgtgaggatattataattcaaggtgagatttgggtggggacacagaacaaaaccatatcatctctttaagaagaactacaaaatactgatgaaagaaagtgtagatgacacaaccaaatttttaaaaatcccataaccatagaatggaagaaataatattgttaaaaatgaccatactacatggagcaatctacaggttcaacacaatccctattaaattactaacatcatttttcacagaattagagaaaacaatcctaaaattcatatggaaacaaaaaagaccccaaatagccacagcaatcctaagcagaaagaacaatgttggaggcatcacattacctgactttaaattatactacgaggctacaggaaccaaaacagcatggtacaggtataaaagtagacaggtccatggtatagaatagagaacccagaaacaatgccacatacatataactaactaatcttcaacaaagtcaacaaaaatatacactgaaaaagttctatcctatttaatacatagtgctgtgaaaactgaatagcctagccatatgcagaagaatgaaagtggacccatacctgtcacaaagtcttatgttctggtctttggattaggcaatgattttatgaccaagtcctcaaaagccaatgcaacaaaaacaaaaatagacaaatgaggattaaatacagtaaaaagcttctgcacagcaaaagaatcacaatcagcagagtaaacagacaaactacagaatgttttccacaagaaaaaaaaaaaataaccccattaaaaagtgggcaaaggacatgaacagtcatttttctttttgtttttttgtcttgtttgttttttgtttttttgttttattgtttttgagacagactctcactctgttgcacaggatggagtgcagtggcgcaatcttggctcactgcaacctccacctcttggattcaagagattctcctgcctcagcctcccacccaggattacagctgggattacaggcgccttccaccatgcccagctaatttttgtatttttagtagagacagggttttaacatgttggtcaggctggtctcaaactcttgacctccggtgatccacccgcctcggcctcccaaagtgctgggatttacaagcatgagccactgtgcctggctgaacagccatttttcaaaagaagacaaacaagcagccaacaagcagccagtcatgacacaaggtgaaaaatgctcaccatcactattcatcagagaaattcaaattagaagcacaatcatacatttctcataccatctttcaccagtcagaatggctactattaaaaatcctaaaaacaatagatgttggcaaggatgcagataagtgaacacttataaactattggtaaaaatgtaaattagtacaagctctatagaaaactgtatggagatttctcaaagaattaaaagtgaaactaccattagatatactgatcacacttctgggtatctatccaaagggaagaaatcatcatattaaaaagatgcttgaaattatatctttatcactgcactagtcacaatagcaaaggtatggaatcaacctaaatgtccatcaatggaggatttcataaagaaaatgtggtatatatacaacttagaatactatgcagtcataaaaaagaatgaaataatgtccttggcagcaacatggatagaactggaggccattaccttagtaaaataactcacaaagtcaaatacttcatattctcacttataaatggaggctaaacaatgagtacacatggacatacagagtggaacaatggacactgcagactccaaaaggtgggagggtgggaggtgggtaagggtttaaaaattacctattgggtgcaatgttcactattcaggtgatgggcacactaaatgccaagactacaccactatgtaatatacacatgtaagaaacctgcacttgtccccactaaatatatttttaaagaaattcacaattggacaagcgattttaatatcccaaaatacaggaaaaaaaactatgagctacaaattatagaagcagccagccaatcacagctgccacagcttgggcatctcactttcatttagttagatccaccccgggcaacagttcttccagacccttcagtgttttgggggcatccctatactcctgcagtgggccccattcatcaaggatagcagctatcagaccccctatagatgtagacagccagcctagaatttcctccgcatacttcctctctcccaatcccatcatcttggcactcatgggattttcttcaacttattgccatgcataccaggtgtcctgccagacctctgtggacttcaattagatggcactatgtttgagaggccaaagaagagacccagaattagtaaaagagacaacagagtttattaagggaacatatgtactgggcagtccaatggcggaggctggacaggagaacctgtccagtaagactccagaaaaagcaaaaaatattaaaataaaggatttattacataaattatgtcatatccacttggccctctatttaaaatccattaggatattaaacataaaaaccaacaggcaacatggaaaagctttgtttacaaaaaaaaatgacattgggctggaaggaaatacactacactctaaaaaggtatacttttaaccaaacaatgtataaatacaaaaacaaaatttctcagcataatatttcataaactagaaaacttacataaaaatgtattcttaagtaagacagtacggacttgtctcccaagtctttttttcttacacacacacatacacacacacacacacaccccacacatatatgaatactttttaaacattttttctcattatgtaaaaaatcaaaataaagtaacccaaaaatttttaagccctaaatattttattatacttgtaatactgtcactaagttaaactcaaagaatctaacattaggtcattagacaaaactgcactgtgttaatctgtttgcactgctataaagcaatacctcagactgggtaatttataaagaagaggtttattttggcttacagttctacaggctgtacaggaagcagattgctagcatctgctcctggtgagggcctgaggaagtttccagtcatggcagaaggtgaagggggtgcaggtatggcaagagagcaagcaagagtggagaggtgccacactcttttagacaaacagattttgcatgaacttagagcaagaactcactcattatcatgaggaacgcaataagcttttcattagggatccgcccccatgacccaaccacctcccctaccttcatcattgggggttatatttcaacatgagatttggagcagacaaacatccaaactgtatataacgcacttattcttttttaatgaaaatcagtcaaaatatatctttaaaaaaatacatccacagccagacacggtggctcgtgcctgtaatcccagcactttgggaggccaaggcgggtggatcacctgaggtcatgagttcgagaccagcctgaccaacgtggaaaaaccccatctctactaaaaatacaaaattaaccaggcaacatgccacatgcctgtaatcccagctactcaggaggctgaggcaagagaatcgcttgaacccgggagacagaggttgcactgagccgagatcacgcccattgccccacagactgggcaacaagagcgaaactacatctcaaaaaaaataaattaatgcatcccactgctatcacagtttttaaaaacccaaagtgaaaacaaataactgtgtcagactatctttagcaacaaaacgcaaaaacgataacgtctagaaatatatgtaaaataattttaattataccatttataaaagattttattttttaaattaccagttcttttcattttactatttcttctaaaccagccatctggccgctttcaccttacaatgtatggtatctatttttatctgatatattcctatcttatttattgattatctgtctggcccactggaatgtaaactccttaagaaatttttttatcttgttcaaaacccagagtcactacatacaaatgtgtaggttttacacatgtgaatatcattacagttatgcagtgcacaacctgcagaactgaatatggtaggtctggctgtgaacaaataattatcagacatgtaataaaacgccagagatcttaacagttctgtgtcctccctagtggtgatgcaaaccctctctaggcatgcatgccaggaaaagctgttcctcaacattttcaattcctaaatattctttaacattatgttacacaagcatgtacaaattatttgctctttgctattccatgaaatctataacagcaaaatatttctgaggcagaaaccaactcaacggagttacctattaaaggccaatatgaatgaattataatagcagtaaatttttaaagtatttttcaccaaaaatactaaattgtttactattagacacatatcaattatttttaaaataacatgctgacagtctcaaagaatactgtaaatctatatatcattaatgtaatccatttttatgttcttaaacatctaaaattatagaactacatttttttataaactgtcatctcttttttattaaaaaaagaagatttttatgaaaaacctctgagtttaaattactattatattcaggagtcccacacccactgtttccaaacatagctctttttataacaacttctgacaatcctctagagaacaaaaattcacttttaatcaaagttaaatgctagaactgtttcctgggaaatttaattcaaggtaaacaatctacttgatattgtcttattcacacaaagctgtgttgttagaagaaatgataatgaaatataaaacctttctcttctaggttattgtttacaatctggacaaagctgataggcaaaagaaagcagagaaagccaatgtgaaaggaatgtgtaggattagtcacgcttcttcccagaagatagatgttgaccagtaagactatcagttactaaacacagccctctcattctacacccctaacacaatctcttaaaaaagaaattacaacttccaatctccatttgtcaagtatcttgaatttaaatatacaggtcttcacaaatatgaactaaaattcaacaaagttttgtctactatgtgctggacactaataggataaaaatgactaggaaacacttcttgcctcagaggaactttgcatgcaaatgacaacattacttggcaacaaaagaatgtggacacaatgtgaaatcaagccggggtccagcagttagaatcagcccttccttgactacaccagggacatactactacaaatcattctgtcttataccccagcatccagctatcctctggaaatgcttctccctgaagtttacatccttgcttagctatttcactcatctactccacggctaatcccttcatctctgcttctcagaaatggctctttccaatcctcccttccaatctctactccacaattctagtggcccagtctcaagcttcccctccagtgctctcataccttctcaaagctgcaattctagtcctgaagatctaggcaggggaaactggtactcacacattacatcaaggaaagacctcagaggtacacacaccagtggagataccataggttcagttccagatcacctcaataaagtgagtcacacgaattttttggtttcacagtgtatataaaagttacatttacactgaactgtaatctattagatgtgcaattgcattatggaaaaaaaagtacacactttatttttaaaatacttcattgctaaaaaaatgctaatgatcatctgagcctttggcaagttgtaatcttttagctgtggaagtgtcttgcctcaatgttgatggctgctgactgaccagggtggtggttgctgaagagtgaggtagttgtggcaatttcttaaaacaagacaatgaagcttgctgcatcaattggctcttctcttcatgaaagatttctctgtagcatgcattgctgtttgattgcattttacccacagtaaaacttctttcaaaattagggtcagtcctttaaaaccctgtcactgctttaccacctaagtttatgggatattccaaatcctttgtggttgtttcaacaatgttcatagcatcttcaccaggcatagattccatctcaagaaactactttctttgctgatccataagaagcacctcctcatccgttcaagatttatcacaagattgtagcaattcaatcaaatcttctgactccacttctaattcaaactgttttactgtttccaccacatctgcagttacttcttcccctgaagtcttaaaaccctcaaaggatcaacttcttccaaactgctgttcatgttggtattttgacctcctcccatgaatcatgaatcacaaatcccatgaatcagttcttaatggcatctagaatggtgaatccttttcaggaaattttcaacttaatttgactagatccatcagaggaatcgttatctatggcagctatagcctaacaaatgtacttcttaagtaataagactagaaagccaaaattattccgtgatccttgagcaacaggatggatattgttagcaagcaggaaaacactgatcgccttgtacatctccatcagagctcttgggtgaccaggtgcattatcaatgagcagtaatattttggaaggattctttgcttctgagcagtaggtctcaagaatgagcctaaaatattccacaatctatgctatgaacagatgtgctatcatctaggctttgttgttccatttatagagcacagtcagagcatattcagcataatgcttaaggggcctaggattttcagagtggtcaaggaccattggcttcaacttaaagtgaacagctacattagcccctaacaacaaagtcagactgtccttcaaaactttgaagccatgcactgacctctcctctgtagctagagaactcctagatggtatcttcttcctatataaagctgtttcgtctagcttaaaaatctgctgtgtagtgtaggcgcctttgtcaattatcttagctggatcttctaggtaacttgctgcagcttctacatcagcacttgctgcttcactttgtacttacatgttatgaaagtggtttctttccttaagcctcatgaactcagctctgctagcttcaaacttttcttctgaagcttcctcacctttctcaaccttcatagaattgaaggaagtcaggcccttgctctacattaagctttggcttaagagaattttgtggcttaatcttctgtccaaccactaaaactttctccataacagcaataaggctatttcactttctcatcatccatttattcactggagtagcatttttcacttcattcaaatacttttgctttgcattcacaacctggctaactgttcagcacaagaggcctacctttcagcctatctaggctttcaacacgccctcctcactaagctgaataatttctagcttttgatttaaagtgagagacatgcaactcttccttttacttgcacacttgccattgtagggttattaattggccgaatttcaatattgttgtgtctcagggaataggtaagcccaaggggagggagagagatggaggaactgcaggtcggtggaggtgaagtcaagtcagaacctagcacttactgattaggtcgggcatgttatatgagtgtgggtcatggtgcctcaaaacagttacaatggtgacatcaaaaatcactgattatgataatcatagcagatataataacaaaaaagtttgaaatattgtgaaaattaccaatgtaacacagagacatgaagtgagcacatggtgttgaaaaaatggtcccaacggacttccttgacacagagctggcacaaaccttcaacttgttaaaaaaaaaaaaaaaagaaaacacagtatctgcaaagtgcaatgagatgaaacacaattttttaaaaaagtgttcttgtatacaactaactggaaaataagacagtgtaaaactcacatgaaaagctctgcaagtagtccgggcactgtggctcacacctgtaatcccagcactttgggaggccaaggcgggcagatcacaaggtcagtagatcgagaccaccctggccaacatggtgaaaccctgtctctactaaaaatacaaaaattagctgggtgtggtggtgcgtgcctgttatcccagcttctcaggaggctgaggcaagagaatcgcttgaacccaggaagcggagattgcagtgagcagagatcatgccagtggtactccagcctgctgacagagcgagactccatctcaaaaaaaaaagctctgcaggtaatatagtctgaaatatttatcagaggaatgtccaaagccatacagttaagcgttcactgcaaagtagggattcctttttgggagccacttaccatgctccacaaatcaatctcacaatagtctcagtgtaactacactaagtatagttctacttccttagtggaactgtaggaagttatagccaaaaactattccaggttatttgccatttcaatcattggaagtagctatagagacatgtacttgagaacttcatcatttacagttgaatgattttctagaccttccaaatactggattttacccctttcatgaccctttgctccctatataaactttcatcaatgccagaatattgaatgaaatcaccctgaaatcagccatcatatcaaagatggctacaagatacatctcaaaccttcagaaaatggtctgtgctaatgagaaggccgaagtgtcaaccgcaatatgtctgtataggtacctcaaatgtgacaacaactaacaaaaaaaacactctggtacaaataaactagtactggatgcagctaataaagcacatgatactataatgttaaatacatacactaatagaattttctacaattctctgttacgaggtcctttgtaaatcacaggagagtaagtggttttaagattaaatttgcccatatagttaattgccacttcacagcaagtactgtgaataaaaaatccaaattgagctggtttggacctagttacaaataccatttaaacagaacagaaaaaaagcctctatgttgacagggataacaccaaagtggaacacaggcctcatacaaccatctagaatctctcagtttcaccttcgcttcagacatactgaggatttttcatttgagtttttctttccagagcatgtatcacaaacttcaaagataaattagtaaaaatacacacacataatagcataggttgattttatgttttttaagatgaaggttttaaggttatctcattcaatccccttcattttaaaaatgagaaaataaagctccaaaaaggtaattcacacatggctacatgatatatcagagacaataatttctctgttaattacttatacctctgttcaatacagtaatccaaattttcaaatgcaataagttattttacaagcctatcaaaggaacttgctactttaaagacaactggagtactacgaccactgtcttaagagaaggaaaactgagtgggctggttaaggatgcagaggaggataaaatcacagtcactctttgacccaaaatcaacttaatttccagaatgcctagtaagcttgaagcagcttggtgcagctaagcacaaagagctcaaacatttatcaagtctcctctgaagagttctaaatatggggacatcctagtgtgctgctttacatttcttcccagtccagactgcacagaacagaactctcctcaaaatatcccagaaggacttcagaatccattttttcaaatgttttgacacaacactgaaaaggtgcaattattaaaatatcggaaactattatattaattcaaatatgttcagctaccactcattcttcttcctatttttaaatgtggggatcactaagtatctttaaacttagtgtattttcaattttttttctctacagccacagtgaaaggggtggaaagttaaaaaagaaggaatttgattttttatctattagaaggaaggaaaagtttaggtggcattattatatgtgaaaactgaactgtaaagcatacagtatgtgcatcttcacagggtatataatttcaaaaggtgaaaaatgtttaaatagattttaaaattatttctctgcaaatatcacaaaatattaaaagtataggcttgctatgaaagtatctttaaatgttgtgtttctatttttaaaaaatcactttgtcacttgagagaaataaggttgttactttttttctattttccccattctcatatccttcatgtttttcttcattaattacattgtcctttttctgagggtttaaaatattgtgcatattcatgtatccgctgatacatatatttatggtctagctcagctaatgcattggtgaatatgttcacatagatgtatatgtatatgcacacacatgcacataacaagaaagatggcacagtggctaaggctctttctagagtaagactgcttggttcaaattctgcttccaccacttacaagcttggacaagtttcttaacctctcagtgccataattttcttatctataaaatggggataataacagtaagtgcctctaggggtacaaataggactaaataaagatttaatatttatagtgattataacagcgtctagcattgttaagtgcctgcaaataagtgttgaatttttttaaattattttttacttttcttcattctccttctcttcattttcctcatcgcttctactgctacatctttatcaagtatttaaccatcaaatccagccatacagacaaaatttatatacttcctacactcagaaaataaacaacaggacactgttaaccctgatgataatgaatatacctaaaacaaagaagtaagagagcaaaaatgataagcaagaacagaaactatatggcataatgcagtggtcttcaaattggagtagatatgcccctctaattacagtaggaaggtctgtcccttcctactgtccttcagcataatatctattggagacattacattattcagtgatacatgaaatactttagacttacgtttttcttgtaacagttatatattaatcaagatgcaggtttatagtctaatgttgagccttagaagatttttctaagaaacagctaggcatataaatatatttaaggaaatcaattgctagatctaaacgtccataaaaatttttcctaaaaatgacctatgtgagaaagtgcctctcaagtatgatatcctttcccatctctcttctcacaattatccttctctagatttatagggaaaaaaaagtcgtgctcttacacatccccaagaacactgcaggacattgttttgggcagacaaactgtggggagccaaaaaaaaatgaaatctcatatatttttccactacaggtgctctcagcttaagtgaggaccagctccccaagtcagaaaacatcttaccatctttactccttcctagcaatttattccccctttcctagaagaatgaaaaaaaaatagacacaaacatacatacatacatacatacatacataagtttaaactggtttggccttcaaaggaacaaaatcatacaagatcatgatgaataataaagaagtataaatgtgaagactgagaataacgaaactttaaaggactaatggagaattagaattcaagcacgttctctaagacatgggcattctcaaatatattctaacgttctaggtttcagattacatgatcccttttatggagtgctaaaagggcggagattgggaaatgggattaattaaagaacagggaagaggaggagccaagatggccgaataggaacagctccggtctacagctcccagcgtgagtgacgcagaagacgggtgatttctgcatttccatctgaggtaccgggttcatctcactagggagtgccagacagtgggcgcaggccagtgggtgcgcgcaccgtgcgtgagccgaagcagggcgaggcattgcctcacctgggaagcgcaaggggtcagggagttccctttcctagtcaaagaaaggggtgatggacgcacctggaaaatcgggtcactcccacccgaatattgcgcttttcagaccggcttaagaaacggcgcaccacgagactgtatcccacacctggctcggagggtcctacgcccacggaatctcgctgattgctagcacagcagtctgagatcaaactgcaaggcggcagcaaggctgggggaggggcgcccgccattgcccaggcttgcttaggtaaacaaagcagcctggaagctcaaactgggtggagcccgccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcacacagctggagatctgagaacaggcagactgcctcctcaagtgggtccctgacccctgacccccgagcagcctaactgggaggcagcccccagcaggggcacactgacacctcacacggcagggtattccaacagacctgcagctgagggtcctgtctgttagaagaaaaactaacaaacagaaaggacatccacaccgaaaacccatctgtacatcaccatcatcaaagaccaaaagtagataaaaccacaaagatggagaaaaaacagaacagaaaaactggaaactctaaaacacagagcgcctctcctcctccaaaggaacgcagttcctcaccagcaacggaacaaaactggatggagaatgatttcgatgagctaagagaggaacgcttcagacgatcaaattactctgagctacgggaggacattcaaagcaaaggcaaagaagttgaaaactttgaaaaaaatttagaagaatgtataactagaataaccaatacagagaaatgcttaaaggagctgatggagctgaaaaccaaggctcgagaactacgtgaagaatgcagaagcctcaggagccgatgcgatcaactggaagaaagggtatcagcaatggaagatgaaacgaatgaaatgaagcgagaagggaagtttagagaaaaaagaataaaaagaaatgagcaaagcctccaagaaatatgggactatgtgaaaagaccaaatctacgtctgattggtgtacctgaaagtgatgcggagaatggaaccaagttggaaaacactctgcaggatattatccaggagaacttccccaatctagcaaggcaggccgacgttcagattcaggaaatacagagaacgccacaaagatactcctcgagaagagcaactccaagacacataattgtcagattcaccaaagttgaaatgaaggaaaaaatgttaagggcagccagagagaaaggtcggattaccctcaaagggaagcccatcagactaacagcggatctctcgacagaaaccctacaagccagaagagagtgggggccaatattcaacattcttaaagaaaagaattttcaactcagaatttcatatccagccaaactaagcttcataagtgaaggagaaataaaatactttacagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaaggaacgaaatcaccagctaacatcataatgacaggatcaaattcacacataacaatattaactttaaatgtaaatggactaaattctccaattaaaagacacagactggcaagttggataaagagtcaagacccatcagtgtgctgcattcaggaaacccatctcacgtgcagagacacacataggctcaaaataaaaggatggaagaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcgtgagtgacctacaaagagacttagactcccacacattaataatgggagactttaacaccccactgtcaacattagacagatgaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaacctcactaaaagccgctcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactcaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacagacacctctacgcaaataaactagaaaatctagaagaaatggatacattcctcgacacatacactctcccaagactaaaccaggaagaagttgaatctctgaatagaccaataacaggagctaaaattgtggcaataatcaatagtttaccaaccaaaaagagtccaggaccagatggattcacagccgaattctaccagaggtacaaggaggaactggtaccattccttctgaaactatcccaatcaatagaaaaagagggaatcctccctaactcattttatgaggccagcatcattctgataccaaagccgggcagagacacaacaaaaaaagagaattttagaccaatatccttgatgaacattgatgcaaaaatcctcaataaaatactggcaaaccgaattcagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaacacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaagaatcacaagcattcctatacaccaacaacagacaaacagagagccaaatcatgagtgaactcccattcacaattgcttcaaagagaataaaatacctaggaatccaacttacaagggatgtgaagcacctcttcaaggagaactacaaaccactgctcaaggaaataaaggaggatacaaacaaatggaagaacattccatgctcatgggtaggaagaatcaatattgtgaaaatggccatactgcccaaggtaatttacagattcaatgccacccccatcaagctaccaatgactttcttcacagaattggaaaaaactactttaaagttcatatggaaccaaaaaagagcccgcatcgccaggtcaatcctaagccaaaagaacaaagctggaggcatcacactacatgacttcaaactatactacaaggctacagtaaccaaaacagcatggtactggtaccaaaacagagatatagatcaatggaacagaacagagccctcaaataacgccgcatacctacaactatctgatctttgacaaacctgacaaaaacaagcaatggggaaaggattccctatttaataaacggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaaccaaagccaaaattgacaaatgggatctaattaaactaaagagcttctgcacagcaaaagaaactaccatcagactgaacaggcaacctacaacatgggagaaaattttcacaacctactcatctgacaaagggctaatatccagaatctacaatgaactcaaacaaatttacaagaaaaaaacaaacaaccccatcaaaaagtgggcgagggacatgaacaggcacttctcaaaagaagacatttatgcagccaaaaaacacatgaaaaaatgctcatcatcactggccatcagagaaatgcaaatcaaaaccaccatgagatatcatctcacaccagttagaatggcgatcattaaaaagtcaggaaacaacaggtgctggagaggatgtggagaaataggaacacttttacactgttggtgggactgtaaactagttcaaccattgtggaagtcagtgtggcgatttctcagggatctagaactagaaataccatttgacccagccatcccattactgggtatatacccccaaatgactataaatcatgctgctataaagacacatgcacacgtatgtttattgcggcattattcacaatagcaaagacttggaaccaacccaaatgtccaagaatgatagactagattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacactgcatattctcactcataggtgggaattgaacaatgagatcacatggacacaggaaggggaatatcacactctggggactgtggtggggaggggggaggggggagggatagcattgggagatatacctaatgctagatgacgagttagggggtgcagcgcaccagcatggcacatgtatacatatgtaactaacctgcacaatgtgcacatgtaccctaaaacttaaagtataattaaaaaaaaaaaaaaagaacagggaagaacaagagaataaaggaaaaaagcagagagaaggcaaggcaaaatgatttattaggaaaggaagaaaccctttcaaacaaagaaatcctacgttttctctcgatatatcactagaagcatatgcaagaaatcaatatatacttttttaaaagaaaggattaagtagaagataagagaagatacacaggtcatagggaataaaaaattaatagtgcctttccacacagacttgaaacaattctggtcactgaagggcagtaaggctggggaaggtatctcccttcctactgtccttcagtgtagtatctattggagacattacattattcagtgatacatgaaatactttagacttatgtttttctagtaacagttacatattaatcaagatgcaggtttatagtctaattttgagccttactttagtttttatcagcaacaatcttgtataatctaccatgactatacatatgcatcaggtttagtaaagcaatttatgatacagtctccatatgtgaaattgaaagccagaagctaactattattttaacaagctgtcaagatatatagagttttgccaaagaaacattgattacactggtcttttgaaaagtagataaaacttagaattccctaagcaaaccatagttacacaaaattgtcctgagattcctatgaagcacatgactcaaatgctaccaaaatccttcataagtaagatttatttccaataaattatatatctctgttttagaactctgataatttgcagcccattttccagtaacatgtttttatcattttctactgctgaataaaaaagaaattaaaggacaaagagaagatcatgagtgaactatccaaattttattacaatcttgaaaaatacacatccgttgacttcctgttcctctgccactaaatctctgtggggaggtccaacttccaattctctgaagtcgcaaggtagaggaaataaaactaaggagcaggttgctatagctctccaattcaaaagcaaattattactctatttaatacagcaatctactataatctcctccaacactcctgatcctctttacagtactcttttctatagtacttatctcctaacaaaaaaatgtacatatttactatacctattatgtcacttgttgctagaaagtaagcttcaaaagggcagggatctacatcattttgttcactggccaatctcaaatacctagaacagtgtctgacacatagtaggagctctactgaataaataaactattactttaccagtatcaaactccccacctgaggtagcactacctaaactacatgttgttccgattctaattgcatgtgatttttctaatcttcgtgtcattatcatagataagtgtccattgctacaactggaagtaatctgtgcacactgcagccttcattgaaacccagataatacttctgttcgtagctgacctcatttttatggcatcccactgtatagcttgcttcttcactcttatttaggcagtgtcttcgcagtttcctgccttgaatacctcttgtatacatttaccaccttaattatttgctgtgtacattttccttgatgccttctccccactatgacagcagattccctcttctgattttccactgatcagcacggcccttcaaaaaccttcacaaaagcccgttagaaacagattgagagacgcatttgtgaagctatttaacaaatttaagtgtcatttttaaagtattcattgtaaattggagcattgtttcatatcggtatcattggagcattgtttgatatcggtaacttgctttaaactgattaagcacatgtaaagatacatgctaccaatagaagaggatgaaaccgagagatcatctttatggttaatagggagtcagtgacaggaaagtaaaaagactgaaggatgattttgggaagtccaggtaattgtctggttatccctcaccaatgtcttgatccaacccaagaatcactctaacacggcaaaactcaatccttcctgttattttatttgtggcaagagaaagatccctaaaataaaatgcatttataaaatgattgccttataataagcactcaataaatatttgctgaataagttaatggatcaatgagtatttccctatggtttgggaagtttagccaaattaaataccagactttcaaatgtaaagggttacgtctcaaaaatatacctcacccagctgatacacataacacttaaataactgtatctgcatgctcagtaagaacttcatgcattcatatatttaatacatcatcaaagcattgtgagacaactttctaacagtgaattgaaaccatataaaaaactttggactttttgagggtttttggtttttgttttttattagagatggggtcttgctttgtcagctaggctggagtgcagtgatgcgatcgcaactaactgaagcctcaacttgaaggtctcaagtaatcctccatctctgcctccagaatagctgggaccacaggtgcaggccaccacacgtggctcatcaagtgacaacttattctcagtcaaaattcatgggtaaaaataaagttaaaattttttattttaattttgaaaaagtatatattttgtgatcatagctttgattctgctctccatcaaatacatttaattttccatttctccatatttaagcgattaaccccattaaaaaatgggaaactattcattctcaactcactaaaggaagtataaaaggaattaaatacaaagacccactcaaatatagctaatttcattaatatttcctgtgtatcatttcaaaaaaaattactaaaaaatattcctaagattcttcttataatttttatagtttcattattaagaattattgagataatttattttaattagatgggcttttataaagtatataatcaataagtgtttgtagatcccttagttttaaagcttttttttaagtttctctttacccaaaaatataatctggattaaattcaatttactgacccaaagatataaatgagaaattcaaaaccattaacactctaacacagctagatggaatgatgaatgattaagggagaaaccataagaaaacatcaggtaatcatctttctagcatggtctgaatgaaatccttcccatgaaattaaaatttgatacaaagtctatcaggaaaacttctaaactttaagatttgtcaggaaaattgtgaaacactgaaatatgcaaaatattagtggatgtcctatctagtatacccttccagattatctgagtcagtcagaatatgagcctcacattgtctttctgctactttacaaccatgcagttgtaagacacagaataatacaaacaattcttttccataaaaatgcaaataaattgtgtccagtgaaatgaaatggataattggcctgtggctattaaccagttttgcgtctgtttcacattcatttcagcatccttgattgcccatatatgtgtgctcttaaaattctcctttgaattatttgtaacatcttactgatcccctcattaattaatgagcttaataaagtctttgatacccattctttttacatttgaataaaagacatgattttaacctttctttaaaagtatcccttgacagaatctatcactaaaagtatgacttttgatccaccttccataaacaggctttcttaaaatttccattaagtcataagtcatcccattcaaattactcaaaataaaatactgcagcatcaatattttgaatccaaatatgaatgaatccaaagcaccatcattatatgatataagtttactatttatatatccctagaagcaaaaaggctgccaattaaactaagacataatgcttttttatcaattagatttcattttttggatatctgtatcatatattccactgttctgccccatgcctctcatgtagatagatgagtatatattacttatccttctaagcctaaatcataggatttgggaatcatcagaatacctgaagtgcatataactcaattaaactttgacattatgaccacattcacacatgcacagataacaactccatcaaaaccaccacctacccaacatggattttgagtccatcaattcaaagaagcatcccagtttcaggtatgttcaaatatgaaaaaatagacatcttagaatgcataaaacaccacaaatataagtgcaaaaacatatagcaggattataaatggcaaatagcttacaatcagaaaacctgtcactagagggtcatcatttccttaaatagtaacactagaataatccacacagactgctagaaatttatgaatcttaaaactgatagtcaaaatctcaatgaagccaaataactctttagggcaagaaaaggtgagatccttgactgaactaaggttattcaatctcttgtttactaaaacagtggtaggggtggtttggtctctagcagaagggcaaacaagatggtatcacataatggagctggcttaaagcaaaataataaaaatgaaaaaacactcattcctctacttctaagaaaattatattcttcctttttgatgtactgctgacattcctttcctctcttcaatcctagattagttaacagcttgtaaaactgctgttattataatgacaatctcaatcaactacatcataaggctttttgcctaaaggatcatctctccaagttgtaatctctttgaagactaaggagacaaaagtctctcttgaacactaaggtcttttccaaattaaaaacaaaatattctaaatatttatgaacgatatcaatcagacttcctgctaaatattacttcttagtttttagccttttgtaatatgttataaaagtttccattgtctttgtattgttgaaggctacaatattgcctagcacatagtaacagcaaataaatgttggtaaactagaaactgactctcacagtggccttgattctcacagttaacctagaagtaagtaccgcaacaatgtttattcccatttcatatataaagaaactgaaggttggagaatttagggttttgctctaaaatcacagttaataagtggcattgtcaaaactgaatcccaggccctttgtctccaagaccagagcaattcttacagtaacagactgaacatcccatgcctagatttccttccctctctcttctcttacctactacatgatacttgactcaggattctggtttgctgaattactgaaaccacatcaacagtgagtcaatggtaattctctacctggttacatttacattttagcacagatattgtaagataaggtgcagcagagattattggaaatacacatattgacagtcagatagctcacttctagtggaactagaatatttaattttcctgtgtctcaagtcctttatctgcaaaagcaggtgaaatgcagatgatcaataaggtcttttcctaactaaaaacctaacattctaaatatttatcaattatacaaaatcagatcacctgctacattttacttaatactggccttgaaaaaaaaaagaaaactataaaaacctgtctgttagattctgcagtgggccaaaaacagaatatataaacaaaaatttaaatatattccaaccatactacttgactaaggacactgtctgtaccaatttaaaactagaaggttttaaggataaatgagatctatacaggcacaattgtcacagcagtccttctaggtatacaagatactgaaacattttactgacctataacttactttttcatacatggcaaaactatatttttctcattacaaatgccctagctctccccacaaagttattgtgaagtctccaaatattgctaatttgtcccttaaagcaaaaatataaaacactttgtgacatatgaaaaatgttcaccatgtcctttagttgcttcaagatatagcatataaatctttgagtttctaaacagaaccatactatctagatatttttgtctaaaagatttaaagcttaaatgtgctacctttttttctctcttgcagctttcaagtcacttagcctgctccagtctccaagatatacattatttttccaataaatcaataaataaaattggtatttttgactacttcttagtataaatcttgtctttgtatcaacaaatgttcgagtgcattttcattgtatgactaaatttctattaaaaatgtaaataatttctgcttactctatcgagtctttaattaaaagtggtttttaaagagtcaaaagactttgatcaatttttatagaatgcaccagggcacggtggttcacgcctgtaatcccagcactctgggaggctgaggcaggtgggtcactggaggtcaggagtttgtgactagcctgggcaacatggtgaaaccccatctccaccaaaaaatacaatttagctgggcgtgatggcgtgcgcctgtactccccagctactcaggaggctgaggcaggagaatcacttgaacttgggaggcagaggttgcagtgagccaagatcatgccactgcactccagcttgggcatcagaacaagacaccatctcaagaaaaaaaaaaacttatggaatgctatcattctgtcaaaaataaacataatatgctttctgttttaacaaatgaataacttaccattgtaccaccctaagttaccaggaaaactaccctaaattaccaataaaattgttcctcctatctttctcctctgcctctgctctacttcccttcaaaaagttctttactccacaatttccccaaacagaaaattttcctgattctcctatccctctgttctttctgtcactctcttcaagatccttttcctcttctatcccaccagcatccccctttgattctctgcctatattctccttcatcttgattcactccttcacagctcatctgcttccacaagatcaactaacatttccatactgatgaatccccaaagaacatttttagcctttatttttaaccagtctctgattctgtatttccagtttccttcaggatatgtctccttgaatgactggatacactattagaattcaaaacttctagtttctctacatcctcctaatctccttgtatataaactcaatacttggggacatataattatcctatgtaatcctaacaatctaaaatcttcaccatttgctagtccttacacccagaatgaactatgttatctgctttatgtcaccacaggatgctaaaatgttattgaaaatagccactaaaaaatgtagcaaatgtttctaatacaaactgatgagttcacaatattctatgagtaaatataatagagttccctctattttcctactagacatctgtttctgatttttcaatattacaaagaaaactgttatcttatcattatacatattttcatatttaataatatctccttagtgtagcagtccagaagtgaaattaatggggaaaaaagataaaagaattgttaaggttcttgataaatactgacaagcttatttccaaaacaatattatcacaacgttagctccatgagtgcaggaatcttgtcccttgtgcatatgataggcactagtaatacaacaatgataaacagtaagcattcaataaattttatttaaataaactaatcaatcaaccaatcagatctatgaaagtacttacaaatgataaacaaacattcctttatatctttattatatcattatactatatttacttactccccctttaagagtaaacatgtcactgctttgagcaatgaaatacaagcaaaagtggtatgtgatacttctagtcaaaagtttcaagtgccatttatcatgtcctttccctctgtcacagcaacctaaatgacaggcaaaagtttctgttactattatatatcatcgataatttcttatagtaaaatatagcttttcccttaaaacatatcctttttactgatcagaaattcaccgggaactccctcttcagtgcagggggatcctatggtaggaggattacaagtgtgcactgtcattcctaagaaagaatatggagcaataaaggaaattgctaaagtctggaaagcattcttggctttctgctttgaaatgaagctgacttggaaaatcagagaatttgaataaagttatcttagatttcaatgaaagaaaaatgcttcatggagtagctctttgtattactgcacctctagaggccccagaagacaactaaaaaccaggcaatatgctttattttgaaattcagctgtgtgggctgagatgtcaccttagcatgagggtcaaaggagtacagggagagagggtagccagagcctcagtcacaaattgtaactcacacttaaactcatttgaaatgcaataaacaaactaaacagaataagcacacaactacttgggcactcgaattgagttttttaagaaattttaactgttattatctaaatgctattagataaggaatatttctttcacaaatacagctgaacacattgatgtttaagagttttagtgcaaattccaagaactaaaagaaaatagaggaagacaaattagaaatgagaagctaacttaatgccaacaaattaacctttcagaaagttagaaagaaagaacaaaagagtcaggctattttattattgttttgtttatacttcataagcaaaggtattcgtgggagattttttaataaatgttttccttgtctttttttttaagtggttaaagaagaaaagttaactaggagaagataggaatgacagcagttatttgcaaatttttccacaaggaaaatcctatcaaaatccttctttgatattatttgtccttataatttgttcccacaattgccaaaaaaaaagattacagtcaggttgcatgattatctaaagcccaacatgatgttctatgtttttatcacaattcaagattactgcatttttcctaccataatattaattaatggtcaatataaaaatatggactatattgaaccccaggcaaaaggaaaaaatacacccacaaaactgtaagactatgacactagtaaatcattattcagcattttagtatagttccttctcatatttttccaagccatgtttttgcttgcttatttgattctatatacatgcttaaccatcttattcatttatttatttaacagcataatctttttccatgttaccataaactcttcacaggcttcactttaggtatggtattccatcaagtgtacattccacaatttatattttgacttagtgctggatagttgctttcaatttttgtaccattacaaataattctgttaggaacttattaaacataagcctttccaatatttcaaattcttttcctaaaatacgttcctcacaactgaattactatatatcaaaaacaataatcaaaattaaaagccaatatggtatctgggatttggtacaaaataatacagattggggaagcagatgggagttccaagtgaagcacatttaatttttttcaaaataaaacattcaaacaaaaaattaaaagcaaaaaaaatcatcctgaaatacacacacacatacacgcacacgcacaggaacacacattctagcaaagatgaaagtatttttatggctcttgctacacattgccaagttgcttccctaaagagttgtaatcatttttattcccaatatatagcttaaggtttatagtgaaggcttttttaactcctcttttctttgaagtctttgtttgtacattgactttggcatgtctctgcaacctactgcaaatttttcctattgagatatgttcctgagttttcactttattctggagactggaaatcgctcttatgatgctctttgctcatcatgcaaacttgattccatgtagaataatagttggataacagtacaatgatttacctacaggaatgtttttcatattgtttacaaggcaaaaatacatttaacataatgtttagtaaaaactggaaacaactgtttctgtatcacttgcaacgtcacagcattccttcaaaatgtatttactgtcatggaaaaaaataatttgccactataatgttgagtttttaaaagtaggctataagattgtttgtatgaacaattccattttatatagatcatacacacacacgtgcacaaacacagagataaaaaaaacctggatgtgtatgtactatagtatcttcttggggagttgataagtgatttttacaaacatctttatacttatttatatatttttattttaataataaatattctaaatgtataatttttaaatcatcaaccaaagtaagactcaaagtataaccagtaattgtttgagcaacttattatgtacacatgtcaatttccagcttgcttacataaatagtctcccaattggatacatcttagtgaatttataatcattaaacaaagtaatgaataacatgatcatcacctgaataagattatttttcttctaaattttcaaaacacagctttgtgcccaatggttttccaaaactgcctcatattaacaagaaaattttggttcaaagtagagattaggaaattaatgaaccaatgaaacacagttaattacatccagaaattaatgatcaggatattaaaacttggaaaatatagaaataatggttttcctttattaaaaattttttttgaattattgtgaatacataatagttgtatttatgaggtacgggtgacaatacaagcatacaatgtgcaatcatcaaatcagggtaactgggatatccatcatctcaaacatttatcatttctttgtgtgatagagcttttcttaactagaagttcaacgataaaatgtgcttacagacctaactaaaaccctatcatgtccacctctaagaattctaatacagttcgtctatagggccctagctctgcccctgccattaagtttgtgtgaccgatggcaaggtctgcatctccaaaatcagtattttacatcagttgatttctaaggtcttcgtggctctgtggctatatatacacttaaaaagaaactgaaaacaaatctgatcaataaagaactttttcatgacatatggtatgttattctgcagggttgccataacataataccaaacacgaggtggcttacaacaacataaaggtattctcacagttccggaggccagaaatctgaaattgaggtgccaggaaggctatgtccctctgaaggcagtaaggaaggatctgttccatgcctttctcctagtttctggcagcctcaggtgttccttgacttgcacatggccatcttctgcctatatctcttcacatcatcttccgtgtgtgtgtgtgtgtgtgtgtcccaatttcccctgtttataaagataccattcatattggattaggacccatacaaatgacacctcattttaacttgattacttctgtaaagacccagatcttcaacttttctgggggggatccaactcaacccataacatgtgacatgctggttaatctctgttgccctctaaatccattccctgctcctttctgctccacatcccagaggctaacctctgtgaactgcatcatccatgcttctttaatttctagcttcaagttggcaaatgggaggcacctgttcaagatcacaagacaacagaagagagaagggagggtatttgttgccactccatacccccaccaggccacttttttggtagcaactacattcagctatccacagtcctatttccctgtccactagccccgctcccataattctagctctcaccagaatgggtaattccattcccacctctttttccttctgccatcaggctatgatgacatcccactgttgctagtccctgggcacttcactattgttcaatggttgcattctgcactaccacccatccctctataatgaagtccattcattaaactctcttcattgtccccattgaatgtaccgtctgtttctcaccaaggccctatctggtacacagggataagtcaattctttagagtatttacataatttgtttatcaaaattctaaaaagtagtttagcctcagcatggctgccacaaattgagatttgaaataattggtagtaaagacatcactttctgtcatatatacatttgctactgttttgctcctttcctccttcacacttatatcttaatctagaaggatatggcagaggtcaggagcatggattgtgaaggcagactgcttcactttgaatctagcctctaccacgtactagattacataagtccagttaatttacctctctgtacactaataaaatgggcataaaggtaataatatacaaggccaggattacaggtatagcttacacctgtaatcccaatactttgggaagccgaggtgggagaatcgtttgaagtcaggaattcaagaccagcctgagaaaaatagcaattaccttgcctctgcaaaatatttaaaaatgaaaacattagccatgcatggtagtgttgacctgcagtcacagctacttgggaagctaaggcaggaggattacttgagcccaggagctgaatattacagtgagctatgaccatgccactgcactctgcctgggcaacacggcaaaaccatgcctcataagtaaataaataagtaaagtttacaagtcacaggacagctatgtgaaatatatgccaaattacttacattaattttttaactattaaatcaattaatctatataaagtgcttagaacaatacctggcttgtagtaagtgttctatgagcattagctgctattattatgattaatttttcctctgatgtttttcccttgacctacacattaagtcactctagcctcaatcatttttacacggaccctacccaaccaatcaaatgtatgctgggaatatacaaaaaacacagccaactcttttttattttattttattttttcccgaaacggagcctagcttgtcacccaggctggagtgcagtggtgcgacctcgcctcactgcaagctccgcctcccgggttcacgccattctctcgcctcagcctcccaagtagctgggactacaggcgcccgccaccaggcccggctaattttgttcttgtatttttagtagagacaaggtttcaccgtgttagccaggatggtctcaatcatcttctgaccttgtgatccacccgccttggcctcccaaagtgctgggattacaggtgtgagccaccgcgtccggccaacacagccaactctttaaattttcctatgtaaactacccattgtccaaaagatcagtaacacctgtcactcctgccataatgggctctctgacccctatatggtgtacatcctaagtcctcaagtgttttatttgcttacgacgtatttttgataattctgctctcagtcaagattctgataaatcatcaatcccctacctgggctatttcagctatatgtcaaacactacactcccactcacttcctggggtctattccggcttttaaaagacagttttcaaacccctacttcagccaaagaaatggtccttaatagtgattttcctcccaaaatatgtgtacttagttttgtttaattgtttggggatggggaggggtagtagtgtttgagaccaggtgtcactaaaaaaaaaaaaaaaaaaaaaaaattaaaaattaaaagaagacatttatgcagccaaaagacacatgaaaaaatgctcatcatcactggccatcagagaaatgcaaatcaaaaccacaatgagataccatctcacaccagttaaaatggcaatcattaaaaagtcaggaaacaacaggtgctggagaggatgtggagaaataggaacacttttacactgttggtgggactgtaaactagttcaaccattgtggaagtcagtgtggtgatttctcagggatctagaactagaaataccatttgacccagcaatcccattactgggtatatacccaaaggattataaatcatgctgctataaagacacatgcacacgtatgtttattgcggcactattcacaatagcaaagacttggaaccaggccaaatgtccaagaatgatagactggattaagaaaatgtggcacatatacaccatggaatactatgcagccataaaaatgatgaggtcatgtcctttgtagggacatggatgaagctggaaaccatcattctcagcaaactatcgcaaggacaaaaaaaccaaacaccacttgttctcactcacagatgggaattgaacaatgagaacacatggacacaggaaggggaacatcacacactgtggcctgttgtggggtggagggagcggggagggatagcattaggagatacacctaatgttaaatgacaagttaacgttaaatgacaagttaatgggtgcagcacaccaacatggcacatgtatacatatgtaactaacctgcacattgtgcacatgtaccctaaaacttaaagtataataaaaaaaattatcaaatttagtcgctttttaggaaagggtaaggagttggggagagaacatgggaaaagaaatcctcattgatctttgcaaattataaaccatctttttaaagtaaaaataaacacacacaaaacttatttaaaaaattcccttacttggcttagcagaaatatacctcagttacgataactataatgaacaaaaagtgattactgttactgtataaaatggccctgagatgtagttatgtactatatctgtgtatttatataagtacatttatcaatacatcagaaataactagatctcaagaaaggttcaacttagaaataagagtacagtaggccatccatatctgtgggttccacatccatggattcagccaaaagcagatcaaacatatttgggaaaaaactgtctgtactaaacatgtacagacattttttccctcttattattccctaaaaaatacagtgtaacaactatttacatagcatttacattgtattaggtgtcctaagtaatctggagataatttaaagtatacaaaatgatgtccataggttatatgcaaatactacaccattcacatcagggacttgagcatctttggattttggtacaattgagaggtcctggaaccaattccccatggatatgaagggacaactgtactaagtatgagctaagagtagtagcaggaaagttcataagtaaaaaaccagattgaccaaatagcagattaaatcactgatcagcagaagacccaagtggtcaaaagcacagcccctgaggcgagaaggccctggtgtaaatcctcaccccagcacctactgggtgaccttgggcaagtcacccaatctctatgtgcctcagtttcctcactgtaaaattacagttcttacctcacagtgctattggaaagattaaatgaggtaatatatgtaaagtatttagaacaattcctgacacatagtaagctcttaaaaacttttagttctaaaatttccaattctatatacagtccagaaatatattcagttctgtaaagatggtattcattttaaagggaatattttgttgcagtttttggcttcttttctcctacttatgtgagtcacactgctcatactcacttaagcataatacaagtcattttacagaataaatgttcaaagatggctggtatgtatattgaaaacaatatgccaactcctgagttcatgtctagacttcctcgggattacagagacggtaaggttaattacccttttaactatgatcattgtttattaccttgctttagttttgagaaaaggacaaaacattctgagtatatgcaaaaatattctagttgacaatatattcattactgtttatgacctctagtattctttcaaattaagtaattaagtatttaaacaaacactcccgaagtagaagcaaaaatcactttctcagactatttagcacttcttaaaggtctccaagaagtagtacactccaattaatatttatcctcttcctcagagcatcgatgcttacactgcctaagggaaacctgttgtcagctaaggcaaatgaggttaataacaggatttggctaagaagaaaaatatgttgcactttagagaactaacatctcatctcatctcaaatacgctaggagaataaagaggccaggaaacaaccaattgtaaaaatattagtaaataggtaacaattaaagtcattctttctcatcccaactagatatactaatggccataattactttttacttacattagtattacctcaggggatctattgttttcttataaaagtcagctgagctgtacagcttaaccaagataatctgctatattagtttccaagtatagaaagcatatgtgtaaataaaacatacatccctcattgttacctggatgttattaacccttgcttcccaacaactaaaatatccacacagggatttacttacaaaaaaaaagaaatatgcttattaacctaattatgggtatcacataaatacattgtatttgcccatttattattattatagcaaggctgtaggggccatactatccatattggatggctagtttctcccagtagccatcaagaagcctaaaatttcatcatttgaaatatttttaagtcttgacttttagaggagagagaactataaaagagaatgtctagagttaaagatagaacagcagtctaggactcatatgcaatataagaagaaaatggaatcagcagaagttctaagcaggaaagtgatattatccaaatcatgttggaaataaatctgctagcaatgtggaaaatgtactagagaaaacatatcatagtcaaagaaggagagatctatgtggcacctggacttagtaaatggagaaaagaaaaatattcaatagatatttttcaggtagacccaaaaagactctgtgtctaactggatacagatgataagaaaaacctagaagttaaagatggaagtgactctaactttgacttgtgactaaatatgatggcaataatcaaaatagtaaccagaagaagaaaaaaagtttggtatgggctaggttgggtttgagaagtctgaggaatatcatcatacacatatatccaatggagagctaaaattacaggtatgatgcttcaaaaagaaatcaggtaggcaagaagttaagagcagtggacaaagggaaaagagaagagggccatttctgagggctctgttctgttccactgatctatatctctgttttggtaccagtaccatgctgttttggttactgtagccttgtagtatagtttgaagtcaggtagcgtgatgcctccagctttgttcttttgatttaggattgacttggcgatgcgggctcttttttggttccatatgaactttaaagtagttttttccaattctgtgaagaaagtcattggtagcttgatggggatggcactgaatctataaattaccttgggcagtatggccattttcatgatattgattcttcctacccatgagcatggaatgttcttccattcgtttgtatcctcttttatttcattgagcagtggtttgtagttctccttgaacaggtccttcatgtcccttgtaagttggattcctaggtattttattctctttgaagcaattgtgaatgggagttcactcatgatttggctctctgtttgtctgttattgtgtatatctacaactatctgatctttgacaaacctgacaaaaacaagcaacggggaaaggattccttatttaataaatggtgctgggaaaactggctagccatatgtacaaagctgaaactggatccctgccttacatcttatacaaaaattaattcaacatggattaaagacttaaacgtcagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtcaacaggcaacctacaaaatgggagaaaattttcgcaagctactcatctgacaaagggctaatatccagaatctacaatgaactcaaacaaatttacaagaaaaaaataaacaaccccatcaaaaagtgggtgaaggacatgaacagacacttctcaaaagaagacattaatgcagtcaaaagacacatgaaaaaatgctcatcatcactggccatcagagaaatgcaaatcaaaaccacaatgagataccatctcacaccagttaaaatggcaatcattaaaaagtcagggaacaacaggtgctggagaggatgtggagaaataggaacacttttacactgttggtgggactgtaaactagttcaacccttgtggaagtcactgtggtgattcctcagggatctagaactagaaataccatttgacccagcaatcccattactgggtatatacccaaaggactataaatcatgctgctatagacacatgcacacgtatgtttattgtggcactattcacaatagcaaagacttggaaccaacccaaatgtccaacagtgatagactagattaagaaaatgtggcacatatacaccatggaatactatgcagccataaaaaatgatgagttcatgtcctttgtagggacatggatgaaattggaaatcatcattctcagtaaactatcccaaggacaaaaaaaccaaacaccgcatgttctcactcataggtgggaattgaacaatgagaacacatggacacaggaaggggaacatcacactctggggactgttgtggggtgggggggaggggggagggatagcattaggagatatacctaatgctaaatgacgagttaatgggtgcagcacaccagcatggcacatgtatacatatgtaactaacctgcacattgtgctcatgtaccctaaaacttaaagtataataataataaaataaataaataaataaataaagagaagagggccaaaaaaggaaccagcaaagcatacaaagctaaaacagaaccaagaaaaaaggatgtaatatacaacaaagggccagaaaacttcaaggaggaagaattcatactgtccatttctgctaagagatgaagaaacatttgtatcgtggccattggatttagcaatgagaagatttgagaatttttccaaagagtttttgtagaatattagagatagaagtctgattttactaaactaaggcagtaagtgacttaaggaattgaagaggactcacagatatttcttcccagaaatatctctttccagatgtttggaaataaacatcagtactctttccagatgcttggaaataagagcaaaatgtactgatttacccgcaaatcttgacagattctagggaatgcaagtctctgtcattattgtatagaagagaggagaaaacaaaaggtaattaaagctgactctaaagtctctaaatttgattcatgggtatagatataaagattccataactttagcagcaaggtccaatacagtagccaaaagccacatgtggttactgaacacttgaaatgcaactagtccaaactgagatgtgccaaatgaaaccaacaccagatttttaagaccttatttcgaaaaatgtaaaatatctcattaatattttaatattaattacatgtggaaatattttagatctattgggttagaaaatattaaaattaaaattacacttgtttcttttctcacttgtttcaaagtgttagtagacaatttaaaatcacatatatggctcacgttatatttcttttgaacgtccctgaacattcaaaatgttatcctctagaataaatactaaactggaagaacaggattcagaaaggttccatcacagccagcctatatatatatcatattagtgtgaaagttaatgaaggggacacccaggacaacatcatgactttaagaaaataaagtcctaactaattaagtggcttactcaggtcacctagctactggaaacaaaacccagactagaacctagtccgtgggtatttcctctattattccacctcttgaaatgtcagtgaaaatttaactgttatatacgatcttattctgtaccacattcaataaaatgacttgtaaaaaaatcttaaaatcataatctccataagagtatcctttgttcaccagtcaacttgtaatttaactaatattgttaacgtatgtcaactcacgattcagttttgttgtgttttactttgggcatgtatatatatactctgaatttatttcaaccaattccacatgaattttaaagagaatatcctcctttcaagtacacatctctttaaaaaaaagttctaagaaaacatatctggaaaagttcagagaaactactctcaaccattattatctgccatttgatagtggtaacttactaaggcatcatgttgctcattaatgtaatattcatacaaaattaaaagttatattcaaaatatagctatagtatatgatgatatactgtatttcaaattctggcaagatttaaaatcctgctttgcccaataaaatcttcaaagacactcaaccattatgttgtaggtaaaccacagttccagaatcaccaataattgtaaccaaccaaaatatttagctgtaatttcttcaatatactccaacaactataaatgtatttatgcttttcattaagaaaagacacaattatttaaaaaattagtcttttcatgctaactttccatgtgaaattgaaaagtaaacatcacttgaaactttaaaacttaattttatgagacatcttaataagctaataactgttgtagtcatggtagttatttcctttgtagaaatactgctccaaaaatagtgctatgctgagtgcagtggctcatgcctgtaatcccagcactttgggaggctgaggtgggtggatcacttgaggccaggatttcaagaccagcctggccaacatggcgaaaccaagtctctactaaaagaaaaaaaagaaagaaaaaagaaaaaaaatgcaaaatagtgctgataaaaatgaatgaagattatttgattaagcaacatgcttaattttgtacgtataccctatatttattttaacaaataaaactattattgtcattccaaaatgacattattaaaaataataaaaataaagaatatcagctccacttcttgaatatttgctgttatttcaatgttatcacatagataaaaggatggtgaaaatctagctaatagagttagctatgcacagggtgactatgcttccaaagaggagctttccatggcgatctgcatgtcttcttttctttgcctggctgtttgtggcccctcttcacataactggagttagtgtattcatctattccaaagttattccatctggactcctatgtggcagcctcccccaaaatacaaaatacaaaaaaatacaaaagtacagagccagatgtcactaagacctgagctttaccacatccttaaaagttttcaagttttccttggttgtatatgtccctttttggcttactatatagcagatgctaagtgtcccactgttgactgttcttagcaaggcgtaatccagcatggagctacagagaatcactgctccttcaatactggcagactgaatgacattgttggtgtttatgtcaacctacttcatgttaagaataactgacagttgatagtcatgacattgcataaacatctgtggtagattcaatatcaatattctagagaatatttgcaataagcagcatttaacagcatttgttcagccactatggaaagaagtttggagatttcttaaagaacttaaaacagaactatcatttgacccaccaaacccattactgggcatatatcaaaaggaaaataaatcattctaccaaaaagatgcacacactcatatgttcatcacagcactatgcacaatggctaagacatggaatcaacctaggtgcccatcaacagtggactgaataaagaaagtgtggtacaaatacaccatggagtactacacagccataagaaaggatgaaaccatgtcctttgcaacaacatgaacgcagatggaggccattatcctaagaataaattaatgcaggaacagagaaccaaatattgcaagtactcacttaaaagtgggagctaaacattggtcactcatgaacataaagatggcaataatagacactggggactacttgagtggggagggaaaaagggggaaaaaggttgataaactaactattggctattatactcactacctggatgacgggatcaatcataccctaaacctcagcatcacacaatatacccaagtaacaaagtgcacatgtgccccagaatctaaaataaaagttgaaattactttttttaaagtccacaatatgataaagtgtgctaaggaatcatacctccttgaaaataactaaaaacatcacttctcccatttataaagcaaaagtgaatattcaaagataactgcaggaggttaagttcattagccaatattcccctagcacctaaggcagttttccgcttttttttttcagtatgctcttattactgcctaattatccatattgcttttcttcctttttgttaaactgaaattcacccaagcagtttaacctttcatttagaatcattaaatacactcccctcccctcactgataattggcctctttctttattaactgatttccccccttgatttattacaaaccttttttgccaaatttggatccattctgttaatacattctttaccttcttgcaactcaattaacacagtgtcattgttaccaaagctttcctattatttcttcaagttcttattgctctttaaagatcatctagtagaataatgaatttttaataaacccggaatattttaatgattcttacttaattctatggtaaaatttatgtgagacatactattcttcacactgaaatgtttcctactgtactgtcataatactatacggtaactttctagcaatccaaatacacaaatccttgcaatataacttatgacttctaaaagtacagaaagccatattataattatcatatccatagctaaatcaaaccaagccagcttcttcaacagcagttccaacatccatacaatttttaataaagtgaaacttatacttgtgccatcagtaagtattaatgtaacctctgagtatgagtaaacctgtcactagattatgcaaaggaataacctttcatgggcccttgaggtttctccttaatggaaataaacaatttttttaaaaggcattcctgttctcttcttggaaagaaatactttcctgagctccaaggcactgataaaatttggtgggtgtcgttttaaggcctttccctttcttatcagctaccgacacatttcccagccttgccacctctactcaccaaaacagtgccttttttttttctaaaaggaaaagaaaaatgaaaggtatctactgaccttggatcaaataaggttatgtttaagtttagtttagagatttcttccacttttccaagacctaaaatatgaagcagaatatagactatggtatctttatttagcaagaaccagcggacactgtgtttaccagtgggaaacacatcttaagttgacaagagatatggagataaccagaacaaaattaaccattagaatattaaaaactctactcccagaataaattacaaggaacaaagaaacaaagatttctaccactatcttattttgagtaattttaaataaataggaaaggattttgatctcatccttctgtaaaacgtctacctgccaacatttatgtttgcaattttcaataattgcaactacagacataatctttataagtatatattcatttgatgtctttcaccaataaagacctggtgttccaagtctcctatctgttccagaatttctatttcatgtgccaatatagctcttctttaaaaaatttcaagtcagttttgactccaactttaaaactatgcaacatagttttctgatatcctgagggattaattcttatgttgaacttcctaacaattccattttgatccctaaagctattttcatgcattttttaaatgaaagagaccttaaagatcaactagtctgtacctcttattctgcagatgatgcaattgatccaaggaacagttaaagtaacctgtgcagggtcactcagccaattaaaaatgatgcaactcaaagtagaaacaagatgtcccaaagcctagacccatagtcttgcactgaagaactggcaaatagaggctttcagatttgtttcacagaaaagaaaataatactttttaaattagtcaattatgtaaataaaatcggtgttttcaaacacttaataatcttttgtaaaagtacatttccttgtacatagtaaacgtggttttagaactgtttgtattttttattgcttaagatgattttctattggcactgtaacaaattacagcaaatttggcggtttaaaataacatttgtttattatctaacagctctcaaagacagaagcctagtaggtttggctagatcctcttcttaagatctttcaaggccaaaatcaaggtgtcagtgggactaggtccttctatagaaatcccaggataatctatttccaggctcattaagttgttggcaaaattctgtgtagttgtaagaccgaggtacttgtttccttgctgatctttgattgaaggttattcttaccttctagaggcagcctgctttcctctgcccatggcccctgaatcttcaaaggctgtaacaatgtgttgcatccttcttgtcctttggatctctcacttcatatgctgcacttccctaactactacttctgcctctgtttctaagggctcatgtgattgcactggacctacatggataatccaggataacctttattttaaggtcaactgattagtagccttatttacatctgtccctttggcaatgtaaagtaacttattcatggatatatcatcttattatattcactatccagggaattagagcatggaatctgcttggaaaccaaagttctaattattacatttagctcatatttattgatgcatccttaaggaaatgtgactggttttctacagatcacgttgttcaaactctaacaaaataaataactttgcattcctaatatttatatatccatttccaggaatggctctgattggccctgcttaggtccagtgcccacccctctaccaaccaccagggctggcttcatggcaatgtgaccagtgcagtcacacataatcctgggctcagaagggaccccacatttggggcttaatgctctgaagctaccaacttgaaattcttaaccctttgaatttgttttgtacatgaagtccaatagaacaattgagcatgtgccaggggcttgtttgtctgaaaaagaatgcatttctctttcattttttaagaatatttccaacaggtacaacattctagattgacattttttttccttttaccactttatagagatgtcattcagttatctcctgtcttctatcagttgaaaagtaggctatatttttgcttctttgaaggaaatgtcttttttcctttgaagacttttatcggccggacacagtggctcatgcctgtaatctcagcactatgggaggccgaggcaggcagatcacctgaggtcaggagttcaagaccagcctgaccaacacagagaaaccccatctctactaaaaataaaaaattaaccaagtgtggtggtgcatgcctataatcccagctactcaggaggctgaggcaggagaatcgcttgaacactggaggtggaggttgtggtgagccaagatcatgctattgcactccagcctgggcaacaagagtgaatttctgcctcaaaaaaaaaaatagacttttatcttctttggttttcagtggtttgactgccatgtgccctaaatgtgctttcattgtatttattccaatagtgctttttcattctgtggattgatgtctttcattgattttagaaaactcttggcctgaatctattaagataatgcttcttcctcaattcctactctcctattctcctgggactccaattagatggtagtcagccttttccactattatattatttacactattgattgtgtgttccattcttttattcctcccatgcactattctatatattttctaattgacccatcatccagttcactaattctttcctcagctgtctaattttctaataaactaatctattgagttcttcatttcagtcacagtttttatttctagaatttctttaaattatttttatggattcttattctgtgctgaaattatccaccttttcatcactttaaaaaaatattgatcataatttttttctgtttttggagagagggtcttactctgtcacccaggctggaatgcagtggttagaccatagctcactgcagccatgatctcccaggctcacattatccttcctcccatctcagcctctgtagtagctagactacaggcatgcaacaccatgcccagcttttgtttgtttgtttgtttgtttgtttgtttgtttttggttaagtagagaccagggaagtcttgctatgtcacccaggctggtctcaaactcctgagctcaagtgatcctcccacctcggcctcccaaagtgctaggattacagacatgactcaccacacctggccaattacagttatttaatagtccatgtctaatcattccaatatctagattactgtgagactgtttctatcctttcttgttttatattgtttttcttggtcctggcttctaatatgcatggtataattttttattaaatgccaagtgttgcgtataaaaaaattatagaaactctgcatgatgtctcttgcttccagcaatgacagacagttgaagtaaaggcagaccaccttaaaatcaagattgggtttatcaaagaatacattttgatttttgtaagtagtggcctatttatagttcttcctaactcctaggatatagccccacaagaattccaatgaaaagcttagagtgttttaccagggtccttcttcctccttcctgaattttagcttgcaggcactgtgaaactgccaaaagttctgctcatcctgtcaccatcttagctattgctgcttggtttctcagcttggcctgtgttgcttgcaaattgacagaacccaaggtgaaaaatgacaccaaatacagggctcacttcagtgtgtttcctttcattcttagatctttagctcttggtagtgctccaatgcctttagatatatatatttttctaatccagtttttttcattattcacagtgtaggccttagtttgaaataaactagtccatttacagccagaaatagaaatcagccactgactgatctgtggcctatctttatgtatgcctctatatcttattaattccaaaagtatttaagataagttgacacccttatatgacggttgatttgccttgtgttctatttcctgcttgaaacctaaactgttcactactctaatatcctaattaattttgttgtaattattatgtaaacttacattcaaaatgcttctcctcgatagctaaatctgactccttacatataatatttaacgtgtatttgggaggtcctttgcaaatgccgtcttgtacttactcatttttttaaatataagaaacagcattctcagagactagattatttcagagtaaaaatgaaaacatttataaacataagcactagtatttaatagaatgttgcctgtataattttgttctttgaaaacttatagttacctctcaaaggatataaaatttataaaacaggatgagcagaagctatgtataactcctatggttacattaacacaaaatctcggtaattcaaaattgaaatttattaaacatttctaagatgtaatttgtctctgaactaagaaaatgtcttattacataattaagtgtataagcattgtgaaggcagtttatcctactttaaaaaataaattgctgttaaggactgtcttaaggataccaacttttttttttttttttgagatggagtctcactttgttgcccaggctggagtgcagtggcgcaatctcggctcactgcaagctccgcctcccaggttcacgccattctcctgcctcagcctcccgagtagctgggactacaggcgcccaccaccacgcccagctaattttttgtatttttagtagagatggggtttcaccgtagccaggatggtctccatctcctgacctcgtgatccacctgcctcagcctcccaaagtgctgagattacaggcgtgagccactgttcccggccaaggatatcaactttttgtatggctatgaacagcatttaaaaatcagtttaatctatatcaaataataagaataataatacctatactatctcattttatttattttaaaaatgtcacttgtacatatacttagtaatgactgcaaattactatggataattgaaagtaccaaaaataaactgcaacacaggatttccctccccagcattttactgtcaaaaaaaaaaaaaaaaaaaaaaaaactggaaacctaggtacttcatcctccctaaagaatctttcataaaagtcatggtctttctacatttggttcctaaatgtactacattaactacaaactcagaaaaatgtttggccatagattttaaaaattgggaatgagtacagatagaacagataagtatacacaattatattttcccagctcaattgataactggcttttaatacaattatgggtcattattcagtattattattactgtggccaaaacatgaaattccatttttagcaggttccaattaatttccttggttggtcaaggaacctttcaagatttacaagcactcaagacacaaagcatctttcgtttttcttttttcaaatgctctattctatttcatctatttcccttgctcaaatctttatgactctttgttcatacttatcgatagagaagcagccaccacactggccatctatcagaaagtggtaatgagtttagcatgacaaaaaccagctgttgaaactgctgtattatgcacactgtatgttcataatacagtaatattgctattaatgaagagactgctatgtatttcaggaaccactgtatcagaaattcaactacagaaatgggagtaaaataagagatgtagacataccagggccagaatgacttctttggtgagaatcaatgttattcaaccatagcatcgtaccacattatatggagacattataggatgatggttaagacacagctttgatgtgaggcacttcaagcctttgctctgccacttattaatatttactatgtccttaagcaggttatttagcctctctatgctttagtgttctcatctataaaaccggggataacaatacctactttactggtttttcttaataagaatcaaataaaagtgaagttagaactcctaacccagtggctaacaaaaaaataagcagtcaataaacactttaaaaatattatgttttttttttttctctccatagattatgtgtctttttctctctgcctttggacctgatcactccgacactcttaccaacaccaggtgtttattacctatctttagaagtctacctttgcttcataggaactaccttagtgttttccatctcagactttgggattttatcttagttcacttcagacatactccagggatacagcagtgtacaatgggaaaagatttagacgtagtgttatcaaatagaaataaaatgtatgtcacatgtgtaattttacattttctactaggcatatttaaaaaggaagaatcagccagatgcactgcttatgcctgtagtcccagccactcaggaggctgaggcaggaggatcacttaggcccaggagttcatgcccagcatgggcagcatagcaagacccaatctcataaactaaaactggaagaaaaagaggaaaaagaaacaggtagcattttagtaatatatttatttgcatgaatatatccaaattattatgattttaacaagcagcaatcaccacatttcaagtgttcagtaactataggtgcttgctatattagacagtacaggcttagagtcaaatgaatgtggattcaaattctggccttgctttttacttgccatgcacttgctgtaaatctgtttcattatgttaaaaattactatctccagatattgtgagaattaaataaaaacagcatactcaaagcacttagcacaatgcttacttacaggcatgctcattcaatgagaattccctcacaccaaccttctactatagaactgaacactggctcaatacagtgaaatctgtgatccagattaagaggaaaggaagagaaaggaagccccccatcgtccttcctttctagctctctataaactgtggccatttctcccactcacacagctctccttctttgcttcctagcagctataaatttgactcggtagacttatttctagaatccctgaacccttgtagtcatgacccaagtatgtggttccaagaaactaaaaaaaaacccatgcctgaaagagaaatcctaccatctctttcttctctgcccctgtggtatccacctccccagctggccctactgcctagtcagacagagtttctcctttattcaggggttctcactgctgcagcttcctcagcctcagcaactgccattaacgttagtgcttctctattgaaagagagtctggcatcaaacattaaagaggctgagcagcattctgcaaaataactggacagtacccttcaaaagtgtcaatggcataaaagacaaagatcaaggaactggcatatactgaaggtgactaaagagacataaaaaataaaaaatgaaaatatgggatcttgagtaggatcttggcccaaaaaaaggacattagtgggaaaacaggtgaaatctgaataaggtctagacctattcgtctaataagattagatctaataatattctactgatgtcaatttcctggtttcaatacttgaactatggttctatataatgttaatattaggggatttgtgggaactctctacactatttttgcaacttttcttcaaaacaaataaaagtaaaattaagttaaaacacttttaaatgtgattatttaggactttattatgaaagaacctctgtcccgatggacttgttaagtgatatattattgtgaaatagtgcaacttatgttaagccaggaaggccatcacacaggttaacgaaaagtcaattccaaggtatagaaaattcaccttactcaccactatgagtttgtaaatcactaagagagtatgatgccacctacatatactatagtgaggacttgatgacagcaaatcatattttgtgcaaccaataatgttattaaataaatgtagctactgaataacatacttaaacaataactccactgtgaccaactttttacagaaagaaagagacagtgaaaaataagaaagatatgcaaaaaaataatatgcacccacctccctctgccagatctcccatgctttaggaaacaacactggtcaaccaactctgaacaaaaccccttgcaatagaaaggacagtctgctttgctatatatgtgtttctgtaacatgaattaacatagacaattggtaagtggagaaaagatttcagtgtaatgcagaagttacattggttcctatgtaatttttttcccagatgattaatgttttgccttattagtacaggcaactgaaggctacgtatactaatggcagcaaaccaggaaggaatcagtattatacattcagcctttctctgagaagtgctactgcaaagttaaccctgatctttgtttataaataactaaataaataaaacaaagtaacacaaaacaatgaggagagcatacaactctggtatcagtacattttgtacaaagcttacaagcttttctctatttatgacttgtaatgataatgtctttctgcccttgcatccacagacagcctcaacccttccttataccacctaccaccaagctatcttcaccttttatgttttaagtaaaacactacttttactgcagtttaattattagaaacttcatgtcttttaaactgtgttagtatttttattgacattgttattgttttcatcagtgctctggttataaagttgaataagccctactgatttaagtaagaatttggaaactgcaaattttccagaaaagcacacataatattatagtagaaatggtgtattaccacacattctgaatacattgtctcaagatttttttaatataaaaaggttatactggtttgttttcaaagattacttatttatcaatgaagtatactgttaatatcaatttctaaacaaaattacgaagtgtattttatcatcagctttaaatcgaacattttaatatacacttctgtatgtgtcacacatttcttaaataaataggatgttccaatgtagtaacaaaaattatcatctatgttaaaaacaaactgatgcattgtataagaaaagcaaatattcaatatttgatataaattaaatgtatattatgaactgcaatcaaaccaacatcaatcttctaaaatgaagcagtttctaaattgtatgaaaatacatggatatggtctagaaagcatgtttcatcataagactaaaaagatactttttattaggcagggtctcactgtcacccaggctggagtgcagtggcacaatcacagattactgcagtctcgacctcccaggctcaatcgatcttcctacctcagcctcccaggtagctaagaactacaggcacgcatcaccaaacccggctaatttttgtattttttgtagagacagggtttcaccgtgttgcccaggctggtctcaaactcctgggcttaagggatccacacaccttgccctcccaaagtgccaggattacaggcctgagccacctggccctgacctaaaaaaatactttaaataatgctaaagaagaatttagcatcagattttttgtttctttctcaaagcaacaatattgcttcacgatcatctgttgttaaatatataatactagtaactaagcactcttttatgtaaatggctcctcctaagaacaagcacatgaaagtttgtgttatttgtacatgacaaagatatagcacataactgagtcattaaaaacacagttcaggccgggcgcagtggctcacgcctgtaatcccagcactttgggaggccgaggtggatagattatgaggtcaggagatcaagaccatcgtggctaacacggtgaaacccgtctctactaaaaatacaaaaaattagctgggcgtggtggtgggcccctgtagtcccaactactcaggaggctgaagcaggagaatggcctgaacccaggaggcggggcttgcagtgagccgagatcccgccactgcactccagcctgcgcaacagagcgagactctgtttcaaaaaaaaaaaaaaaaaaaaaaaaaaaacacagttcaactggaatagctataatttatatatcaatcccaatttgaatagaatatttttgaagttaatgtatataataaatatcaatcactatgaatatttatataaaatagtagtgtgctctttttaatatactccatgatatggtaggatacttttatggacccatgcaaccctgaatatcaagcagccctgttttatttttcaattatctatttaagtccacttggttagagatagtcagcatgtttctcacgggaaaaaaaaaatactgcacaattgtctgcgtatagtgtgacctctttcacttgggtgggtatcctttccatcaccaactaagtgaggatataaccttgtcaaaccaaaggcaaaagaataataagcatatgacaggctaacccagcatggaaaaggttgtttaggaggttgcaaaaatagtactcggaatgacaaaataaaagtacacttcaaagagcaggttaatatttttaaaagcactcaaaacctgagaagcatttaatccccctccttggatgtctgccatacaaaactccacttgaatttatttcattagtcactaacgagatttggttaatatgttttcaaatgaatactggtagaatagtctgaaagaaacacatttatagaatatctatttccacaaagcactagccaaaggtaagtacaaataagcagatgatgtcttgcttttaccaattataaattaccatccaacaagaaaaaaatccttccaattcaagaatcagaaatacaaatgggaaaagtatttacccagtagcaggtttttactgtctccaaatcaaatggcagtaacactgctaccttaattgctacccctaactggcataacagggaatcatactacaacatttttataagtatttgaaaccagaagaaattagacaagtttggctacagtcttcctagtgtaaatttacttttaaagcaaacaaacaaaaatctccaaaccatttaggcctgtcctaggactatgtattatatcattgtgtcagttatacacactttgacattccttttctacattaagactggaatgaaatttttgatcctgaccagtcatcatattataacagtgaaacagtgccaccttttggacccaaacagaagcatccagtgctagtctttcaaacttcctttttcagttaaactcctgatgtacataaatgtcaatgattttcatgtcataattatcaccttctaggaatactttttaatctatacaaaccaagaaaacattggggtaacaaaaaagttgcttaccaagatgcaaaatttcaaaatattccaaagtagtaccaaatgcatgtatttttaataatttctaatcaacatttcattaaatacatttcaccaaatccaaatatgttagtcaactaacatattttaaatgcaaaaaattctttttatagcattgttacactgcaaaattgattttttaaaaatgcattgtatttaacatgtattcaatttaataattggcaatatgatattaacagtggattaccagttaaatcagcataagtataaataattttatatacaaatatagtatgcttctgagttacttacaccaatgatacaatgtcaccacggtgtacttcaaaattcctcactttccagtggttcaaaagcaccacatcagatgactggctccccccaggattcaaagaaggctagaaaataaggagaaagagacacttctatcatttgtatttttcaatcttcatggttcttgcacttcacagctcgagtggactgaaataaaacatttctaatacagtacctttctataaattgctgttctaaagtaactgcaaatgatgagttttcaaaaaggctcactgggattcttcacagatgaaccagaaaaaaataaattaccaatgcttatttgaaaggaacgtgtgctagacattaaaatctttagtaaactccaataaagaggtatgaaaagccttaagaataatataaaaacatgaggaagaagtgagtcaaacctcctaacaaaatatccagataggatctaattccacagtagtacacatcattgttccatctggggaaaagaagaaataatcccaaatcacagtcatgtccacaaatcttcacagtcatatgaaaaactgaagggggcaaaagaaagatgtgataggattaccattataaaatgtatggatttcccactttgacctctcttttctcaaaagagcacatatcctaagggtcctggtcccagtttgagcctaataaggggctttcatcctaggattcagagaagtctaactgtgcctgagggttaatggatcaagaactgagaaacattttgtgtaagaatttttctaaaggtcaggaaccatacaggcacaaaaatttgactggggaactatgaaaccagcatacctgtcatttggacaggggtacagacaaagccaatgaataacaagcttgaggcaagaacagggggacaaaataattagaaaagctaagatagccttttcactgttttttaaattttttttcattttttatttcaataggttttgtaagaaaagacagtgttcggttacatgagttaagttcttcagcagtgatttctgagattctggtgcacccatcacccgagcaacgtacactgtacccagtgtgtaggcttttatccctcaccaccacccacattttcccccaagtccccaaagtccaatgtgtcattcttatgcctttgtgccctcatagcttagctcccacatatcagtgagaacatacaatgtctggttttccattcatgacttacttcacttagattaatagtctccaattcctttcagattgctgtgaataacattatttcgttcctttttatggctgagtaatatatatacacaccacattttctttatccactcgttgactgatgggcatttgggctggttccatatttttgcaactgtaaattgtgctgctataaacgtgcgtgcaagtacacatctttttcatataatgagttattttttcatataatgagtttattttcctctgggtagatacctagtattgctagggactgctggatcaaacggttgatcgactttagttatttaaggaacctcgatgctgtttttcatagtggttgtactagtttacattgccaccagcagcgtaaaagtgtttccttttcaccacatacacatcaacatctattattctttgattttttgattatggccactcttgcaggagtgaggtagtattgcattgtggttttgatttgcacttccctgataattaaagatgttgaagattttttcatatgcttattggccatttgtgtatcttctcttgagaattgtctattcatgtcctcaatccactttttttttttttttttttttttttgagatggagtctcacaccgtcgcccaggctggagtgcagtggcatcatctccgctcactgcaatctccgcctcccgggttcatgccattctcctgcctcagcctcccgagtagctgggactagaggcgcctgccatcacgcccagctaattttttttatttttagtagagacggggtttcaccatgttagccaggatggtctcaatctcctgaccttgtgatctgcccgcctcggcctcccaaagtgctgggattacaggcgtgagccaccgcgcctggcctcagcccactttttgctgcggttgtcctttcttgctgatttgagttctgactctccaataatgctaccatgggaagtggccatttctgtggtgacaggaaaggtgccaagcttcctctccgccttcactgaggggctgatgacagcagccagtggagacacaacaacaaccagggcagaagcaaggaaaatagtgaacgcagggcaacagccagtccctggagcagtaatgacgtgccttttgttaaagattcctgggattatttgcagattttctacaaagcaagagttgacaaatatgtcaaaattctgcatggaggctattatcttgacactatttttgatccagggttttgcagctgaaaaatactggttatccttgaacacctcaaacactttcagaactttcaccaactcctttagtgataatacctaaatccctaacttaaattccctgctactcatttcacttaactacctgacaaaaaattcaacaggattaaaatggaatttgttatcatttcaacaaataaatttttttttgagacagtctcttctgcttttctgcctcagcctcctgagtagagctgcgactacaggtgtgcgccactatgcccagctaatttttgtatttttagtagagacggggtttcaccatattggccaggctggtctcgaactcctgatctcgtgatccgcccgcctcagcctcccaaagtgctgtcattacacacgtgagccaccacgcctgccctcttttttttttttttttttttaagagggtctcgctctgtcacttaggctggagtgcaccggcatgatcatagttcactgtagccttgaactcctgggctcagtctcccagttccagttcccaggtagctaggactacaggtctacaagtgcataccaccacatccagctaagtcgggttttttttttcctttttttttttttagagatgggagggtcttgctatgttgagcaggatggtcttgaactcctgacctcaagcaatcctcctgccttatcaaccaaagcgctgagattacaggtaggagccaccatgcccagccctttcttattttcttacatccgggttacccttttcccagtcaaccagtttaaaaacttagttgtcttcttacttctcatccaaccagtcagcaagctaaagggatctttttttaatcataatgtcttctacttctggcacgttttctttcctctctagtatcatcatatttcaagcaccaatcattatgtaactcatgctatatctacactaatcagtctctcacctccaacttagaaatgattccatttctttctagttatatgatcttcagcaagttacttaacttcattatgccactcattactaggaaaatggtgatgaataataactattatctaattaataattaaataataatagccaatacctacgaagtacttaccatgtgtcctggtctaataataatagccagacatgttaagtgcttaccatgtgcaagacactgtttaacagctttacaaatatagttgacccttgaataacacaggtttgaactgcgtgggtccaacaatacacagatttttttcaataaaagttacactgagtgtgcctgcctctcctgcttccctttcccacctcttctacatctgccacccctgagacagtaagactaactcctcttctttctcctcctcctccttagcctactcaatatgaagacagtgaggatgaagtcctttacgatgatcctcttccacttaagaaacaaaaatatatttttctctttcttatgatgttcttaataacattttcttttccctatcttactttattgtaaaaatatagtatataatacatatagcatataaaaatatgtgttaatctcactgtttatgttaacagtaaggcttctggtcaggagcagactattagtagttaagttgtggggtgtgggacagtcaaaagttatatgcaaatttttaactgcatgggagttgggtccctcaccccctcgttgttcaagagtgaactgcgctaccttatttggtaagatcattcatttaaagtgcttatggtagttcttggcccatacttacctctcagtaacttctattattgatatttctacatcacaattttaattttaagcaggtctgtactctctacccccaggttcctcctatgtctctatctctagtgaggaacagagttgatatggtagcataagtccaaagggctttactgagccatggtgctgaggaatggagcttttgtcatcacaacagtaggtcagattattaaaaggtgagctttcacaagggtatgctctctatctcattcatatttctcattcaaattctctatctccctcttcctctctgtctttgacctcagtatccacaggtcctcttccctaatttatttgtattctttttcctatataactgacactgtaaaggtgacctggagggagaccatctgggctctggaccataaagagaaaatattcctattgaactttcactgcattcgttttttttttcttttttcttgccataatagtgaaggaacaaaaggtgatttaattatttctgactgttctccttggtctcttttactggtgttttttttgaagtttgtgaccacaactcataagatcaaaaatcccaagttcaccatcacagcctatgattatttctataataatatttaaatatgcattataatcactcccttgtctctctttccaagagtctataagctctttttttttctaagttttgagaataaattatttcctatgcctatatttttgagatcgagcactttgcaggtaattaacacattttagtggaaagaatttaaaaaaatcaattagtggaatttccaaagattttcaaaattaacaaggtcaaaacaaagatcctattccagcccactccagcccccaaatatacttcccctccttatttaacagtagtaccacttaccctatcccccatactagaagactcataagtcaggtccagtttctaacccgctctttggatgcctcattatcagacttcccctctgtcaagaatgttttttccccacttggaaacttctagtcatttgtcaaagtccttatctgatggggactcctctgtaaagcctttaaaaagaataaaaaacatgctgcagttcccttaaggaaattggaaaattatatcttggtgttccaacaatggggatagaaaaatccccactgacccaaattttaacttcgtctttcccttatagaatcactcaaatgcccaacttttctaattgtaattgttagaaccaaaaggtaaagcattataaacaaaagatttatgcaagggaagaaaacagaaggaagcatgtctaacttccaatagtgaagtaagtattagaatcaacagtcaacacctgaatgacattgcttgattttataaaggaagcaacagagttttcttttaccttttctttcctccacaagtttaaattagctactccctcatgtgcgctcccatagcaatgcaggtacttaataggtatctgcctacagataagactcttccactcaggtgtaagtttctcaactgctgaaaccgtgtcttagccatttttgtacacctaatcccagaacagtgattggaaaataatatttctataaagtctaaaagattaaaggtttttaaaagcgtatttaaatcagatagtttctagaatatacattatctaaataatgtatacatctctttcaatgaaaacatattctagataagtatagcaataaattttttgtgtctcatcaagttaggcaatttaagagttagaaatagttgaatagggctttgttattcataatgaaataatggtaatcacaacacaataaactatcttgtttatttattaatctaacacttatgaatatcaacaaaacatcataaagaaaaaccttcttgaattgggaagttgttcctatggcactataagaaccacagttttctgtacttcactaaaaacaaaagctttattaaaaagaaaaaaaacaggccgggcgcagtggctcacgcctgtaatcccagcactttgggaggccaaggtgggtggatcacgaggtcaggagatcgagaccatcctggctaacacggtgaaaccccgtctctaccaaaaatgcaaaaaaaaattagccgggcgtgggggcgggcgcctgtagtcccagctactcgggaggctgagacaggagaacggcgtgaacccgggaggcggagcttgcagtgagcggagatcgcgccactgcactccagcctgggcgacagagcaagactccgtctcaaaaaaaaagaaaaaaacagtggccggtcacggtggttcacgcctgtaatcccagcactttgggaggccgaggcaggcagatcatgaggtcaggagatcgagatcatcctggctcaacacggtgaaaccccgtctctgccaaaaaattagccgggtgtagtggtgggccgctgtagtcccagctactcgggaggctgaggcaggagaatggcgtgaacccaggaggcggggcttgcagtgagccgagaccacgccactgcactccagcctggggcgacagagcaagactccgtctctaaaaaaaatatagagcaagcaattttttcaaatcgatgaagttaaacacatcaagtagaaattaaaagtcataaataataatttgatatggccacagaatctgtattttcttgttatattgttaatatttaaatcctagattccaagagactacatcaaaatataactaacttaaaataataaagtgtttgaagaaatctcagagaatatttaatctaggagtttccacctgtatctccaagtatttgattgtatcagatattcctgctagtagtcacagtgatttccagtagcaaaaggaaaaacactaacaaagaacaaaaaaagccaaacatctgctctggactgagtaagaaagacccaccctcacccaaggtgggcagacaccatacaattagttgagagcttggaaacaacaacaaggaagaggaaaggtaaatattctctgtctgtctctctcaacaacttgcattctcacactcatctatttctctgcttctaccatggaccactaaagttaaaaatcaaacttggagaagtgttttgaatagtccttgccctaaacacagaaaactatgttcaaatcttgtctccatttcttattaaccatattactttaaacagattatttaacctgtctcatttcctcatctataaaatggggactgactgcaggaacactgatctcatggagttgctacaagaattaaatgagacagtctacaaaacattacagtcatgaaacagagtagcagtcaacaaataggacactaatgatgatggcaacaataacaaaataaagggaaacaatatcaggtacagtatcctttccacaagatttaagaaaaattaaacatttaaatattgccctgcacatttctcattttacatagtaaactgaaagtattcaggcagaaaattctacccctcatttctaaattctttgttgattgtttcctcacttttttaaagcaagtaaagttaggatgcttttatgtggggccttaattgttctgcctctataaattaatccaaaaaaatttaatatgcataattagttatgaatacctataaaatacctaaagaattttacacccgttatgttttacattcttatttttaaaacatatacacacatacagatatatataaaaacatatgcatttaaaaatctaacagttcttagctctggttgatgaaatgatttccattttctccctccctactgcttacccctccccacaccttgttttcctctggctcagttgtatctcacaaattgttttttataatgaacatatatttagtttgtatgctttgctctgacctaagtactatatagttcactctaagaaatacaatataagtcagcatatttcaacagatgttagtaagttatgctaaagctagaaatagccaatatctatcaaatctgcttttggaacaagcataacacaaaagttaggctttaatcttttctctgatcaaagactatgctgaaggatttttatttgtcctacaaacaaatattattgtcaaggtatcctaaatcctcagcttgtgtctaacctcaaatcatatgacaggtttggaagaatttatctttcggtttacgaaaataaaattctcctagagaattaagcacagtcacagtacacttcctgttttgtaagacttaactgaagccatcaatcaataaatgatattattctggctttttactataaattttttattcattttttaattttaaagaatctacagcctatgattcactgcctccaagatataaagaaagcctggttttgaccttacttctttgggtacaatgctttcaaccttttcaggcttataaaaagcaccactcacactggctacatacaatctacaacaggtaaatatcaaactttgtgcttttaagtgagatggagcccagctgcagccacaaggacccaacagtagccctcagacttcttttgaagaaccattactttgaagacatatctgtggaggcgggggcaataacagaagaaactgaaatagtactgttgatttagactttttaacactgcagcactggccaagaagcatgaagtaagtacagttaaagtaaatgtacattctgattaagaattattagatgtcacacctttgaaagaatgcggacaatatggtctacaatgccgtctttcttcccttgctattcaggggtctccataatttgcatggcttctagaattctcagatttgtctcactaggtgtgcataataaaatagactataatgtacccaggtctgtacaaagctgtaagttagaaatggaacattccttttatatcatgggtacttattacccataccccttctgatggttaattttaggtgtcaacttgactagattaaggctacccagaatgctaagaaagcattattctgggtatatctgtgagggagtgttcccaggagagattggcctttgaagcactggattgagtaagaaagatccaccctcacccaacatgggcaggcaccatgcaattagttgagggcttggatacaagaacaaggaagaggaaaggtaaatattttcatattctctctcgctctctctctcctgacgctgggacaaccttcttctctttccattgcaaatcttagaactccaggtcctctgacttttagactctgggacttgaaccagcagcccccaggtctcaggcccttggccttggactgagagttataccatcagcttctgtggttctgaggccttcagacttggactgagccaagctacctggacctccagcttgcacatagcctataatgaaacttcttagcctccatgatcacatgacccaattcccctaataaattccctctcatagatagatacatagatagatagatagatagatagatagacagacagacagataaatatcctattcgttctgtctctccggtgagatctaattataatataatttcttaatttttcttttaaaagcaagcctgtaaaactacattaataaaataaaagtgaacatataacatattgatttaattcagaattacactaggttgttaatttttcattctcctaatcttaactgcatgttctactatagaacgccccatcaaagtgtcacaggcacgctcacatactacctgtaggaatgaaaatctttataaactatcaacaaggtaatttgccaaaatatatttaaagtcttaaaagtgatcttgtccttagacttgaaaatgtcacatttaaaaagatttcctaagaaactaattggacatatgtgcaaaggaacatatacaaagatattcataatacattatttacaatagtgaatagcttcttagtcttttagctaaaatcaagtgaataactgagccaagctcaataccaataataggaaactgattaaaccttggtttagcaatggttaaactttatggatattaaaaaatgattgtaaaaattacattgtggaaaaatatatatttggatatgtctggagaataagtgaaaaatgcgacatagaaaaaacaaactgctatgatccaatttcaggaaagacaggacggaagaaaaaagggaaaaaccttaaaagaataaagtaaagaaggaaattgtgcagaaaagaaagagagtaacttataatggtttagaaatgcaaacttcaaagtcagaagctgggtttaaatctatgcaatcttcagtaagttatcccatctctctgattgtatttcttcatctgttaagtgggctaacatagtatcttcatcatacagttgtgggtgatattaaataaactaatatatataaagtcaatactgtaatgacttgaacatagtgatcattcaataatttttcactattagtattatataataatatatttaaaataaataattctgaaaggtggtatcaattatttattttccacatttttctatgttttctaagttttttgccaatcaatatgcagtgcttttatattaatgtaagcactaagcaatgaattgtttttgaaggggaaagcatctgatttttatatcctcttattactaatatttttaaagtttgtgttctttaaacaagctcttcagtatttaagcatctctttaattcaggtcgctacaactagattgcaaggttcaaatctgcaaagtttctgtttcaatgcactaattataaaatactaccattaaatacgtgcattgtgtttcctagctaataaaacatgttttgagatagctattctaatttatagttctaattaaccatatcagaaatagatcacatatagtcaatgaaatataaaatttatataaacatatctgcatattaacctgaagacagactgctatatataaaataagccagctacacggaaaaaccccagcaagatacatgcggaatctttaacttcctcataaaactgaataaggctttcctattcattgctaagtttttcttgctcagaaccacttttctgtctcctaacctaattaaaaaaaaaaaggtcatagtaaggtgtgtagcacagaaaggaagtgattcaacaaataacaaagattttaggaggctgcatgattccctcagaagcatgtaactccaaagaggccaaattccccaacatatacaatggtgtagcaatctattcacatggcttatataatatctgtgaacaaatctgtgaagataataccatggattttagatcctttagttcttcattgttgaacctgatgctgcattataaggaaaaaaataaaaaagaaccagtcagcatcctaacactacaaatgtgtatcaacaggaattttggtacctgggtaccctaaattacattgatcaaagctataagaacaaaggagctcaaatgcataggaaacagcttatcaaaaggaactgaaaagcattctggcagataaaaagggggaaaaaaggatatataccttatatcatttatctactgctacaaaacaaaccactccaaaacttaaaacaaaaatcatttattggttcatgattccacaatttaggctatgcttagctatgcaattagccagcttgtctggctgtgatcactcaggcagctgcagccatggaggcagcagtgttccaggagcaaaaactccctcgtgtaagcatctaccaagcctctgtttgcgtatttgctgatattccaccagccaaaatgagtcataaggccaagtcaagaatcagcataggtgaggatgacatagagctcagtaccgaggagcatgactcatgggggatggggtagacagggaatatcaatgtaataatctaccaaaactctgccctctagctccaatgaatcatatccctcacatatgcaaaatacatataacccttcctaagagccccaaggtctcctcagatgtttgcaataggattcatatccgttaattcatgatatgcatcaggtcccaggtcccagtatggaagaggactctagggtgcagctcatctcaaatcagagacttatgaagtgaaaagataaattatctgttccccaaacaccaaacatataatggaaagacagaaagaagataaccatggattttaaaaagcaatgaaaaaagcatagaagtcacttgtccatagaaagcttaaaatccagcagcatgtgttgtcaaggcctcccatctcatggagagaaatgtcctttaattaagattcttttctgttctctggaatggttccctaatttattggtctgcatggctcttagctctgccctctgggctttgggctcttttttaaaaaggaggcccggtggagccaagatggccaaataggaacagctctggtctacagctcccagaatgagcgacgcagaagacgggtgatttctgcatttccatctgaggtaccgggttcatctcactagggagtgccagacagcaggtgcaggacagtgggtgcagagcaccaggcacaagccaaagcagggtgaggcattgcctcactcgggaagcacaaggggtcagggagttccctttcctagtcaaagaaagaggtgacagatggcacctggaaaatcgggtcactcccaccctaatactgcgcttttccaacaggcttaaaaaaacggcataccaggagattatatcccgcacctggctcagagggtcctatgcccatggagtctcgctgattgctagcacagcagtctgagatcaaaatgcaaggcggcagcgaggctggggaaggggcgcctgccattgccgaggctcgattaggtaaacaaagcagccctgaagctcgaactacgcggagactaccacagctcaaggaggcctgcctgcctctgtaggctccacctctgggggcagggcacagacaaacaaaaagacagcagtaacctctgcagacttaaatgtccctgtctgacagctttgaagagagtagtggttctcccagcacacagctggagatctgagaaagggcagactgcctcctcaagtgggtccctgactcccaagcagcctaaatgggaggcatccgccagtacgggcagactgacacctcacatggccgggtactcctctgagacaaaacttccagaggaacaatcaggcaggagcatttgcggatcaccaacatccacttttctacagccaccgctgttctgcagccaccgctgctgatacccaggcatacagggtctggagtggacatctagcaaactccaacagacctgcagctgagggtcctgtctgttagaaggaaaactaacaaacagaaaggacatccacaccaaaaacccatctgtacgtcaccatcatcaaagaccaaaagtagataaaaccacaaagatgggggaaaaacagagcagaaaaactggaaactctaaaaagcagagtgcctctcctcctccaaaggaacgcagctcctcaccagcaacggaacaaagctggacggagaatgactttgacgagttgagagaagaaggcttcagacgatcaaactactccgagctacaggaggaaattcaaaccaatggcaaagaagttaaaaactttgaaaaaaaattagacgaatggatacctagaataaccaatgcagagaagtccttaaaggagctgatggagctgaaagccaaggctcgagaactacgtgaagaatgcagaagcctcaggagccgatgcgatcaactggaagaaagggtatcagtgatggaagacgaaatgaatgaaatgaagcgagaagggaagtttagagaaaaaagaataaaaagaaacaaacaaagcctccaagaaatatgggactatgtgaaaagaccaaatctacgtctgattggtgtacctgaaagtgacggggagaatggaaccaacttggaaaacactctgcaggatattatccaggagaacttccccagtctagcaaggcaggccaacattcaaattcaggaaatacagagaacgccacaaagatactcctcgagaagagcaactccaagacacataactgtcacattcaccaaagttgaaatgaaggaaaaaatgttaagggcagccagagagaaaggtcgggttacccacaaagggaagcccatcagacaaacagcggatctctcagcagaaactctacaagccagaagagagtgggggccaatattcaacattcttaaagaaaagaattttcaacccagaatttcatatccagccaaactaagcttcataagtgaaggagaaataaaatactttacagagatgcacatgctgagagattctgtcaccaccaggcctgccctaaaagagctcctgaaggaagcactaaacatagaaaggaacaaccggtaccagccactgcaaaacatgccaaaatgtaaagaccatcaaggctaggaagaaactgcatcaactaatgagcaaaataaccagctaacatcataatgacaggaccaaattcacacataacaatattaactttaaatgtaaatgggctaaatgctccaattaaaagacacagactggcaaattggataaagagtcatacatcagtgtgctgtattcaggaaacccatctcacgtgcagagacacacataggctcaaaataaagggatggaggaagatctaccaagcaaatggaaaacaaaaaaaggcagggattgcaatcctagtctctgacaaaacagactttaaaccaacaaagatcaaaagagacaaagaaggccattacataatggtaaagggatcaattcaacaagaagagctaactatcctaaatatatatgcacccaatacaggagcacccaggttcataaagcaagtccttagtgacctacaaagagacttagactcccacacaataataatgggagactttaacaccccgctgtcaacattagacagatcaacgagacagaaagttaacaaggatatccaggaattgaactcacctctgccccaagcatacctaatagacatctacagaactctccaccccaaatcaacagaatatacattttttttcagcaccacaccacacctattccaaaattgaccacatagttggaagtaaagcactcctcagcaaatgtaaaaaacagaaattataacaaactatctctcagaccacagtgcaatcaaactagaactcaggattaagaaactcactcaaaaccactcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgcagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaagatcaacaaaatcgatagactgctagcaagactaataaagaaaaaaagagagaagaatcaaatagacacaataaaaaatgataaaggggatatcacaaccgatcccacagaaatacaaactaccatcagagaatactacaaacacctctacgcaaataactagaaaatctagaagaaatggataaattcctcaacacatacaccctcccaagactaaaccaggaagaagctgaatctctgaatagaacaataagaggctctgaaattgtggcaataatcaatagcttaccaaccaaaaaaagtccaggaccagatggattcacagccgaattctaccagaggtacaaggaggagctggtaccattccttctgaaactattccaatcaatagaaaaagagggaatcctccctaactcattttaggaggccagcatcatcctgataccaaagcctggcagagacacaacaaaaaaagagaattttagaccaatatccttgatgaacattgatgcaaaaatcctcaataaaatactggcaaaccaaatccagcagcacatcaaaaagcttttccaccatgatcaagtgggcttcatccctgggatgaaaggctagttcaacatacacaaatcaataaatgtaatccagcatataaacagaaccaaagacaaaaaccacatgattatctcaatagatgcagaaaaggcctttgacaaaattcaacaacccttcatgctaaaaactctcaataaattagatattgatgggacgtatctcaaaataataagagctatctatgacaaacccacagccaatatcatactgaatggacaaaaactggaagcattccctttgaaaactggcacaagacagggatgccctctctcaccactcctattcaacatagtgttggaaattctggccagtgcaatcaggcaggagaaggaaataaagggtattcaattaggaaaagaggaagtcaaattgtccctgtttgcagatgacatgattgtatatctagaaaaccctattgtctcagcccaaaatctccttaagctgataagcaacttcagcaaagtctcaggatacaaaatcaatgcacaaaaatcacaagcattcttatacaccaataacagacaaacagagagccaaatcatgagtgaactaccattcacaattgcttcaaagagaataaaatacctaggaatccaacttacaagggatgtgaaagacctcttcaaggagaactacaaaccactgctcaatgaaataaaagaggatataaacaaatggaagggcattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcctgcatcaccaagtcaatcctaagccaaaagaacaaagctggaggcatcatgctacctgacttcaaactatactacaaggctacagtaaccaaaacagcatggtactggtaccaaaacagagatatagattaatggaacagaacagagccctcagaaataatgccgcatatctacaaccatctgatctttgacaaacctgacaaaaacaagcaatggggaaaggatttcctatttaataaatggtgctgggaaaactggctagccatgtgtagaaagctgaaactggatcccttccttacaccttatacaaaaattaattcaagatggattaaagacttacatgttagacctaaaaccataaaaaccctagaagaaaacctaggcaataccattcaggacataggcatgggcaaggacttcatgtctaaaacaccaaaagcaatggcaacaaaagccaaaactgacaaatgggatctaattaaactaaagagcttctgcacagcaaaagaaactaccatcagagtcaacaggcaacctacaaaatgggaaaaaattttcgcaacctactcatctgacaaagggctaatatccagaatctacaaagaactcaaacaaatttacaagaaaaaaaacaaacaaccccatcaaaaagtgggcaaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggtgattcctcagggatctagaactagaaataccatttgacccagccatcccattgctgggtatatacccaaaggattgtaaatcatgctgctgtaaaggcacacacacatatatattgtggcactattcacaatagcaaagacttggaaccaacccaaatgtccaacaatgatagactaggttaagaaaatgtggcacatatacaccatggaatactatgcagccataaaaaatgatgagttcatgtcctttgtagggacatggatgaaactggaaaccatcattctcagcaaactattgcaagaacaaaaaaccaaacaccacatgttctcactcataggtgggaattgaacaatgagaacacatggacacaggaaggggaacatcacacagtggggactgttgtggggtggggggagcggggagggatagcattaggagatatatgtaatgctaaatgacgagttaatgggtgcagcacaccaacatggcacatgtatacatatgtaacaaacctgcacattgtgcacatgtaccctaaaacttaaagtataataataataaaattaaaaaagaaagaaaggaggccaggctcacacctgtaaccccagcttcttgggaggcgggaggatggctccaggccaaaagtttgagaacacctgggcaacatagtgagactgcctccacacacaaaaattttaaaaattagctgtccaggacttcgaggctgattgcaccaatgcactccagcctgggcaacagagcaagaccctgtctctttaaaataataataataataataataatataaaaataaataataaatttttaaaaagaaatgctccttcataataaggtggacacaccccagaggtctctttctaaattgaccccattttagtacaagttaattcaacacccttaaaatgttgtagacttcccattaatctagttggggctcattccattccccccaaaactacatccatatcttccttcttttttctttttcttgccctgtcccccaggctgcagtgcagtggtgcaatctcagctcactgcaacctccgcctcccaggttcaagcgattctcctgcctcagcctccagagtagctgggactacaggcacatgccaccacaccaggctagtttttgtatttttagtagagacaggttttaccatgttggccaggatggtctcaatctcctaacctcgtgatccacctgccttggcctcccaaagtgctgggattacaggcgtgagccaccacgcccgacccttaatttttttcaaaccagatctttctttactttgaaagtgtcaggctgctgtggcacaaagccctgaagagtttacaatatattttgtctaattaaaaagatatactaagtaccaccttatatctttctgaggttttttttgtttttgcttttgtttttgtttgagacagagtctcacggtgtcacccaggctgaaatgcagtggcacagtcttggtttattgcaacctctgccttctgagctctggtgatcctcccacctcagcctcccaagtagctgggactacaggcgcatgccaccaagcctagctaagttttctatttttagtagagacagagtttcgccagttgcccaggttggtctcaaactcctgggctcaagttatcttcaagccttggcctccccaagtgctgggattataggcgtgagccactacacccagccctgaggtcttaataaagagtcttccagtcctgatttgatctctacccgaggctatttcttattttgaggatcttttgcctgctagatactgggaatgaaaaatagttttattttccaacccaaaaaagttctgggcaccctatatttcctctaatttctgctataagttcatttctctcttcccatatcttatataaagctatacgaagccagctgacaatttcaatattttcgcctggaaatctccttagccaaatctataagatcattaggtatatcttctatttttcaagttcttacagttcacatttttaaaaaatgtttaagtaccataaaacacagatcatcgtaattccagtccgcagtaacagatactttactatctttctgttttctattaacagttgtttgccatttgtccagcgtctgccaacactcccctcaccacattaccagccccaaactgccacccagtccccaaatcaatgctacatattttaggtttttgttatagtatcacttcactaatagtaccaatttttgtttcagttatctcttgcttcataacaaaccactccaaaactatatgtctaaaaagaacaaccaaaatgtatctgcttgtgatcctgcaattttggcttccctcagctggaaagttcaagatggcttcattgacatgtcaggcactcaactggggctggaaggccaggatgcttcatttattctccaaaatctccgtcatcaggatagcctgagtttttacatgtacccagctcacaagtactgaccaagctcctacttgagcagtatttgcttatatcctactgaccaaaacaagtcacatggtcagagtcattgtgggaggaaactacacaaatcaatgagggaggcctgattcactatggaatcattaccataaaaatctacacatatctcatactaaatgaatgggccatccattcagctgacaatcttgtgactgtgctttctgttgatcattttaaaagctacagaaataaaagatagtttatattttaaaaagaaagaaaaaaattcactgacaaaaaaataaaaattttaaagataactaaatagtcttaaaagcaaatgacaagctaaaaagtataaaacaggcattttaaaaaataaaattaaaaaagtttacgaagaaataaaaataaagttcataaaatagaaaaatgtttaattaaaacttaaaaattaaaaaaagaacataattataaaatgatatacccattggtataatattgttgtggtctttctactccttagctcaggtaggtccgagttcttgtcgcacaaccaggaagaattaggcatgcagacaccagagagtcagtaaagtagaatttaacaggcgaaaaaggaaagctttcagccaagagagggcacagagggtgggaggggtatggttcccctatctgaaggcagggaagtccccagtgtggctgggtccagggccttttatatactcagaatggggagagtgtgttgattggtttgtgagtatgcaaaaaatgttaaagcaaagacaccactcaaaggtgggcacgacagagtagaaaaccaattaggaaagggtaggtatatgtgaaataggtgaatggtggggatctatcagaggaaatcatgccaaataggcaagttctcaatccagtctgaggatgtaacttgtagcttggctttcaggctttaaactgtcttgggcttggaaggggggtttcactggggacccaccctatctgcctaggcatttggctgcttcctgccactctcaatattagaaacaataagctaaaattagcacaaatatatgataaataatttaacagacaaagagatgggaaataaaacaaattttttaaaagttataagactaagaattcaaaagtttagtaaacaaaggcaatcaggattttccaagcaaaagcaattaccatgtctagcaaatcccccaacaatttgccctcacccaagacatggagctctccttaagaaaatggttctcaaactttagtatttacagagtttgttaatgcagattccaaggtcctcacaaaacgattctaatttcataggtctgaaatggggctcattaatcttcattaataagtaccccagattatgtaataaaaaaggcccaaggaccacagcagctacaaaagggttttctcaaacaagggacagactatggggctccttatccttcgtgttgcacttattgcttgaagtgcttatgacaagcccacatttaaaatttcagaatcaaaagttaacatgctccactcccttagttatagctcaatttgagctgtctcacccttgtaagcttccctccagcaataaagcagcattttgcaaactacaggtcacaaccaatgagtgagtcagaatcatcaatttaataggttatgaccagaacagaaaatatcagagggcattgcacataatgatagtaattacaatttaagtattgttacatgaaacttttgttccagttgcatgtatgtgtgtatagtgcaaaatatattacttaatatgagtcatgagcaaaaaggtttgaaaatctctgccataaagaatatgatgaatttgtcaagaagctaaaaactttttaggagaatagttcaccagaaacaccctcaaagtctaagaaaaaaaaaattttaatgatcataatttcattttatcatatttctgtagggtttaattattcaggcatatcaatgcttcaaagaagaaatttcatatgcatttattccagcatccctctgaactagcaggtgagaggattatggtcccctttcttttagaaacttacagagtagagttattattaacccatgaaattaataattagagggcagtacaaaaggatttataatcatgagttaaacttacaatgctgtaggatttctaataagtgaatgacagaattaaagaaagttacatgaagaaaatagagcttgagtttagacttaaagggaacttcagaaaaagcagaggagaaaaggtataataatgagtcgtgttatacagtcagaataggctaaatgcttgtaaaaagaatttcaaaagctcagtggtataacacaatagtgagtggactgactccacacaatcattcagaaacccagttttttcgagcttgtacatctaccatcccctgcggcatcgtgtcctcaactggatcctctgctgtattgtattatatacatacatatacataaatatagatatagatattgatacagatatcaaaatcagtatagatatcctgtatattatgatgttttgacacgttaaaaaaaacattcctagctggggagacactgcctctgccagacctagccaattcttccagctagcaagagctcaaccagaagcatgcctttcatatacaaactaaccaatccagaaccatacctcctccagccagcataaccctggagacaatttcctctgccttcatcttcccaaggccaggtaccaggcaaccagggaccacccctacagcttagaatctgccaaaattattcaaactagccagtcctaaactgttcattctgccctgccttgccttgccttgcctgcacagaaaccccaaaaaggctttggcctagctgctattgtcatctgcttcctgaccactctggtgtctttcccatgtggccccacataccgtgctttaccttcctgtctctaggacctgtaagtctaataaactttgttttcctgagcctctcctctgtctgctctagtggccatacctaactaaccaactcataaaagaatacaaaacatctgccttcagccagcagacagaggagagagcatggaggatcacaaagatttttcatgggccaggcctaaaaatggcacttcacttcctcccattttccactggccagacctcagtaacctctgatatcaggaaagattaaaaaacaggacaagaaatcatccattcatcattagtcatccctcttacaactaaaacaccctgaacataacaccacacacaaaaatataggaggatctgcaaggtggaaagaagataaactagaggctaggaaccacaggacttgagaaatgacaccatcgctcccctggactttctttttgcttctcatatatcctagatcaggcactagggaatcctgcaacctgtagctaccaacaggccaagcaaaaaaaagggcctgaagacgtggtggccaacacctgtaatccagcactttgggaggctgaaacgggcagatcgcttgagctcaggagtttgagaccagcctgggcaacatggtgaaaccccatctctaccaaaaataccaaataaaattagccaggcatggtggtgcaagcctgtaatcccagctactcagggggctgaggcacaagaatgtcttgagcccaggaagcagaggttgcagtgagcggagatcgcgccactgcactccagcctgggcaacagagtctccctctgttgaacaaaaaaaaaaaaaaaggccttaagaaaagcctactctctctagccaaaggaccaggaaaaggaagacctagcagaacagaaacatttttgctaataaccatcctaatccagtcaaacatcaaaggaaaaactaccccaccccatcccccaacaccatggtgtcagcagggcccagcaaggagctggacttctaaccccactcagcaattaggagatggggcaagtaggcccttcacttccccgtatcaggtgtcaaagaggtggaatgagagtgcaagtggtgccagttagcagcccactttccccaccccagttagttgagcaatttctttagaagttaaacataaatgtaccatgccactcagcaaccccactattacgtatctgcccaagagaaatgaaatcatgtatatacacgtaactgtacacaaatatctatagcagcattactcacgataatgaaaacatcaaaacccaaacatttatcatctggtgagtggagaaacaaaatgtggtatattcatacagagaatactttttgcaataaacagacacaaaatgctaatacatagtacaacatggctaaacctcaaaaaaatctagtaagtaaaagagccagtcaggaaaaaccacattagtatggttctatttacaggaaaggttcagaaaaggcaaatctataaatcagatcagcagttgcctaaggaaagagatgggagtgaggattaacttcaaacaagcataaggttcctttctcaggtgatgaaaatattttaaaaccgggttatggtaatgattgcatgactccataagtttacttttaatactatttattgatattttattatataaaacataatttttaataaaaaattcaagtcatcccaaagcgttctacagattcaattgcactatctttaaaactctgatgtcatttttcgcagaaatacacaacacaatcctaaattcatatggaaccacaaaagaccctgaatagccaaacaatcttaagcaagaagaacaaagctggaggcatcacactacttaactcaaatgcaaaattatagtaatcaaaacagtatggtactagcataaaaacagacatatagaccaatgtaatagaatagagaatccagaaataaatgtacacatttatgaaaaatcaattttcaacaaagatgccaagaacatacaatgaggaaagaataggttcttcaataaatggtgcttggaaaactgaatatccacatgaagaagaataaaatcagacccttatctcacaccatatacaaaaatcaactctcaatggatttttaaagatgatgcctgaaactgtaaaactacctgaaactgtaaaactactagaagaaaacatagggagaaaagctccatgacactgatctgagcaatgatttgttagatacgaccccaaaagcacaagcaacaaagcaaaaatagacagctgagctcctatcaaactgaaaagtttctgaagagagaaggaaacaatcaacatggtaaagagacaatctatggaatggaagaaaatatttgcaaaccatatatctaataaggggttaatgtataaaatataaggtacacaaacaactctatagcaagaaaacaacttgattttaaaataggaaaaagacctgtatagagaattctcaagacatacaaatggcccagaagcatataaaaaatattcaatatcactaattatcagggaaatggaaattaaattaaatgtgcaatgagatgtcacctcatacctgttaggaaggctattatcagaaattcaagagataaatgttggtgagaatatgcagaaaagagaacccttgtgctctattggtaggaatgtaaattagttcaaccattatgaaaaatagggatatatctcaaagaattgaaaacagaactaccagatgatctaccactctcacttctggatatgtatccaaaggaaatgaaatcagtaagtcaaagaaatatcttcactcccatttcattgcagaattattcaaaacagccaagatatggaagtaacctaaatgctcataaatggatgaagggataaagaaagtgtagtcagtgtgggtgtgggtttctgtatatatatgagtgcgtgtggatattcttctgcaggtgtatatatacacacacacagtggtatatatactatgaaatattattcagcttttaaaaagaaggaaatcttgttatttgtgacagtgtggatgaacctagagaacattatgttaaatgaaataagccaggcacagaaagacaaatactgcatgatctcacttatatgggtaatcaaaaaaagctggactcacagaagcagagagtagaatagtggttgcaaagagctgagaagtagggaaaatgagaagatgttggtcacagtatacaaagtttcagttatgtaggattaataatttctggaagtctaatgtacagcaaggtgactatagctaataatactgtattatacactcgaattttactaagagagtagatcttaaatgttctcaccaccaaaaagaaggtaactatatgaagtaaagggtatgttaattagtttgtggtaatcatttcataatgtctacacatatcaaaatatcatgtatactgttctcactcacaggtgggaactgaacaatgagaacacttggacacagaatgggcaacatcgcacaccggggcctgtggtggggttgggggatgggggagggatagcattaggagatatacctaatgtaaatgacgagttaatgggtgtggcacaccaacatggcacatgtatacatatgtaacaaacctgcacattgtgcacatgtaccctaaaacttaaagtataataaaaatatatatatatcatgtatactttaaatatatgtaattgttgccagtttacctcagtaaagctggaaaacatcattacatcacttacaatgggtaaattcaatggtatataaattatacctcaataaaaatgtgttttaaaaagtagatggactggcataatgaaccaccatgtaatccatcacctagagccaacaattatggattcatagccaatcttgtttcatctgtaacccttctacttttattcttgccatattattttaaagtacatctcagctattatgcatttcactgcaaattttataatattcatactatgaggataagggttttttttaacataacagcagtaaataccattatcaccccaaaaaacaatgtatcaaagcacaagtgatataagtagtgctttgcttgaccattttagataatctcttgttgctttctgctattttcattctcctctctttctttcaactacatttagtatctgatagctccaatttctaaagcctttaaagtctagttcggctaatggttgcttctgactctcacttacagagctcattttctcatgcaatatttttactgggatataatgttcatcaaactttatctttgggattctataaggcctggttgcaagctgcatgtgcccagggaatttggtgcctgaggctgctctaaacccaggccactgtaaattaatatctcagtttagggtttttcaggtgcagtgaatgtgaattcaaacctcaattccacatcagggctttctctctcagagcctagacaatttttcttacagaacagatttttgctttagtctacccatttcctaaagatgtgtctcttctatggtcctgactttattaagaatttctgttccaatttcctgccttctatgagcctatggccttgtcttctgatccccatgtggccattgaaaccaaaagctctaaatgaccaggaattgacaaatatccatgtgacagctactgactttaatgtatacttactgccctggaaatgtattcccccttattgtggtctctgagaatttcccttgcttccctgcaagttagttacacatttttaaagtttttaatgttttgtttttaattttttaagagttttgcactgggaatatttcaagatgtttcatctgctatatttccagatagtctaatcccttcttataaactttaaaatctttagactttttataagagaaacgtatcttccatcaacctgagcggcacagtttaaaatctttttcccccattataacataaagcttaatttctatatttaagtcctaaatgtactacagaatcataccaaaattaaataacttactaagtacatcattccataaaccaaaataaaatggaataaaacatcactgtgagaaggaatagtataaacaggcaccaaaacagtgacaaggcacaacttttattagttattatttagtgaaatggacagcactgtcagagttggttcaagccagagttccaaaattcaatgattgtctgagcttacgtaaagtacctcaactgtctgagcctcagttgtttcaaatgtaaaatttagaacttgagtcatttcttaatgtatttaaagctctatactactatgaataaagtgttaaattttaaaatcagctgaagaaaagcattaatataccaatcagcaagcatcgtgactcaggaagaatgtacaagagtatcaagaattaaaggggcatgatgtatgcaacctactttcagatggtttaataagattttttgagggtatatattcatacacgcataaatacagagggagaggaagaggagggggaggaggaggaagagagagagaagagggagggaaaaaagataataaaataaatatactaaaatattgaaactggtgtatctgggtagagaagccataggagttctacgcactactcttgcaacttttgtgtaaatctaaatttacaacaagtttttaaaaagtgtaataaagttggtatttaaataacagatataaccctggctatataaaacagaaacacatagttattctatcatgggaagtgaagaaaaatccacaaagggacattacaaatttatcactcaccaactgtttcaggaacacacgtttgttgctataaatacaaagtctctattaatgacaggttacagaactatgtaaaaactcataactcatcctaaggggtaaaacatcaggtgagatttctgagccaaaagtaatttgggcagaaagcacgcaagtaagccaataaagcattccaacattaaatcctgacttcctttgacgtcagccccagcagaccaaggtgagtgacgacacagagaagtcagcacaggaggaaatgtgtgccagcttgtgcccagtatcttggaagtgcaaatttaccaggtaacataaaactccataactctatcttaaatgctggtatataaatcacaatgtatctcttttcttaagagtctgtatccagcttctcagagttcaaaataagttacaagcaataatgactgttgagtattattaagctgactgtaggttaaaattttttaaaaaaaacatagattgaaagagagcttgctttttgatgatacttttaatttcaaactcagcaggaaacaagataatcacaggtagctgaaagtcaagacaatttaaaacccataaatgtatgttattgatgaacaaagacctcaatgctaattaaactgcattttccttcatattctgtaatttcctaatatattctgcatacattatctctaaggtctgacctagagatacagtattgtgtagcagtgttttcaagtatttttgccctctggccatgcaaatgaaaaaaggaaaatggtacactatgtaaaaattatgtatcaattgcaaaaaaaaaaaaagataatgacacaaaattatttattttacttactttttaaagtcttaaatcttagttttaaatgtggaaagcatataccttttatcaggaccagtgaccccactgcaggaattctcactcaaataaaatctaaaactttggcatgaggtcattaaactattcctagggcacccttttacgctaaaagcctctgtaagcgattaaagttctaatttgaataattacattccacctacataaattccctctgtagtttcaactgtatgcaatatcagtcttcatttcctgaattaaattaatgtcgtgtaatgtggtgcttcttttttaaaaaaagaagtacatctactttcataggtaacctttcagcaaccagtaaaagtgattcatgtgcatgaggggaataggtcagtatgaataatcattaaccaacaatttgtgccagcatttattgtgtcgagcattgcaaaagggacaactcatataatgaaatgaatgcagctatacggctttataaaaatcaaatattttataaactaaatcctattttccattgaatttaccaatgcatcattagaaactttattttttatttatggcttgcctttaattagctgatacttcccatgtttgatcacccttatctttctagtcaaatacttaatgaattgcaaattaatactgaaaatcctaacttaaaaaaagaaccactgagtagtgtttaaaaagtaaataagtatttctcatagagggaatcttaaaaacatgcttcccctaatcacaaaccaacagaatttttgaaagaccgaaaaacaattcttacagcaaaatttgttactcaaagtgaatttccagtgtaaccaaaacagtatttattcaataaacccaaaagactagtattacacctccctttaatgagatttaatctttcgatccttggatatttcttaaataatgtgtctaccagttgctgagtgaccttcaagagtggcttttcccagagtaaagaaaaacagctgtgttccttgcaggatgctcagtgacttccagagatctccacaccatgccaactatttcagtccttgagtcattagagaaatttaaagagaagaatttatcccaattgtcaaaaattctgttgaaccccatgacataaacgtgtttagttgatcaaagctgtatagtagcaaagatgtcttcaaatatgttgaattagttaatccctaaatctcattattataatttctgctcttaaagaatttaaagtatgatttactggcatctagtgaaactgtaaattaaattatctattatacctagagttggtctcaaattcatgaaatatagatccaattgtaaaaacatattttcctttcttcctagaattccattctactttgattctgaaaatagcatcctctttcctctaggaaatgtcacctgtactccaatccccaattcccacagaacaatgtgattcaaagagatgctgtcattttcttacagatcacttggcctagccacaggcttggggtgtgtacttgttcaaagctggaccaatcacggtaccccattctggtggccaaagttgatctgtatagttgtatagataagggcatgtgacccaagctgaatacatcacagtccttccccaagatattccacactgaaatcaaggcagtaggagcaatctctctcaggcggtgaagaaactgggcatgcgagctgccagcagccatgtaccctgctatgcagagaaaactggtctgagagaactaagccaagatgcagagaagaacttaaaaaagacggagcactccagcggcatccaagtcctggctctagttgtccctgacaactgtctcactcgtgccttccttgtgtgtatataataagccttccaataaatcccctttataccaagctattttcctattaccagtagccaaggaaactatacaatataccaaacaaattctaacataatacatttgacttcttagggatagggcctaggaatactgcaagaaatcctaatacctctgcaaattcaaatatatctaatgcaaacctgggtttaatccatgaaccgacatttagaaataacatgatttaacactttcttcactgccttcttcactggggataagccttgtcctttcataaggcagtcaaggtcttgtgagcaagacctgtatcttatattttgcaatgaattgctctctcagcacaagccatgaacatagatgttcagtaggaatatattaggctaaaaatatgaagattgggatattatgattgccacatgatcctctggaatatcatcagatccaaagtaaggagattttgtgttctggaaaagtccttcttagaatagtgatagctgtatagcaagacagcagtaacaaaattgggggaaaaaaaatcattcttaaactgattatttgttaccaaaagatacatgcttgtgaatggattcaaagggatccttgggaccaaaaaggaatgtgggtggctgtgaagaaggcagttttaatctgaaatgaagaatctgactccaaagctcagcaaagaaagtctacgtttccctaaggattgagtctaagacaaggctgctaggaattcaagattaaagaggcaacgaatgtaaaatacattctatcttaaacatattaaagtgtatttaaagccatatgcctataaatctttctttctatgtttactgtacccctacattaagatattttggcattcaaagtaagtgaccagtttgctttgggctggtgatccactatggagagaacctgaaagacacggttgagagcagaatcttctgcccaagaaaaggccctaaccatgctcaaatgatggaagtagaatataaaggcagtcctgttttaaaaatgtagcttttcccaaagaagctaaaggatttcctgaccttctgtatctgactaccagaactcagggagaagttcaataccataattataataaataaagcaaactaattctaactccttaaagctgataactatgcccttaactagttctaactgaaacaaaaagaaaaaaaattaagctggttattctctgtataattttgattttttagaagcttatatattcattttagttatttgttttatacaactatttaccacaacgcatgaacttaatacatattgataatacaggaaaccaaatcctataacaaaatgcaaattctgcctaactgcttaaacttactaaaaaagctaggttctagacatcaactttaggacaacataattttctctaagttattccagaagactatttgcataaaacttttggaaatctccactccaaagttcttccactgtaaactgcacttaatcttttcaattagcaacatgcttaaagaacacaatacaatatctgggatcaatggtctagacatttctacaaactgaaatcatatacctatataacaagagagcaactgattgtgactcaaacccatcttgcaactacactaataatttggcattaaaaggatattctaatagagccatattcacagaaaacagtgtcatttagtataatttcttaagaatctccatttaaaattctcagaaaaatttaaactacagacccagagaactgatagttacttttattaacctctcctctgattataatacgactgtattagaagaccttaagaacaaattcagtaaagtaaaatttcatttcaatgcctttttataacctttcagttcccagaataggaataataattagcactctcatttctagtgcttgaaaaacaatgaagtatgtgctttaaagaacgaagttatatcattttcacctgcatcgatgctccttctactcttgccacacaggcgacccgatccaagaaagtcactgccacaggcaccgccacaaagaagcctttacaaaaggccttgatgtatcttttcacccacccttgtgactgtgccatacctaaaaatacaaagaaaacaactatgaaattagtctcaagaaaggtgaaaaacaaagacataaaaacagtacatgaaaagtaagagttaccgaagggcaatcttgtctcttaatatattacacactcattcctgtaaccattagaataaatctgacttacttaaagtcctaaagtgaaatacgtgaactcaggttaatgcttttccacaactcaagtccacttgctaacttcagtgggaaatttctccccacaaaacagtaagttagaaaaaaacaagcattccagaagtaaattcttttctgttgctattatgatgaagttactccttatacccctgatatctgttctcttctacagtaataaaagtttcagtggaacatgtggctgcccaactaaagactgttttccagcctcccttgcagctaattgtgaccatgtcactggatttgatcaacagcatgagtagaaaggatataattcttggttgcaccctgaaaaggaggatgccctcccttttcttccccattttataactgtaatactaacaatttggtggtaggagcaggggtggccatctcaaactatgagataaaagcttcaagtaaagatgacaaagcaacaaaatggaacgatcctaggtccgcaacaccatggaggcaccatactgtcctgcattgcttacatttggactgttaaatcacagataaatcacttgcgctgtttgtggtggcagtgttggtgttgttgttgtcgttgttgtttttagacagggtctcactctgtcacccaagctggagtcttggcaagacttttttggataagacttcaaaagcacagtcaatcatagcaaaaacagacaatggagattacatcaagctaaaaagtttctgtgcagcaaacaatcaacgtaatgaagagacaacctacagaatggaagaaaatataaggaaactatacttctgacaagaggctaatatccaaaaacgcataaggaactccaacaattcaatagcaaaaagacaacccaattaaaaaatgcccaagagcttaacaataatttctcaaaagaagacatacaaatagccaacaggtatatgaaaagaatgcgcagtcatgagggaaatgcaaatcaaaaccacatggatatcattccaccccagttagaatggccattatcaaaaggcaacaagtgctggcaaaggtggagcaaaaggaacccttatatctgtttatgggaatgtaaattaatatggccattacagaaaagagtatggaggttcctcaaaaagttaaaaatagaactaccacatgattctgcaatcctattcttaggaatatatccaaaggaactgaaatcagtatattgaagagatatttgcactcttatgtttatcacagcactattcacaatagccaaggtatggaattaatccaagtgtccatcaatggatgaatgaactttaagatgtgagatacatatatatatattatttcaccataaaaaaagaatgaaatcctgccatctggtacaacatggaaaaacctggaggacattaagtaaaataacccaggcacagaaagacaatattgcacgaccactcatatatagaatctaaatagttaaactcataaaagtagagagtagaagggtagttaccagaaggtggggtagttagtggggaggagaggttggggagatgttgctcaaaggatatataattatatttaggaggaatacatttcaggacatctattgttcagtaaggtgagtacagttaatggtaagatattgtattcttgaaaaatgtaaacagagtggatgttatatgctcttaccacaaaaatgataaatatgttaggtaatgcatttattaattagctagatttaaccattccacaatgtacatgtacttcaaaacattatgttgtatacaataaaactcacaatgttatctgttcactcataaaataaataaaaataaaaatactcaaccactaattccctcccaaatctttaacatgtcacaggaaaaagatgaatgataatctaaattggctaattctgaattacctactgtaactgacatcaatgagggctatatgtatgcaaggtaagtaagaccagtactcttgttttttatacttttatcaacatatattgcacataacattcacccaaaccagtaatctttttatacctaatcaaaataatgtaactcagactaactttagaatataagcaatttaaaaacatgttttcattcaaactcatctaacaactataatcttaagttaaattgcttatgagttcacacatctggtactcaagaaacgtgtttggcccaaggtactgattgtttctgcgagcagtcttaaccactatattcctaaaagagtaaacctgcttgacatgtttcattcattcatacccagctttaatgtgagcccttgagtgaaactaatttctcttcaatgacgtcttttgcctagaatcaaaacacctttactaactcattttatatatctctacaaaagatttaatatacttttccaatggactattttacaaagatcccatttatcatgtactacctccattaatataaaagaataaccttgacatatttatcaaatcagtaccttcaagatgcaaaagatgcattttcctcaatattagatttcattagctcagtctctctgaaaacacttctaaccacaggtttagcaacacaaacatcagtcttataataaatttaaaaacggaatgacctccacatctattctttttattgtttccaaaatatatataaataaataaataaatccaaagatttcagattataaaatatctgaatccacaaataatttataaaatgctcccatgtacataggaaaaaaaatagttactacgtagaagagaaaggaaacggctcaacagtaaataatcaattcctctttgaccagtttgatagcttcaaagttattttaagtggtctacacttatgtttaagtcatatacaactcccagataataattccagggtagtgttccccaagcttgccttgactgacatgcttaaaaatgaagatccccactccgactcagacctccaaaatcaaacacttcaggtgattcccttaatagagcaagtctggaaaatactgatatttgggtgtttaaaggtcagctgtttactcactcctcaagtttattaccttctgaaaatgaaaacaggggaaaagttagcaaagaaatatcaccctgaatgtctcctcacatttagtttacctccttactagattaagaaaaagtatctgcagaacaaacattgcacagaaaatgaacaccactaccagatcctactttgtaacctctacgtggttccatcagaaaatgacttccagtggattttctctttgccccactaaggcagttcaatcatccatccactcatctacccagtcacttactacctggctcattcattctttcaaccagtatttactaacggtcttccacaagcactgtgttaggtaccagggaatcataaaacagtgaacaaggccagtcccagtccctgatcttatcaagtttttacagtcaactatggagtgataagggtcaatctgaaaatcacataaacatacataagagttgtaataagtgctataagagagatacacagaggtcaggaaaggtctttgaggaagaggctgaactgaaaaatgaggagaacttctctagataaagaactgtgggtaggcaagggtattccagagagcagccatgtcacatgccaaagtccctgggtcaggagtggccatgttgtgatggacaactgaagggaggctggtgcagataaagcacacaggaagtggaagagcacagtgggacatgaatgggaggaggcaatgtaaatcccagagcagttaagacctcacaggccccgtaaggatttgcagcaaatgagaagtaactgaaatgttctaaaattgaggtgaatgatcctatctgcattttgaaataatcatctatctgaaagcctggataggacaaaaatggatatagggaaaccacattattctagtggtccagggcaagagatgatagttggagtagcatgatagtggagatggattaaaatgggcagatttatgtatatattttggaagttaaactgacaggatctggaaatagatggacaatggtgggagaaggaaggagataagaaagtgtcaaggggccgtggtagcctgtcaaagcactgctattctgttgttctcttgaattacatgtcaaaatatttaatactaaaattatgctcataattccattcctcaaactttttttttggcaaacaagcagatgtgctccctgccctcaaggagttacaatataccaaggaagactgcccttcaacaattatttccaatggatgagcattaaaagggacgatggccctgaagcatgacagcatgaagcaaggctgtctattcatcagaaaatgatcaaggaaggcctgccccactccacccccacccccaaaaaatggcatttgaggcaagacctcggcatttcaggtaaaagcagtaacatatatgaaggcctaggggcaaaataaaatgtagctgtttaagaaactaaaataagttcagtttggatagagtatatacagaatttattacgtgaatttttaattcagtaagcatttatttgctatcaagcagcaatgctaagtacagaggatataaagatggctaagcatacagtatagtaccattcaaaaactctcactaaacaataccttacatttcaacatacatttatatgtgcacataaaagtatttaaaattgaatatttatattgttttaattgtttaataaccactcatatgttacttgtgtaattattaaagtataccaaaagagggaagaaagcagcatcaaaatgctagcagtggttaattctatatgctaggaatggagacgattactattttcttctttgaatttttgctggtttctaaaacagaaagatggtatctgccctaggaagtcactatgatatacagataatacggggtaacactagtgttaatttctatcccatcacaatgaacaaaccacactctcaccccaatctctgctgctctaagtagtacaaataacactgagcaagattctttcctgtttatgcagcaatcaatatatttaactgactataatgttgtttatgtagccagtgcaggctatctatatttctggaaacttctggaaagttctgtcaaatattcgctacttttattttaagaggcacagaatggaaacatgtcttctctttgctgttcatcatgccctgcatgcatggaccttcacaaaacagctgaggatacctgcaggacagaaacggaatgcttccaaatatgatgccacagctatcttagttataaggtagtatgcatgattaaaatgtaaattaagggggaaacattaataaaagttgcattaaattcacatttcctgaattgtgagcctcctcttcttttccagtaatgctctcctacattacttctactccatgtagtcactggtccccaaaaaggagcatggtaatgagactcaggagacctgaggtagatatctgtctctgtctataaccagttccatgactttgaacaagtcacttctggcctgtttcctcatgtgtgacaagaaggggcttatttgggaggccaagcaagagggtcacttcaggtcaggagttcgaggccagcctgagcaacacagcaagacttccatctctaaaaatttaaaaattagcaaggcatggtagcatacacctgtagtcctatctacttgggaggctgaggtggaaggactgcttgagctaaggagtttgagactgcagtgagctatgactgtgccaccacactacagcctaggtgaccaaacaagaccctgtctccaaaaagggggggggggtagatttaatatctaaggttctttctaagccagaattctttatttctataactttttattgtcttttaactgtttcttaagaactttggcagatactaaaacaaacactgagatcactattgactaagaaaaagtgagttgcctttatggtttgagacttttttaagtattgaaaataaaagagaattaactttttttaaacaactggttaaaagacccaacagtgagggagctgaaaccagtgccaatgatgtaaaagaacattttaaatatagataaagacctgaacaccgttgctctttcacttctcatttccacaacctgactgctgaccagagcattgctaccatcgcctgcacaacaaagtcagggcaagtgtttttctgagagattataaaggagcatgtgggagatgtctcaatctgatatgtgctgatcctgctccaagccaaggaagcaagagcaataaaagctaccctggaaacaaggtacaagtggttgctattttcagaggctcaaaagaaaacgctcaattcagtcctgttttatctgaattgtgaggggcacctatatttcataataataaaacactgttaaaagcttctatcatgtaaatactaaagaagccattcatacatgaagaaatgaacacaacatttctatgttgtcatatccaataattttcttaaagttttatggcattcacatattggcaaagttaatgcacctccttgtctatgtaaattgccaaagaatcattcagatgatccggtcttttgttcacaccttaaatgtttaaaaccaccacagtaataagtacctagccccgacttcctctgggaaaatttcatctaagcaataacaatcaggtactaaaatcacccccagcaaaaagggaataatttttatcagttacctcattcttcttgtaactatggaagtcactgaggttcaaaacactgctcctgagaaaattattgcttaaaattgtaagtacacccagttcattgttgaagtgcttaaactgagaatattttttaaataagctttcagaatcaagtgaaaccatatttgccacctggcatacagcacttacaagtgagagtttcttggtgatgctgacctcaaccacataacaacccacactgtaaatttctctccttcccgtaacaacttgtggcttgatcatgcattaattcatctaaaattgttcttaagcctgcttatattttagcttgtacaaagtcaccaatcactcatccatggcaaccaggtggataaatccaccacaagtcatcctaattataaaaactatttaaaagttgtgtgggaggtttgaaggtaagaggaaaataataagttataaagcagtatcttatgtaaaatgtaacctttcaatcatcataagcctacacaaaatcaagattttatttataaagaggaaaccatcaaactatgaatatcagagaacacaagagtagggatccaagcaaatctgacacacaattcctgaatcagtcagtatatgtgtacctaccatgcaccatggaattgtgctaagagataaatatgtgttatagaacaaggtcagcatggtcctttctccacgtagagtttgcattttcattctttcaacattaagtgcctactttgtgctagacactatgttaagacaccagattgaccaagccatacttcctccccagagggacctgtgacaaggtcacaagaaacaagtatatgaccataaataatccagctatcatcctccacggatctttctagcagcccctggtaccaataacctggctcggcaaacagagcctaagcatgtgaaaaatcaggagacatttggatacatgtggtctaatacaaggataaaaaagaaaaactgatgaattacaacaattttggttccactggaagcagatcctggcaagtaatctatagaaagcaatttaaaaaattttttcaggactatcttgctcctttcacattataagtaaacaatattttataaacagacacttagtactctttagaacatgaataccagtatcaaattctttatctttagtcttgtctgacctagtagttctcacttgaaaattctcaggaaagaccaaaatggcacatacacaaaaaaagaaataagaaagaaagaggaaaaccagccaaaaataataaaggaggagaaatgtaattatgtaaggcataaagttagtcattttttggcaaagatacccaataaaaaagtcaacactgatacaatgatgaagctaagccctataaaattgcttctttcatggagataattgtgactttctgttggtaaactgataagcatctggatactaagagaagagaggttaaaactgatgtattcaatcttaagtcagcaatatgtaaaaacaaatgaatttgaaggtcatgctctagtacaactgatgtagagagaaaatacaaccaggaaacaactaggatacagaaattcataaaggcttcctgatttttggtaaggactccttcaacttgcaaacatcatgcatttatgcacacccttccctctgattcagtggaaaagcaggccccatcctatccaaggtgctcttcagaagcagcatcagcaaagagggaaagtcagtgaaaacctggtgggctttgaatccaagacctcagttcaaatcgtgattcaacagtgtggaaattactttatctcagtaagcaaaatttttcatctgtgaaaccttgcagggtttccagaggttcaaaatgttcatatgtgtttgttttcttttgtttacataagcatttgtgtaaagaaaatgactagatcatcaaataaaggatatttcttcagataaagcactagctatgtctaaggaagaggactagtaataacaaatcaaaaaaggataacagaattaaggatgtccattacagacaataaaccaataaagcccatcttctaggtgataagacacctaatacataatcattttgttctgctttgaacctcatgctgttctaagatttgaccagttaggggcaatcatatgtactgatattaaccagttaacaagaatgtattcagcactgtcttaggtgtcttgagatttttttaaaagcaaaataaaaggaaatataagacttagtgccagaattggaccacagggatagattatataatattcattgaggaaagaataaaaaggaagaaaactggaattacaggaaaaaaattcatgatgagaaaggctaaaaagaaaaaaaaaggaattagaatgtaggtggtgggtttaaaaatgttcattataaaattcttagaatgtttctgtatgtttaaaatttttcctcaaaactttggaaataaaagaataaattacatctgttaagtcactcagataaaagaaaaatataattagaatgaagatgcatacagcccatctgagatagcaagaatgctggccagatcagcgaacaggacctatattaagacaagtgagacataagactgaatattaattttttttttttttttgaggcagagtcttgctctgtcacccaggctggagtgcagtggtgtcagctcactgcaagctccgcctcccgggttcacgccatcctcctgtctcagcctccagagtagctgggactacaggcgcccaccaccacgcccggctaattttgttttggtatttttagtagaaacagggtttcaccatgttagccaggatggtctcaatttcctgaccttgtgatccgcccgcctcggcctcccaaagtgctgggattacaggcatgagccactgcgtccggcctgaatacgaatttttcttgttttagttgttttctttttttttttttcctcatcaatatggacatcttcatggctccagtatttttggaaaccatataaagcaaaatcctttaacaataatctaggactctctaagaactggctcaggccatcctaatcctataaattatccttatcctgtaactccaaatagacaccatttaacagcatttacaaccaaggcctaatctcaaatttcagttattaaaatgaaataaattctgcaaaaagtttaccataaaaattaataagacagtgaatagctttttacaggagaaaaatcctattaaatgataaccattagcacggagaagcttggtaagctttaaaccctaataaccacaaaatttggatttcaacactgtactttatttttttccaatttaatagaaaagcataactgctatcattaagtagaagctaaaggcaacgtgaattttaagctaacaatgtgaggacttaaatatgtatataaatgaaacagaccagctacttatccataacccaagcaaagcaattagaggatacttttcaccataagtccattttttcttgaagtaataatacagtgggttagtaaaaggatatattaccagcatcaggaatacttactgaatagctaagaagaaaatactgcattatttggcatttgggctgtgttcaaaattggctttaaaaaaattaagaaggcctataaatggaaaaagcactctttttagaaaaaaaaaatctcaagaacctttcaaaaatcaaaacttagaagaagtgagataggggaaataagaaaaaggtagtaacactcagaacctaaaaaaagaagggtacaaaatattagaaagtgggcattaggcaataacatgagtaatggaaaagtatcactagaaaccatgtgacagccagtttccaaagcacggtcatccaagtaccaagctttgctgttccttatctactttgctacctcacattttttcctactatctgacactgcttcatattcacttctcttacactgcagccctacttcggtcttattttagaatggtacaagggtcttattagggctcaacaataagcggaattgaaaaacttttttaaagaacatggtttctgggtctcatgaaaatcctatcctgatccctactcttcatgcctcaaatatattgctatctatactagaatgcaaatgcctttactagaatgccatatcaactcaagtcatacttacaacatggcttttcctttgatcagggttgggagtaaggagtaggaaggcttctcaaaagaatcaggccactagaccccaagggacaaaaatggaaagagaaagtcacaaaaaagtaggactgaaaaatacaatttaaccagcaaacttatagctagcccagggactattactactctttacaaaatgataaatacaaaaaaattagaaacacaggctcccccatcaggaaagcacattaaggctccaattagtctgtcaaaaataaaatctattcagactatggcttgaagatttggaaaggtgcccacagcccatgtatggcagctgcaagtccatggggagttcaaacagcaacagtgcagagtcagtactgaagatgcaagccagaggaaaagatttatgcaatttaaggtgaaagcaacagaaataaactcccttggaatgagtgcttatggtccttttagcttataagtgcaagtgtacccacaaacatgcatgcacacttgctgaaatggcaacaaaggccaagttagcagcatatgttaaaaaagaaaaagtaaaaataaatatataaataaatagaacagccaagaggccagagtataaagcagctcatcctgagtggcctggagataaaagcagatggagcacagcattacccagactcaagtgtctgttgcacaaaaagtccaggtattataacgagcctgtggtattacagcaaatggaactgcgatctcatttagattattctccactcttatatgccttgttttgatttctgcatacttgcctataaattggaagacactgttttaagatacctgtgaaatttcatcaactgtggctagagttgaaatcttaacttcaaccttaagagaaacactgaatcagaactacaaagctgacccgctcctaaatttctgatgatccatggaaactgtgtgagataataaatgtgttaagccactgatttgggtggttatttgttttgcagaaatgactaatacaatacaaaatgcacaaaaagacccaagggcgcaaagaaacttggtatttgataaagtcgacattcatattgggaagagaagttgaattaacaagttatgttgaaacaattagctacaatttggaaggagaataaaatcaaagctagatatttattaaattcattataagaaaataaattccagataagccaaacattatatgtaataaatagaaatataaaaataacaagagaaaataaaggcaacagtcttttaagggtagaaagaggtctttctgaacattttacaaaatccagaaaacatgaaagataaatactgatagatttcactacataaaaatcaaaacataccataaataatgttaaaagacaatcagcaggacataaaaaattataatatcagtatctctaaaattacacaattcttataaagtataagaaaaaagacaataattttgagagaaaggtatttcactgaaacaaaatatggacagtatataaagacataaaaagatgtacaaacacactaataataaaatcaatataaataaaaacaaagtactactttagtctatcaaactgacaaatttaatatggtaatatgtaccaaaatgttacatgaatataccttctgatgcagaaacaccactccaggaatttattttatggatgcaaagatatgatcaacgatattcaacataccatttttattgcagtgaaaaaatgaaaacaaccaaatgttcacaaatatgtaaataaattatgacatgcatacagtagagtaatctgcaatcattaaaaagaacaatatatcgttatattgcttgagattctcctccaaaaaagttggaaaattgcatttttaatatgaacccatttatgtgaaattttatacacacacagcatcatcctcatcgtcatccttatcatcatcatcatagaaagaggtcaaataataaagaatatgaaccaaaatgatgacagtatttatttgcaatgaaaggaatttcactttatgctttatatttttccatattacttaaatcttcagtaataggtatttagtatctttatatactaaaacaaaattaatattacagtcttttctgctacaatagctatttcttaatgtaaattagctcatatataggaaaatgacgtcagtcttatgtgaaagctatgctggttcatacacaattttccccagtacatgaaggttttgattcaaccaagagcaagtcttctcccaattaaagtgaaagtctcatttggtggcttcaagactttccactgttaaaggaggctgagcataccaacgaagaaatgcaaagatattttcccctgtgtttaaaatagaataaaatcaacagatcaatatcctagagcagattttcaactttgatgaaattggtctgtattagaagtagatgactttaaggacctacaacaaaggaagaaaaccagggtttcaagctaagactgatgtgatgctgggtgcaaatgcaaggagggagttaatagtgctcgtttttatgacaacttctattttctcagctctgtttacaaaatgtcactggtttcaaatgatctgttcctagccctattttctttataagccctaaaattttatggtttaattttgcagaattaaagatttttcaggaatgcatgtatgtcattaataggagaaatgcctctactattctgagtaaaatgcagtaaggtagagaaatgttccatatcaaaaagaaacaaaaaacaaaaaaaggaagcaaaaaggagaaatgaaggaagggagggaaggaaagaaagagggggaaaaagaggaagaggaaagaaaaaaactgcacacttcactttgttttagtgagagtgtctaacgaaagatattaaatgcagggcaaaacaatctcattaatattcttgatttataccacacattttgattctatatgagatatatctaaagaaatggtctttgccccatcggacacttaaaatctaaacaagggagtgaattaaacagtcatcaactatggtggggcaggaaaagggactaatccaattaactttaggacacagttatttaattatacccaacccaagggtatagagtcaaatactataggcggtatttgggctgggaagttggggggtggggaatgcaaacagtgagagaaacaattgtgaaactacttaagatacattgtaggactcagcaaatgagttgggagaacagtggtgactgtgggaaaagggagataaaaatacacagtgggaatcagggaagaatgctgtggggccctggaagcaaaaccatatagaagtagcaatgagtatatgtagtactcaattcttagggtctaataccattccctactccaaagaatcagcaatcttcagagtaaaggttgattctggggctgtggtggggaaggtttaagatgagcctgaaacattttctttggccactaagaagtgcttagaaaaaagatggaagtacatcaaaaggagacgggagcttgcctggtgatcccactggctaaatatgaaaaaaatttgattacttattaaataaagtcagtaatgagtttaaactactggaaaaacagctttgaatgtgctaattttctgaatctgagcaatactttaaaatatgggttttagcttcaaaaggtaaatcaggtaatttcattttatttaagtaataccatgaaaataatgttacaaactactaagttaaatacaatatgaaatattggtggtgggttgttttttgttgttttttggggtttttttgaaacaaggtctccctctgttgcccacgctggagtgcagtggcatgatcacggctcactgcagcctcaattcccaggctcaagtgatcctcccacttctgcctcccaatagctaggaccacagatgcacaccaccaggcctggctaattttttatattttttgtagagatggagtttcaccatgttgcccaggctggtcacaaactcctgaattcaagtggtccaccagcctcagcctccggaagtgctgggattacaggtgtgagctactgtgctccgcctaaaatattgttttaaaataagtcccctttatgatcattctcagaaatttgttagaaaagaagttcccttgcacatataaaaaatttttttcaatttataaattatccttctacactaatttccaaagaataatcattgagatgagttaaagcttttcactattctttgaatattatatcagcatatccaactgttaattgaatttgagatccactagtaaagcaaaaagcttgtgactttgaagactatttaaaatgtacaatgttttattaattatcattagtagtactattatacaatggttgtacccttgtaagtttgttaagaaacagctgacattgaaattgtctgcatctaaaggacatgtcaggaaaagcagagaaatcttaccaaaaaaaaaaattgaatcaacatctcttcttttggtatttacccctttcacatcaataaacatttactgaatatctgctaagtgccaggcatcatatcagtttctataccgaaagagtaaagacgtttctgtatagtatctatatagatattgaacattaagcattgttctttggaattattccagccttgagataaggctaaaagggccataaaaataaaatgaagaaagatggattttataaaggatagaggcaattggggatgttatggaaagacaaactacacagcattttatactctctggttcttctactttcagagaatgactctatcatccaaacagctgcccaaaggtcaacatggtagtgagccaaagtgagcattcatgaaaaaaatagaaatcatcctaactttctcttactttaaatcgttcaataactcctcattttctataggataatatcaagctgcttagatttagcatataaggctaattatgattagattcctagtctcatcacttccacttttttttttttttttttttttttttgagacagggtctcactctgtcacccaggctggagtgccgtggtgcgacctcagctcactgcaacctctgcctcccaggcacaagcaatcctcccacttcagcctcccaagtagcgggaaccacaggtatgtgccaccacacctggctaatttttgtattttttgtagagatggagtttcatcatgtttcccaggctaatctcaaactcctgagctcaagtgatctacccaccttcccaaagtgctgggattacaggtaccagccaccgtgctgggccagttcctctctttcacagcacatcatgcttcaaccaaacccacctccatacaatttctagaatatgccacacttttacttgtctctgggcccttatacatctctcccttctgtctacatcactcttcccacctttctttgttttggccagctttacccatccttcaggttagcttagatgtcactatcaggaagtccactccgactctccaaatctgacttagatttccttcctatgtgttcccataaaactctatgctccccctagcacagcatttatcacacctgattttctcatccttacccctaatcagttgtgagttctgcgcgagcagaaacacttgttcactactatacttaagtgctttgcacttaagtgctcagtgttcaatacagtttcattgaagaaattaattaaccacttagctgtccatataaactacatcatactcagaatgtgatataagttctggaggccttgattgaacagcactgcacaaccacatgccataaattttatgtgtgtgtgtgttagtttgtgtgtgtggtgtatgtacacacaaatgactgtctccatctcttacctgatagttttacttcacagctgaagatatttatgaagaaagtggtttttaaaagaaattatacttatgctgtaagtataaatatacacagaaagaaatatgtgggctggacacagtggttcatgcctgtaatcccagcactttggaggccaaggcaggaggatcacttgagctcaggagtttgaaaccaacctgagcagcataggaagaccctgtctctaaaaaaaaaaaaaaaaaaaaaattaacatagccagtcatggtggcacatgcctgtgctcccagctactcaggaggctgaggtgggaggatcacttgagccaaggagatcgagactgcagtgagctctgatcacaccactgcactccagcctgggtgacagagcaatgagaccctggctcatttaaaaaaaaaaaaaaaaaaaaaaggctgggcacagtggctcacggctgtaatcccagaattttgggaggctgaggtgggcagatcacaaggtcaggatgttcaagaccagcctggccaacatggtgaaaccccgtctctactaaaaaaacaaaaattagccaggtgtggtggcgcatgcctgtagtcccagctactcgggaggctaaagcaggagaattgcttgaacctgagagacggaggttgcagtgagcagatcatgccactgcactccagccttggcgacagaacaagactccatctcacaaaaagaaaagaaaaggaaggaaggaaggaaggaaggaaggaaggaaggaaggaaggaaggaaggaaggaaggagggagaaagaaagaaagaaagaaagaaagaaagaaagaaagaaagaaagaaagaaagaaagaaagaaagaaagaaagagaacatacgtcgattactacatatatatctgtatattgaacttcaggaagttgacttttctgtatttttcttcaataaatcataacacaacactcttgtccaaaagcagtaaagatggataagaaggatcaagtaactttcataatccacccaactataaggcattaagaatttttttcccaattaacagctgatttttaggaagtgtttagttagattttctttcaaagcaattatttttcagtctgtgcttcatggtctcctaatgattccctggagtctcaagggccagggggagcaggtgctaagtgaacagagttctgaactgcctcaatcagagccactctgctttttatctggttttttttttttcaataatggaattccaaccaagattttctttgaagaagggttcactacattaaaataagaataaaagaaaaaaagaaaaaggttaaaaaacactgccttaaagaatcagcagtggattgaggtttgcactatataattcaagctctaatgtatttcatatttcttggttagactaaattcaactgtcagctttataggcctttctttgtgctaaaatgagaaataccatttgaatacaaaaatatccaggtagagggaaaacaaaatgggtttttgataagtatatttattctctgatgcagctatttctaaatttacttattatttttaatggctttatttatgtaccaatcttcaagttaatgattcataacagaacaccaaaataatctaattgaacaacagaagcccactgtaaatgccagctgctgctatgtttcatatactgtaaacaaatacccacctcattttaatagtttcttagtagaaagattaccttaaaggaaaagatccaccaaactcatatttaaataataattttagctattttcgcaatctagaaacaacaggggctccgggtaactgaaactgggggtgctccatcataaaacatccagaagaccagtggggtgaatttgatctgctggtgaacacaatgaagactaataagcaaaaatgggcttcttccaacagaaacctcctgccaacctgtgcacaacattgtgcaattgcagaacggcacttcactggaagtcagggaaacacttgcaatcaagtccaggctctgtaacaagttaagtgaatccaaaacctttacagctgaacacataaaattattcaaaagctctaacgaggtgagaagcaaccaaacttgattttcatctctgggaaaccctatattagcactgtaacccacaaggccctcttccacttccaaactcctctggcattcactagccacaccttcatttggcacccaagagtgttagttaccgttttataggtaactccccaactaagttgtaagcccctaaagggtatacataggtcatgtctcactcttttctatacatcctaaaattcttagaattttgctaagcatttgcagatgctaaataaatgtatcttgactgtttgtttaattgtagatatggtttatattaccacccgtttacaatgttgatagtttcatatggttgtgtcagacgacattccactcctttaaatgccagtcaggagagtaacggagaaaataagcggccagatcaggctgtattgacagccatgcaactaatctgatactacctctccatgcatgcgtccctcccaaagaccaagtgcccactctgttctagggctaagtgttttctgttcctgctatgctttgtaccaagtcagaaataagatttggattcaagtcttagctatgccaatgagtaagcaatttgaatagatgaccttagctccaattatctatgattctatgattctaacttcaggcctttaccttccaatatcagaatggcccctccctcacagtactaaaattacttatcttccatgatatgtcccattatcatcatcaatacacccatgttcaaaggccatttctgacttctgctacaaggtcaacatactcatgaaattatttacacttctaaagataacactgttaaatttcttgtctgatctttacgtcatacctgcgttcatttaataaacacaagtgggtagttgggtaatatgggaaaagacactcatttagggaagtttctaacatattcctgctttcagcagcaaagataagttatggctccatttgcaaataagcaccaataatagtaaataaaactaaattatttttatactggtcactaggaaggttgttttcatcttaaacggcagcttagtagccttgagaataatctgatctctcccattttataagaaacttatttttattgtctcatcaacatcaaatgatattagggagtttcacaatgactgtgacaataaatggcttagaaagaaaattcagtaacaattttgataggttttaaggaatatatgagctagataaaaatatatgagccatatagagatttgatgcaatttaaattaatatctaccagttttgaaaaataaagtttctcagaacctaatgtagctttcttctgcaaaaaagacgaggcatatcacctaaaaagacctgtccctaaccaactgttatccaagtaattaaaaagaaaagtgaaaatttcacctcttcatacatgttaagcaaaaccagccataataaaatccctgatgaaaggtgagttttaaaaataaaagtgagacgtaggtaacagaatcctccaagaaatacttaaaaggttagttttcctcagccaaaatcatatcaacattttcgtatattttggatattaacctcagtacaaatattagattatcaaacataaaatataaaaatatttggctaatggtatagtaaggttttgtttcatttttaatagagtgattagccattcacaaaaatcagtcaatattactcctccataaattatgacaaaaaatatacaaactctgaatgaagcattaattgggaaaagaaaaaagctaaatatttttattgtgaaactaataaaataaaaacctcagtctagtagagaatatacactttgtgttgattaaaattttatatcactatgttaaacacagtaatactgaaaattgttattttaattacctcatttaatctctacattaaccttatttttatccccattttaaaagatataaaccgatgctcagagtgcttaaggaatcttcccaaggtcaaagaaacagtaagtagcagagctgaatccagattatttgaccctgtaaactaggtatttaagcactatgctacactgcctccagttattcataactcccaataaatattcaacactcccaataaaacacagggcacgatgagttattgatttcataactgctactgcagcattcagatactacttatttggaaaagtgttctgaatacacaattaattcaatccactatgtaaaaggtaaatgttcaagtctcattcaaatggagaaggggtagaaaaggaagaaaagtacaaagtctatatggaacatcaattaataaaaaatattatcagggttgtctttaaacttcacaattactgaaggtccttattatcttgctgtcatttcagcactctcaattgcctcttagaatttgaaatttcactgttgaaacaaaagaaacataaaatatatgtgcattctaaaaaattctgcccttttgcaatttatcttctacatttattacctggatcttctaacactcgactagaaactaaagcaatccaactgtatatacaaaatgtaaaactggaaatgccagaaaatcaacatgacctttcaaatataacattttccacaatcatttacttaatactagaaaaacattttacagtatttaaagcataatctttatgtgtaatactttcggcaaatataaaagcaaatacagaataaagtcaaccacatttttaaaccaaaactgcaattaattttaaactactactttttctccagtagttcattatctatctattaaaacattcataaccatattagtgtgctctccgtttcaaatacaaagctgatgttaaccactgtactagtcacctcctgtacctggtagggactgctagtataacaaacccctcccctgacaccaatttccctatattagtttgcttgagaacaaaaatatgtattgggcaaagaaatgagataagccttctctgtaagccagcaagaccactcttgattaatccccaacgtactggcctcaacagcatggcttctaaccaaccagaatcctcagtcaaaaatactttaaacaaagataaaaattagctagaagatcatgttaccctaaaattaaattttatttgagagcaaatgtatagcctttatattttctgatccaatcacatctttgttaaaagcaaaagatatgtaaatcaacactaataggatgttagattttccaagagagaatcacacttcagataaactactactcaaaatcttttttattccataatcaaatagcaatccttaagaatatacctttcattcccttttgactactttaagtatttccaaaagaagctgaacagaaaatacttttcttcagacttttttccgcacatctcctagcaggagagaaaaattagcaaaacaaatgaactcagaatcattaaaaggtgtggacagtgtccatcttatagctttaatacctaagaattaggaagaaaaagagatcaaggaaataaagcgaccaacataatacctggctgaaggacaaattctatacttaaaattaagtatggctctaaaaaaggatgagtttatgtcctttgtagggacatggatgaagctggaaatccatcattctgagcaaactatcccaaggacagaaaccaaacaccacatgttctcactcataggtgtgaactgaacaatgagaacacttggacacaggatggggaacatcacacaccggggcctgtcgtggggtggggggatggggtgggatagcattaggagatatacctaatgtaaatgacgagttaatgggtgcagcacaccaacatggcacatgtatacacatgtaacaaacctgcacattgtgtacatgtaccctagaacttaaagtataataaaaaaaattaagtatggctcctaccgactctatgaattcagttcatatttctttaatgcaaagagagaaagagcaaagttactgaatgaagagataaaagtgtaaaacatcaacaaagcaactaaattagatacctcacctatcacagagaaaatcaacaaggcccaatgaatttatatgtacacatttacctttggaataatacgtcatctgctttttgtattctagacatgttctattccattgactgggaaaaatcgaaaaggtggcctttgtagcagaggacaaacagaactcaggcttagtgtaacagagcagcaaaataaggtgagagaaaagcagctgagaaggggaggtttacattcaacatgtataaaaataatgtatattggctttttttttttcatgagggaaggaaggtaactggctaccctaagaatgaagcagaatcagcatggcaagaaacaaaacaggcagaaaattaaaggatccctgagaatggtttataccccaaacaaaacaaaagtgagacaaagtagaaaaaagaccaaaacccaaactaagacaaaaaccccaatcctctctcttacattgagagaagcagaataagacaacatcaagaacaaaatatctgcatccagaagtcagactcacacacacacatactctcagagcagcaggagaacaaaaggacaacatattttacaatattaagataaaactagtacaattatatttttaaatattaattttttttaaaaaagagaaagaacaggttggtcagctctgcccatagatgcttccaaaaaactccatagcagtcatcctaatggatgtgagacacaatttcactaggcctttgatatgcatttccctaatgattaatgatgctgagcatcttttcatgcccttattggccatttgtatattttctttgcagaaatgtcaattcaaaccatttgcccatgttttaatcttgttgttttttcttgtagagatgttcggagttttttgagacagaatcttgctctgtcacccagctggagtgcagcggcgcaatctcagctcaccgcaacctctgcctcccaggttcaagcaattctcctgcctcagcctcctgagtagctgggattacaggccaccattcccagctaactttttgtatttttagtagagacggggtttcaccatgttggccaggctagtcttgaactcctgaactcaggtgatccacctgccctagcctctcaaattatatactgtggatagtaaccccttatcagatacatgaactgcaggattctttttaaattcatttctctattccctaatttctcagagttggctatatgtaatgcagaagtacattttgagttgaatatatttcttctttgtttttattttttacctaatacaaaatttacaatactcaaaagaggaatacaatggaaaataacctccatccctgttcttcagctacgaagttccaatccccagagacatttttcatcttcttataattccctccagaaatattctatgcctatataagaaaatacatttcttaagtctcctccaaaataatctattcattgttctgcattttcctttttgatttactacatcctgaagattattacatttcagtatatataaactgccttatttttaacaacataaatatttcattatatatactataatttatttatccagtcccctaaggatgggcatttgtttccagtcattgccaagagtatccttaaatatatgttatttcacacaattacaggatctataggatacaatctagtagaaaacttaaatgctatatatatttcaaattttccaaactgacctcaatgaaaattgcacaaatccatactcccattagcaatgatcacacttgcctagttccctataccctcaatgacacattgtgttttcaaaatttgtttctttgccaattaggttttaaaaaaaggcatctcattagagttttaattttgcatttctcttattatgaaatattaatactctttgtatctttgtccatttttctatccaattgttggtcttcttcccattgagttgttcgtgctctttatatatttatgaaatcagctgtcttcctatgatatgaattgcaaacattttttcctagtttttctttgctttttgatatactttgttttcttaattctcaaatttaggaacaaaagtacttccactatgtctttgttcaaactatattccttattttgaatgttcttcccttccttcaaaggtcaattcaagttgatgtctctgctctctccctaatcactcaagatcaccttgattcaaaaattatttagtgagagcctactgcattatatttacaaataagtaaatccagtgaattttgtgatatagtagcacacagcaaggaaaatttatagaggccactaaacatttaaattgtatctgaaaaaatgagaagatatgatccaaattttaaaaatgaaacaaaggcccaggtaacgagaacttattgtctataaattagtctcattggggtacagaatgctaatgttgtagtgaaaaagagaaaaagctgaagaggcaagcagagccaggtaggataggtcttttaggccaatttaagtaagtttttcttaatctaagggcaactagaagccacagaaccattttaagcagcagaatgctggtcagagaagaattttacaaagaccactgactgcaatcttgagtttaaccagcacttcagtgaacagagttgaaactgattcaaatatcaaatatactcttatttattcaataagtgaattttaaaccactatggaatagaatgctacagaaaggtgaaataaggtactgtgctgctctacttccttaactgagggcttggaacaatcactgttgcaagtcaatttaaacaaccagacaatcagaccatgttaaagatgagacctctaataataaaaaatcatagttgattctcactttatcataaaatccaaaacggacaagtatgggcccaaattcatgcagttcactcaacaactgtactcttacttctccattgtaggctaaacaaactgtcataccccccccccctttttatcctgcttttttgcttgtttttttttaattttttatttatttaggttgggggagacagggccttgttctgtcacccaggctggagtacagtggtgtgattatggctcactgcagtctcaaactcctgggctcaagagattcccctgtctcagcctcctgagtagctgggactacccatgggcaccaccacaccagtctaattttttttttttttttgagacagggtctcactgtgttgcccaggctggtgtacagtggcatgatcacggcttactgcaacctctgcctcccagtctcaaacactcctcccacctcagcctcccaaggagctgggaccagaggcacatgccaccacgtccagctaattttttgtatttttgggagacacagggtttcaccatgttgttcacactggtctcaaactcccagactcaagtgatcctcctgcctcagcctcacaaagtgctgggattacaggtgtgagccactgcacctggcccatcctgctttcaacagatgacattaaatgtccagaaagaattcatgagatgttatgaccattgaatttccccacgtttagcctgggtagtgagaaaccagtttcagggagagaatattatctatcagggagagaatattatctatcttgtcacccaattcaatcctctaaaatgaccttctatgtgcttgctacaaaaaaaaagttcttccaaacaaatacattcaaaaaataaagtttgtttgactgcatgcttctctagaatgcttttaaaattttcttctccccattctcaatatcataaatcaggtaacacctaacaggaattgtctgtactatttcttatttgctggtgacaattcctttttgattccccatgtctactttaggggttagtggtttaacagtcattcttacatcttttgtcataggatattccaccgttctgtctttagatatatgatacactttgaagttaacagaagaaagtaaattagtataaatacaaaaagttgatattacaatataataagcatgtcaatggtactaacaggagatgacaattacacctttatctcgaagtaatcaccatcaaccattctcaaactcagaagtgtatagttttttttataattttaattcattatcatgtcacttaccatttttctctaagtattttaaactatagggacattttgattgaaactagaattgtattcaatacaacacctccctcaggaatttaactttacaagcctatttctattctcttcccaagaatctttccatctaattctaccttgccctcgtggcttaacccatacagagactggtcataagtgctttagaatctagcattttcttcctacaaacaggaaataatgtgtctctgacactatccaaaaatgtggcaacataatttatgcttttggaaggaagactaacatctcaagctgacaactaggtaataaatatgattaagacccaagcacacaatgagaatatcccaaagggtatacctttcagaagaagacaaggcttaatcagtgagacattttcagcaaaaaatacagtcatttttttctcagatgctcctaaataaccatctttttggcagtattgacttgttagccccaaatcattatttcccttctttactattaatcttcaaaacaaaaaaatttaagtctatgatagtaaccaagtctgactcattaaccgaacaattccccactattctctgagtttaaattcacataggattcttacaaacagcttatgaagtcctcaaaaataacccatgaagtatgtgttatctctgctttcccagaaggaaaatgaagttcacagacaaaaagtgacttgttcatgttcacataggtaataacagagctagcacctgaataaagatcttacatatccttttcactatatatcaccactttaacatctggatatttatatttaaagcctattttttaacttttaatatagaagttttaactgaatgtttagagtattagcataatgtagtcatatacatcagacaggtctcaaaaaatcttctaatatgttgtcataatccacatactcagactacaggatgtctcttaaacatgagaaatagtaagattctggccacgtgtggtggctcacacctgtaatcccagcactttgggaggccaaggcaggtggatcatctgaggtcaggagttcaagaccagcctggccaatatagtgagacctccatctctactaaaaatacaaagattagccagacatggtaacacatgcctgtaatcccagctacttgggaggctgaggcacgaaaatcacttgaacttgggaggcagaagttgcagtgagccgagatcacgtcatagcactccagcctggatgacagagcgagactccgtgtcaaaaaaaaaaaaaaaaacatagtgagactcataaaaagcacaagctaattcatttataaactgattcaaactgccctcacataataacagtgctaaatagttattaatatttaacaaaactaaataataattattcagtatttaaatctgacactaaaaaaaactcttattcaagcaactattaaacaaataagctcctgggaaaataccaagatccttagtaaataatctgcaataccaataaaactaaaaataaaggccaaaaaggctacatactgtatgattctaactctatgacattatggaaaaggcaaaaacattggagacagtgaaaagatcagaagttaccaggggttaggagaagggagggatgaataagcacaacccaagatttttaggcagtgaaaatactctgtatactataagcatacatacatggcattacacatttgtccaaacccacaaaatgcactacaccaagaatgaaccctaatgtaaacaatgaactttgggggataatgatgtgtccatgtagtttcatcaattgtagcaaacgtaccattctggtgggggatgttgatcatgcaggagaggctatgcatgtgtgagggcagggagtaaatgggatatctctgtaccttccattcaattttactgtgaaccaaaagaccctaaaaaaaagtctattttaaataaggcaaaatatctgcggcaatcttaatcttctcctatcaattattacttcacaggtcctctgttaactatttagtagaaagcatccttggctgtcaatgctaaccttctgcacagctcttatttacacacacattgctcctcataacatctgctctgcccactgtagcctgcttatcctctaatggtcatcagtatactgagtccaaagacagggaaggagtcaggtacaaatgagatggagaagacaggtagtggggctaaggaagcaaagaactgctaaagagggaagtcagcagataaatctgcaggagaaaatctgcagcaacaaggagaaaagaatcctgagttgatacaaatttgtttattggtttacataatgggaaaatcatatgaaatgaaattatcctaaaatacaaaacatgatgacattacaaacatttcccttctttaaaaaaaagtctttgctgtatacaattccgtaactagaacttgataatctgtttgcaatgtgtcccccagcgacaagcaagatgatttttcaaaagttgactgtaaatgctacatttttcaaaggaaagatatataaaagtgtgtgtgacaaagacctatgtctcagaataacttggaaaaaagtacaaatattaaatttttatgatttattgcctgaaagaaagttgtacacttttatattctgggtattcttaatctaagaagtcaagaacatactatgtattaccaaactgggcaagagttcaatgagattctgaaagttatacctaacgtactatgtattaccaaaaacatacaatatgtttagtaacaaatagtatgttaggtatgttaggtatgactgttagaggtgtgtgtgtgtgtgtgtgtgtgtgtgtgtgtgtgtggtcacttgcttgctttggtcatcggtgaggaagccaggctaagcaactaacaaagagtccaaatatctgagtcatttatgagaggctaagggctccagtggcaaatcagggacctataagacaggctcaaagatggttctggcaggatccaccaccaccatcactaccacctcagcaaaatacaaccttcttcatctgaagtttcagggaagcacaaaggctcgagttctgccagcagtccagctcagtaaacactgattaagcaccagtgaagtacaaagcattaggttaaaggtgataaaagacactgaataggaggaaatatagcccctactaccttaagaattttccagtaaaaaatatggtaagactataatccaggcaaggtagagcaagtactaaaagagaaatacaaagaaggcattcagaggtttcctcaaggagatgctctagaatgaaacctgaggctattactcagatgaccaacaagttcatgctatagccactgctcgtttataattttctcccattcaatgtactacttctacaccagagatgtgagaaacttgaaaaaggctattttgttctagctgattattaaagggggagaattcttgaatataaagtaagatataaggtaaagcaagcaggaaaggatttggagcaaggtgtgtcataatgctaacatggcacaaagcaaaataattcaacttccattcagttttactggtcaaaaggaatagcatcatttttgttttgttttgttttgttttgagacagagtctcactctgtcacccagcctggagtgcacgggcacaatctctgcccactgcaacttccacctccagggttcaagagatcctcctgcctcagcctcctgaggacctggcatcacaggcatgtatcatcacacccggctaatttttgtatttttagtagagacagagtttcactatgttggccaggctgttctcaaactcctgacctcaagtgatccacctgcctcggcctcccaaagtgctgggattacaggtgtgagccaccatcacttctataacacatttatatgctgctttaatggtttacaaaggactctcacataaatgcttacaatgaaactcaaagcaatcctatgtcaggtagagactgttatcctctcagagagcctaccctcacaagacagtccacaatgatccttgcctcatgtccttgtgtaatccactcccatactgaatcagggctggtctgtagaaccaattgaatacatctgaaatgatggtgtatgacttccacaggtaagtcataaagggcactgcagtttctactttggcagcttgaatctcgggaaagtcatctgccatctcatgagaatagtcccacggcaagcccattgtggaaaggaaccaacctgccaacaccaactggccagccaagtgagtaagccaccttggaagtgaatcttttagctccagtgatgctcctataaaacttccactcctgctgatatctgacagcaacctccagagaaccaagcaaggaccctcaaattgctgacccacagcaaccatgagataacaaacaatcattgttgttttcagccactaaggttttcatgttacaaaacaacagagaacccaattttacatatgaggctcagagaggttaatttaccaattatcatataggaatgagtagagaaaacagatctggaacccagtctttaggctttaggttcaatttgtcattaaacaataccactttcttctcaactaaaataaggtataatactgtaaggatgatcattcctacacgattatatgactgatactagtatgtcaagcttcctacagtacagagacacagtatatgtccctgcattcttaacgaatataatgggaatctccaaaataagtccatttgtggtgctccattgtgctctgtggagttgttactattttctggaaaatggctatttttaatgtgcatatcatgaaaataaacacttaacacatttagagaattttaatactaaaatattactgacactgagactacacacttaaatcttaattacaataagcatctgtgtaattttaaacaattagaatatatcagacaggaaatgctcaactgctatttctttaaggttctgcattttggctttaggtcttcaaccttgtagcattacacaaatgtagtaaaatatatcatcaaaatgctcgtgatggtaaaatattaaatcaaaatccataaagtagttcctatcttacaggacaaggtagccagctcttaagcctgtccacttctggagaaggtcaagagaacattttattgttataatcacatctgcatataatgttccttcacacaaatctcctcttttgagccatataactttgcaaaacaggtaggcaggacgggtatactaccatcctatttttcaatgatggccttagagaagtctcagtaacttaactaaggatacgtaactattaaaaggaattcaagaatctaatctacaattttttagctccaaatcccagccttttcttctaagccatgttttagcccagtggttctccaccctgactgccatgaggacacctaagatgctttgaaaatatcactgcctggacctcatcccccagatacttgatataattgcactggtttgtgttagctgtctaatatataataaaccagtgttggtaaattcacagaaagtttatatcacaagggagaaaatgctgatacgtctatatgtaaactgaaacatattaaccccctaagaactccctcaaacacaaaaatatcttgcaataaaatcacgcagaacaagaagaaagggaagatgagaaacccaagccccttctgctgctatcgtggggccattaaggaatattttattcccctaatcttactccccgaacctcaccatgccatatctcaagctatagctcaggtatcaccttttgtgagaccttcaggatcacaaaaataatgaagtccattttttgcatctatcttaccttgaactctatcatagcacatattgtccctcaaagcattgctttatttttattttattattattattattattatttgagatggagtcttgctctgtcacccaggctggagtgcagtaccacattctcggctcactgcaacctccacctcctgggttcaagtgattctcctgcctcagcctctgggattacaggtacatgccagcatgcctgactaatttttgtatttttagtagagacggggttttgccatattggccaggctagtctcgaactcctgacctctggtgatccacccacctcagcctcccaaagtactggtgctgctttatttatatatccatttttctcactgccctgaggggtccttaacccatttatgctggaggttgcaaattttttttgtgaaaaatcaggccttggcgatgaccttgagaagtaggatataaataactcccactagcttagcgctccaataatggagcactaggcataaatgcattaagatcagatccctatgttactcatccttcctgccatatatatctttgtatccagggcctttaccatagcagatattaatacatgttggctatgctgaatgatttttatgtttgttatcattatttcctccattctcctagcagacactcctgtgaaatttttcaacttttaataaaggaaaatggagtttttacgcacaactggattaggttagagaataatgtatgcaaaagggccagacgtagtgagagcaagacagcagtgaactgtggggcaggaaagaatagagtagaaaggacatttaaaattcatatctgacagttggggtcagatatgaattttgcaagccgggaaggagtaggcaaacaaagcgacaacctaatcttcattcacaaaaaaaaaaatatgacaagcaaggaatcaggcaactgtattttcaacatctccctttctatggtgtttctaactcacagcatacagacatgttgtttctctctcaaaaaataaaatctgaagcagtgatatgatttcactatgtatttgacttttttttaagattccacatgtgagataatacaatatttttctttctgcatttggcttacttcacttagcataatgtcccctaggtttacctatcttatggcaaaaagcagaatctatttcttttttaaggctgaataatattccattctatatatgtactgcagtttgattttctgttgtcttttgttggacagttaggttgtttccatatattcacacccatcaagatggctactaccaaataaaacaagagataagtgttggcgagggtgggagaaaagagaacccttgtatactattggtacaaccattatggaaaaagtagggaggttcctaaagaaattaaaaatagaactaccattacttctattttgtaccaattagccatccctcttctgtgtgcatgtatatatatatatatatacatacccaaagaaaatgaaaccgcaaccttgtaaagatatcagtcggaatttttaaaagctctctaggggattctaatatgtgtgcatacagagatggagaataaaacagtgatcccaggggagggggaaggaaattgagatgtaggtcaaaggacacaaagtagcagccatgtataatgaaagagtttgggaactcatgtacagcatcagtactatataatactgtattgtattcctgacttttgctaaatgagtagattttagctactcttgtcatacacacaaaaatggataactatgtaagatgatggatgttactatgtctcactacagtaaccattttactatttacatgtattccataacatgttattttccttaaatatacacaataaaatgtattaagtaaataccctgactgaagaacaattatctcctaagagggacccaagcatatctactctctattctcatgtccagcccccttcagcctcatctcctattcagtcctttacccacagcacgatagctttacctccaccactacaatgaaaccagtgacttctaacagtcattgatgattgtaactttacaatcatcatcatacttaatggccactctccttcagcatctttacatctttctcttttatggtttctcctttaaatttttacattctctaagactaatttttagcccttttctcttctctttctatacaattcctctatgtacttttatccgtatctatggatacttcagttactctccatatggtaagaacacacaaatctgtttctccagcctttgcaatctcttgtgatgttccaggatcctatatccaactgccttctagacatctcacacttgccaatgatatgccctgcgagcatgttaaacacaggtccaaagttgaactcattctcttctccctcataccttcttcctcttctcttttcccactcacaacccagaaacctaggaagcattctaacattctccctctcccatatcttttacattcaaacagtcacaaagaccagcaaattctccctcatcttacttttcctaaacattctcacttctctattcccactacttccacctttatctaagctttcaacctctcttatccctactgatgtactgtccttgaaagcttccagtcttgccatgaccccacacccaaccccactctaccctcaatctacccagcacactgctttcagtgatcttccatgacactcacaattcttcagtggctcactactacacatggtataagaagtgtaccctgaactggctatccagtttcatctaggaagtgtaccctgaactggctaaccagtttcatctcctttcactcctgaccttgtccttcacactctaatataactgacctacatatagttcccagtatacactatgttctcgtaatgccacacaactactcatgctgttagctttacctagaaatgctttctattgcttgtcaacatgcccactcctactcagttttcaagtctcagctcaaacacaaccactactaaaacccttacctggtattgcaggcagagatcaagagctcttgctagatttcatttgtacttgtacctacctctgttatagcaaatagcatacagtatttgaactattggtcaagatatctgtagtcctacagactataagatccttggtcaaagatgacttttcatctttatatcctcctaactagttcaattcacacagtcactagttccatgtacattactagctcaatgcagatagatatactaaaaaaaggaggggcgaggttaatgaataaggtacgagtcaatgaaagaacaagaaaatcaactggactttgagtatagaaaaaaaaacaccagatcttaagaacgtacagacatctttagtacagacatctgttactgtagtacagatatccattactaagtcctaaccattaaaaaaaatagaaaaatatggttattcaggtagtatgaagatgacaaagaaaaaaacttattattggactaagtagacattaagaaggtaagagtttccagcggaacagttgacaaagatcaacagagaagccagagaaaaagatggttctttctaggaaacaagtaattcattgatctaaattcatggactgagcaaaagactgccacctttctctcagttcacaacccctctcctttgtcattattctgcatgaccccttctgagtcctcactaccaaatccccaataccatgggtagttcccctccaatggagccacaggtccaggccagtgacttaatctggatgcaagggcaagggatagaagggtatctttgttcttgtgtctaggactttgaggaaaaatgaaacaactatttactgagaatttattttacggcagattctgtgccacattacactcactcactgaatttcacagtaatcataagtaattatcccatttatagatgaggaatttgtgtccaaggtcaacagttaagcaataacaggccctgcctgaaaacctaagaatgacaacctccagagctttttctatacccctcactacctcaaaatggagggagacgtggtccagccattctaggttggcactcaggagacacttacctccaaaacactattatatatgttgattagagtctacagtaccactaatatataataagcacacaatgagtttaaaaagctttccttagtacctttaggaaagtaagtactagatttcctggggttctgatctggaaatctaaatgctatttattcctataagtacattgttaactttacaaacaacagacttgaaaatgaacttgtggaatacaatgggttcttaagtaaggcttttctttaagaatattttcttgcttccacaaaaaatacaaaagccaccaaagatagaatgattttgccttgttaacttgtaagaacaatgacactagaagaaacctatgggaaatgtgcttatctgaccaggtgctcattttcggtgggctgtcatttgactaaaacatcatactaaaccctacagaccacagcttatgagagaaatgccacaaactatagcagtacagttaatatgcctataatctactgacaaaacatactcctcagtaaagtgaaaccagatgtctggtgtgaaatcagatgtctgtgaacttgtctttctcagtttccagagcagtatcagatatactaaatacacagctaagctgtatattaaatccacaacttggcaaaatcatgacagtttggacatgaagcatcagcatttttattgtaatccttataaaccaaagacatttccaaaatggaaatcctaagtttaagtactcagctaaatacagtaatatgtctttctcactttaagaatagtgtcagggctttttaaacacattatagaaattctttcccttcatttttcaagctgacactctttatccaaggctgtggaatgatctgataaggccacatcaggtgtcagtcctcgtcccagaaattctaggatcagatacaccaggtgaacccctgtgaaaagcaaatcccagggaggcttaacagctataggaaagttaggcactacatggctttccacaatcaaaaggaagatcataggaaagtaatgggtgaccacatagaaaaacagggagggaaatttaaaagtaagtacttctatgccaggcactgttttttcacacattcttttatatatactctttgttctgttttgatggataagaaatcaagcagcagagaaattttaatggcccaaagtgacacagctaataaaataagagccagaaatcaagctcatgtccaaaagactgtaaaagtcatgctacttctacatgaagttgtggggtggagtgaggaggggtggtaaatagccaagaagaaggagaaaaagaaagaaatttacaattttatcaaataacagtgaaatatatatatataaaacatgtattatgttccacatatgttccatatataatacgcagttaagatgtatacatgtttaacatatacttaagctgcatatttagtatgtgtatatatggaacaaaaagttgaagaaacaagtatcaaattgttaagtggtcatctgaaagtggactcataggaaactcacttattgccttttataccctcccagatttaattctaaataacttttttttgactttttattactcttataaccagaaaaagacaaagaactattctagcttagatcttttaaatgaggctaaatgcacagaaacccatgcaagttaaaaatggtctactttcgaatttatttttctaagtacatcatcctttacactctccatgattcctaatattaggtccttcttatggaacaactacaaaagttatcctcatctaattattatactcgtacactggaaaatgactataacattattcattataggaaacaaatcatcaaggtcagccatccttgtaagtttattactgaaagtactagaaaggcggaataataattctgttctcccacaacactgtatagacctgcaaaccactatgatcagtagtacagggaaagtcttgtaaattaacatgtaactattgagaaaatccacaaaactggtgaaaggcctaccccaaaacagccatctccaatacaatctcatcattctcaccatcctacttttatcaaagtgctgataaaagtgcgtagcacatggtaagagagaattagctattgaatcaatgaaggaacccattatcaataaacaatcacttcctgttttccataaattatgtggtcacctatcacttgagcacaaacaaataggcacgttcaggacacaggcagccagtatcagaataggcagcctatcacagagggcaattctacttttcctgtgtaagaatccaagaatgcagttttactacattcctgcttgtagctaatctgaatttcaactaatttaaaacggttatttatatgtgacatataggatgcataatgagctcccaaccttgtgagaggagctgtgtttcatttcaccatacaggggagagggaagcagtgtattaaagaagtgatagaaaagtcccacagaagaaccaatgaaatagaccacactgaaaatcacagtaagcctcagagaacttcagtgtcctttttggcaacttttcaaaagtgaatggaatgcttgccaggaggtaccaagagtgaaagcccagagaaaaaggcccagcctggtcatctctctcccctcaaaacatcttcttctgtaagcttgagagatcccaaagaacttcaacacttgtaatcttgttactaactttatgctttggggtcctaaaggattttttcaggagtacccttttaaaatgtaaacatccctaggggggttactgttcattatcaaacaggacctggattctttagtgctatggtctcagggattagtcaaagctggctaataagataggggccggagacagacaactagagaggaccaatgttccaaggtaaaaacaggtaaaggggaagtgcagttttctgtcgggtcaaggggctaaaagggatccacatgcccaagctgttaaactctatagactgtgtgaggctgaaaacagtccggggcctggagcctgtgactttgaaggtgggtcctccagttcccgatgaaaaggtagaatctgggcccaagttccccacgagcagttctggacatctagcccttctctctctcgctcgctctcaggataaagtcctaggtccttccacccctgaccattccttacttaccctttctcccgctcttcctcggtgagaaggggtaagtggttattttgtgccctcgcccaatttggccaaaaccctaaaagtaaaaaacgacagacagacacgtgctttaaaatcatgttgttcaagcctgacgctctcccaccacctgcccaacacttccaggcagaaggcagcgcgcccccacagcgctccctcacggccagagccgggggccggactaggcccctttgtgaggactgggagagggcgcgttgttggggcgccggctcggcggggaggagcgggccagctccgggccaggtgtgccgcctgtggcgccggtttctcaacctagttagccagtggcaccaagaagaggactaggctggggtggccgccgcacgcgcctcagataaacacgcgcacgcacacatgctcgcgatcacgcaggactcgcggccgcgcacccctccgcctcccggcaacgcccgccccgccggggccggggccgactcccagggaagggtccccagcccaagagaccaccaagggtcggcggctacgcgcccgccgacccctgccagcctcacagccccccacccgccgccggacgccgggcgcccgccctccgcacccgctgcgcagctcagcccgggggaagtccccgcgcagaccccgccctccgccggcggcaagctccgccccgctgccccgtcgcgcgctggccgcccgaagctccgcccccggcggaaaactggtctctggaccgcccgcccaggtcgggctcaaaatgcggcgtggatctgaaaggatcaaacacaacactaattcagcaagctattattgagcacttgccctaagctcagcaacgtactaatgggggagactacaataaagagccgaaaagtctatgaaactgtgtcttcagctcttcctcttgttttagaagccaggaaacagagaaccctcacagttacttaagtacagggcagtagtggcaaagcacctcactagcgatctctgggcaactcttcatttcattttttcctactcatgagcactcaggaaaactattcagttttgctgcctccaggtaaaacaaagtgagtaacacaggacaggcggtttacttgagagaaacgggaatttcatactgaagcttttgccctcaaatggtacaaactctttttttttttttcctgagacggagtctcgctctgtcgccagagcgacactgcaatctccgcctcccgggttcacgccattctcctgcctcagcctccctagtagccgggactacaggcccccgccaccatgcccggctaatcttcttgtatttttagtagagatgggatttcaccgtgttagcaaagatggtctccatctcctgacctcgtgatccgctcacctaggcctcccaaagtgctaggattacaggcgtgagccactgcgcccggccgaatggtacaaactcttaactgggttattacaacctacaaagaaaccttcttatccatgttattaattatcctaattcaatgtggtttaaaatgttgatgaaagtacccaaatcatggtgctccaacaagctggatgccaaccaggtactcgtaagtacttgcaattacaggtgcgatattttcattccatatcatcccaagatgcccttccttcacgtgaagcagccagaaagatcaactaccagattccgcatgattgaggaattgataaatagaaagggaagaccgaaaccggccaaattttcccttcgaagtgaaacttgagaaacttgcgtgcattttacctgagttcctttctcagcagataaactgtcagacctcccagatagtgtcaaggaaatgcaactttccagaacactacatctggacaatgaggtgcatctgctgcctgttcacaaactcctcttccttacccctccataattccctgctatagaaagccctaactttagtctccctaagacatgtttgagactggtctccctgccagcatcacctgcattaaagcctgtcttccctggcaatactcgttgtctcagggactggttttctttgctaggagcaacccaacctaggctgaagcccaggcatttagcagcagtggcacctagaaatactgaacagacataaaatactttttttctccttttcttactcctccagttgtatcttcattatttctgtctctattctccctctagatactgccaaactactctgtgcactttcagatcacttaatactaatgtaaataacagacattctggcactcttggttcaaaatttattctaaaggtttaagaatctactcagggtcttaaatagcctgataactaaaattccaagagtttcctaaagagagcaaaattgctctcctgtgaaggggatatgtcccagtttttcttacttgtcactgaaataattactgcaaagtaagctcttttcggccagtgcttaaggacttaatttcaagagcacttaggtgacaggaccaccctcatcaaatagcagtcaagaactatttggtaccatgaccccaaattgaatggagctcctggtcactaggaactgacagtctgggatggaatgtaggtgaataaacaacaaagacaggtgtttatggcctttattgtattgggaagtcaataaacatacaaaaagagttgctaggtctggcctgattttatcactaagattcatcaagtgtacttaaaaagaagctaatatctggaaagggcagaactatggtatattagtcagggtttcctagagggacagaaccaataggatagacatataaatataaagaggagtttattaagtattaacttacatgatgacaaagtcccacaataggctgtctgcaagcttgaggagcaagagagccagtccgagtctcaaaattgaagaactttgaatccgatgtttgagggcagtaagcgtccagcacaggagaaagctgtaggctgagagactaggccagtctctccttttcatgtttttctgcctgctttatattcactggcagcttattagatggtgcccacccaattaaaggtgggtctgcctttcccagcccactgactcaaatgttaatctccttggcaacaccctcatagacacacccaggatcaatactttctatccttcaatacattcaagctgacactcagtattaaccatcacatatggagacagtaaaaagatcagtgattgccagaggtcacagaggagggggatatgaagcacagatttttagggcagtgaaactattctgtatgatatgataatggtgatgcatgtcattatacatttgtccaaacccataaaatatacaacccaaagagggagccttaatataaaatctcaactttgggtgataatgatgtcaatgtaagttcatcaattgtaacaaatatactgctctggtacaggatattcatagtcagggaggctgtgcagatgtggggtacaggaatatataggaaccctatacttcctgctcaattttgctctgaacctgaaactgatctttgggagaaaaaagtttatgagaaaaagaagcagcagttagagcatcctattttattctaatttatcaattaaattctaagctgaatatttggctttatgtatctagttcaaatatatttgccttgtctccttatatattaaagcagacctctatttgttgttaataccatcaggggaaaatgaatcataaagtcctaactaaggtacaaatttaaactatagttaggcatcaaatctaatggtcaaagagatatttaaacaaagttaaaataattaagtttacagattccacaaatatagatattaaaatatattcctatctatacatacttaccattggtaagcaaataatagaaggtatcatagagtagcagttctcaaactactttttgatctcaagttctctttacattcttaaaaatgattgagaactttaaagagctgttgtttatgtgggttatatatgtccatatttactgtattaaaatttaagatagaaaaatgttagacatgtgtttgcttaatttaaacccattacatgttactgtaaaagttatttttataaataatgactactttttttccaaaaaattagagaaaagtggcatttttaacattttataaatctcttattatctggcttaaggagagcactggattctcatattctgcctctgcattcaggctgttgtgatatgttgttatacctaagatatgaagaaaattaactgtcatacgaattcatagttgaaaaagagaggaccttacaaagctccgggaagggtttcagtaacccctaggtgttctcaaacctcacttggagaattactgccaaatggccttttgcatttcatttgtttgaatgtcatatatttccacacaggcttctgttaacacctgaaattatagccctttacttatttcaagctaaaactcatatttgtcagctcatatcaaaccatgacatttcaataaagtttttaaaagcttttactatagcaactctgatgaaattgatattattatttgaattgatatgaaaacacttgagatttcatttatatccttcatctcaaacgttttggaaaattttgaatataaattgtaccatctggaaaaaatgtaagattggtatatagttattaatccaattttaggtatgcttataacaaggtatatccccttttataaaaataatttaaaagcgagcttaaaacaaaaacaaaacaagcaattacagttttatttatgaactaaatacttgattctaaacttactaccttggaataaaattttaaatatataacctttcatttttattacaaataaaaataatgtaaatcatccagtttggggttttttaatacaatttccaactaaaagaaactagagctgaccaaccaaatgtctgacttcagatctgggtcaggttatacacaagatgagcataggataacttgtcccacaaagccgggaatccattaacaacaaaatgtgtcaaagggacacagaaaccaatatcaaatagctcctttggccaaagatggacaatttaagcatcaaaaaaagtaatggatgcagttgttagaaacatactgaatatataaaaattcatgagttcttaatgatgttccaaaaaggggaggtcaataaaaggaaaaaaaaaatccactggacactattgcaagtagctagcattaagcccttattctaaaattgtccattaaaagaaaataattcaaattttctgatgtatctttcctgattaaactatatatcagaaaaccaaattggtgttgagggaaagttgttttttataataaatatgaaacaacagaattggaaacccaccatttagcaatcttgcatttaataaatgattcaggcaaccatcatcaatggatcaaaccaacagatgaaatgttcatgaggaacttcacaatggagatcagaccgtcactacctcagcctaataatctgtcattacaagtgggactccagacattgtgtgcttcctgatctaatgccatctgaagcactcagcacaactatgaaatgttatcacccaaaaaacatgaatgggatctaatcaagccttaaaactgacttctcacttacaggcttacaaaaaacatgagggttacaggaataagttaaatgacaccacaaagaggctgggcgcagtggctcgcacctataatcccagcactttgggaggtcgaggaaggtggatcacttggggccaggagttcaagaccaccctgggtaacatggtgaaaccctgtctctactaaaaataaacaatgagccaggcatggtggtgcgtgcctataatcccagctactcaggaggctgaggcaggagaatcgcttgaacccgggaagcggaggttacagtgagccaagatggcaccactgcactccagcctggatgacagggtgagaccctgtctcaaaaaaaaagaaaaaaagatgccacaaagaaggaaacaggtaaatctagaatggagtagaatggaggacactctctaggacaattgatgtagtctctacaacaagttaataactggacacacaggagagggaatgggtcaggagaagcctaggttaaaaaaaatacagccatgaaatgtaagatgtgaacctttatttggatcctgattgaaacatcacaactataaagacttgtaagacaatcacggacatttaactatggactggtgttagatgataccaaagaaatattattttattaggtgtaataatggcattgtgattatgtaagaaaatgtccataatttttggagaggcattctgaagtatgttgaagttaaatgacatactctctggaatttactttatacttcaacataaaaaaaaagaaggaagaaaaagagatagcataaataagaaaataaaatggataattattgaatctagatgatgaggggagttctttgtacttttccatggttttcgtatatgtatgaaattttgtataatgaatatttaaaaatataagtgacggccgtagctcagattttctagaaaacagtgcctgagacaagctcacatgttaaaattttcttgggggttgcagtactagaaaagcaataatgaaggaaaagggagaacagaggcagggacagagggaggaagatccatggtggtatgtttccaagctgattatagcatcccagtacatgcagttggttgcttagtcacacaggacatctcaagaaggctgtgtgaaaccactgggtaacaatcctccctcaggaggggaaaggttaaggcactttttttaactggatccttcctgccttctgtctctcattcatcaatgtttgttccataaagcagggcaagcatgtgggggaaaaaaggttgggggcagggaagtgaaaatgggttttatgaagtgactgagatttgtttaatctcacaatgtagaatttaaacaaatcagtgacttttgggtttagtgaagacttacctataattttagcctttttgaactagaataatcattctgcttgactttcttattacatcagtaaataatttattcaggtcaaagccattatttttgattaacagaaatcacagtcacataaatggctacagaaactaaatataggagaagggttctaccacagtgacctgaacatttgcatgcgcccttgcacatctccacaaaggccacatcagcaagacttgactgcagctgatctaagtcatggtggaattctgttgattctcctacaacatgagatcatgagaggcttgttaagagctgacccaaggccatttctcattcacctcccagtttctcattgcctcctgtgttttgaggaggtatgacactttctgcctcattctccctagaatacagcctcaggctgtaaaactgcttagctgaagcatgacattggttcctcaggaacagggtgccctatcatccaggttgtggtcatctggcctcctttgtatcagtgtcaccctgtgcaagggataccagagctggcatctttggctactcttgcttttgctttccaagtaagtaataaactgtctgaatctaaaaatggcaactcattgttttcttactagctgaatctatcacccttgccttaccttgacaaattctaggcaagaaatttttactttccttaatgctaaagaggtcctttactctttcctctttgtattttgctcagcctacaaagttagtagccagtaaacaaactgatatgaaaatatgaaagacttagattcacatttttagaaagagtaactgttctctaagtattttaggataatttttggccaacagttaaaggagccttccttctcctggccttgccttcaaattaattaataggctattcttacaaggcaggtcaagattcagtcctcttaaaaaataaagaccaatcagaaggattttcaacaaagtccctttattttctactcacacttaaacactatagttggtagggttcaaaaagtctgggaaagagggagacgaagcaagatggtgaaatacaaagctccacgaatcgttcccactaacccacaccaagttaacaactatctacatggaaaaaaacaccttcataagaacaagaaatcaggtgagcactcatagtaccttgctttaacttcatagtgctgaaagaggcaacaaagagagaaaaaatagtactgaattgccgatgccaccccctattcctccccgaccccaggagcagcatggtgtggagagtgtccttgggtgctgggggagtgagaacacagcaattgtgcggcgttgaactcggtgctgtcttgttagagcagaaaggaaaccccaaactcagctggtgtccacccacagagagaacatttaaactagccctagccagagggggacttgagtgcctgcaaacctcgccacccagggctacagctgtctgtctccaagtaaacttgaaaggcagtctaggccataaggactacaactcttaggcatatcctagtgctgaagtaggcccaggacagtggactggtggggcatgtgacatactgagacactggataggtagtcaaggaagtgctggcctcacccctctcctaacctcaggctgcacagtttgcagctccaaaagagacaccttcttccacttgaagagaagagagggaagaacaaggagaactttgtcctgcatctacggtacaagctcagccacaacaggatggggcaccagatagacttgcaaggctgcaaggcccctgttccaggccctagttcccagagaacatttctagacacaccctggaccagaagagaatggcttcaggtaacagcccagccacagtgggtagaaaatcaagcaagctctcgaggtccctgattctaggattttactcttgaacagcatttccggacctgtcctgggccagaggggtgtccactaccctgaagggtgagtcccaggccaggcagcattcatgacaagctgacttaagagctgttgggcattaagggaacatcagtggtagtctggcagtactcttcatggcccaggatggcagtggctatagggtaaggctcctctgcctttggaaaggggagggaagagtgggaaggacagcatcttgtggtttgtttaacagctcagccacaatacaatagaacaccaggtagacttctaaggtttttcactctagtctctgactcctagacaatggcacttctgtacccactggtgggctgggggaccttccctccctgaagggaaggacacaggcctggctggctttgccatctggtgatagtagagccccagggtcttcagcaaacataggcagtagccagggggtggttataggaggccttggtcaagtaccagtgctctgctggcttcaggtctaacccggcacggtcttagtggtggtggccacaggggtgtttgtgttactccatccctagctttaggtggcttggaacaaagacagaggctgtttgggagaaagtaagaagaaaggaacaagagtctctgccttgtaatctagagaattctcccagattttgtccaaggccatcaaagcagtactctgtgagtctgcaagaatcatagcattactgggtttggggtgctccctgaagtacatcacaacactcacgtccttgtagatcacaacacccaagtcctttcaaatatctggaaagccttcccaaagatggctataaataagcccagacagtgaagactatagtaaatatccactcttcaatgcccagacaccaaagatcatctactaggatcaacactattcaggaaaacatgacttcatcaaatgaactgaataatgcaccagggatcaatcctagagaaacagagataggttgaagaaactcaaaaacattcaagataacacagagaaggaattcagaataatatcagataaatttaagaaaaagattgaaataactaagaagaatcaagcagaaattctggaactaaaaaatgcaattggcagactaaagaatccatcagagtactttaatagcagaatttgtcggggaatttgccctgatattcacgtaggttcttttctatttttccgaagtgtcagccagtttgagaaataaagggacagagtacaaaagagagaaattgtaaagctgggcatccgggggagacatcacatgtcggtaggttctgtgatgccccacaagccacaaaaaccagcaagtattttttaaggattttcaaaaggggagggagtgtgcgaataggtatgggtgacagacatcaagtacttaacagggtaatagaatgtcccaaggcaagtggaggcagggcgagagcacaggaccacaggaccgaggtgaaattaaaattgctaatgaagtttcaggcaccattgtcattgatagcatcttatcaggagacagggttttgagatcaaccggtctgaccaaaatttattaggtgggaatttcatcttcctaataagcctgggagcgctatgggagactggagcttatttcatctctgcagtttcgaccataagagacaggcacaccttgcgggggctgtttataagcctaaaactccaggcgtgtattctctttctcagggatgttccatgctgagaaaaagaattcagcgatatttctcccatttgcttttgaaagaagagaaatatggctctgttctgcccggctcaccagcggtcagaatttaaggttatctctcttttttcctaaacattgctgttatcttgttcttttttcaaggtgcccagatttcatattgctcaaacacacatgctctacaatttgtgcagttaatgcaattattacatggtcctgaggtgacatacgtcctcctcagctgacaggatcaggggattaaagtaaagacaggcataggaaatcacaagggtattgattggggaagtgataagtgtccatgaaatctttgcaatttatttttagagattgcagtaaagacaggcataagaaattataaaagtattaatttggggaactaataaatgtccataaaatcttcacaatccacattcttctgccatggcttcagccggtccctccttttggggtccctgacttcccgcaacaagaattgatcaagcagaagaaagatttagggagcttgaagacaggctatttgaaaatacagccaaaggagaccaaagaaaaaagaaaaaccaatgaaacatgcctacaggatctagaaaatagcttcaaaagggcaactctaagagttgttgttcttaaagaggaggtagagaagggaatacaggtagaaagcttattcaaagggacaataacagagcccaaacctagataaagataacaacatccatgtacaagaaggtaatagaacactaagcagatttaacccaaagaagactacctcaaggaatttaataatcaaactcccaaaggtcaaggataaagaacaaatcctaaaagactggtggctttgcatggtggctcacatctctaatcccagcactttgggaggccaaggcaggcatatcacttgaggtcaggagttcgagatcagcctggccaatatggtgaaaccctgtgtctactaaaaaaaaaaaaaaattagccaggcgttgtggtgggcacctgtaatcccaggtacttgggaggctaaggcaagaagaatcacttaaaccgaggaagtggaggttgcagtgagccaagatcatgccactgctctccagcctgggtgacagagtaagactctatctcaaaacaaaacaaacacacacacacacacacacaaagcaagagaaaagaaacaaataacatatgacggagctccaatacatctggcagcagacttttcaatggaaaccttgcaggccaggagagagtggcatgacatatttagagtgctgaaggaaaaaaactttaaacctagaataatatattcagtgaaaatatccttcaaacatgaaggagaaataaagacttttctacacaaagaaaagctgagggatttcagcaataccagccctgtcctacaagacaagatgaaatgctaaagagactatttcaatcagaaaggaaagaacattaatgaacaataaataatcacctgaaaatacaaaactcactggtaacaataagtacagacacaaaaaaaaatgttgtaaaactgtaactgtggtatatgaactactcttaccctaagtagttgaagactaaacaatgaaccaatcaaaaataataactataacaacttttcaagacatagtaagtacaataagatataaatagaaacagcaaaaagttaataagtggggaaacaatgttaagtcatagagctttcattagttttctttttgtttgtttatgcaaatagtattaagttgttatcaggttaaacataatgggttataaaatagtattagcaagcctcatagtaacctcaagccaaaaagcatacaatgtatacacaaaagataaacagcaagaaatcatatcaccagagaaaatcaccttcaccagaatacaaataacacaagggcaggagtaagtctttacttatcaaaattaacattgtatgtaatagactaaactttccaatagaaaaacatagagtggccgaatggatgaaaaaacaagacgcattgatctgttgcctacaataaacacaactcagctacaaagacacacatagcctaaaaataaagagatggaaaaagatattctgtgacaatgaaaaccaagaaagaacaggagttgctgtactcatatcaggcaaaggatatttcaagacaaaacctagaagaaacaaaggtcagcatataatgataaaggggtcaattcagcaagaggacataacagttttaaatatatatgcacccaacagtggagcacccagattcataaaggaaatattattaccactaaagagagagatagaccccaaggcaataatagctggagacttttacaccccactttcagcagaaagacagatcttccagataaaaatcaacaaagaaacatcagattaatagacatttacagaccattccatccacgagctgcagatacacattcatttcctcagcacacggatcattctcaaagatagatcctatgttaggtcataaaacaaatattaaaacattcaaaaaattgaaataatatcaagcatcttctctgaccacaatggaataaaactagaaatcaataagaagaattttgaaaactatacaaatacatggaaattagaccatgtgctcctgaatgatgagcaggtcaatgaagaaattaagaagaaaattgaaaagtttcttgaaacaaatgataaaggaaatatgacataccaaaacccatgggacacagcaaaagcagtactaagagggaagtttatttatgttggtgcaaatgtaattgtggtttttgccattaaaagtaattaaaagtaatggcaaaaccacaattatgtttgcaccaacctaataactataagtgcttaaatcataaaacaggaaaacttcaaataagcaatctaaggatgcctcttaaagaactggaaaagcaaaagcaagccaaatccaaaattaggagaagaaaattagtagaagaaaagaaataataaagatcagagtagagataaataaaattgaaatgaaaaaaatacaaaagaccaatgaaataaaaagtaggttttttgaaaagattaacaaaatcgacaaacctttaaccaaactaagaaaaaaagagaaagaaatccaaataaataaaatcagaaatgaaaaaagagacattaaaactgatactacagaaattcaaaggcccattagtggctactatgagcaaccagatgccaatgaattggaaaatatagacaaaatgaacaaattgccagatacatacaacctaccaagactgaaccaggcagcaatccaaaacctgaacagaccaataacaagtaacaagattgaagccataataaaaagtctcccagtaaagaaaagactgagacgtgatggctacactactgaattctatcaaacttttaaataagaactaatgccaatcctactcaaactattctataaaatagaagaggagagaagacttccaacctcattctacaaggccaatattaccctgataccaaaagtagacaaagacacatttaaataaataaataaataagtaagtataagccaatatctgatgaatatcgatgaaaaaattctcaataaattccacgaccaagtggaatttattccagggttgcaaggatggttcaacatgtgcaaatcagccagtgtgatgcatcatatcaacagaatgaaggaaaaaaaccacatgatcatttcaattcatgttgagaaagcatctgataacattcaaaatccctttatgataaaaaccctcaaacaactggggatagaaggaacatgtctcatcataataatagctatatatgacagacccacagcaagcatcaaaatgaataaggaaaaactgaaagcctctcctctaaggtctggaacatgacaaaggtaccctctgtcaacagtgttattcaagttatactggaagtcctagatagaccaatcaaactagagaaagatgtaaaggacattcaaataggaaaggaggaagtcaaattatccttgtttacagatgatattatatttggaaaaacctaaagactccacaagaaaactattagaaatgatcaacaaattcagtgaagtttcaggatataaaatcaacatacaaaaatcagtagcatttctatatgccaacagtgaacaatgtgaaaaacaaatttaaaaagtaatcccatttacaataaccacacataaaattaaatacctgggaattaatttaaccaaagaagtgaaaaatctctataatgaaaatgataaaacaccaattgaagaaattgaagaggacaccaaaaaaatgaagaaatattccatatgcatggatttgaagaatcaatattgttaaaaggcccatactacccaaagaattacagattcaatgcaatccctgtcaaaatatcaatggcattcttcgcagaaatagaaaaaacaatcctaaaatttatatggaaccacaaaatacccaggttagccaaagctctcctgagcaaaaggaacaaaattggaggaatcacattacctgacttcaaattatgctacagagctatagtaaccaaaacagcatggtactggcataaaaacagacacagagaccaatggaacaaaatagagaacctagaaaaaaatccacacatctacagtgaactcgtttttgacaaaggtgccaagaacatacactgaggaaaagacagtctcttcaataaatagcactgggaaaactggatatttaaatacagaagaatgaaatttgacccctatctctcaccgtatacaaaaatcaaactgaaatggattaaagacttaaattgaagacctcaaactacgaaactactgcaagaagacagtggggaaaatcttcaggacattgggttgtgtaaaaatttcttgagccatactccacaagaacaggcagccaaagcaaacatgggcaaaagggatcacatcaagttaaaaagctcctgcacatcaaaggaaatcagcagagtgaagagacaacccacagaatgggaataaatatttgtgaactccccatttgacaagggattagtacccagaatatagaaggacctcaaacaactctataggagaaaaaaaaatctaataattcaatcaaaatatggaccaaagatgtgaatagacatttttctttattttttatttttttacttttttttaaaattatacttcaagttctagggtacatgtgcacaatgtgcaggtttgttacatatgtatacatgtgccatgttggtgtgctgcacccattaactcatcatttacattaggtatatctcttaatgctaaccctcccgactccccccacaccacgacaggccccagtgtgtgatgttccccttcctatgtccaagtgttctcattgttcaattcccacctatgagtgagaacaagcggtgtttggttttctgtccttgcgatagtttgctcagaatgatagtttccagcttcattcatgtccctacaaaggacatgaagtcatcattttttatggctgcatagtattccatggtgtatatgtgccacattttcttaatccagtctatcattgatggacatttgggttggttccaagtctttgctattgtgaatagtgccacaataaacatacgtgtgcatgtgtctttgtagcagtatgatttataatcctttgggtatatacccagtaatgggatggctgggtcaaatggtatttctagttctagatccttgaagaatcgccacactgtcttccacaatgattgaactggtttacagtcccatcaacagtgtaaaagtgttcctatttctccacatcctctccagcacctgttgtttcctgactttttaatgattgccattctaactggtgtgagatggtatatcattgtggttttgatttgcatttctctgatggccagtgatgatgagcattttttcatgtgtctgttggctgcataaatgtgaatagacatttttcaaaagaagacatacaaatagcaaacaggcatatgaaaaggtgctcaacataattaatcatcagagaaatggaaatcaaaactacaatgagatataatatcatcccagtcataatagcttacgtccaaaagacaggcaataagaaatgctggtgaggatatggagaaataggaatccttatacactgtttctaggaatgtaaattagtacaaccactgtggagaacaatttggaagttcctcaaaaaactaaaacttgagctactgtgtgattcagcaatcccactgctgggtatataccaaaaagaaagaaaagcaatacatcaaagagatctctgcactcctatgttggttgcagtactgtttataatagctaagatttggaagcaacttaagtgttcatcagcaagtaatggataaagaaaatgtggtacatataaacaatggaatactattcagtcataaaaaagaatggaatccagtcatttgcaacaatatggatggaagtggagatcatttgtgaagtgaaataagctaggcactgaaagacaaacatcacatgttctcacttatttgtagaatctaaaaatcaaaataattgatctcatggagatagggagtagaaggatggttaccagaggctgggaagtgtagtgggagggttgggggaggtggggatggttaatgggtaccaaaaacattagttagaaagaatgaataaggctgggtgtagtggctcacacctataatcccagcacttttggaggccaaggcgggcagatcacttgaggccaggagttcaagagcagcctggccatcatggcaaaaccctgtctctactaaaaatacaaaaattagccagggtggtggtgcacagctgtaatcccaggtactcaggaggctgaggcatgagaatcacttgaacccaggaggtggaggttgcagtgaactgagattgcatcactcactgtattccagcctggtgacagagggagactctgtctcaaaaaaaaataaaagaaaaagaaaaagagaaagtaccctaaaacttaaaatataataataataaaataaaaaataaaaataaaaaaagaaaaagagaaaagaaaaagaataagacctactatttgatagcacaacagagtgactcttaagtcaataataacaaacaattgtatattttaaagtaacttaaaaagtataattagattgtagctcaaaggataactacttgatgggatggatacaaaaagtttataggaataaataaagcaaattttgaactaacaaaaaaagataggaaaagctagaataaaaaagagaagcatcaaagatcaagctccatagacatgccctactcagattttcacaggtaggtgatctgcctctgtcttttatatacaagatgattgataatgatgttaaccaattacaactttgcctttcttatttggtacactgagaggcagggttcctctcttcttttataagcttataataaagtagaaaacagaaaaataagtgagggcaaaacataaaagctagtgaatatctcatctttttcatttctttatcacaacatatgtagattatctcttggtaatggaaatacataagccttgctaaatgactatcctagtaatagttgaccaaatccttagatccatgaatgaaggaagcagttatgtaggagacccgggcctgcctcacattttgtccagggatttcctggtactctacagtgggggtaaaaaaacgggggggactggttttgattgactttttattgataatcctgagatatctgaaagaattccttaaattatctaatgaattagccagataacaattacaaaccagcaatttatagtaactagtaatgggagaaacaattcaaaataaaaccacacatggtaaaaatttgttgaaataaaaaccaacccaagattcatatcttcatatcttcttaataactataaaaaccaaaaacactgagagagtagatttagctggaataataaacacaaaataatgaagcaatggctaagcctgcacatgatcaaaatatattattgactacagttaacaaattctattttcattcatctgagaatgtctttatttcccactgatttctgaagcaatatattttcatcagatagaattgacagttcttttctttcagtacttgaaaatgttttgttattaatacttccttttcgcctccagatgagaaatctgctctcactcaaattggtgtacccctctataagttatgtgctgtttccctctggatgctttcagtactttatttgtctttactattcaaaagtttaattgaaatgtcttggcatggatttctcctatttggggttcactccatctcctattgtgtccggaattggtgagttcttggtcttactgacttaaagaatgaagccgcggaccctcgcagtgagtgttacagctcttaaggtggcgcgtctggagtttgttccttctgatgttcggatgtgttcggagtttcttccttctggtgggttcatagtctcgctggctcagaagtgaagctgcagaccttcgcggtgagtgttacagctcttaaggcggcgcatctggagttgttccttcctcccggtgggctcctggtctcgctggcttcaggagagaagctgcagaccttcgcggtgagtgttacagctcataaaagcagtgtggacccaaagagtgagcagtagcaagatttattgcaaaaagcgaaagaacaaagtttccacagtgtggaaggggacctgagcgggttgccactgctggcttgggcagcctgcttttattctcttatctggccccacccacattctgctgattggtagagccgagtggtctgttttgacagggcactgattggtgcgtttacaatccctgagctagatacaaaggttctccacgtccccatcagattagttagatacagagtatccacacaaaagttctccaaggccccaccagagcagctagatacagagtgtcaattggtgcactcacaaaccctgagctagacacagagtgctgattggtgtgtttacaaaccttgagctagatacagaatgccaattgatgtatttacaatccctgagctagacataaaggttctccaaggccccaccagagcagctagatacggagtgtcgattggtgcactcacaaaccctgagctagacacagggtgctgattggtgtgtttacaaaccttgagctagatacagaatgccgattggtgtatttacaatccctgagctagacataaaggttctccaaggtcccaccagactcaggagcccagctggcttcacccagtggatctcccaccagggatgcaggtggagctgccagccagtcccgcgccatgcgcttgcactcttcggcccttgggtggtcgatgggactgtgtgctggggagcaggaggtggcgctcatcggggaggctggggctgcacaggagcccacggaggcaggggaaggctcaggcatggcgtgctgcagtcccgaggcctgccccgcgggaaggcagctaaggcccggcgagaaatcgagcgcagcgccggtgggctggcactgctgggggacccagtacaccctccgcagccgctggcccgggtgctaagtccctcattgccccgggccggcagggccggccggctgctccgagtgcgggacccgccaagcccacgcccacccgaaactccagctggcccgcaagtgccacatgcagccccggttcccgctcgtgcctctccctccacacctccctgcaagctgagggagtgggctccggccttggctagcccagaaaggggctcccacagtgcagcggtgggctgaagggctcctcaagtgccgccaaagtgggagcccaggcagaggaggcgcccagagcgagcaagggctgtgaggactgccagcaggctgtcacctctcattatatctataggtttatatcttttgccaaatttaggacatattaacaaattatttcttcaaataccttttcagtctcactctttctcctgtacttctgaaactccaataatgcaaatgctagctcttttgttattgtcccacaggttcctcagtctgttcaattttttgttctagtctattttctctattgttcaggttgggtaaattgttattatcattattattattgtagagacagggtctctgtgtgttgctcatgctggtataaaacttctgggctcaagggattctcctgcctgagcctcccaaagtgctgggattacagacataagccaccacacccagtcaggttggataaattctattgatgtgtcctgaagttcatcaattctatctttagtcatcttgactctactattgaacccatccagcaaattttttatttcattgctttatgttttagttctataatttctatttggttcttttttaacttatttatttgctgagatattttattttttatttgtgtcaagagaatttgtaattgctggttaaaacatttttataataactactttaaaatccatattagatcgttccaacatctgattcatcttgattttagcatctgttgattttcttttctcattcaaattgtgatcttcctggttcttggtatgaggaatgatgttcaattatattctggatattttggatattatagtataagactctggattctatttaatcttttttaatcaggtaggcctcctgttggggtgtagcaagaaggcaggtgattttgtatgtttggtctcccagtgggcccaccaacaccttccagacaaacatgcagtacttattcatcctgtccagatgtctatgggggggcggggtggggggcgggggggagggtattcattttctagtgctgccataacaaaatgcgacagattggatggcttaaaaaacagaaatttgaccaggcgcggtggctcacacctgtaatcccagcactttgggaggctgaggtgggcggatcacaagttcaggagtttgagaccagcctggccaacatagtgaaaccccgtctctactaaaaatataaaacttagcctggcatgatggtgtatgcttgtagtaccagctactcgggaggctgcggcaggagaattgcttgaacccgggaggcagaggttgtggtgagccaatattgcgccactgcactccagcctgggcaacagagtgagatccgtctcaaaaacaaacaaacaaacaaaccaaaaacagaaatttattttctcacagttatggaggctggaagtccaagatcaaggtgttgacagggttggcttcctctgaggcctctctccttggcttacagatggccacccactcaccgtatcctcacatagttgcccctctgggtacacatgccactggtgtctctatgtgtgtccttatctcctcttcttattaggaccccagtcagattggattaagggccaccctaataacctcattttaatttaatatttcttttaggaactatctgtaaatacattcacattctgaggtactggggattagagcttcaacatatgactttaggatgggaaacacaattcagcccacaacatgtgagttggaagttcagctaccccttgccctgttgacaccttcccagtcaaagtgagatattcgctcacacctctaagttcaggtgccactagaaaggtggaagcagatgattgattcacaccattttattacagcaggattggggtagaaattaggttctcaactctctgctgggcctccctgatgccagaggaggagagggagacaagcaaagtgccaactatccctgcctctaccgctttgttctgtctcattgatgccaggtggaagtgaagactcagcaacccactgggccctgcctacatggaggtgtgggggtaagtggagtactgaccagacttgagtcacacgacccagttcagttgttgatgctggatgggagtggagtctcagcttcctattggttaccactgacactagactgaagcataactgtgatgagccctgcatcccaccgtctctttgagtctcactgtgggtgcaagctcagctcattgctgcaccctgccaacacaaggtgagggatagaaaaccagatccctgctcagccaggcaaagccaccctgagtgggatcacagtgctgctgcctgcctccagtgagtggagtaaaaaatcagcctcctgtcctattctactcaaactttgagaaagggagggtgcagttgttacactggtatttgccctgagtagggcaggtatcgccaaaaagttctggctacggggaacgaacaggctcatcttggggctttttgtgtatgtttgttagtggctccaagttgaaagcttctgcaggaccctgtctggaatatatgagaggcaataaggaaatccagggaactcagtgccatgtcattccttgggtccccaggttcctaagtagttcaccttcttcttttcagtgttagagtcttcctgtgcttgtttgttgagttatggccagggtttttttagttgtaagaaagagggtctgggaggaatgaggctacttccatttgcccagaaccagaagtcctccttataaacactttaatagaagaaatgcaaagaagatagggatttttatggaatattccaacataaaatcagcaactgatctaaaacctgaattatcaaaaggaatatcaatttctaaaaccagggcaagctgacaaaataaagctgagctatataaaggtatgtgtgctgtaatactcaacttcaagatgcttttggatgagctcaattcaactaacatcaaaacaaaaggaaataaatttttctacattcggaatatttgtcacaaaacaaagaccaacactatcagatagggcaattcatgttttgtgtgttttaaatttttattttaagaataacttttaaatatttgtaacagctttcaattttttaattgattttatttggtgttagtgatacttttttagttttttctatcatcaggtatagatcatttttacatgttattaaaatacataatctcatcaaatgcagttaatattgtatttttatttttatagaaaacctctgaaacttttagcataattctatcatcaaaaatgacacaccactattattgtggtcacttatcaaaatttgaaaacacaggctcagcacagtgggtcacgtctgtcatcccagcactttgggagacagaggtggctggatcacttgacgtcagaagttcgagaccagcctggccaacatggtgaaaccccgtgtctactaaaaatacaaaaattagccaggcgcgttggtgcgtgtctgtaatcccagctactcaggaggctgaggctggagaatcacttgaacctgggaggtggaggttgcagtgaggcaagatcgtgccactgcactccagcctgggcaacagagcaagactctgtctttaaaaaaaataataaaaacatgtaaatatcacaaaaaaaaataggatgaattctgttttgagaattcccaggaatttgtattttttttaacctgaatcctgaagatatttgtcagggatttagaaacactataaaaggcaaatactgtcccaattaccttattaacaaagactttttctttttcaatgatcaagacttaatcaaaattgtttttatctcttcagtttatatgtccagacttacttggttattacaggcacagtgatgcagtgaaatcatgacctatacctaaacagcctgaaaatattcagcctataaaagaaaagacttaggtgagaatttaatagctgtcctcataaacttcgagagctctcctgaacaagagggattgcatttgttctgtatgacccaagaggaaagaattaggataaatgagatgaagttacaggaaagaaaattttgacttactatatatatccactttctagcaactagagaattctgaaatgagagcagactccctcaagcaatagtgatttcttgtcaaggtaaaaggctggacgaccatttatcggggatattatcaaaaagactcagtgtttgtgattttttttttttggtgtgtatcatctcattttgttctccaagtgacacacatagaaaatgtatttaaatggctatgtatgaatgaaaatagtaaagttcagagggtatattagttaggattctttgtaaattataaagcaatttgagctagcctgagcaaaaacaaaatacagtataagaataaatggtatttcacagaacctaaggccagtgtaatgcagctgtctctagggtcggactgaggccaaagctctctctctctctgtatcttcaccctgtttctctctaacaactgctttgttctctatttctgcagatgtattttctatgcttcccaaccacataatgggtaggagatatttatgccacagatccccaatttacatctctatcattcaagggaccagtccagaatgattgggtgcctaaattattctggactttatgcagccaattaatcacattattctcccttctgaatgctaagccaattaagaaatagccacagtaaaactggatgggataatgtggcttaaacttgaggccaaaatgtacttttctgcaactttcctttgcctttgaattgaattcagccagtccaggcagatatccagattgcatctcaggagatggcctgatctggcggcctgacctgacgagcttatcagatgggaaagacgtccaggaggtgagcacattgcacttgcacatatgcaaaaggagaataaaggatctggtcagacatgtgcaatgaccctttactgaaacctactaattaagtaagtcactccaccaactccctcagggttgagttgctgaaaaacggagataagggcagaaactttcctcataacattttcaaagatattttatacgatggactaaggtaggaatgtgcagatgggaagagaatagccttcccgcaattaccaattcttatttctggagatagggaagttaactcacccactttgaaccagttattcatctacgtccaatcaattatggttttaggagagtctctcgatgcataaacagcatggccaggggacaaccattacagataggacaggcgatttttggtaaaagatggctagacagatacatgaataagtacactcagaatgcatacacttcttcgtttacattataaagttattcttgactcataatatccagctacctcacgttcaaatgcaaatacacacaagtacacacacactcattcacacatgctctgcagtggaggactacccaagtaatgagtggataatccattacattaggaagtgatgttgccttgaggtcactgctcttcctgtgtaaaatttctggatgaggtccatttcctccccgaatccagttttaattttgttctcattttcttaaaatttagagattaaattacaaacgtaaccactctcaatatatctaatatacaacacttggggaaatggccatatagagaaatagcgacggaaagaaagctccacatagtggtcactggtctgtgatttattctgctggacagtggcagtttgaaaagcttgaaagaacaggtgacttatttgggcataattttgactcactcctttggcgtgtttcttgaccctatagtgaactttcagtttgtgttatttcttctttggattgtgtctgaaaatttcctaagaattgactcttctggtatgagtcaactatgggtccctttcaccagatttagtatttttcactgacattttcattcttgtaaaacatttctggttggctctcacatccattttggactccatttgctaaaatccagcaccacaaatcttgttaggtcatgctccaaattgaatagccaggacttgttcactctactcaggcgtatgttctgttttgttcgtttttgaagtaagtctgaaggtttcaccatccatatggtctttaatacatgaattaaaaactataaaattagctgggcgtggtagcaggggcctgtaatcccagccactcaggaggctgaggcaggagaatcctttgaacctgggaggcagaggttgcagtgagccaagatcacaccattgcactccagcctgggtgacaaggaaagattctgtctcaaaaaaaacaaacaaacaaacaaaaactatagcctggccgggtgcagtggatcatgcctgtaatcccagtactttaggaggccaaggtgggaggatcacttgagcccaggagttcaagaccatctgggcaacatagcaagaccccatctctaaaacaacaacaacaaaaaaaactatggcctgatacgaggtagctagcataacagaactccttcctttcttatcagctatggaaatattgtccctattctcctattttagctagtgagaaggactttggaaggatgggggtgggaggtagaagtatggtcagtctttctccactcttctgcttcttccaggatattcccattcctgtttccaggatcttgcgttttcttggtccagacatttatttatcctaactacaaaaaggagagtcaactcagaacttgactactgcaattcacatttccttgatttatttcttcatcagtacctcagcaattgattgattaattgattgagacagtcttgctgtgctcactggagtacagtggcatgatctttgctcactgcaacctccacctcccaggttcaagcaattctcccttccccagcctctcgagtagctggaattacaggtgcctgccaccatgcccagctaatttttgtatttttaagagagacaggctttcgccatgttggccagtttggtcttgaactcctgacctcaagtgatccgcccgccttggcctcccaaagtgctgggattacaggcgtgagccactgcacccggccagcaatctatttagaagctcagattttctctctgtgcttccagtcaagcaaatctaagttggtttttttcttctgcaccttatactgacagctacaaaaaatagatatatactaatattttctaccaaggccccccatggcttggtggagaatgatctgagatgtaagagacaatgagcaggttttcctacttacttcaatattgcagaaagactgtaagtttctatcctaagattggggtggtaggtgggagtgtgaggctcctcccaatctgacacctgccttaacttcactcattttatattttctgattaagaatctgttactccgaaccctatcacaggtagcactttgtatattaaataagattctctgttgccttaagctgtatgcaacagaaactgtatcgagccagcctaagcaagaaaagaatttaagaattcagaagggcactcaggcctaagaaagagatagaaaagttaccagatctttcttcatctctcatatcttcttctctctgcatgtttgctttatttatttattttctctgaagttaggctttctctgtttctctttccacataccaggtaagatcatggtcactcagcagcttccaacttcatatgtcttttctttgagaaaccaagggtagtatgccaaaaccattgttggttttttttcagatatgtccagggagaaaatctggttgaccagtttgtccttatagtgaaccttcatcagtggtgtgtgttcaatatcaaaacatctttctaattataaagaatcttcagttaggtgagcagatatttcatctccccaccttttggttcctaaaacaaagacatgtgacccaagtcccaccaatatgatgtttttgcctggaactttatcaagtgatacacacaatttggaatttttctatggctgtggcaccaatggcagtggcttctggttctggtggcagtagtggcttccagcatctgatgatacagtggtgactgctcggcaaagacagcagtcatgtcctaaccaggttctttctgcagcataattttaaatgtcctgagttatggcctcccttaattattgctcatttctttccaagcccaatcttcagttcttctcattgattctgtgagcgttcctaaactcttctaataatgttttttttcctcaaatataccagaatgattttatgttgtttacaactaagaacttgcctatattctaatgagctaaaccagtgggtaggggccttgtagagcaaacctgattgtcagaggtctacccctgtgaacaggaagaacagttcccagagaagacagaatcagtggacatcccaataagtgtctttttgcattaatattggaaaagttgtccaagaccatagaagagctgaatatcagaactttaagaagaatctgcacatctcactactcaatataggatttattcctttgtcccaaggattaattttaattcttgaattaataatggatggggatacctaaggttattatagaaaggccaacataagcccttcacaatctcaataatttgctatttcaccaaactgaaaaacctatttcaaaaaagaaaaggctgaattcaattaaacaacctggttctttcaaaataactggttacctaattaaaccttactattgccttaaactttgtaaacatatcttaaacactactatgctaagatggggcagaggaatgaattactgataaaattcatagttaattgaaaatgatatcaaaaacattttaatacttttcaccacataataaaataaaaactgtgtgatttgagtttttatctccttttatgggcctgtttaatttctgtaaaggagctttgaaattaagcaaaatagaaagggaaatagtaatttggataatcagtcccaaataaacaagaattgctaattgcatttcttgtacacaactaggagtaaattcaaaaactgaaagtaaattggacatgatgctcagagagtatccttgagcatgagtaactaaaattaaccagaattttaaataaactggggactcctagacttctgaagacatgaatgaggctattagaactctctttctcctactcatccattagcaatgtcgggaacagttcataaaagattaatgtttaaatgcttaagaatatatatttgaataccttgaaaacaccaagcaatgctttttaaattaattgataagtcattttatacttgtgatgtagacttagacttttttgtagtaacaagccagaaaacatctatccttctgagagataatatgtgaaagaattgtagaagaaatgagaaagatgattagtaatcctgtattgcttcttgagacagcaattctctcgtaagtggaaacttaggcaagcatcagtgatgagaaatagatacattttactctttacttcatggttgagaagtgcctgtaattcacctttcaaataagaggcaacatgtatagcataatcccacagtattatgaaattttggaggtgaaagggaccttgatgtatcggtaagctattgctctataacaagccattcccaaaactcagtggtttaaaacatttattattgttcaagcatctacagattagctaagggtaggctgagctcatctggggtgattctgctccatgtgtttctcattctccataaaccacaaacaaaataataataataataataatagtatttttttaagttctcacttgttgaaggcttactatgtgctaaaagcactttaaaatgttatctcctttacttctcacaaaaacattatgaggtaggtactactaatatcctaatttcacagatgaggaaacaaagaaggaatttccccaagctcaagaagctactgtatggtgaacctggagcacacagatgaaggtctacctgacactaaactttatgttcttaatcattctgttatattctgtttcatgaaatttactattccattttcagagagttctaaccactaagaagttattcttatattcagtgaaatgattttctctataacttttaatcactgatcttaatttggcccttgagtacatacaggataaagataataatcataaattaaatgatatagtaaaagtgcctgacaaacagaatgtgttccacaaaaattaatctaagtcagccccacaataggcataacagtcgttaataaaatgttcaaccgggcagggccagaattatttgcagttttacccagttggcacttatcctattatacagaaaactatccaacctaggataaatacaatgtttaagtccagatatactgtgtctataacatttcctttatctatcagcctagtaatcttgtcaaaaaggaaatgagccctagattgaataagcaacagacaattagaatttagagggtagagaggaggtaagggaacattaaataatgctttttaaaattaatcagcatatattttattaataagcaagcaggcaaaacctagtaaatgttgactttctttctatttggaaaaaatttaatttgttcaaaggtaaacttttgtttatattataggtttacctaagctgatgagagaactgagtacataatacctattgaggataataaacttgttaaaagatgattttcaaaatgacaaaatacaaatattaaaagagcatatgtgaaaatttttatttaactcattaattaatgaaggaccctgtaagatattacaagctattcaaaaaagaatagaaacagtcatatgtaggcaagcaggaatgttgaagtaaatgtgctaatatgtgcaaattaatagatcctataggtactaaattgtaatgtttggaatcatcttttctacagagaggaaatcaattatatctctatgataaaattcattagcatgtctatggaaaagaataatttgcattttactgtcagtcaattttttacaacttcctgagttgtaaaatagctcagtcaagggcagtccaaagcacaggttccaacagaatcagataaccttaccttggagagtaagccagacagtgtcagacgttccagaacacccagaattgtgcccattcaaaattcttcactagtcttcctgacaaagtttctagaagaacatcaaggagaaaaactgggggaagtgctgattacatgaaaatgtacactggttgaaacgttttacaattttttaaaaacatattatttgagactctttgagaaaaaagataatcccggaaaatcatgaaattatttttttttaatttttttgtcacatccttcaaataaactgttaatcatgatatacaaggtcagatggaaattgaaaaaaggaaaaattaacgttttttaatataccctcccatttgtctgccaaaattgtatttaaaagtagtgttatataattaatgatattttatattttcagatgattgctaacaagccaaagaaaaaaatttccctgatcgtatttggaattaaaaaaatcattgattgaatgaactagtaatattttatttagcatttccttgtatttagagtggtaagaatttctatgtcagctctgtcctctgcattgacaaatcagaaggtcctgaatcctctttactctgttatgagatcataaaaaagaaattaaaagtcaattgctctccactgaaaatcctagaattgagaatcaaggaataatcttctcttccaaccaaagtccctgtgtgactaaagatcagtgtaattttaaaatgtggcaacttgtatattaaaatgtcatatagaatttttaaaaatcttttattgagattcaaaaatagacaaagaaaatataataatggctaataagcacatagaaagatgttcaacatcactggttattagggaaatgcaaatcaaaatcacaataagacactactttacatccatcaaaatggctattgtttcttaaaaattgaacacactaggcattagtgagtgtcttacttcgttttgtgctgctgtaataaaataccacagactggataatttataaagaacagaaatttattctctcacagttctggaggctgagcagttcatgatcaagggactggcaagttaagaactggtctctctgcttccaagatagtgcctggaatgctgagttctctggagagaagaaacgtggtttcctcaactgacaaacaggcaggagagagagagaacctactcctgcaggcctgttttatagcagcattaatccattcataagggtggagcctcatgacttaaacacctcccatcatgccctatctcccaacactgttgccttggagattaagtttcaacatgagttttggagtggacgaaaacatttaaaccatagcaataaggatgtagaaaaattagaaccatcccatattgctggtaagaatgtaaaatggtgcagccactatggaaaatagtatggcagctcctcaaaaagttaaacatagaattaccacatgatctagcattctatttctaggtatatacctaaaataattaaaagtaggggctcaaacagatgcttgtacagcaatgttcacagcagcattattcacttgtagaatttaagacactctaccccaaaatacttatttaagctgaaagaatttgagaaaacagcagaatcaggaaggtcaccctcactttactccacccttcttttctgaagcaggtcataaaacttaggcaggattttctgaccttcccttgaagcaggtcatagcaccctcatgtgagaggtgccctctctaatacctggataaagcagccaaagacagagacacgaataatctgaacaggcaggccttgctaagtttccccaaattcattactggtagattacacccactatgtccaagtctacttctccacgtctatacatttattcatcaaacttggcataaaagtacacatgtttaatctgcttctttgggtcttcattgccttatgcaggctcccatgtcacataaaacttatattgaataaattcatatgcttttctcttgttgatctgcatttcagccatgaacctgggataagtgaggaaatacttctcttcccctatatcgcagtaggcaacaggtagaaacaacccaaatgtccatcaacaaatgaatggataaactaaatgtggcatatacatataatgaaatattattcagccttaaaaaggaatgaaattttgttacatgctacaacatggatgaaccttgaaaacattgtgttaagtgaaataagccagactcaaagggacaaatattgtgtaatttcacttatatgaagtacctaaaatagtcaaattcatagagacagaaagtagaatagaagttttcagggactgagaggaatagggatagggagttattgattaatggtcatagtgtttctgtctgggatgatgaaagagttttggaaatggagagtggtaatggttgcacaacaatgtaaatgtacataatgccactgaactgtacacttaaaaaaggttaaaatgataaattttatgttatgtatatgttatcgcaatgaggaaaaaaatcactagttggaagtcaagaatgttttaaagctttttcagagctccaagtgttacaggaaagggatcccgatccagatgccaagagagggttcttggatctcaggcaagaaataattcagggcgagtccatagagtaaagtgaaagcaagttttattaagaaagtagaggaataaaagaatggctactccatagacagagcagccccatggctgctggttgcccatttttatgattatttcttgatggtatgctaaacaaagagtggattattcatgcctcccttttttagaccatacagggtaactttcagatgttgccatggtatttgtaaattgtcatggtgctggtgggagtatagcagtgaggacaaccagaggtcactctcattgccatcttggttttggtgggtttttgtgggttttggtgggcttctttactgcaacctgttttatcagcaaggtttttatgacctcaatcctgtgccatcctcctatcttatcctgcgacttagaatgccgtagccatctgggaatgcagtgatgttgcgggaagtcagggaccccgaacagagggaccggctgaagccatggcagaagaacatggattgtgaagatttcatggacatttattagttccccaaattaatacttttataatttcttttgcctgtctttactgcagtcgctgaacataaattgtgaagatttcatggacacttatcacttccccagtcaataccctgtgatttcctatgcttgtctttacttcaatcacttaatcctgtcagctgaggcggatgtatgtagcctcaggaccctgtgataattgcgttaactgcacaaattgtagagcatgtgtgtttgaacaatatgaaatctgggcaccttgaaaaaagaacagggtaacagcaatgttcagagaataagagagataaccttaaattctcaccaccggtgagccaggcggaacagagccatatttctcttctttcaaaagcaaatgggagaaatatcgctgaattctttttctcagcaaggagcatccctgagaaagagaatgcgcccctgagggtgggcctctaaaatggcccccttgggtgtggccatcttctgtggtcgagctgtagggatgaaataagtcccagtctcccatagcgctcccaggcttattaggacgaggaaattcccacctaataaattttggtcagactggttgctctcaaaccatgtctcctgataagatgttatcaatgacaatggtgcccgaaacttcattagcaattttaatttcgccccagtcctgtggtcctgtgatctcgccctgcctccatttgccttgtgatattctattaccttgtgaagcatgtgatctctgtgacccacaccctattcatacactccctcccctttgaaaatcactaataaaacttgctggttttacagctcagggggcatcatggaacctaccgacatgtgatgtctcccctggatgcccagctttaaaatttctctcttttgtactctgtccctttatttctcaaaccggccgacacttagggaaaatagaaaagaacctacgtgaaatattgggggtgaattttgcccaatatctggctgaattttctgcgatacagcacagtatgtttcagccttattttacccagctcctattcaagatggagtttctctggttcacatgcctctgacacaagcactccaaactggtttccatttcaattttctctcattattttatttaattaataggcatttattaagagctttttttgctaaacactgtactaggcacagcaaaaaaattcaaaataataagatctttttttctctgaaatccatcatttagctcttcctaaactgggatttaaggaaagctgtttctttttttatggttttgtttctttttgttgggatgggttgttcataggtgtgctgaaaggaaaaacatttttcctctttgcaaataaatgagtgtttaattattaaacaaagttaaatggatttttttaactgtgaagacttcccataacctttaaaatgctaatgtattttttgaatctacaagactggatttagtaagtggcattcctaagcttatttaatcaagaattctttgtctctcagagcccaattaattaacatctccctttgtactgtggctgcagaagttgagctatgtggtggattctttttatactgggctaaatgtattatacaatctgtaattatggtataaatgtgtattttgttttatccctatgtgttctagaatgtgagtatgattttaaaagcatttttaaatttaaaaatgtagattaaacattagagacaataaagtcattataatttcttacctcaatttaccattttttttctcctttagatagcatttattattctggaaaaagggatattcttgttttggggagaaggatttgctaatggagattttgcagaaaactgtgatgctgactgtgatatgtaacttgtgagcatttttaataagaagaaacatagaatgccagtccttattcttttcttgataaaagaattcctaccgaattgtatccaatcaatagctttaaggacttgtgattttctctctgcctttgaataattgcaaatttttgatgctaattcttactccataagtttaaacgtccctatttttccgattactaaacttatactttaagtcacaacctacaataatatgcagacaatccctgacttacgatggtttgacttatgattttttgacattattatgatgtgaaagtgagatgcattcagtagaaatactgttgtatccatacaaccattctgtttttcacttttagtatacagtattcagtaaattatgtgagacattaaatcctgtattataaaacaggctttgtgttagatgattttgcccaactgtaaactaaagtaagtgttctgcacatgtttaaggtaggctgggctacattgtgatgtttggtaggttagatataataatgcatttttgccttacaatattttcaactgttgaagatttattgggacatatcccacattgtatgaacatctgtattcctgcatcctccatatattccttttttttttttttgagatggagtctcactctgttgcccaggctggagtgcagtggcatgatcttggctcactgcaacctccacctcccctgttcaaatgattctctttcctcagcctcccaagtagctggaattacagatgtgcaccatcacacctggctaatttttgtatttttagtagagacggggttttgccatgttggccaggctggtctcgaactcccaacctcaggtgatccactgacctcagcctcccaaggtgttgggattacaggtgtgagccaccgtacccagccctacatatattcttaattttgtgcttttccttcaaaattaaacacagtagaacaatttaagtaaagctaaagatatagcaaatttgagcctatttcatgattttaatattggtctcagttatattttcattagtagtatcattttcatgtgtctaaagtatcacgtaaaatgcattagaatatttaagtaattgcacaggcattacaaaggaataaaaatgataaaattgccaagatcaaccagctggtcatcaggcagaagcaccccgtgatactgtgaaatacttggttattggtgaaggatgaaagtctagattcagcataggaaagagaattgttatgtgtatatgtacactggatggaggtgctagttgtttgcaagtcaagcattctaaagcctaggactgcctgaactagagcaacaaataacaaagtatcagagttcaaggatttattctgaccggatgattttggaaaccttcctggacaacacattgggctgggttctgaagaataaataggattcccacaaatttttccagactgaggagagaggctaagatgtgcaaatagagggtctatctaggagtgtaattttggagtgcaaagtatagagtgcgtaagggatagtgaagtaaattaaactagaaaaaattattgaggccagatcattagtactaacaaatttagactttattctctaagtaactgagagctgaggaaagtttttgagcagagggcatggtttgtgtttcagaacaattactctggtgggcccatagggagcagatgagactggaatgaggcagggaagctaattaggatgttataattgtctagcaagaaaagatgaagacttgattgactgtcaaggaaacaataaataggagacattttgaaaaaattaactgagcttggtgaataaatcaattagaaatccctttggatgcaagaaacagaatttcttttgaacagagttgaacatacagagccttactttattcaagtagatgcagatagatgcagatagatcaagtagatgcagatgaatctactttattcaagtagattcaagtagatgctgctggtgttggtgcagaggcttgacaatatcagtgacatcatttctcagctctcttggtttttctttcatgttgttgaacaaccgtctcctccacggcctactttaggtgagtgattggctggagctgagtcacatggcagcctctagctacagtagaggctaggaaggtggggaatagtagtgtcttgatcacctgagactgatcatggtctgtaactatgggctgatcacactgtccttttgaaaaaacattattagcatggagtacatgggcattggatattaggtgaacaattaatagagtttgctacagtaactaattggctatcggagtgcagtgggttgaatagtgtccttccaaaattcctgtccacccagaacattagaacactacattatttaaaaatgtgtgttgcagatacaaataaagtaaggatcatggtgagatcatactggattagggtggaacataaatccaaaaagactgtcttataattaccaaagataaacaaagacagatactattaaagtgataaagacaggttttgttttgttttgttttttttgtctttttttttttgagacagagttttgttcttgttgcccaggctggagtgcaatggtgcgatctcggctcactgcaacctctgcctcccaggttcaagtgattctcctgcctcagcctcccaagtagctgggattgcaggcatgcaccaccacacttggctaattttgtatttttagtagagatggggtttctccatttggtcatgctggctggtctagaactcctgacctcaggtgatccacccacctcaccctcccaaagtgctgggattacaggcatgagccaccgcaccctgcctaaagacaggttttaattagtaattaactattgcaaaagggaagagaatccagtataaactgaactcaactttgatttgttttaaagagagaatgagagaataggaaaggggaacggtagggaccagagtcagggagtggaaatttacaaaaagtgagaagacgagtgtcttagtctgttttgtgttgctataacaaaatatcacagaccaggtaatttataaagaaaagaaatttatttagctcatggtcctggaggtgaaaagtccaaaagcatggtgccagcatctggcaagggccttcatgctgaatgataacatggtagaaagtatcacatggtgaaagaaagcaggagagtttgtgtacaacttcaagccgtttaaataatcaacattattccattagtgaaggtggagtatcaatgactaaaataacccccatatggccccaactcccaaaactgttgtattggtattaagtttccaacacatgcactttgggggacacatctaaaccacagcagtgagttggcccatgtaaaatcatctgagtttgctaactggtactggtcaaagttaggctcctaccctcccaaagaggcaaaaagacaggggccctatcttcaggtgttggccagaacaaacaatatgttttttgggcagccttgagctttcccaagcaggaacttaaagagactggagtggtgatactaaggatgggaacttgagctgtcagaaactatactaatgtttgttcagacttttaatgagaatggaggaggaggccaggcatgaaggctcacacctgtaatcccagcactttgggaggccaaggtggatggattgcttgagcccaagagtttgagaccagcatgggcaacatggtgaaaccccatctctaagaaaaatataaaaattagctgggtgtgatgacctgtacctgcggtcccagctactcaggaagctgagaggagaggatcacttgaacctgggagggcagaggttgcagtgagctgagatcgcaccactgcaatccagcctggataccagagtgagacaccatctccaaaaaaaaaaaaaaaaaaaaaaagacagagagagagaaagagagaatggaggaatggaggagggacattgtcgtaagagacaaagttaagaaggctatgtgaaaatgaaggcagagattggagttatgctgctacaaaccaagaaatgtcagaagtcatcagaagctggaagagacaaggaaggatcctcctctagaaactttggaaggagtgtggctctggtgacaccttgatttctaatttctggcctcctgaactgtaagagaataaatttctgctattttaagccactcagcttatgataatttgttatagaagccctaagaatctactacatggggtgaaggagagggggaggtatctaaacataatagcctggaagaggatattgacagggctcagaacatgataccccaaagtatggcgccctgggatgctgagtactttgagctgaaggacattggaagggcctcagaagcaagtctctctaaacatttctcactctcctgtctctcatccttttttctcctccaggtgagtcatagaaatcagaatccctcttccccaaggtgggtcatagaaattagaacccctctcccacaaaacaagccataaaacctggaaagataacaagggccttgctgcattctgggaggaaggaattctacatggagagaccaagaagaatctaaacagacaggtgttactgagtattccccttcagtctattaccattccatcatacccttttggccaataacatttctacatggctgtccattcttcatagaatccaagcataaaaacaattttttccttggtctttgggtcttcatttctaaaggctcctgtgtcaagtaaaaccttttttttttctttgagacggagcttcttgttgcccgggctggagtgcaatggcacgatctcagctcactgcaaactctgcctcccgggttcaagtgattctcctgcctcagcctcccaagtagctgggattacaggtatgcaccaccacacctggctaattttgtatttttagtcaagatggggtttctccacgttggtcaggctggtctcgaactcccgacctcaggtgatccacctgcctcagcctcccaaagtgctgggattacaagtatgagccaccacgcctggaccataaaactttgattaaataagtttgttatccttttatcttgttaatctgtcttttgttataggagtgtcagccatgactcttacaatgggtgagggaaggtatcacacttttctgctcctacaatattaataccatgagtagaacatgttgtctgtgagacatttaggaaatattcatatgaggatgttaggcaagaattgggattatggatttagaattgaggaatgaagtaaggaataaagaaactgcagggaaaagaaaaataaacttcaccaagcaatagttaataacataagataaagtataagttagtatttaattgaccacttgaacacaattctttccctcttatttccaaattctattcctgtgtagcaggaatagaagaaaaagccagcatcattgagggttaatgaatttggcctataagggctaataaatatctacaaacaaactttggaaagagtcattaacaggactttgatttcccatttgccttagtagcaaatttagcagcactttttaaactgcctcatggatgactatctccattagtttttttttttaataagaaaacagtaaacactatgcatggtagtgttgtatcctcagtgcttctaatataatttcttcatatttctagtattacatttatctcactgcattctaattattgttctgtctcccctgctagactgggagcttcttaaaggtaatgcaccatttttattcatatttgtatttcaattacttgacacaatattcagcacttaagcaatttatgtaataactactggatggattgtaataacaataatagttaaggatgcagatctagagctagtttagttgggataaatcctggctttactgcttatttgttttgtgaccttgtgaaattactaaacctctctgtgccccagttttttcatcacaatgtgaaataataataagacctttgtcttggtcaatttgggctgttctaacaaaaatattatgtaccgactggcttaaacaacaaacatctgtttttcgtagttctgtggctgggaagtccaagatcaaggtgccagcatattcagtatatagtgagggctctttttctggttagcagacagcctccttctttctgtatcctcatatggctgagagaaagaaaggtcatctctctggtgtctcttctcataagggcactaatcccgtagtgaaagctccaccctcatgacctaattaccttccagaggatccatcttcaaatatcatcacattaaaattagggttttagcatttgaattttgaggacatacaaacattcagtccatagcaaacctcctcaaacaattgttgtgataattaaataaattaatctatttaaagcacttagaagattgctagacatacagtaagtgctcaatacacacatatatgttattgaattattaaatagaataatgcctctagcattcattactgctgttcaattttgtcttcattgttattttattttatgtcttcctgtgtaattcccttgtggcaatttcataattgctatagctttttttgtttgaccctccacatctcatgttcaaatttgatccccattgttggaggtagggcctaatgaaagctgtttgggtcatgggggtggatccctcacaaatatcttggtaccgtcctctggtaatgagtgagttttaactctattagctcccatgagagctggttgttaaaaagagcctggcacctccccctgcattctctcttgcttcctctctcaccatatgatctctacacatgccagctcccctttgccttccaccatgagtggaggcagcttgaagccttcatcagaaacagatgctggagccatgctttctatacagcctgaagaaccatgagccagtttatttataaattacccagcctcaggtattcctttatagcaacataaatgaactaagacaataatctacaaattcatttacttgattactggcaaattactcccatgagagtgagaacgttttctgtgaagttctctacccattccatgcataacacagcatctacacacagcagagattagtaacagtttgttaaaggagtaaattgatccacttttaccttctgtaaagaccaatttaaatctttcttatattgctaacactgaacctcctggttcaaagttaaaaaaaagataaggcgcagtaacaacagagtttcaggaagatctgggaaagaaagatttcctattattttttatttatttatttatttttgagacagattctcactctgttgcccaggctacagtgcagtggcataatctcggctcactgcaacctctgcctcccggattcaagcgattcttccacctcagcctctcgagtagctgggactacaggcacgtgccaccacacctggctaatttttgtattttttagtagagacggggtttcaccatatcggacaggctggtctcctgaccttattatccacccacctcagcctcccaaagtgctgggattactgacgtgaccccctgcacctggcctatttcctattaattctaggactaactacctgaaaataggataataccttgcatcactacattaatatactcatttttattgtcccctgtttctgagagtaacaacttcaaatctcctaccttctttcctgactttgacttcctataccgtcagctcttcagggcagtcttgacattggaataataataataacatcatgttcttagacaaagactgatccactctcagaaatcaggttaaaggttattttatgtgattcttttttgttttaatatgatttataaagagggagagtcaatgttgaagaatcagctattttaaaattgatccctctactggagtactaaaaagtatttgtgaaatgaacacgaataatctttataacattaaacattgcaaaacccaaatgcaaaatagtcctatttaacataaagtctttcatattgttctgttctgccatccttctatacatttgcccagacaggacagcaacaaggaaagaatatgtaaacactaatcatttctaacttgccatctgtgacagttcactgtgctgaaattagaaaggatggaatcacttttccatttccttaaggtcaccaaggacagacaagctcaggacatactgtatttgtcagaagaaaaagagatgactggtgaggtggcagtgacaaatctgttctaggttcagctcattttactgaagaatgtgtgtccccttctgacatttatcaaaagaaattcaattttataaaaagaaggatgtcaaataatagtacattgctaacactcattttgttgctgtcagaagggcagatgggggcaaaaagggaaaagggtggatggaagagaaagttattccagcaagaaacaaacaaagtcatgctaataatacacttataggcttgaatatatttctgattaaaacacctatttttgagatccatcttagtgcctggctcacactttagaataccagttttcacttcttccagacagaaggaacgacacaaagcaggttgatttgtgggttttgtgtttgtttttggttttgtattttgttattgtttgagtgccattctgctgcaccaggaaggaaagaaagctaatgaaacctggtaaaaccccaggtacaatgacatgcaccctgtgggcatgcaatcaatagttcttatggtgatgatgatgtttttctctggcagaaaagggtattttgggtcaaaaaataacccaaaagttgtgacagaggtaacggaaaaatagaagtcagattaaaatcaaaggaagaaattctaacccaaaagttgtgacagaggtaacggaaaaatagaagtcagattaaaatcaaaggaagaaattctatcaggagactaataatgaagctgacaatatactgtaacaagtaatagtgttttaccatactgcataaaaatattggattaagatacaaattaaatctctttctcagtgagggttttctgcagaacataaacaattaagctgctttctggagaagacaggaaacttgattaacagatccaaaaagacagcatagggaagatgggtttaacactaggaggtgaaacaccaactgttatccaaattgacttttccagaaacgttggataatttcaatcaaggactgaaatatactcttttctttttaagcgtcagtgttctctggacttaaacaagtcaaaggaggttcttattaaataaatgctactggtgcatatgttccagtcacagtctcctgaggtgagtatggagacactacagaaaattgaaccatgaaatagggttttgtgtctctataccaaaatttcaaatatctggaggtgtcctagctcatggtggctaagcaggcagcttgtgggagtacaggaggctacaggagacgccaggagtaaaacgacctattctgagtcctgtagtctctgtaaggtgcctatttgatgcaatctaagacagtcttatttagaatagggacccttagaagctgctaatataagtcaaagaaacaaatacttctgtgcatttttccccacaaataagggattgtcctaaacctctaagcattaaaccaggaatccagtaaaaaccaggcttattgtactccaatccccaactcacgtactgtcttagagattttcagacacaaggtgctaaaagttatatagcatattttaaaatttatctgttatcaagtgcctttcattgaacaaaaaaaaaatcaaattcaatagtacataaacaagatctttctgctccttcttggaagatttttaggagaattaaagtcatagagacaatcatctacatgccattaatattgtcatcttcacatattattaccagtattattaccagcacagctttcaaggtttgaaattttgcattgggctggccttaacatttggacaaatcctttttaaatatagggaataaataataaatttaaaaataaaatacgttaatatgcaattttttttttttgagactgagtctcacactgtcacctgggctggtgtgcagtggcaccatcttgacttactgcaacctccgcctcccaggttcaagcaattctcttgcctcagcctcccaagtagctggattgcaggtgcctgccaccacgcccggctaattttttgtattttttagtagagatggggtttcaccatgttggccaggctagtcttgaacccctgaccttgtgattctcctgcctcggactcccaaagtgctagaattacaggcgtgagacactgtgaccagccaatatgcaaaattttaacgctttaaattagaggtcagcaaacttttttcattaacagagagtaaaatatgttctgctttccattccatacactctcacacaactaatcaactctgctgttgcagtacaaaagcagccatagacaatacaaaaacaaataggggtggctgtgttccgataaaattttctttacaggcctctgcctctgcctctgcctctgcctctgcctctccctctcccctctcccctctcccctctcccctctcccctctcccctctccctctcggtctccctctccctctctttccacggtctccctctgatgccgagccgaagctggactgtactgctgccatctcggctcactgcagcctccctgcctgattctcctgcctcagcctgccgagtgcctgcgattgcgggcgcgcgccaccacgcctgactggttttcgtacttttttggtggagacggggtttcgctgtgttggccgggctggtctccagctcctagccgtgggtggtccgccagccttggcctcccagggtgccgggattgcagacggagtctggttcgctcggtgctcggtggtgcccaggctggagtgcagtggcgtggtctcggctcgctgcagcctccatctcccggccgcctgccttggccgcccagagtgccgagattgcagcctctgcccggcctccaccccgtctgggaggtggggagcgtctctgcctggccgcccatcgtctgggacgtggggagcccctctgcctggctgcccagtctggagggtggggagcatctctgcccggccgccatcccgtctgggaggtggggagcgcctcttcccggcagccatcccatctgggaggtggggagcgtctctgcccggccgcccatcgtctgagatgtggggagcgcctctgccccgccgccccgtctgggatgtgaggagcgcctctgcccggctgcgaccccgtctgggaggtggggagcgtctctgcccagccgccccgtctgagaggtgaggggaccctccgcccggcagccgccccgtctgagaggtgaggagtccctctgcccggcagccaccccgtctgggaagtgaggagtgtctccgcccggcagccgccccgtccaggagggaggtggggggtcagccccccgcccagccagccgccccatccgggagggaggtgggggggtcagccccacgtccgggagggaggtggggggggtcagccccccgcccggccagccgccccgtctgggagggaggtggggtcagccccccgcccggccagccgccccgtccgggaggtgaggggcgcctctgcccagccgcccctactgggaagtgaggagcccctctgccgggccagccaccccgtccgggagggaggtggggggctcagccccccgcccggccagccgaccagtccgggagggaagtggggggatcagcaccccgcccggccagccgccccgtccgggagggaggtgggggggtcagccccccgcccggccagccgccccgtccgggaggtgaggggcgcctctgcccggccacccctactaggaagtgaggagcccctctgcccagccaccacctcgtctgggaggtgtacccaacagctcattgagaacgggccgggatgacaatggcggctttgtggaatagaaaggggggaaaggtggggaaaagattgagaaatcggatggttgccgtgtctgtgtagaaagaagtagacatgggagacttttcattttgttctgtactaagataaattcttctgccttgggatcctgttgatcggtgaccttacccccaaccctgtgctctctgaaacatgtgctgtgtccactcagggttaaatggattaagggcggtgcaagatgtgctttgttaaacagatgcttgaaggcagcatgctcgttaagaatcatcaccactccctaatctcaagtacccagggacacaaacactgcggaaggccgcagggtcctctgcctaggaaaaccagagacctttgttcacttgtttatctgccaaccttccctccactattgtcctatgaccctgccaaatccccctctgcgagaaacacccaagaatgatcaataaaaaaaataaaaattaaaaaaaaaaagttaaaaaaaaaaaattttctttacaataacagcataaaactttggcttcaggtcacagtttgttgacccctacttcatattatcatgtcccccccacccccatttctttcattcaccttctatcacagagtcacagctttgcactcacagtgtagccaagttgtagctacagaccaaacattgtaaagaaatacctccggggaacttgagaataagttaaaacttgtgctaaatcatgagtgaaatatacattgggaaacacagttaacaacccattccccaacctgcttactgggccatctttctaaaaatgcaaatttgatcctgcagctccctagcttaaaaggcttcacctgcaacagaaagccctggctttttagtttttcaccataggcttatttatggctggtcctgctttcttcccctccttatttcttctcatcccttccttctcacattctatgcttcagctacatagaaggacttataatttccagaatgatacctgctcccttgcctttcaacccatacacttatttttttttttcttcttagatggagtttcactcctgtcgcccaggctggagtgcaatggtgcgatctcggctcaccacaacctccatctcccatgttcaagcaattgtccttcctcagcctcctgagtagctgggattacaggtacccgccaccacacctggctaatttttgtagttttagtagagaaggggtctcactatgttggccaggctggtctcgaactcctgatcttagggaatctgcctgccttggcctcccaaagtgctgggattacacgtgtgagccaccatgcccagccaacccatacacttgttactcattctccttgaagcactcttctccacacatccttggccttgccaactccttgaaggctgagcttaggtgtcttaaggacttcaactcccagacacttctgtatacctgcgttataatatttttactgctggctgtgtgtggttgctcacacccgtaatcccagcacttcgggaggccaaggcaagaggattgcttgaagccaggcattcaagacagcctgggcaacatagtgagaccccatctctaccaaaaaattagaacttagctgggcatgtggtacatgcctgtactgccagctacttgggaggctaacatggtagaatcgcttgaacccaggatgtcaaggctgcagtgactcgtgattgcaccactgcactccagcctgggtgacagagcaagatcttgtctaataataataataataatattcttaccactatctacagatgattactggtgcagataaatttaaaattcttcttggccatgtgtggtggctcacacctgtaatctcagcactttgggaggccgaggtgggcggattgcttgagctcaggagttcaagactagcctgggcaacatgattaaaccctgtctctaccaaaaatacaaaaacttagccgggcatggtggcacatgtctgtggtctcagctacctgagaggctgaagtaggagtattgcttgagccctgggtggtagtggggagactggaggttatagtgagctgagattgtactactgcactcctgactccagcctgggtgacagagtgagatttcatctcaaaaaatatataaaaaataaaaaatttaaaatccttgaaagctgaaactgcattttcttgtaagcacatgatatccctcttagggtcctgctcccccatcccctgagcatgggaataaagaaaaaatcttgactccctttaggggaaaattccaggcaccccactatccttgagaaataaataaataacccactaatcaataaggtaataataagcttaaacaatagccacccaagtaatctagagtcataaaatgtttggttccctataaaaactaaagataacatcttgacatatttccctgagttgtttttcagaaacctgtacccccacaagatggaaaatgctgaccactgtcacacagacctcaaataagggagagctaaggactgaactctaatcgttgtcccttgttctaaatgtcttcatgaggggcctggagagggtcatcatgcccatagatcaaaccttaacattcctttcttctgaccccaagtttttagacaaagcattgcttccctaaccaattgtaaatcaaataatctgtgaacctctctatgacttgtaagcccccacttccagatattctgccttttgaggcaaaaccaatgtgtaacctccatgtattgaattacatatgattttgcctgtaacttctgctttcctgaaatgtaccccttcctttaaagacccttgcttgtaagccgtgggagagtttgggtcttaagtgttagctgcccaattctccttgcttaatgccatgccataaatgcctcactttctctcactgcaaatcttggtgtcaatgtttgcctttgctgcaccaggtgggctgaccaaagttgggttggataacacatggtatctggtacattgagaataatccctaatgcttattaaatgaagccatcaattatttaatgtctttaataagcttttggcctttctacttcagaatataactttagttattcccagctatgggcaatttattttcttttgcatattgtctataaatgatacccaaagaactaataggaaaaaaaattattagtcagttaaacaggtaatttaatatcaaaccatagaggaggaaaaataattgtctctctacccttcagagttcgtagctgagactctgaaggttaacaggagaaaaataaataaaagatgaataacgtgtgtacctccagtatacatggaaggcatactcagcgaaatctgaaagagtaaaatctccaggctaaatctcaagagatctcaaaagggttgtttaaacttcaggcttataccatcctttgttgaaacaaaaagagaagtttattgggaaaggctgattatgggagataggaagagtacagtatacaagaacagtttgttatgcaaacttaagtcagtcccttctccattgattaagagtatcttggatttagtcattctcttcctggtactaagagagagagagacacccttacaaataacgattttctttatagacataaatttctcttacaaaagggtaccttctactctagttttcagagcttctcctgtgtctgctgtttcccaaaataattcaattcaaaaaattctatgtcaaagaggcttatttggggtggtgtattctggtcttttacagtcacactttgagatgacgtgttctgaacgccatcaatataaaaatcttcttaacttgatttaaaatttttttcaggttgaaattagacatatagctttatgttgtcattattgttttgtttctttagagtgttaacttaaaaggaagaagctgaggaaaattaatatatgtagagagtttctttgggccaagcttgcagattgcaacacaggagcacagattgaagttgccctgaatataattcaacaagcagtagttacaagtgaaaaaaagtagttaaaggcaaaaaggggagacacagagtgggctgatacaaagttgcttgtcaggaattctcattgtttcatggaaatgacgtggagtagtgattggctatacatttttggctatagtgtgtgggttatagtgtctggtgtggcattattagcttaatttatagctacttgtagcaatagcaagcagtttcaagagattaatatatagctcaaagtgggaaataggacattattgcagtctcattttaatgtctctttgggcctggtaagtactgtcttcttttttttctttttttttttttttcttttttgagacagggtctcactctgtcacccagactggagtgcaatggcaccatctcggctcactgcaacctctacctcccagcctcccaagtagctgggactataggcatgcactaccataccgtgctaaatttttgtatttttttgtagagatgaggtttccccatgttgctcaggctggccttgaactcctgagctcaagcgatctgcctgcctcagcctcccaaagtgctgggattacaggcatgggccatcgcaccaggccaggacctgataattaaaaggcctcagataaaagttcttttctcaagagacaatcttaggaccacttgctgcattatctatcagtattaataaagccactttacatttaccctataagtggaaatattttctcaactaatcacttaacagccaggttttatttgagaagcaattaaacatttatggggtctacagaagatatgaacaaatgctatataaagacatccctaataacagactataggaaaaaaattgtgctttaatgcattatccacatacagcatgtcactctgggttactagattttagcctttcatgatctttgcattttattgcatatttattttatgactctttgcaagttaaaagtgacaaagaccctccccttaggctcctttgaatcttctttttgactaactctcactcttggtctcatccttgccccacctagtctagttttagcaagaatcctcttgaatcaatatggcaaaaatcccctgcccttggcatgtgatcactattgatgactgattaggttcctcttacttcatcctctatatcttttcacagtgggctgccttcagcaagaatcctaagtcagtgtagccataatccccatagtcttgatgtttcctcttagtaattttctatcctctgatctccgccctttaccttggccataaatccccactttttcttgttgtattaagaatgggatttcattctatgctgagatctctttttccctattgcaataattcctgaataaaatttgcttttatcactttaactttctgtctggctgtggtttgctttgacaatagacatgcatattctgtcttacagagtggagttcaatcgacttcccatctcctatgggggaaaaaaaccagttttgcctctatttgtaattccatttctttactccatagaaatgtgtgactttggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaagaaatgtgtgcctttgaattttcctttcaaccaattataatatctacccgccttccttactgaatgagtaaaataaacattttaacacatgcttatttgtatgcccacatgacagtcatgatcttaccttttcttttttctttttttttttttttttttttgagacggagtctcgctctgtcgcccaggctggactgcagtggcgcaatctcagctcactgcaagctccgcctcccgggttcacgccattctcctgcctcagcctcccgagtagctgggactacaggcgcccgccaccacgcccagctaattttttgtatttttttagtagagacagggtttcaccgttttagccaggatggtctcgatctcctgacctcgtgatccgcccgcctcggcctcccaaagtgctgggattacaggcgtgagccaccgcgcccggctgatcttaccttttctagaaaattatcttttaacaattttggaagttccactgaaatgcccagtggatttacctaccaaagccaggtaacctttgcaggcagagaaatgcacttcatgggcagtgtaagcccaggtagatcttttcttggctcacagaattgaatccaagatggcaagaaaaccttgctcactctgtttttctcattctaattctcctctatactaattttacatttttggttttgggttgtttactgtcagtaagttagtccccgttgcaggaagtaatggttgggaattcacttttatgatctgattatttgatgatctctgtaaatgaattaatagttaacagagatctctgctaggtgagagatagcagagaatctagtgggttagtcttttctgtttatctgttttctattttgaactcttgcagaaaccaaattaatgttttaagaaatcaagttcagctgggtgcagtggctcacgcctgtaatgccagcactttgggaggccgagatgggagtatcgcctgaggtcaggaatttgagaccatcctggccaacatggtgaaaccccgtctctactaaaaatacaaaaaaaaaaaaaaaaaaaaatagccgggcatggtggcatgtgcctgtaatcccagctactggggaggctgatgcaggagaatagcttgaacctgggaggcagcggttgcaacgagtggagattgggccactgtactccagcctgggcgacaagaacgaaactctgtttcaaaaaaaaagaaaagaattcaagttcacataatttagataaatttttggcaaatgatacaagcttaatattattggtttaacaaaaaatacctatgtcttctttgatttactagagaatgagaataatataatgtaggtgcttatgctacttgggtatgtttttcctaatcttaaacaggttaatagattgaataagcttgccttacttctacttcatgtttaagatgtttataaatataaatttatatttactcatactgaatcattattgtgataaactttatttcaacaataattatgttttgtgtatgtcagcttcaggacaattttcaaggtctgtaagtaacttaaaaccttggaccaatggtaagttgagttaattaatggagaatcattagatagacagacagtatttcaagatagtaagatagaatactcattactactcataatttcaagtttatatccctttacttcttattttcataagactatctctttgggtctgtactgaatgtgctgctcatttctgccactttggggagtgtataaaaatgatatgtgtggctaaggcaagctgtattgtgtgtattcacaagttctgctagtctgctgcaaaatgctggtgtgacagtgaacaattatccactctccaggtctctctgtgaaatagaagtgtgttactttggctaaaagttataatggatatgtggctttggctatatttaggagccatagtttctgacaaatacagctgtgtatttccattttttgaggaaaagagtaattttgtcccaaaggagtggagtatttttggtctccaaacccccttgtgctcttcaagcttattgagaaccacaaagaaatagaactgcctttgagatttcccaaaggactcccataaagtcacaaagatttgttcttttgccttctaaaaaggcagatgttaaaaataattaggctcatgtaacattattagggctaaaaacaaaaaacttatactgtaaaatatggtgccttgacaagtcttttttttttttttttttttttttggagacaaggtccactctatcacccaggctggagggcagtggcatgatctcagctcactgcagcctgacctgccaggctcaagagatcctcccactccagcctcccaagtagctgggaccataggcacatgccaccatgcccagctaatttttgtatttttttgtagagatggggttttgccatgttgcccaggctgatcttgaactctgagctcaagcatcttcccaacttggcctcccaaagtgctgggattataggcatgacccaccatgcccagcctcttgacatgctttgaactaaaaaaccagcctcagaaacaaagtctctctgactttctcccaccctcaccctctgtcccccaatctcagtcctctgcctctctgaaagcacagggagaggctttctctcaagttcatttatgggactgcaggaagttcctccagacagaatgcaattgtcttaggtcttctccctgtaatctcagaaaacaaagaaggttaacttgctggaatgatgactagattgggcaccatacccaaagcccagacagactttctcccaggctattgtttgttcttctcccctaaaaatcatttacttttcctctaaaattgcatacatcccccactccttctcccctatgaagagagtatttaaacttcaaccatctggcccttctttgagtatcacactttgtgtgactcccgtgcacttgcacgttaataaatttttatgccttttctactgttgatctgtctattgtcattttgttttataggctcaaattcttgaactcccagggagtggaagaaaactttctttcatccctacagtgtgttattattaatgagttacatagaaagagttgtcgaattaaaaaagatacttatgcttccctagattaaatttatatgggtaaaatcatcacaaacattttacaaactaaaatccatatgtgaagttcctagagatttgtcaatgccttcactgcctatgacatggttctatttatcagagttcaggtgtagctctgcctgataatagacaatagacaatagtatacagtagacagtcataatttcagttatttttggcatgccagctttgttaagatataattcacacacaacacaatttaaccatttaaactatacaattcagccaggcatggtggctcatgcctgcaatcccagcactttgggaggctgaggcgggaggattgcttgagatcaggagtttgacatcagcctaggcaatatagggagacctcctctctacaaaaaatttttaaaaatcagccaggcatagtggtacatgcctatagccccagctacttgggaggctgatagggggattgcctgagcctgggagatcaaggctgcaagtgagccatgatcatgctactgcactccagcctgggagacaaatcaaggctttgtctcaaaaatactaataataataataataataattaggtgtataattcaatggttcttagtatattcagttatgcaaccatcaccacaatcaattttagaacatattcttcacttcaaaaagaaatcctgtaaccattaacagtcattctgcatttccccactaaccaccaacccagaattgcctatttgggacatttcgtatagatggaatcatgccatatgtgatcttttatagctggcttctttcccttagcataacattttaaggttcatttatattttaccatgtatcattacttcattccttgttatttgcaaatattattccattgtacaaatataactttttatttatccactcatcaattgataggcatttagattgttttcactctttggttattatgaatgctgatgctataaaaattcatttacaagtttttgtgtaaacatgttttcatttctcttgggtatatacttagaagtagattttctaggtcatatggtaattctatgtttaatcatttttatggcaaccctatgtttaactatcagattgttttccaaagtggctgccccatttttcagtccactagcagtgtatgagggtttcaatatctttataccttaaacaacacttggccaggcacagtggctcatgcctgtaatcccagcactttgggaggctgaggcaggtggatctcttgagcacaggagtttgagaccagcctgggcaacatggcgaaaccacatttctactaaaagtacaaaaagctagccaggtgtggtgtcatgcgcctggagtcccagttacctgggaggctgaggtgggagggtcacctgagctcaggacgttgagctgtgatcacagcactgcactctagcctggatgacagaatgagaccctgtctcaaaaaaaccgaaaaccaaaaaccactacaaccaataacaaaaacacttattatctgtctatttgattacagcatcttaatgggtatgaagtgctatcctatcaccttgagatttacttgttttcttttctccctaatggctaatgatgttaaacatcttttcatgtgtttattggccatttatatatcttctttagagaaatgttaattcgaatactttgcccattttgtacttgggttattttattgagttgtaagacttctttatgtatactaggtacaagttccttataagatgtatgagttgcaaatattttctccagttcgtggattgtctcttcacttttttgatggtgtcctttgaagcatgactgtggtgaagtccacaattttctaatttttcttttgtcaattgtgtttttggtgttacatctagaaaggctttgcctaacccaaggtcacaaagatttataccctacatttcattccaagagttttattgttttagctcttacatttaggactctgatccatttttagttaatttttgtgtatggtttgaggaagaagttcatctttattcttttgcatgtgcatatccagttgtcatatttgagaatgatgctcattttaccaaatatgaccatgttcctataagtaactaaggttgtaaacttcatgaaaccaatgcttgcaatgtcctgttgggtaagctcacctggtacctggcttataggtttccctgccttccaggtaggtttagaaggtcactttctggcaggtccaaaagtcttagcatctttgggggacctggagaagaaagcaatttgtctcatttataggaaatgcaaggaaatctgatgatgagttcttaccttggtttcttagcctcatgatagtaaataatgagaggttttaaaagcccattccgagattgcttataaaaacttccagcaaagcaaatttaaggtctctatggtaaaggaattttcttgctacacctgtatatataatcaggccagatctgtcaatgttgagagaggaggaagggagaaaccagttaggcagcagttagggtgggtcctctgttgaattctttcaaacaaaagaacagcctgaaaaatcaagctgcaggcacagataagggaacttgcacaggggcttgcctaagacatacccaccgctgcacagataagaaaggctacacaggtgacttgcccaaacattcccgcaatggaaaatttcgtcctctgacacatgcacagtgaagggaacaaagcaatatggagtaattcaagctaaaggcctgcatgcacactaggtggatgcaatggggctaccagaaatttgtgccttatggaaataaaatgtccagccctcatcggttcctataaaaggctttgtattcaactttgaaaacagcaatcctctttcaggccccctctctgcagcggagagctttcttttttagcttactaaacttttgctccaacctcacccttggtgtctgcgcttcttaattttcttggtcattacacaaagaacttcctgtgatactttgggcaatgagaaactgctacattgtggtgcactggggagactgtaaccatgtgtatcttactttgtgatcaagaataatctttcgagggttattttttattaaaagaggagagactatacaaaaaaaaattgtgtttcaatggaaaactatggattatctacatacaacacgccttgtgttacctaatctagactttctaatttttcttagagacagggctttgctctgttgcccagactgaagtcaagtggcatgatcatcactcactgcagcttgaactcttgggctcaagtgatcctcccacctcacctcacctaggactacagggatgtgtcactatgcccagctaagtgtttgtttatttgttttgtagatctggggcctctctgtgttgcccaggctggtcgttaactcctggcctcaactcatcctcccacctcagcctcccaaagtgctgggattacggttgtgagcccctgtgcccagccagtcagattttagcctttataatctctgagctattttacaactctttgtaaacggatagactacacattctgtcttgtctgatagggtttcaatgaacttatctcccctctcagggaaaaaatacctttgcctccatttgtaattccattcctttattccatataaatctgtaccttttgacttttcctttgatccagtgtaatatttgcctgcttccctcatcaaataagtaaaatctttcacacatgttcattttttatctgtatgagagtcatgattttacctttatttcaaaagttatcttttaacaatacattacaaagtgggatagagatgaaatcagataagagagaaaaagacccatgaaaatgcataggtttaggatgtacctcatttggactctgcagagacaatgaaacaaagtctcaaagaagttgatttgccgaaagatacaaccaggaaatgggggtgagataagggtgaagggtaaacaataattaatggaaaagaaattaaaatgacacaaaacatgtgaataaatgctcaatcccataatgctctcaaatccttttttaaaaagacctatcatttttcatttaagagagtggtaaagaaatagaagtgtggtactattcagggctggtaagtaggtagcaggaataggcgcatttctgctttgtgaataagggagcaggatacactctttaggaggctatttaataatatttaaatacaagtatcctttaaaccagcatttctacttttagatgtttaattggtgaaatgcttgcacaagtatgtgatgatatatgttcaaggatgttcattttcaatattgttgtaatagaaagcttggaagcaccctagatttccatcaataaaggactgtttcagaactctgtatctagaatggtgcattttttgtttaaaaatatacatatagtggtcatcttagagggatgggactataaaactttgtactccacattttttgttttacatgtttgtattacttttgccatattttttaaaaagtaaaaatatacctataagagaatccaatcttttgaacttggtacagtatcatataaatgaactcattttttcagtgcaccaatggaagcttctcagtggaggtggagagggttgtagaacagcattctgaattggacctccatgaagtagggcatagtcattactcactagtcactaagaacattttctatgggatgtgcacaatatccagacaagaattttaacaagatccacacatgctacttgagccaatgaaacactttacttaatcaattaactaatgaaggttttagggcaaataactacgactgaagaattgatgaactatagaatgtaggtgtatgtgtgtgtcttttgactgtagttcccactgaagagttgccgaatgatgaattaatgctaaatgatccagatacacatcatataaataattacttataaatattattcaaatgaaatttatctactttaaacagctatttgtgcagttaattgattttaaactgcatatacttccaatttcaaaataggctgatttgaagtagagtcttcagtaggggcgtagcatattatgattttaaaaatttaaatcttatgttacactaaaatgctgtaggaaatagatttgatcgggcaaccaaaccgatgtcatgggtcactattcgtaagtaccatggcaaataataatgattaacatttaccacagacttattgcatagaaataatttctgtaagttatgcctccaagcaactcagtgatgtaagtaatgatttatcctggcttaacagaagttaactaaagatacggagggagaaaatgaggccagggagttctctggggcctcttttataagggtacaatcccattcgtgaaaactccatttccattacccagtcctatcccaaagaccttgcctcctaacaccatcacatttcaggtgagaattttgcataggcatttgggaagggaggacaaaaatattcagtccataacaaaattcctcattgaggttgtgtgtattgactagataaaagaaattcaacagtttccatcccaaatttgtttgctatccaatatagatagcttggtttttgttttgagacagagtcttactctgtcacccaggctggagtgcagtggcacaatcatagctcactgcagccttgaccttctgggatcaggtgatcctcccacctcagcctccttagtagctgggactacaggcatgtgccactgtgcatggatcttatttatttatttatttttgtggagacagggttttgctttgttgtccaggctggacttggacttctggcctcaagtgattctcctacgttggcctcccaaaatgttaggattacagatgtgagccactgcacctggcctcataatttctgatttatattcacaataaagctaaaagaggaaacacatgtattgtggaacaaaaagcacacaaagaagctgtttgaatgtctttttaaaatttttacttttcaatgtttttattgatgtgaaatatttgaacatatttataggatacatgtaatattttgttacatgaatagaatctgtaatgatcaagtcaggatatttaggatatccatcaccatcagcattttaccatttccatgtgttgagaatgtttcaagtccttacttctagctattttgaaatgtgtaatacataattgttaaatatagtcacctatatcactataaaatattagaacttattctaactaactgtatgtacccattaacccatcctactttacttccccccacgcacactcacagatagttcccagcctctgataactgtcattctactcactacctccatgaaatcaacatttttatgagcatatgagtacatgtgataatatttgtctttctggtttttgtttttgttttgagacagggtctcaccccgtagcccaggctggagtttagtggcactatcacagctcactgcagcttccaactccctgggctcaggtgatcttcccccctgtacctcctgactagctgggactacaggcacatgccatcatgcctgtctaatttttgtatttttttttgtagagatggggttttgccatgttgtccaggctggtctcaaactcacgggctcaagtgatcagcccaccttggcctcccaaaatgctgggattacaggcatgagccaccacacctggccatatttatctttctgtgtcaggcttatttaacttaacataatgacctccagtttcatccatgttgctgcagatgacattatttcattcttttctatggctgaatagcatcctactgtgtaaatatatgacattttctttatgcattaattcattggtggacacttaagttgattccctatctttgctattgtgaatagtgcagcaataaacacaggggagtatgtatccctttgatatgctgatttcctttcttttggataaatacccagtaatgggatagctggactacaaggtagttctattttcagttttttgagtaatcttcataccattttccataatggctgtactaccttacattcccaccaacagtgtatgagagttttattttctctgcattgtcaccaacatctgttattttttgtattttttatagtcatttttactggggtaagatgatattgtggttttgattagcatttccctgataattagtgattttgagcatttttattatacctgttggccatttgtaggtcttccttggaggaatgtctatttagatccttgcccaacttttaaatggggttgtttgtgtttttgctgttgagttgtttcagttccttgtatattctggatattagtccttgtcagataaataatttgcaaatattttcttccattgaataggttatctctttgctctgttgattgtttactttgctgtgtggagctttgtagtttaatataacttcatttgttaagttttggttttgttgcttgtatttttggggtcttagccataaaatctttgcttaggcaaaagtcctagagtattccccgctatgtttttttctagttgttttatagtttagggtcttacgtttaagtcctcaatccatcttcatttgatttttgaatatggtgagagataggggtttaatttcattcttctgcatataaatatccagttttctcagcaccatttattgaagaggatgtcctttcccccagtgcatgttcctggcacatttgtctaaaatcagctgtctataaatatgtaagtttatttctgggttctctattttgttccgttggtctgtgtttttctttttataccaatatcatgctgatttggctactatggcctgataatatattttaaagtcaggtagtgtggtgcctccagcttggttattttcattcagaattgctttggctatttaggctcttttttggttccatacaaattttaggatttatttttttctatttctgtaaagaatgtcattggcattttgataggaattgctttagtagtatggtcattttacaatattaattcttccaatccatgagcatggaatatctttacgtttgtttgtgacctttgcaatttctttcactggtgttttgtagttttccttgtagagatctttcacctccttggttaaatttattcctagtttttttgtttttgtttttgtttttgttttgtcattgtacatgggatttctttattatttttcagctaattcattattgacattataaggtatatagaaatgctactgatttttgtatgttgattttgttttctgaaactttactgaatttgtttatttgctctaggagtcttttgaaggaatctatagggttttctagatatagaattatgttgtcagtgaacagagataatttggtttcctctttttctatttggatgccttttatttctatctcttatttgattgctctggcgaagactcccagtagtatgttgcatagaaatggtaaaagtgggcatcctcgcttgttttagttcttaggggaaagggttttagtttttccccatcagtgtgttaactgtgggtttgtcatacatggtctttattatgttgaggtatgttccttctgtgcagagtttgttgagtgttgtttatcatgaagggatgttgaattttatcaaatgctttttctgcatctattaggtgatcatgtagtttttgtcttttgttctgctgaggtgatatatcacatttactgtttacatatgtagaaccatgcttgcaatcctggggtaaattccacttgattgtggtatattatctttttgaggtgctgctagatttggtttgctaatattttgttgaggatttctatgtctacgttcattagtttattgacctgtcattttctttctgtgttgtgtttttgtttggctttgttaccaaggtaatactggttttacagaatgagttagggcaaattcccacctcttctcttttttagaatagtttgaggagaattgaaattagttcttctttataagtttggtagaattatgcagtaaagccattatgttttcagcttttctttgttgggagacttttaaatttgttttcaatctcattacactttattgatctgttcaggttttctatttcttcctgatttgatcttagtaggttgcatgtttccagggatttatccattttctctaggttttgcagtttgttagtgtgtagttgttcataatagtatctgatgatcttttgtatttctgtggttatcagttgtaatgcctcctttttatttctaattttatttgggtcttctctctttcttcactggtctagctagtggtctgccaatattatttatcttttcaaaaaacccactttttgtttgctgatttttttgtatatttttagtcccataggttttagtatgctatgtttccattttcatttgtttcaagaaatttttggcttctttctttccttccttccttccttccttccttccttctttctttcttttttctttttttgagacactctcactctgttacgcaggctggagtggagtggcacaatctcggctcactgcaacctccgcctaccaggttcaaccaattctcatgtctcagccccccgagtagctgaaactaaagtcatgtatcaccacatctgcctaatttttgtatttttagtagagatggggtttcaccatgttggccaggctggtctcgaactcctggtctcaagtgacctgcccacctcaacctcccaaagtgctgggattacaggcacgagccaccatgcccagcctgatttgcttcttaatttctttgttaacccaatggtcattcaggagcatattgtttaatttcatgtatttgtacagtttccagaaaccctcttgttttttatttctagttttatttcattgtggtcagagaagatacatgatatgatttcaatgtttaaacatttgttgaggcttgttttgtattctaacatatgggctatctttgaaaatattccatgtgctgatgaatgtgtactctgtagctgtcagatgaaaagctctgtaaatgtctgttaggtccatttgatctaaaatatgcagtttaaacccaatattcctttgttgatattctgtgtagataatctgtcagttgctgacaatggggtattgaagtccccaaccattattatattggagcctattcctcactttagagctaataatatctgttttacatttccaggtgctcttgtgttgggtgcatatatatttagacttattacatcctcttgcccaggcacggtggctcacacctgtaaccccagagctttgggaggccaaggcaagaggatcactcaagactaggagttacagactagcctcagtaacatagtgagaccccatcttacacaaaattttaaaaaattagccaagtacggggcatgtgcctgagggtgaagtgagaggattgcttgagcccaggaggttgaggctggagtgagccatgattgtgccattcccttccagcttgagtgacagagcaacagagcgaggctctgtctcaaaataaaaaaagagagaaaaaagatttttatatcctcttaatgaattgatatctttatcattatataattaccttttgtctctttttgctgtttttcacttaaagtctgttttatatgctataaatatagcacattctgcttatttttggtttctgtttgtggaatattttttccatccctttgcttttagtctatatatgtcttcacacgtgaaataagtttcttgtagataagacatagttaagtcatgttctcttacccattcatccagtctatatcttttaggtggaaattttaatttgtttacattcaaggtaactgctgatatgtgaggacttattcctgtcattctgttaattgttctctggttgttttgtatatcctttgttattttcttcctctcttattttttatctttatggtttggtgattttatgtagttgtaacatttgagtcctttctctttctcgtgtgtgttttctctattcattagttttatactttcatgtgttttcatgatagtagatatggtccttttgcttccaagcacagaactcctttatgcatttcttgtaggtctggtctagtagagatgaattgcctcagcttttccttgtctgggaaagtctttatctttttcttcatttatgaaggataatttagctgggtatagtattcttgagtagccatttttttcacttagcactttgaatatatcattccgctctcttttggcctgtcatgtttctgctgagaagtcaatttttagtctggtgaggattctcttatatgtgactaggtactgttctcttgctgttttaaaattctttctttgtctttgacttttaacagtttggctacaatatgacaggaaaaagcctttttttggattgtatctgtttggggatctttgagcttcctgtatttggatgtctaaatctcttgctagaactgggaaattttcagctaatattttgttaaataggcatttctatggcattaacttctccttgccttctgggacacaaaacatttggatattttgtcacttatgatgtcccatatatcagatagcctttcctcattctcttgtattcttttttttttttgtctgattggattatttcaaaagacctctcttcaagtttttcaagtttcttctgcttgatctagtctatcattgaagctcttgattatatttttaaattttatttattgaattcttcagttccaggatttgtttagttcttttttatagtgtctatctctttggtgaatttcccattcatatagtgaattatttttctgatttgatttctttgtattgttcatctccattcttttgtatctcactgagcttctttaatgttatttttaatttctcaagcatttcataaatttctcaagcatttcataaattactattttttgaaatctgttgttggaaaattattatgttcctttggaggtttcatatttccttgttttttcatgtttcctatttcctttttttttttagatggagtcttgctcttgctgcccaggttggagcacagtggtgcgatctctgctcattgcaacctccgcctctcgggttcaagcaattctccttcctcagcctccccagtagctggaattacaggtgcccaccaccacacctggataatttttttgtatttttagtacagacagggtttcaccatgctgtccaggctggtctctaactcctgacctcaggtgatccacccgccttggcctcccaaagtgctgggatcacaggcgtaagccaccacgcccagcctcctatttcctttcattgacatttgcacatcaggtgtaacagtctcttcttctatttttggattggcttttgcatggggaagactttttcctgtaggtgaatctatggtgttggttgggtagggcacttttgctttgattctgggtgtgtgcagtagtgcaggctcataggagttcctcggctataaactcagtcagtggtgtttgtgattttctcagtagcttgggctctggttgttaatggaagctgtggtgaggtttttctggggacaggacaaccctcaggcttccaggtggcacttgctggccggtcttgcttccttctttctttctttctttctttctttctttctttctttctttctttctttctttctttctttccttccttccttcttttcttttttctttctttctttccttctttctttctttctctttctttatctttctttctcttcctctttctctctttccttccttccctttcttccttccttcctttctttttctttctttcttatttctttttttttttttttgtctgtgatggtctaagcaggccattccctaggtccccaggtggcacatgcagttgtgtgctggtggtggtggtgatggaaggctgggcaggcccatcttcaggaccccacgaggagttcccagatgccagtagttatgaatgaggcagggagatgcccaggcctccagagagcatgcttggttgctggttgctggttttctaggcctgttgttaggccctttgcttgtgtgcatgtgttcccagggcaactgttggggtggtgtggccccaggctcccaggtggtgtgtttggggcactgaggggccaagcctggtaagatgggtctgtttttaggtgtcctgttggcccacttaagtgttggctttagtgggtggggcagggcaggcccccaggcctctggaaggtatgatagggtgccagcagtggcaggtgttctgaggctattattaggccccctgctggtttgcatcctcacctgggtgactgataggatgggctaacccctgggtccccaggtggaaggtttgggaacgggggggtgtggttccagtctgggtgggcctatccttaagctccccattgttgcgtatggccacaggctgtggtgagcattgtgggtcgatccccaattcttgggcagtgtgctcaggcagggatagtagcagtggcagtgggcagtaaaaacccatcctgaaggcatatgcaagtgtgcagtagccctgctagggatgggggtgctatttgtggtagccatcccaggaaggtggggttcagactctggacagtatgtactttggctcccagtaacagcagtggctgaagcagctggcaaggatagcccggactccaggcataagcaagtgcatggcagccctgctgctggggagagcattagggttgctgtttgtgaccacagcttaaggtagatggatttcagactctggggtgtaagcactttggctccctcctccctggtgtgctgcacctctctctccccagtgtataggacactgtacgggctagattgctggggatcctgctgttctactggttccaactggcatctcacctctgtagcccttctggtggatgtggggaaatgtcactgggactccagggaggtggagatgcaggagctgtggggcactgggacaggatgtagcttggtggaagttgggctctcaaaatggtgtcatgctgcagctgcctgggagttaggagacggggtggtgtgagacccactatgagctccctctctggagcaaaactctctcatggactctagggagctcctcatgccagtctcagggcctgcagggcttgaggaactctcccatggctagtattacaggaatctgtggtaaggatgtggaccactggggatcttgcacttcccctttccttgcactgaggagcctctctgagctcccagctgatcctggctgggctgtcggtttcacctctggctccttcagtgcctcaggtgtttcttgtcactttgttaaattctagctttctctcttagatgttctgttccaagtgtgagtatctactcaccattttggttctttgtggaggagctgagtgtcttgtgcctctagtcagtcatctcaaaacgtcactgctcagacttcttttttttttttcttaaatagagacaggatcttgctatgttgcccaggcaagttggtcttgaactcctgggttcaagcaatcctcccacctcagcctcccgcagtgctgggataacaggcatgagccaccacacctggcccaaacttctcgagagtagtagtgtttgacttttgtcttctgtggtgtaattattctctaatagcttgggattgaactctgacatgataaacagtgagtgtatgctactgagagaccaaaaagattggaatagttcacaaagggatataggagactctatttcccaggaggtcctgaacaaagatttacccacttagagtaagtataggcagggatacccttgaagctagaacactaagaggtggcacttatatgactctattcttgagaaaatttattttttccccctcgtggttggttataacatcgaaatagttaaatgaaacttgctctgagttgttatttgtctgccaccctcccctttagagaaactgatttctgaataatttctcttgtacatgcattttaaaggtgtgtaattaactggtaacaggttgttaggtagctgatgaggtgtgaagtagccactaatttgttttctttatttacaactttccctgctcttgaagatgacagcatgatgtttttcattccctgcttacttcaccagattgaaaagtgatttgtgaagccatttttaatccctcaaattccattaaaaaggaatctccaagggagtcttaatcaagacataatagacactaaaatgtgatcacacaacagcacttctaatatggccctatttcaactataatgttaagcgtttgcctccagtttactgaactcagccctaacactgacctacaacttctgaaatgaaataacctctatgcagttggcaattactttattgtaaatgtttgcagctaacatactttattgctttagaatttaacatataccccaaagggataattcgttaccaaattattatagtattatcagtaaaatagtttgctttccccttcaaattgccttttcccctacttaataatatatataatttaaatcagtttaagaaattaaaatggaaacataatgaaatgagaatcattaaaaacaccacactagaatactgaaaatgaagctgaaacagaaatggctaaatgtaaaatttgtatgtaaccaaaaggggtaatttgaaaccagggagcatattgagttattggatgagtttgatgaaaataaaaactctgtccttgaagttttaaaaatattaccaaaagtaagctacagaatatgtaaagaatatatcatggagaactccccttcacccttgaatagacagttaaccaacatgcaacaaagcacagatgttagatacgtggcaacattttcctttctacctgtcagagcctacattaatacttccatcgagaacattgtggcctccaggatactattttcaaatgtagatatgtctcagagcatcaatgctacaagttgctatggtgatcacttttgtatgataataaccaatgctcactgagtttttgatttatggcaggcactgttttaagtgctttatagtattaactcctttaatcttcacaacaatcctataaatctcattaggactctaagaatcctattaggattcttattttatagacaagggaactgaggcccaattttacagttaaaagtaatttggctaaggttacatagtgttggagaaattaaaaacaaaatctcttcccaatctctcagcaaagaaagaagagaaaggtaacagttttattattgaataagcactaaaccagaatgtgatgcccatcacaggcaatatgctaagagattgcaaagacagaaagaaatctcagccttttccatagccaagcagataccagatacaacccattacatacatgttttcttttctcttttttttttttttttttttttgagatgaagtctcgctctgtcatccaggctggagtgcagtgacatgatctcggctcactgcaacttctgccccctgggttcaagtgattgttctgcctcagcgtctcaagtagctgggactacaggctcccatcaccacactcagcgaatttttgtatttttagtagagatggggtttcaccatgttggccaggctggtctcgaactcctgacctcaagtgatccacccgccttggcctcccaaagtgccaggattacaggcatgagccaccatgtccggctacatatatgttttcaagataaataattatagtaagaggtctgtcagcactatttgtcacacatagttatcctcattttacttgatattttgtggtgttagctaattggctttatccagaagaaaaaacaagcatctcatctctttataataggaggtagttttgcagcttggagcaaggtatctaccaaagttaggctcctaccttcccacagaagacaggggtactatctcctctgatgtttacatttcaaagagatggctcctaggtcttaaaagtgacaaaaggcctatcattttcaaatggaattttatacatttcaaagagaggaggaagtccttacaattagaagggtttttgttttgttttgttttgataaatgctttaagaagaaggagaggatgaaaagtctcttcctttattttcatttttttctttcttttctctctctgtgtgtgtttgtgtgtgtgtgtgtgtgttttgtttttttgagacagggtcatactctgtcacccaggctgaagtacagtggcacaatcatggctcacagcagcctcgaacccctcagattcaagtgattctcccacctcaggctcccgagtagctgggactacaggtgcatgcctccacacccagctaatttttgtatttttcatagagacagggtctcactatgttgcccaggctgatcttgaactcctggcttcaagcaatctgcctgcctcagcctcccaaagtgttgggattacaggcgtgagcccctgcatctggccttatttttaatttgcatttgtccttacaacagataataagtagtggagttaggatttaagatagtctagctttaatttttttttttttttgagacagagtcttgctctgtcacccaggctggacgcagtggcatgatctcacctccacctcctgggttcaagcaattctcctgcctctcagcctcccgaatagctgggaccacatgcacgtgccaccatacctggccaacttttgtatttttagtagagacggggtttcaccatgttggccaggatggtctcgaactcctgacctcaagtgttccacccatcttggcctcccaaagtgctgggattacagacatgagccaccactcccagccactttaaagcctttttaagaatcctatactatgccatctttgtaagcttcctacttggaagccattgaacagaggcaatatactgaggaaattaatatattcactcaacacttacttaatgagcacctactatgtaccaggcactttgctagttattaaggatataattatgaataaaacagacaacagttttgccctcatggaacttagggtctaggtggagagactcatattaaacaaatagttcttcaaggttatcaaacaaaattatgaaaactgagaagaatgaaaagtataaagagttttgagagcatattaaagagagaatgtcaactagtccaggtggtcttgagggctatttaagttcaaaataggagttttgatgaagaagaaaggaagataacaaaaggataatttgaggtataaaggaaaacaaaaaaaatctcaggacccctaaacttcttattgcaaaagaggttaagctgcgaggctgagttaggcaacaccctcttccaaatgaacagctgttactaacatgcatcagccagatccccatggaaagataaaaggcctcaagcatctatgaagggctgcccccacacatcattcataagttctttgccggtctcctataaacaaggacatgccaatttaacttaaggtcttcctaaaattaaagtctgttcagttccacactgatagtgtagtacaagtttatcttcccaggtgcagaacaaagacaagactcatttctccacctagccagtgatgcctgcataactgaatcttcctttactccctttttctcttcaaaccttcaccttatcttatgtaaaatgtagattgaccaggcactaaccaaagtcccccgggaatgtaaccattcgcccgacctcctacctgcccctcttcctacactccttcccaactttaagaaaatgtataaatacgaaaactcttgagagtctctttggaaaaaacagccacagatgtgtctgtggcttgtgtttttcccagacgtgcttaaagctggcttaataaaccttgatgattgagatttgtgcctcattttggttgtcccagctttggggtattagattgggaggaataggattaaaaagtaggaatgctaccaggcacagtgactcgtgcctgtaatcccagcactttgggaggctgaggcaggcagatcatgaggtcaggagtttgagaccagcctgaccaacatggtaaaaccctgtctctactaaaaatacaaaaattagccaggtgtggtggtgtgtgcctgtagtcccagctactggggaggccgaggcaggataatcgcttgaacctgggaggtggaggttgcagtgagctgagatcataccaccgcactccagcctgggtgacagagcaagactccatcaaaaaaaaaaaaaaaaacaaaaaagtaatgccacactttgaacacttattctgccggactgaaataatatcatttgatagcacacatagaggtggaaaaggaatgatccttttcctccccatcataaagcatcatggctgatgccccagtttgggtgctcagaaacagatgccccaaaatatgagactcccccatctcaaaaaaacaaagttgggcactgttgattaatattttaaatgcttactcattatttttctagtttattcctttaatattttatttcattttttatttacacaagtagttcatagatatacaatttacacaaggtgctacagattgaatgtttgtgcccccctccattcatatgttgaaatcctagcccacaaggtgatggcattaggaggtggggcatttgggaggtgaataggtcatgagggtggagccctcatgaataagattagtgtccctataaaagaggccaggagaaatccttcaccccttccatcatgtgaggacacagtgagaagacatccatctttgaaacaggaagaatgcatttcacagacattgaatctactgataatgttgatcttggattacccagccttcagaactgtgaagaataaatttctgttatttataagactcagtgcccttataaaaagtccccacagggacaaagacaatagtgttctttatttatttagtagagacagggtctcactatgttgcctaggctggtcttgaactcctggcttcaagagatcctcctgccttggcctcccaaaatgctaagattacaggcacgagccacaccttgccaacagtgatatattttatcttacttttttccccactctattcaggaacttctctgtgattccagatgttcaaagtatttcatcacagctttatttgtcttaaatccagatgtctttcgttaaatgaaaaaatgagcaaccaccaacaagctgagattatcttcttccaatgagcaatgagtcagaactgggctggactttcagtgatccttttaattttattttgtttaaatgctattgggagtaaacccatgaatgcactgtgaccccagaaaggcatgaagggcaggagaggaagaattagctatgagcaaatggggaaggcaggcagtgagctgctttgcattaaaattctaaaagttggttgtggcaggggacaagtgcccggagagaaagagaatgtaagggaagtgagccaaataataatttctctcaaacctagcaaaaatttgactgagatttatgagagtttaaagccctccctctatgcttactccatgtctctttatataatttttttttctttttggtttatgtcccccttcccccttggatttaagctaaatttagactttctttaggattaaaacaagcttaataaaagttcttggagcaggatttttggagtgagagtttaaaggattaattcacctgtcacgtgactgctatatagaggaggatcacagaaatgtaatcacgagtttgcatttattattgtcaaaccaggaagaccccttgcctgaaccgttatataatactttctaaactataattttcaaaaagggacatttatgactcttgccaaatataaaatatagacatgtcacacatttccttttttttcctttaactcattaattaatcagagaactattaagatactgaaaacagttcagaccaggtgcaatgacttacgcctgtaatcccaacactttgggaggccgaggtgggcagatcacttgaggtcaggagtttgagaccagcctgaccaacatggtaaaaccctgtatcccatctctattaaaaatacaaaaattagctgagcagggtggcacttgcctgtagtcccagctacttaggaggctgaggcaggagaagcacttgagcctgggaggcggaagttgcagtgagccaagatcacaccactgtactacaaccagggcaacagagtgagactctgtctaaaaaaacaaaaaacaaacaaacaaaaaaacccaaaaaattcaaataaaaatttgaataacaggtatgtgtgtatgtaggataccaaaaatgctgaaatgaacttgttaataggtgcatactggttaatattttataggtcttaaaatgtcatgtttggggattatctcttctaaaagttagaaatcaattgcaactctaccagacaaaaatttttatttgcatttttttttcttagacagagtctcattctgtcgcccaggatggagtgcagtggtgtgatctcggctcactgcagcctctgcctcctgggttcaagcgattctcctgcctcagcctcctgaatagctgggactacaggcgcgcgccaccatgcctggctaatttgttttgtatttttagtgcagatggggtttcaccatgttggccaggatggtcttaatctcctgacttcgtgatctgcccaccttggcctcccaaagtgtatttgcatttttttttttttttttttgagacagagtatcgctctgtcacccaggctggagtgctttggtgcgatcttggctcactgcaacctccacctcccgggttcaaatgattctcctgcctcagcctcctgagcagctgggactacaggcacgtgccaccacgcccagctaatttttgtatttttagtagagacggggtttcaccaggttgaccaagatggtctcgatctcttgacttcgtgatccgcccacctcggccttccaaagtgctgggattacaggtgtgagccaccacacccggccatgtgtatttgcatttttatggaaaaaatattttgtattactacagaaaagaaacatttgggttgtcaccaggttttttcaacttaactattttccctataggttgtgaaacagtctagtcgatcaaagattatttaagatacaatattttttgtgtgtaaaggaaaccaaaaacattttaccccaaaatatacttctttgacatatttcaagatggttattcagaggccctgcagacaggaatagtctagcataaactaaactaaaatcctaaacctccccaaatgactgagtgggccacctcttggccaaggggacccagagaagcctgaaaaactgaactcctggtcatgatgggatgagagtgttacaggtagttaggtctgagtggggcaggagagacctcttccctgcacccattagaaatgtcggatggttcggcaattatcacattgcctctctaatagtgataaattggctatttcctgagggtccacacctgtcaacattaaagtattaattaaaggcagaccccagggagaagaaacttcctgggcatgcacattaagagtcaaaaatggcgaagtatgatcttccgggtacacttcactgtaaacaggaagaaagcctcagatgggcatgcatacaacttcctaaaaacactgcgcatgctcacttcccaagggtaaggagggctctgcacatgctggcagccaaccctaagggaagaatcatgagaaagaggcaagcctatgaaagtcctaggatcacagttaaaacagagcactggacctctctctactcctcatgcaccctcctggatctcttccaagtgaactttcctttctttcctgttctaaggccttttaaataaacttccactcctgctctgaaacttgccttggtctctttttctgctttatgtccctcagttgaattctttcttctgaggaggcaagaattgaagttgctgcagatgcgtagggatttgctgctggtaactcagggtaactcagatctcttccaccactaacaagaggtcaggcaagcctcattatctcctccttcctttggagttcagaaacatcataacactaacaaaatggacttttttttttttttgagacggagtctcactctgttgcccaggctggagtgcagtggcatgatctcggctcattgcaaactctgcctcccgggttcacaccattctcctgcctcagcctcccaagcagcttggactacaggcacccaccaccacgcccggctgattttttgcatttttagtagagacagggtttcaccgtgttagccaggatcgtctcgatctcctgacctcgtgatccacctgcctcggcctcccaaagtgctgggattacaggcatgagccaccacacccggcccaaaatggactttaagttaatagtatcttaacttaaaatattcctttctgttgactccaaatttttagacaaaactttacttctttaaccaattgcaaattggagactctctgaacacacctatgacctataaaccctcgtgtcaagataatgccacctttttgggccaaatcagtgtctaaccatttatggattgatgactttgcctgtgacttctccttccctaaaatgtataaacagagttgtaacctcactttgagtgaggactgctcactcaaagcttcttgggtttgtgttttttcccaggccatggtcattcctattggcccagaataaacctctttaaaatattttacagactttggtttttctgttaacacctgaaaagctgccttttgtaaaggagatttgcatctgtggagaaaattgacattggtgaaatagccaggctttctccgaggctcccctcccttttcaggatctaggacagatgaaccaaaccacaggctatcaactattctttctgaaagcagctccaaaattacctgagatatttcacctgcataagatggcctttgcttgacatgcttttccgctcttcattctcccataacctgtgacaccaccttccacagagcccggagaaacttggtcccaggcccttggtctttgggctcattcattttccctcaaaatcatatttacttctatacctccccatctcccttctccccagtgaagaagatatttaaacatcaaacatctgtccctcctccgaattctttgagacaaagtctcatcctgtcacccaggctggagtgcagtggtgcgatctcagttcactgcaacctctacctcccgggatcaagtaactctcctgtctcagccacccgagtagctgggattacatgcatgcacgaccatgcctggctaatttttgtatttttagtagagacagggtttcaccatgttggccaggctggtttcgaactcctgacctcaggtaatctgcgtacctcgtcctcccaaagtactgagattacaggcgtgagctaccacgcccagcccgaattcatattttgtatgactcccatgcatgcctgtgcacacagtaatctgttatgcttttctctgtgggtggcaagccactcaggtgccgaggcaagagaccgagggcacgagctgttccagtataataaaatatataaaataagaagttatactagatataaatcttagatatgattatatatgactatcattaatcattagtttgtagcaattactctttattccaatattataataatcctcgctctacaatcataacctaggaaaaaccaggccatacagagataggagctgaggggacatagtaagaagtgaccagaagacgagtgcgagccttctgttatgcccagacagggccaccagagggctccttggtttagcagtaacgccagcatctgggaagacgcccattgctaagcggaccgtggtctagcggtagcgtcagtgtcaaggaaaaacacccactacttagcagaccaggaaagggagtctccctttccctgggagagtttagagaagactctactcctccacctcttgcggagggcctgacattagtcaggcccgcccgcagttatccggaggcctaaccgtctccctgtgatgctgtgcttcagtagtcatgctcctagtccgccttcatgttccatcctgtacacctggctctgccttttagatagcagtagcaaattagtgaaagtactaaaagtctctgataagcagaaataatggcgtaagctgtctctctctcctctctctctctctctgcctcggctgccaggcagggaagggcccccctgtccaatggacacgtgacccacatgaccttacctatcattggagatggctcacactccttaccctgcccctttatcttgtatccaataaatatcagtacagcctggcattcggggccactaccggtctctgcgtcttggtggtagtggtcccccgggcccagctgtcttttcttttatctctttgtctcatgtctttatttctacactctcttgtctccgcacatgggaagaaaacccaccgaccctgtggggctggaccctacatttctctcctgaatctgtattttgtgacagaggtgtagggaccaagggacaacttctcctttggtctctgaaggtacagtgaaaaattaactgacaaaaaccagattaacaggagaaaagacatacacatttataaatatgcatggagggaacaatcatagcatgattaccccatcacacaatgaggtacggatggttatacagtttttcttaggggaagggagatggataattttaggggaatagcaaataatttttaggggaattcaatgaacttgaagaacatacaatggtctgagatgaagtttgttgggtttgcagagcagacaatggcttgtgactaaagtctatccaattgtgttgacaggctttggtgtttcagctaacgttgcccaggctggtctcaaactcctggcctcaaataatcctctttggcttcccaaggtactggaattataggcaccaatgcacctggccagtgaccaactttaacagttagcatttgaactttggtagttagtactagaatgttaaatatcttaaagtgatttttctccaaaatttgaacttgatatcatctctatagtttaaaatccttcaaatagcttctcatagtatttcagatgagtaatacaatgttttaactgagtcagcctatttttctagctttatcttccaaccattgcccttgttcacaatttgaggagtggaaagatggggaaggggagggcaaagatgcgtcaatagtaggttgcatcactgcactgttccctcctctccctcctcctcggatagcatctaaaacaggtaagtatcagcatatcgactggaactctccaaattctacctctactcctttcaggaaagagacgttctccgcacacatatcagctctggagcttcttgttatgtgggatgattttagggggaaaagtgagtcctacttttccagggtttttttttttttttttttctctttaggggaagcttagtccattgtgtgagtctatagttattgggtaaactcaaatatccagatttatgtcaaatttccatatatattaaatggaaaaagtgcctcaaaatgttaccatactcaagctgtcctaattcctaacattgaaataaatcttatttttaaaaggtaatcctgttttaagtaaaatggatttcactttggacacaccttagtgtaaattcattgattcattaacaagccccagttacattcctaagaccacacggctttgtttctgcttccacctagttcccacacacaaggcaatcatcacaactcttattgtacccactaattttcaatggaagccaggagtggaagccaaagacacttctctccactgctcccacggagacataccatatgggcgtgtgtgtgacatgggtgattcaaaaaactgctgtgcccccaatctgatatgctttgccagaaaatgggtcccatttttataaatttctatttatgtgaataaaacctgagagaggggcacatggaattggggaatctgtgggttggggttggtgagaagatggggaaagggctttaacacagggtgttgctcaaatacattaagcctggacaggacatcgaagtaagggggattgatgaacgctggcacctgggaaaggagaggcacttagagagggtggtgcctgcagagagaaggcttttgcagaacatccaacattaactcagtccacttcacactttaaataagagccagtgttattcactcccaggggtgttcttagtctgaagagagcagttctgtgaacatagatgagggagaaaaagaaaaaaaccctgtatcttcctacattggaaaagggaggtccacaagctttaccaaagggaccagtggctcaaaagatagtttaagaatccctgagtcttagcgattttctcattattatgtacttacaatactatttttttcttatcaacaatctctctagagactttttcaatttattcttttaataacactttatatttttgtggctctctgtatatgtcttttgatatacttcttacaaagtctgttctggtttatagggactttgaaagaatgggctacctggagaaaaatatccgcagactaaggtacagctaaggacaagagccctaatttcagtttagaacattgtgatggacttgttgagagcatttatggtgcattcaaaatctgcaaaaaggccaggtgcagcggctcatgcctgtaatctgagtactttgggaggccaaggtgggaggattgcatgaggccaggaatttgagaccagcctgggcaacatagtgagaccatttctagaaaaaaaagaaaagaaagaaagaaggaaagaaagaatgaatctgcaaaatattttaccaacacacccaccagttttgcccaaatgccagagaagaaagaaaaagaaaagatgaaggcattataaacacgacggtgtgcagcattgctatcatttatctcaggctgctcaatactagcctcaattcatcttctcccaggaaggaatgtttgtaaattgcatcagaatggttctggactatcaggaatgctgggcggcctggacacctggaagcagttagagaagctctcatttgcaatgtcttgttggtttcttattcttgaatatattagccaagggggaaaatgcccagacatttgtgctcacagcagtacgtgatcacatctctttttgcatgaagtattttaagagggaagtgatttctttaagtgcctgattatatgaaagttgtgtatctgtcatcaagaggtcataactgagtgttgggttaactttctgctgcagttatttttaagcatttctactcgatattcttccagttgtgtagtttcacattttaatggaaacaacacagctcaaaacacatcaagaatattttaggccgggcgcggtggctcacgcttgtaatcccagcactttgggaggccgaggcaggcggatcctgaggtcaggagatcgagaccatcctggctaacacggtgaaaccctgtctctaataaaaaagtacaaaaaattagccgggtgtggtggtgggcacctgtagtcccagctgctcaggaggctgaggcaggagaatggcgtgaacccgggaggtggagcttgcggtgagccaagatcgtgccactgcactctagcctgggcaacagtgcaagactcggtctcaaaaaaaaaaaaaaaagaatattttagtgattagagagcaagtttagattatatttgtctatgcattttggaaatggtagaaaaaatgtttattctctgcaagactatttcatactctgtcaagaatgttcaagaaaaaaacagttttctttcgtttctaaataatcaaataattactgttcacttattttcttgtctaacgtaaaatatataaactggggtaaaaaatgtcagtgcaaaaggcttttagattgtctatcattttttaagttttcctaaacctttttatatcaaattaatacatatcctaagatataaattttacttgataatataagaaattttctttattgttcagattacttagtttattgctatctttatttattggcagatggctaaaatttgagaaatgtttaagaatttaaaacacctgtagatgagacatgattaaatttaactcctttaggctaagagaagcctattttctagattacctttccaaatacacttccccaggatcctagaacacaacttagtgacatttcagagagttaacaggaacattgagtaacattgttagaagtgtaaaaatcaatcaagaaatcactcactttgggttgtcaggttcaaaagatacgtgagttcagccaaagcctacttgtaagaagccagtagattgctctcttgcgagaagcatatgattcttttccaagaaaagttgaaatggtgtattaaattgctttattttttatttaaagtagatctcctccattaaggctcctttgagtaacattctaaaagtgaaaagaaagctttgtatcggagactattcttattaaaaagagtaatataaatattatatcccaaaattctagggttactgggatggggtggagataaggcctaggatatggaggcagttttcactggttacaactaatcaggctgggcttggtgattctgttgggcaattttgttttatgtatttttatagaccagaactaaacattttaggaggaggaggaggaagaagagaagataggagaatatcattagacaagcccagccacctaggtcaacatacaaactaattagagtagccaacttcctcaatcctacgctgtctttcaaaaagcattaaaatcttctcccccatccactcccatgaaaatattttgtcacctggtgaagcttccacatttttcagtgagaatctcctaaatgaagaagataaagtatttttttcagtcacttccagacgagaggattttattcagttttcttttctctttctttctttctcttttcttttttttttttttttttcccagggtctccctctgttgcccaggctggagtgcagtggtgcaatcatggctcactgcagcctcgacctcccaggctcaaatgatcctcccacctcagcctcccaagtagaggggactataggtgcatgccaccatgcctggctgatttttgtattttttttttttttgtagagacagggtttcaccatgttgcccaggcttttattttctgtggtttacatttcaaaaatgatagggtttgtaggggtggggaaggtgttttttaaatataaaatacatttttcaaaatcccctcccccccaccacataaaacaagataaaagacaagcatctctctactaactgactttagaacctgacatttccacattagttcaatctttggattaaggcaacaaagggatcctgtttcaatgtaattctactggtacttttatagatgtttatcagattggtccaaatgcctagtacggttcacatttgaaaagaaaaccaaggtacaactcaggtagggctgcttggtgagggctaccttagataaggcaccactgagagggtcccaggcaactatggaaagacgactggggagtccccaaagaggggtggcttgtgccttgttttcttttatagctttgacatttgtgtagtgccttgaaggactgagttatatgtgacagacttttctgcttttccctggaggctccaaaatagtcatctgagacggagtaaatggaaccagctgatatggatttataactcattacaaatctggcctgctactttttgcattattggatgtgtttcactaggtctgttttctggcagatgtctggcatgaaaggctgacttccatttttgccagcgttatttcctgccttcctttcgactacaggacttacaaacatctggcagagaaaaggcaaacacagttatgagtcacaatgtagaaagtcaacagtaggcccaactcatattcttgtgtatcctactttgtgtaataaggcgcattcaaaattctaaaaacccacactattttaaatcaaataatattctgccattgacttttggttttttaagatatatggtcctatacaacataaatcttgaagatttatgttcaaaacattatgaagatctatatatttaatagaaaaattaaactttataataaaataacagcaacaaaaggttaaaaatattttaaaaaacacaattgctataccaaatgaaaaagtggctattgtcagcgaagaataggaaagaacacatgttttttaaatgttctcaaagaacaatttttctcaatgtacaatttattgtcccagtttatttaaatattggcttttttcttatcttatcttatcttttcttttcttttttgagacgaagtcttggtcttgtcccccaggctgaagttcaatggcgcgatcttggctcactgcaacctccgcctcctgggttcaagcaattctccagcctcagcctcccgagtagttgggattataggcacctgccaccacgcccagctaatttttgtatttttaatagagatgaggtttcaccatgttggccaggctggtcttgaactcctgacgtcaggtgatccgcctgcctcggcctcctgaagtgctgggattacaggcgtaagccaccgcgcctggcctatggttggcttttttctaggcatctttaaactaaatttaataatggctgacaatagcacaaaaactccaaacccaaccaaacaacagacagacagactccacccccatttgagaatttgctctactgcaaagcactatgctaagagatctagacagattgttctgttttatccttacaacaatttactattattattgctggtgaaaatgtagaagacatacagaggtatgaatttgaagtactaatgagtcattctgcagtatttctcagtgaatattgctcagaccacctacaccagaatcatctgagacccttgttagatattcattttcttgggtccccaacactcagaaattctaattcagaggtttgaggtaggaatctggaatttacttaagaagcactttgagtgattctgatacacaataaagtttgagatcacttgtgaatattcattgttaatattaattgtatacttttttttttaaacggagccttgctctgtcatgcaggctgaagtgcagtggcacgatctcggctcactgcaacctccttctcccaggttcaagcaattctcctgccttagcctcccaagtagctgggattacaggcgtgtgccaccatacccagctaatttttgtatttttaatagagacggggttttgccatgttggctgggctggtctcgaactcctgacctcaggtgattcacccaccttggccccccaaagtgctgggattacaggcatgagccaccacactcggctaatgtatacatattttaacatagaaaagtataagtaaaatggcccatgcttcccctcttggcataaaaataaaaatgtgtattagacaattaaagtaaaacaaaaagttagaggtaaaggctccccctttgccacgcccttcatcctaacacacacacacacacacacacacacacacacacaaaatctccctcacccctaaataactgtgattaagtttcttgttaccccctaggaaaatgttagcatttacgtagatatactttgtatcaagtgaatcatactatgtttactgttgtgcatcttaaaacttactacatatgactcaagatctgtctatgtaggacatataaaaccctaactcattcatttaaactgctgcataatatttcattaaatctacgtactaaaatttaattatttcttactttcagtttttttttactattataaacagtgtttccatgaatatttatatagagctatagatatctctcttggttgtgctatcgctttaaaagtgtaaattgggtattataattacctaaatagagacatctatgtttactagaagcctagagccttcatttaaacttatttctgcaagaatggaaagaaaatttcttaccaaagttcatattaaagcagctaattagtgttttatttgagttggcttaattgtagaaacacagagaaccctatcatttatgaatttaagaggactacaaatgcaaaagaatgaataaaattaattggaataaggcaaaacggaagaaaatggagcaaatgtagcaaaactctaagagaaaaaggattagagaagattcagaaagtaaaatttaactgagaaagaggattattagaaggaagactataaaagcaactgtattaattcattttcatgctgctgataaagacatacccaagattgggcaatttacaaaagagaaaggtttcatggacttacagttcctcatggctggggaggcctcacaatcatggcagaaggcaaggaggagcaagtcacatcttacatggatggcagtaggcagagggagagcttgtgtgggggaattcccacttataaaatcatcagatctcagccaggcatggtggctcacgcctgtaatcccagcactttgagaggccgaggtgggcggatcatgaggtcaagagatcaagaccatcctgaccaacatggtgaaacctcgcctctactaaaaatacaaaaattagctgggtgtggtggctcacacctgtagtcccagctacttgggaggctgaggcaggagaatcacttgaaccttgggaggcggaggttgcagtgagccgagatcacaccactgcattgcatcctgggcaacagagcgagattccatctcaaaaaaaaaaaaaaaaaaaaacccatcagatctcaggagactttattcagtatcatgagaacagcaagggaaagacctgcccccaggattcaactacttcccactgggtccctcccacaacacatgggaattcaagatgagatctgggtggggacacagccaaactatatctgcaacacagtaatctgcagtgattatttcaaacataccaaagttattcagtgtatgcatttgttcatgcactaatttactcaatgaatatttatcattcggcactgtgctaagtttgaggatatagggaaggaaagacatatttcctaccggcaacgagcttactgttcatggaaatacagatgcaaaaaaaaaaaaaaaaatcaattgcttttaaaaagcagaaaaatagtgttcctgacaaagtctaagatgttttcaaagaagaggtttccaagttgcatctaaggtagaagtaacatgtgctgcgtcattgaggaatataagagcagagtgggttagaaacccacatgtagttcgtgttgccacagtggaaagcataaggtgagaactgcagcagtgagaggtgatgtcgctaaacaggagctgatgctagatagggacacagggccagatcctgaaaggtttcgtttgcatgctagaaaactgagatttttatcctgtgagcaatagggagcagccaagaattttgaatataaatttaacataatcagattcacgttgtaaaaagccctctggagactgggtggagttgaaataatctaggtcacagataatgagaacgtggtgatctccagtagttatggggctaggccaggaaatgagaggactcctaacaggcagactcacagcgtcttggccattgattggatggtgaagggaggtgggggaaataatttatgacattgccaacactggggaaatggatgtctgatagtatcattctttgaagtaggaattaatgaaaggggagcagatctttccaaaatctcttttagatgttctccaccatatcagaggcaacactcttacacacacaaaaaatcatcactttcccttgactaatctgaaaatttataggtaatataacctacttatatacatatttaaaaaactttaatacaatagctcaacagtaagataaagtataaataaaaggaaagtaattgaggacaaaatatattaatacataaatgttcaggcatgactacataaaggcataatgaagaagtcagatgtgtttgcctatatgtgaagtcattgttagtgtcccaaccacaggtgcaaatcaacacacctctgtaatgcatgtcataaagtcttggaaaagagctgtgttagttcattcttgtgttgcaataaagaaatacctgagaccgggtaatttataaagacaagaggtttattttggctaacagttctgcagcctttacaggaagcatggtgctggcatctgcttttggtgagggcctcgggaaccttccactcatggtggaaggcaaaggaaagctggcatgtcacatgtggagagagggaggaagagagagaagagggaggtcctagactcctttaaagaaccagatctcacatgaattaactgagtgagaattcactcatcacccagggaatggtactaagacattcatgagtgatttacccctatgatccaatacttcccaccaggtcccacttccaacactgaggatgaaatttcaacatgagatttggaggggacaaacatccaaaccatatcaagagcttgtcttggttgcagtattggagaaggctccataacactgttgacatttcagcttggcgtttcaagaaggaatataattttgaaaggcagaactagaggaagaagaaaggggtgttcccaatacagagaacagtacaaatggggagagaaaaaggaaaatactgggtgttctttggctttggctttggctacggcagaggttgcgtgtagctggtgtacgaagctggagagatgtgttcccgctagtacagggagggcttcgaaagtgtaccaatgagtttagactctaataatcccacgtgacctcttgctttggtaggttgtttgcattcatcatcatcaagaataattctattttcccatatatattgaactgattatctttaatctttccctgaccaaattatctcaaattctaaagtgatgacatacaaattaatgatattttgttttctaaattgataatgctgctttaaagagagtttgaaggtaatgactacatataaaaatagatttcatataaagtcaggcttgaaaggatcaaataaagtatttggtgctttttcttctggataataatctgtgaagaggacatttattatctctgctggtagtgatatcagagggagagtaaaaagcatgtagatgatagtgccaggctgagagaagagaatagattccactggacaacttcctaagggaaggtgcatgttaacattctatcatttaaatcacagaagttttcttttgaaagtataaagatgtattatataataatatttaacaatcctaagaggtttgttaattatccttgctgaaagacaacagagataagtttcgctcaagcaatattcttctgagaaaaatggacctctgtctctccctttcttattttgttttattttagcctgaagtgtcccattacgttttcaatgccttatatctaccttctcttcaactgtccatttggctaagaattcagcccacaggaatcaggaataggacatttaaaactacttcacgcattttaaatcttataaataattgagatacagttgatggttgctaggctgcagttgaattccatttcatcctatcccattataatgtaatttaggtttgtttagttgttgttttttttgcttctttttaatcctatagggaaaagtttttgatgattgaatgctgtatttgatagtacctattatcaggcaaggactttgagatatttcataccgtttcttttcatatcttcaaataaaagaatgtgtgaagttcccatgctagccacaccacggacaacgttaaggagaatgaaaatgagcagggcctgaaagttgctttctttggtcccaaagtgactcttctggacacccagaggtaagggcactaaactaagttacatcagtttatcaggtggaaatcaacaacaggtgaattaaacgtcaacagtgaaacaccattgcatcttgttctttagcccaggaactccagaaggattccatcttcagagggcaactctgattggtggttacgtgtctaaagcaggagtctgcaatccacagcaggcaactacagactaaagtctttggatcatatccagccagtcacttgttctataaacaaaactttattggaacacagccatggtcattcattccatattgtttatggccgttcttcccctgtaacagcacagttgggtagttgcaacaaagattgtgtggttttcaaagcctaaaatgtttactatctgactttttatattaagtgtttgctgtgaccccaggtctaaaatattaggttatacaggctgctgaggccccaactaatctcagaaaaaacacatgctatgattgatttttcttctgtttgccatgttcatggaggaggagtgccatgtatttatcagccctgctttttccccttccccaagtaagagctgcatgatggaacatagagatgtaaaagaatagatacagcatcaaaactaggaatgagtagacattgaatagtatttcaaaagagttggtggcagctatttgggaggctgaggcagaagtattacatgagcccaggagtttgggtctgcagtgaatcatgtcacactactgccctccagcctaggtggcagagagacagatcctgtctctaaaaaaaaaaaagaaaaaataaaagagttggtagcaaggatgcaggaagtgatgtcagggaaaagtgatgaattgtcactgggaatcattgaaaagctgtaaaaccaaacctatcattacaaatataagcatattaagtttagttttctgttctatggattgaattatatttattgggaatataaaaaattcggaagaaaactctatgactttaataaagggaaggaaagaaggcatagtggtaggaaagagctcaccttacctttaaaaagagtggctctctctttctctgtatcatctttcacatccatacacatatagtcacacattcaatccttctcattacacaaagctgtggatatcctgggaataatgacacttatttgcattgagatattggagccagaactggaatatatctagttatctagttatttgtttgaagtgagcttaaatacagtacttgtgaatgggaaaagggaatattttcatgactctgtagatcctacaggcatattcctatacctcagaaagtcagaatagaacctaagaaaagacaatctaaaagtgtcttaatatttttagaatatggcgttagggatgcttgttagttgaaatgcaaaaatctcaacttgtggaaagatacaaatgatccatcgattagaaaattaacaaaataagagcagttgggaagtcagcaatacgccttgaggaggaatccggctaaataaatttaatttctttctttggcaccctgacaaagaggaagcaatagatataatatctccagacttcagtaaggcttttgaaccatttcacatgacatttcttttcaacaagctggtaatacatagcttggatcatagtgctgtcaagtggctgaagagttgcaatcaaagagtagctatcagtgacttcttgtcatcctgagaacatttatcagggggtgtccatccataagggctggttgtgggccagagttatccacagggtgatgaaagtaagagcaagttcaataaatttgctgataacaccaatctggagcagctgcttacacctggcaagatgggaacagctttcaatgaccttgtttaagctgggctggtagagtgagacgatctcagagccaggatacctggccaagacacagtgggcagattttctatgcaggaagacttatggcatgttgcagtaaaactgggcagtgttttatttctaaaattttctgaagcactataattaattaacaattctctatgatgccaagtggtttagaattacttttattatactagtttcccaatttgcaaagtagagactcaaaaatcttgtctcataatattattttgaatgttaaataatctctggaaagtacctaacagatattgagtgctgaatgttagtttccttcctcttccctattttcccaccctgttctagtgggaccagcactgggaagaaaaagccctaactacaatacagaaattcaaaagaaaaaaagagacaaaaacaaaacaaaagaaacaaaaacattggcattgaaccttaaaccacactctggcatacctaaatattactgcttaattaataacagtttaaccgtcaagtagaatacgtttgaaaggatatttcaaatttatactagtggttataagattttctagaagttcaccttcagcaattatggaaggtggagaattattgctttttttacatggtagatcctaaaaaaggttagttcctgcatgatgggcactcaatagctacttgttttattgccctgtgtgttgtcagagaaatgtattaaaagtatcagcacttgataataactctaaagcaggtgctcttaactcccttgggaatttgatattccttgagaacaagaaacaaaagccagtgcaacatttagatcacagttttactcacaggtccttatctaagtctaggtagagaaaggcaagataagtcttaagttgttttcccattagtaaatgtgactggacagaccctggtacttggagcaggagagtgacaggttaagtaatgggaaagctggctgaggttcatggtcaatgtcttgcaaaaataaactaaaagatatcttagttgtaaataccttctgcccaaacaagatgatgtgaaaaggatcctgctccaaattccttaaactcaactgaggaaaatagagagccacagtcagagaacaaagtttctagcctattaacgctctctcccttcatcctcacgctcagcttattgcttttattacactgaaacccattgactaatcaaaagggagcttccaggctgggcgtggtggctcacgcctgtaatcccagcactttgggagaccaaggcgggtggatcacttgagctcagaagctggagaccagcctggccaacatggtgaaaccccctctctactaaaaacacaaaaattggccaggtatggtggcacgtgcctatggtccccaagatggagtttcgctctatcacccaggctgtagtgcaatcttggctcactgcaaactccacctccccatttcaagtgattctcctgcctcagcgtctggagtcactgggattacaggtgcctgccaccaggcctggctaatttttgtatttttagtagagatggggttttgccatattggccaggctggtctcaaactcctggcctccagtgatccacctgcttcagcctcccaaagaactgagggccaccatgtggggcctgagtttcctatatttttgtctacatttcctcttgtctgtgtcactctttaatgtactgtaattagtctttttttccctctgctatactcagactcctattagcaagatactaacaacctccacatggataacaccaatgattaattctcagtccttgttctaattcacctgcccatagatcacttccccttatttgaagcacttccttcttttttcctcctagaccccattttctcactggcagctcctcctcagtcttctttgcttgatgcttctcttcttgacctctaaacattggtacatcctaagattgtcctcagacgtctccttttcaatctctatgattaccctctgggggattttatccagtctcatgattttataaaccacctactcactgacaatttccaaatacatattatcagctcagatctcactcctgaattccatacctctctatctaactgccttcttaatatatccatttagatgtctaagtgacatgcaacataacatgtccagaactagatccttggcccatacccctaattgttctttcccagaattttccatctcaataaagtcaacttcattcttctagttgttcatgtcaaaaaacatggagttggcctggcgtggtggctcacgcctgcaatcctagcactttgggaggccgacgtgggtggatcatgaggtcaggagatcgagaccaccctggctgacacggtgaaaccccgtctctactaaaaataccaaaaacaaaaaaaattgccaggagtggtggcaggtgcctgtagtcccagctactcaggaggctgaggcaggagaatggcgtgaacctgggaggcggagcttgcagtgagccgagatcgcgccactgcactccagcctgggtgacagagcgagactctgtctcaaaaaaaaaaaaaaaaaaaaaagcatggagtcacccttgacttctctattttcagccatgtcggctctacctttgaaacatatccagcctgactactcccactatcatcatttcctggtagaattttgcagtagtcttccaccagtttctctctctaacccccgcaccaacctctccccagccctaacacacatactctagtttccagagtagcctaaggaaacctactaaaacttaagttaaattatgtaaagtttctgctcaaaacactccattttctttccatctcattcagaacaaaattctgtcttttccctgatgcacaaggccctgatccacacagcccagttctgggaacttatctctggcttcatctcgtaccactctctctcattctggtgtctccattctggtgtctccattcagaatggtgtctctcattctggtgccctccttgtattcctctaacatcctgtacacacttctgcctcaaaacccttgcccttgctactctgagtgtctggaactcttttcattcatcaatctgcatgacttcacttcatttaggtccctgctcagatgttacatactccaaacaccctacataaaattgctcagatctacgtcatctcatcattctccatcctaaggtagggtaactgctttagttttattcttagcacttatcaccatctgactaacatacgtttatttgcttgttgtctatcttcttccactaggatataaacttcatgaaagcagggatcgttgtctcttttattcactttatcatgtcagcacttattgaacagaataggtattcaaaaaattttttttggatatggaaggttgcataagtgctgcctattgcaactgcttagagctacaacctttgcttctggagactgagctggaactagtattacttgaattactttaaaataaatccaaaacacccaaatttatatctggaataatacagaatgaatgtgcaaagtaagtataaattcttgaccaagactttttttgtggatatgacttccaaagaacaaaaccaacaggatgtgtgtatgtatagagagatttattttaaggaattggttcatgaaattgtagaggcttgctgagtctgaaatctgcagtacagactggccagctggtgacttagaaaagggttacaatttgaatccaaaggcagtctctggcggaattcctttttgctcagggggtggtcagtctttattctcttaaggcttacaactgattacatgaggccctctcacactatggagagcaactacttcactcaaagtccaccgattgaaatgttaatctcatccaaaaaacacatccagagtaatgtttgatcaaatatctgggcaccatagctcaacaaagttgacacataaaatgagctattacatgtaggttgttacaaatatgtattttggatttgcctgacttgtctccttatttatctataagttccttgggtacactggtttgcaggagagtaggtgatcagtaaatatgtgacatattttcatatagcaagatcaagggaatataacgcatgataaccaaaaattattctcaccactaaaggtctccattatattttaaaaaatgctaaattgctcagttacttaattttctaaagtgggtcatatttgattatttataccctttaaataagctaggagatgagtatggaaggtcttccaataacacttttactggaggttgcctaacagaatttggggacttgcattggcaatggcctacaacattgatgttataaatgaattttcttggcaggggggaacatacaaagctataagtattgggcaaaagtctcaagcctcacagaaagtctacacagagtcttctacaaagagtcttgtgatcatggctgtattagtccgttttcatgctgctgataaagacataactgagactgggcaatttacaaaagaaagaggtttattggactcacagttccatgtggctggggaggtctcacaatcatagtagaaggtgaaagtcatgtctcacatatcagcagacaagagaagagagcttatgcagagaaacatcccattttaaaaccatcagatctcatgagactcattcactatcacgagaacagagcaggaaagacccacccccataattcaatcccctcccacctggctcctcccatggcatgaggaaattgtgggaattacaattcaagatgagatttgggtggagacacagccaaaccatatcaatggcaaaccatgaaagtttagcaactgttctgatcaataatacaaacatataggtttggagatcattgaaaaatatgtaaattcccataataaaaggaaatatgggatatatgtatttatttatatatgtgtctgtgtgtgtgggacatgtgcctttctattttattgaaaactgtgctcttgaatagtgaactttgatgccacatagtattttgcagctaatccctaaaaggtaagatgtcataggctagggtaatggtttatagtcacttatgtgccaacatagatttggaagccaataaatgcctggcagtaaatgactaactaaataaaaaattttaaaaccctcatgtgggaaaatctaatgccagcattttcccagcagttgatacagagtttccacaatggctgtcttttatcaaggaaaaagttgatactaaatattctgttttagtgtagattccacaagaactgtagaaatatggggtgaggaaaataccagcaataagaacatgattatcctaaaagactgacaccagtagctttaattttatatttctacttttcacttagatctctgataaattgtaaatcagatatcagctgaggtcaccctgtcctttcagatttaaatacagttggcttcagtctctttgtcttctgtcctgtgggatgcataatgctctccctgatattttcatgaagtttttcgagctcatgtttctatggacatatctgctcagagtctcccttctggtgacctcttagttcactttcatctgatgtcctggacaggattctctagagagacagaactaataggatatatacagatatttgagacatgatttgttagataaattggctcacacaactgtggagactgagaagttccatgatatactatctgcaatctggagaaccagggaagctggtaacatggctgagttcaagtctgaaggcctcagaaaccaggaaagccaatgatggaacctcctgtctgaggccagaagcctgagaatatggggactgctggtataagttctggaatccaaaggctagagaacctggagttctgatgtctaagggcaggagaagaagagtgtcccagctccaaaagagagacagaattcaatttctgttgcctttttgttctatccaggccctcagctgattggatggtacctgcccatactggatgaaagcagaacttccttacttagtccactgattcaaatgctaatctattccagagacaccctcacagacatgcccagaaataatgctttcttagctctctgggcatccctcaatccgaacaagttgacaactaaaattaaccctcacacccccaacccttaccactgctcttgtcttttctcagccgtgtgctgacccagacaaaatggactatagtcccctttccttctggggaaaatcatgcagataaagcatttgggtgtgtagcagattttataaaagatgtggggaaacagagtggttaaatcacagcaaggcaaacaacttaaatatacatggctggagccgtctgtcgtagctctttttcctttaggatccctcacccatggcgtggctcctttcccttctctgctttaactcaccaccaaattcctattatttcttataaagagtggtcttcttacggattataccctctgggcctcatcttccctctgaaagggatctttcaaagtatagacttaagccagtgacagcaacactgtcagctgttaaaatggtgttttcatctggtatctgaaaagtacattggaagtttctattccaaatctctctctctctctctgtctctctctcactctctgtttctttctctctcaacatggatcttcatgtaccaaaatactgaaatattttctgtaggttttttttttttgtttttttgttttgtttttgtttttttttttttttttgcatttcatcttttccctgataccataagcatccacttttgaagactgtccttttaaaaattctaccattggctgggtgtggtgcctcacgcctataatcctggcactttgggaggctgaagtgggaggattacttgaggccagaaatttgagaccagcttgggcaacatagtgaggacttgtctctactaaaaataaaaataaaaatattagctgggtgtgatggtgtgcacctgaagtcccagctactcaggagagtgaggcaggaggatcccttgatcttgggaggttgaggctgcagtgagccactatcatgccactgactccagcctgggcaacagtgagaccctgtttaaaaaaaaaaaaatataccataatatttttatgcatttaaatggatcattgtgtaggttatttgtaataagaagcaattagtgtgtctaagtagatttatagatagacttatatttccaaaatattccaaaatattgttaaaaatgttctgcttacattacttaaattattatatatccagaaaattagaaagtaaagtctcaggtatgttggaaaattccagaggcatcaaagtttaaattaaaggtgcttcagttggaatgtccctcagtaggtgaggactatttgggtagcttcaacaacatcactaacaattagttattggtaaacccaaagacctcaattaaatagttgtttgaaataactcttttttgttggagcaaaaagtacatttcacttggtggaacatttgtatccagatggagctatcagatctcagagaattcatttcctttattttggcaaagattcctctaagtgtttactgtgtgacaaacactgtgttaagctatacatgaattaaataatttagtcctcctcatgactccacgaggtagctatttttatctccatttcacatacgagaatactgaggtttaaggttagctaactcatccaagatcacaagatgttggcacacccaggtgtatcagatagggcctggcaagaaacagttggcacacttcaacagggtacctgaggagagtttaatgaaggaagtacttatcaaggaataagtagcatcagccaggaatggtgaaacacacaagggctagcagcaggtctccaggggcacagggaggagcacttactggaacttggaaagacctgcagccacgggagaggagataccctgcagaagctgtagtcgtctttttttgtttgtttgtttgtttgtttgagacagagtcttactctgtcacccaggctggagtgtagtggcgcgacctcggctcactgcaacctccctctcttggataccagtgattctcctgcctcagcctccagagaagataggattataggcatgcgccacccacttggctaatttttgtatttttagtagagatgggatctcgccatgttggccaggctgctctcaagctcctgatctcaagtgatccaccctccttggcttcccaaagtgttgggattacaggcatgagccactgcgcctggcagaagctgtagtcttaggtagagcaaagctgatagtgccatactatggcccaaagagaactgacagattacattgctgagcaatttctcatcacatcttttcttctcctgctagtggctcctattgaccaaactcaatgagaaggcagagggcaaagaagcctgactgatctactctgtaaaggtgagcctccctgggcagagtaggacaaagaagtttggagagtgggtctggaggagaaacagaccattcagcataccaggtgcatctgaatccagagcctaagcccttgaccaccacactatcctcttgccttggtaggtgtgttgataatttccacagaagggggatgctgtataaacatgatacagtggaaggaatactagagtaggggtcaggaaaatcaaatactgtgaagtgtggaagtgcctggcacagagtagaaacttaatcaatgtaaatccctcatcccctcccattgtgcatcatgagcttcccaacacagcccataaaatctccaagttgtaatgctgaaagaagggccacaaccttgtcaatgacgcaaaagagctttcatcagactgtgcataatttagaatgtgaatctctgagaaatgagagctgatgagagcagactttagtaatcccctaaactctcaatcatctgtgttttggtaaaacaggagcactagcagatcatattctgctgtataccacaagtctggcacacttctgtgtagtggcctgtggtgggcagaataatggcctcctaaagaggcccatatctgaatcgctggagcctgtgaatatgttaccttacacagtcaaagaaaggctacagatttgattaaggttaagggccttgagatggggcaagattatgctggtttacccatgtgaatccaatctacctacatgagtctttaaaagcagagaaccattctcagctgtagaaagccagaaatatagcagcgtggaagcagattttgaagatggagaaaggccatgagccaggaaatacaagtagcctctagaaggtggaacaggcaaggaaacagcttctgcaccagaacctctgggaaagaatgcagtcctgccaacatctttcttccacaccagtgacacctatgctggatatttgacctacagaactgtaagaaaataaatttatgtgagttttgttttttgttttgttttgttttggagacagggtttccctctgtcacccaggctggagtacagaggtgcaatcacagctcattgcagcctcaaccttcccaggctcaggtgatcctcccacctcaacctcctgaggagctgggactattggcatgcaccaccacacctggataatttttgtattttttgtagagaatgggggtctcaccgtgttgcccaggttggtcttgaactcttgagatcaagcgatcctcccaactcaacctcacaaagtgctgggattacaggccgggcacggtggctcacacctgtaatcccaggactttgggaggccgaggcgggtggatcacctgaggtcaggagtttgagatcagcctggccaacatggcgaaaccccgtctctactaaaaatacaaagagttagtcaggcatgatggcgggctcctgtaatctcagctacttaggaggctgaggcaggagaatcgctttaactcaggaggtggagattgcagtaagccgagatcacgccactgcattccagcctgggtgagagagcgggactccgtctaaaaaaaaagtgctgggattacaggcgtgagccactgcacttggccttgtgttattttaagctactgaaattgtggttacagtagcaatggaaaatgaatgcaagcctcttcatctttttgtttcagggcaagagcacctcagtatgtaaatttcttgatatatgatgactgacactgaagtgttcaacaggctccaaacatcaatctttaagcattgaatctattcaagttctagcatagaagttttttattcaattgcataccagcgttacttgagagtagactgatgcttcacattgttgttgttgtttttattttttttaaataactctgcctcttcactagaaaaaggttttgttttggatatcattaaaacagtcaggggagcatagcccttgaaaagatctcagaactagtaacctacctcctgaccgtgcctaagtagaggaaccaaaagttttttttttttttgggggggcggggggtggggacggggtttcgctcttattgcccaggctagagtgcaatggtgcaatcttggctcaccgcaacctccgcctcccaggttcaagcaattcttctgcctcagcctcccaagtagctgggattacaaacatgtgccaccatgcctggctaatttgttttttttgttttttttttctgttttttgttcttatttttaatagagacggggtttctccatgttggtcagactggtctcaaactcccaacctcaggtgatctgcccacctctgcctcccaaagttctgggattacaggcatgagccactgcacccggccccaaaagtttttgaaaaccttcacgtcaaccacagagccttcagtatactgtatgttattttgtacccaacccatggttctggtcgcacacaaaaatgtctgtgagattcctggtcaactggtattcaccatggagttcataaagggctgatgttcctcaaataccagatgagtctaagtaagtactactttatgtagccatacatgaagtggaaattgagtttaagcccaagctacctgtgcctgaggggaacaaataattagaggggtttagagaagaccaagttatgcaggtgtttactgtaattctctcattatgtatatgtgaaggtagcccttagaccctcaagtgtattgggaggtattaataataaccacaaagatggtcctgtgctatggcaaatgcagaactttcaaagtactattcagcctggagaagaaagctcatttccagatccttccttctgtttttcaagtgacatcacataggaggatgagaatttgtctttgtattaagcttcctttgtcatgtctacttcagacatgatctctgagtttgaagtcccaggattttagatgaaaagaatctttgagttaagggagggagggggccactgcatgagaatgcctgtttctaatctcagagtacccacatgctgaatggctgattagacaaaagccacagaggggaaaatcagctactctgggttaggggattcaaatttcattgtggtggacacctatttatcttttattgtagtcaatttcccaagggagaaagggcaaatgtgtccctcctatgccaacattgtagcacccccaacggagcagacctcaggagtatcctacacagaagaaaggagcagtgaaacctatgacaactgatttttctctgaaaacaatgttatgtgtatatttcatttcttcatctctccaaaaacttttgtaacaagtatgttttttgcaactgtggcaggtatactagagaccagctcctataacctaatgatcatgccaagtatttctgttatatctcttaaaaatggcttttcttctcatctcccaaaacaatttttttttttaaacacagggccttgcctgttgatgattttctcacacttttgtcaagtatacttttttttcaactcaatgtctaatatcacaaaaacctggcactttaaacttcagtttctaccaaaggtataatgctttttaaaaagaattctgcctagtgttcctccagtgtagcaattagcattctcttagcggcaaacatcaaaatatccaaataaaatggtttcagtaatagggatggttattgtctctcataacaggaaatctggagggagctgactccaggtggattgagaggttcagccacgcctgcagtcttatccatccttttgctccactatcctctatatatttgttttcaatagctctaggtatccgctccttacacaaccaagttccacttctgcatgtgtttctcctattaggaggaaagaaaactatttcccagctggttccagcagagaagtctccttttaagtcttttgccaaaataagtctctaaaccagccccaggaaagacgatgagattgccttgtttgctttagattgatcttgattagtctactgagcctgagcacgattttcttaagcatctcattcccaacaggaaagcaacaaaatcggcattctattaataagacaaagaagagaatggctcttgtgtggacaatcaacaatgtcttccacatcacagaactctttagtatgcattagaaaaacctagggtggtggttacaagagcagattccaggtgtcaaagagattttgattacagatgaggtccaggagggtgtattttcaacaagaacccagatgtcttggatctagtcatccaccagccaaagtttaagacactgccctacagaaatgagaacaaactttccttaaaaaaaaaaaaactttggccggaagtgttggctcacacctgtaatcctagcactttgggaggctgagacaggtggatcacctgaggtcgggattttgagaccggcttggtcaacatggtgaaaccccgtccctactaaaaatacaaaaataagctgggtgtggtggcgggtgtctgtaatcccagctactcaggaggctgaggcaggagaattgcttgaacccagggggcggaggttgcagtgagctgagattgcaccactgcactccagcctaggcaaaaagagtaaaacttcatctcaaaaaaaaaaaatcttgttaatacatcaataaatattcacttttagtacctggatgttactgatccacacaagtacatctactgttagaaagtaaccattcttaagcaaaacaaaggacgtctgcctgcatagggtgatcagaataatgtccaaatgcacaaatgataatgagatgatgcagataaagtgcttagcatagtagactatgaatgtgccaatggaaaattataattttttaacctgtcgagttttgttgctactagatctttgcatcattatttcctgctcaatagttgtctttgttcaaagtgtcagtttcatagaacataccactacttgaaatcttctttatttgttcttttagtctgtcatcctcactaattatcacctccacaaggaagggctatgtcttgttcatccctattgcctaattctcaagtcctgaaattttaagcatttaagcagctgttttcaaatttctaaataagacacctttccatgtagatatgatctaaactatgacatacaactaaattgtaagaaaaatgtcaaaacatggtttcttttatcaatagtttactataggaagttaagagtaaaagtgaacaatctatgatagtgaattaataatgactttaggaaaaactaatagtacccaagtaaatcttccctttgacaacttaattctgaaaattatgtatgactttgaaaaattgaataaatcagcaatttccagaaactactgacaattagtatggttgcaacttgattccccaatccagggtgtgcctaggaaataattagtagaactggcctttaggtattcttttttttttttttttgagacggagtcttgttctgttgcccaggctggagtgcagcggcgtgatctcagctcactacaaccttcacctcccaggttcaagcgattctcctgtctcagactcccgagtagctgggattataggcacacaccaccatgcctgactaggttttttgtatttttagtagagatggggtatcaccatgtcggccagtctggtctcaaactcctgacctcaggtgacccaactgcctcagcttcccaaagtgctgggattccaggcgtgagccaccacgcctggccagcctttaggtattctaatgtgcattccttctgaaaggagtttatcactatgttgaaatttctgtgttctaaacccacgttatctgataaaactttctgtaatgatgaaaatattctacatctgcactgtttagtaaagtattacccactaactgtatgtggctactaggtacttgaaatagtatgactgagaaaccgaatttttaatttagtagccacacatggctagtggcttccacattgtagagtgatgttctggacagttttttgtaagtaggcacaatgtatagcaacacgttcctagagctttaaattttgaaaatggattttcccaccatcgcttatttcctatgactccaatttcccctttttacttttattcccttgtcagtgaactgcttagctgctggctccaaagtttcactaccaagaggatgcagaagtatcatagtaggggcagtaaaaacattacatatattataaaaaagccactgtcctgggagtgaattctgagaaatgcaatggaagacaaaagggggcaggaataaaaggcaagaggtttccttgatgtgttcccctgtgatttaagaccttttttttggttttgtttttaagtcagcaaatctatcaagcactgtgccaagggctacgggcaaaaggatgggaatggatagagatgggtaaactaacaatcacatcaggaagtgaaacacagggtaagttacagaacaccgtaggaatgcaccaggcgtcaatttcctcagtctttggggaagaggagtgatgggggtaccatgaaaacaaaaagtgatatctaagctaaacctttaagtgtgatgccaattagattggatgggagagatgacagaagaagggaagagggttagggacagagagaaggaaaatacgtgctgtagaagacccgaatatgccactcccaaatatgccattttgacataaggatgattttgagctgaaggcaactgaagaaatagatataagaaatgttctctccttgctcccatttgtctaaaagcaggacgtaaacttatgaaggtaaaggtgtccctcctctcttctctaccaggaagaacaaagattgagcaccaaaggcaactttagacacttatcagccccggagaaacatgtatagcaaaattctacttatttgccttcctacaatttaccacccctagagactcaaagtccttctcctttgtcttgccacttctctaaacatttatttttctttgttgaagatgctatatgtacaaatctacataatgattatccaatctctgttttcattgggaagcaagcaggtctgccaaaaatctgttacctaaaagcatgatatagatatagaacatctggatcaattgagaacaaaacaacccaaattacaaatgtgccacataggtatgaagcagacagttttccccacttaccattagaaaccaattttctaaagctgaaccagctttagaaaaccaattttggagtttttaaaaactcatagttgcagtgtgaatactaaaagcaagtggaaagtatagattataattatagataatggttaaatttgatattaaggacttccatttgaaaacaaagttaggaatagatgtgcataataaagatgcatttagatttatttaaaaaatattttaaaaaattaggcaccatgcttgttacatttgccctaagctgaagttggcaatgagatctgtttagagaatatgctcacctcttaaaaaaaaagtggaataattttcagcatagtagtatatccccctcagaatttattatttaaaacaatatttttaaaaaatttagatttagaatattaacacttcaaaaaatcaggtgcaatgcttattatatttgccctaagcttcagttggcaatgagatctatttaaagaatatgctcacctttaaaaaaaaaaaaaaaaaagtggaataattttcagctatagtagtatatccccttcagaatttatgctacatatgtgcactacctgttttattatctctttaaatcaactcacattcttttaaacaaatgtgatttgaagctttaaatcactacggcaaattaaaaaacattattgcttgttatgaataaaagataagacataaataaatacaaatgaagactaaactatgttcttacattctagctggttaccattgttccctaaatgctgtgttaaaaagagatatcaagtaccagaaagatgtttaagacaaactgaggcttttatcttggtataatcaaaaagattaaaaagaaaacaaaattatttcctcattgtgattcaacatatacttaatgcagtttctgtggcaccacctaaaaccatcaagagtattaaacacagctgaagcataacttatctttcccacacaattgatattgcatgtcgtcttcctttagattgatgtaaaaaaaaatctgtcttatcaaaaaaatgtagttagaagataggaatgaaaaataaaatgtctgtctttgctaaatgctaaccaaggtaacatctttgggatactccccactgacctgttttgcaatatttctgcaaactatatttgtgatgtatattcattgacccactggctcatatatttgtatagcatctgccttctcttcaattgtgagttcatttccctctgcactattactttggctcaccataggctctaggtacccaagcatggaaaatcatcatagaagtggtcagcaaagtgtgagatgcaataacacccctgtaggagtatccattgacctcaaagttgagaagcagttctgcccagctagcccctctccactgctggccaatgcatcaagccagcaaccaggtacttacaacatgagaaagataggaatggtaaaaggtaatatggcaaggacaaagaccatataaggtttttgtggaggactttccttagaattggaggtcagccattatcttgcaagaaaggctgggctgctctacctgactcgtggggtgttccaccactgcactctgagcggcattaaccagggcagcaggtagcaatcacctgggggtatttaaaatgcccatagccagcctcatccccagaaactgtgttttaattcatgtaggatagggccctgctgcaataaatagctcctcaagtagttatgaggtgtagtcagggttgagaaccaagaaagcatcatactcagcagacagctcccagcactaggcagcaagggcaggaggtagggatggtgacagactccttcagggttaaatgctaagacagtactggtagcttggttaggccagctttgctgtcagtgtgctgagaagccagcagcctacattgctaggctggaagtgactgctgtcataatttataagataatgttttaaagaaagagctttaaaaaatcccatgtaagttttaacttagtttaacagactaagtatctgttaagccttaagcatcttgatctttccagtccatatgtcatggcctgtttacccagctagttcgttcttttctccatttctctatttgcctgttgttaagctaaagttatgtttgtacatttagaagatgggatgagatccatgtgtatctaaaagggcacacctctccaactatgttctatatgataatttctcatttttcactggttacttaaagctgttactaaaacaacatgtatgaatgttggatagatagaacactaaacttaaattaatttcaaaacactaataagaatcagatccattattcagagtcagagataaaaatatcttcacatgctctaaaagagtaacttcttgataggaaaagtcatcccattttcttttaaagcaatcagaggcatcatggtgtcatttttaattctggcagaatcagtacatcctctccttccacgggttggagctccgtgtgctgattctgagtgacaggaacaaatgtcattccaaccaccatcacagcacatggaggattcctgggtgtaatgctggtctcctcccttgctggggtattgcaaagcttaattaatgtttgcaaaacacatggaggaaattgtatagaaattactatgtaattgcaaaagatcattgaagggaaatgctagtaaaatttactgggagaggaggaggatttaattggtaagtcttatgctttactttgaaaatcatatcagacagaagtgaattgactttgtaagtgccaaaaataaaggaaattatgttgggtggtctataaattcaagatattaagtttcatggctgaatttaatttcgtttgaattcataatactacaaacctaaccaactacattaatttgttacagagactaaaatctgcttgtatgtctgtctcctaagaaaacccaagtgtataaggatccttagttttccaagaagttcaaccagaaaagatagcctagccaccttgatggtaactggatttactttgaggtgtttccatttaaccatagcttttggatgccttgtcaaagcagcatattatctttgttggattacttcttgggaaacttcagcaatattggtaatgttttgcattttcttagttttttttttttctgaagcagaacttctgagctgagcttatttatctgataacgtaattttataaccatgtaatttgtactgttttttttttctcccagtacatattttggtacaatgtcaaacttaccacatttcagggctaatgggttaagtagaataattattctaactaatttgtaggcaccaaggtttgcaaacctcaattagagttgaccaaggggttactgtgtggctcaaggcttgaataactgagggctgagcagctcaactcagggctgagtttgctgtcaggtccaaagcagttctgttatacacctaatctgcaggagctagagtccagatcacaaggaccaacccttgcccaggctgtggcacaacctgactgtagggagaattgagtaatagctgcagcaatccagggtttgccaataactttctttaccaggaaaggctgttcattcaagacattctcagtgtggtttaaggactgtggctagatgtcagatctaaggactcaggtggaagggagcaaagagacaaggttctccaagaaaaggggtcttgttagcagttgcagtctcagttatgttcaatcctcggagcaaagggtagaaacttgagacattgtaattttcaaactaaggcatgttgcttagactgggattcagagaacccaggaatggaaacaaagaaataaggaacaggggcatatgagaacccagagacaaattatttggatgggagcaagtgacaggagctggctagtatgtaccgttgctctacagtgctcatctggttaggtcttgtccctgcttacaaatcatgagtaacttgaatgttttctttggcacaaacgagaaaatctaagaatgttgaactttatctcagctaaggaaagcagcaatggtagaggtaccatcccaccctttgtaatccttttgtgtgctgagaaaaacacatttaatcgtggtctaactcctgcctacatctccagataccctcttgccatccctccagcaaaccctgtactccagcctcacagtctacttgcattttaccattggtactgtaaggatggaaaagtgtgatatcttttctcacctatcataaaggtctcagctgacaagcctatgacaaaagacagattaacaagtataagccaaaaagtatctgagacaggtctcaatttagaactttattttgccaaggttaaggacaatgcacggaacaaaaaatagaaaatcacaggaacagtctgtggtctatgactttctccaaagatgaatttaagggtgccagtatttaaaggggaaaagtgggtgggagggtatggtaatccacatgttgcaagagaaaaggagcaggtaggggaatagccaattatgtattcttctcgtgttcagtaaagcagcattttacataagataaggagaacatagagtagctatctgtggagatacgtaacctgttatctgtagctgtccagttaggaacaaaaggaaaggcagcttcttgcatgactcagctttcagcttagttttttcttttggcagagtgaattggggtcctgagtatttattttcctttcacataagagaaagccataatacattgatttagtcacagttttatgtgacatgggagccttcagaaatgaagacccaaagatctgggagaactgtttttatgcaaagtgtgatgaaagaagtgactagttgtggagaaacatgattggtcaaaagggtactatctaatggtaataactgagggggaaaacccagcaaggcctgactgttcagattctccttggcctctctgtgtagcattgctttctccccaatttagggcatgactctgctggaatgagggtcttcaagggagaaagttttacttggaaggggtcccaatccagacaccaagagatggctctcagatctcacacaagaaagaatttggggtgagtccacagagtagaatgagagcaagtttctttaagaaagtaaagaaaagaatggctactccatagagcagctgcaagggctgctggttggatatttttatggttatttcttgatatgctaaacaaggggtggattattcatgggttttctgggaaaggtatgagcaattcccagagttgaggatttctcccctttttagaccatctagggtaacttctggaccttgccatagcatttgtaaactatcctggagctggtgggagtgtcttttagcatgctaacacattacaattagtgtttaatgatcagcgaggacaatcagaggtcactttcatcaccatcttggttttggcaggttttgtctggctcctttactgcattctgttttatcagtgggatctttgtgacctgtatcttgtgccaatgtcctatctcatcctgtgactaagaatggctaacttcctgggaatgaggcccagcaggtctcagcctcattttgcccagcccctgttcaagatggagatggtgtggttcaaacacctctgacaaaagcagacagtgacctttctagggtttatggctggctttgggggaaaggagttctagtgtctatgacctccctttggggaagagaaattctggttttcatgacttgctttcggggagaaagtagggaggatccaggagggtgggaggtggtcagaatgatgttgcttctgagtccttccaaagtccttccatttcaaagtaccgtactttggggtattgtattcctagccccagtagttccaagttcttttgggtatccctgcctttgcacaagctactcccactgggcagaactcattgccctcgttctctatccagctagtcctgaatcatccttctagactaagttgagctatccgcttttcagaagcctttctcagcctcatctgggactcatagcattgtgtttactgtcattagagtacttgctgtaccagtttatgtatacagttttcgggggtcagaacatgataccccaaagtatggcgtcttggtatgctgagtatttttgagctgaaggagacaagagggccccagaagcaagaaagtctttctccttccctcctctctttcctcccctaaagcaaaccataaaacctggaaaggtcactctgacctacctcccctttagtaggttataagaccctttgaataggtaagccttactggttttccctcattagaccatacctttttgtccaatcatgtttctctacaactatccacttccttcatcagattttgcatagaaatatttttccctaggtgtttggatcttcatttctgaagactcctgtgtcatataaaactgtgattaaatattataaatttgttggccagggctggtggctcataccggttattccagtgctttgggaggctgaagtgggaggattgcttgagcccaggagtttgaggctgcagtgaaccatgatcaccccactggactctagcctgggtgacagaacaagaccttgtctcaatctatcaatttgttgtgcttttctcttgttaatctgtcttcttttataggagtgacccttgcaaaatgggtgagaaaaagttatctatttgcttctacactgtgttaaaactcccatttgtttaccttaaaacaggcaaaaacccttttagactctgagctacacagtggttggggaaaaggttctcaataagtttgctggaaaaacctgcctgattaatcatcatagattgagaggggaccttgtatggtaacaaccacctctctgctatttacgtggaaatgagcactactgctgctggctccaatttgattgatagcactcaggctttgcagattggaagccttaattaaatgtcaaaagggactacattgcgaactgtgaattgtcttttaattacagtaagagagcaattgaactatatgatccggtaattgtttaaagtgaccatgctgaatccttagaatccccctcagtttctttctctataggatgctgcatgacagcccagagcaggcattaaaagggcaaaagcagggcctggagcagggaaccttaggctacctaaatgaaaggatccctccttactttcttttccctcgttacccacccttctttttccttttttctttcacacttcagttccctcattcccaacttttggtcattaccacacaagatgttttttataattcctgccatgtctatgtaccattaatagttttatataattcatagtttctttcattcatgtacacaaaaagcaaactttgtatgactaccttaagcaataaccagtattacttttcaaaggttgccttaaaaataaataatgagaaattctggcctgccggaaaacagccccacccttacagagcagaagaatttgaaaagggttcttttggagcctggtggcctctagaggctcttccttcttgatgatctgctctgtatgagttgaaaggcagtgtttgaaattacagtacaattcaagctctatctaaagccaggcagccaatatgtccccagtagtgaacaccaggaaccaccactgatacctgcactgcactgtgggcaacattgctctagtttccagtctcaaaatagataaaaagtgtcttattattatgttggtcatcctctgtcaagtaggaagtcctgatttttcacttacatgccacaaacattctgattaacatcttgattttacttttccacccttttaaccacctcagatactttgttctgggaacctctgtatgtctctttaaaaaccatacagctagaatttggaactgacatttagcaagcacctactttaaggtaatttatacagtctatctgtattcatcattgtaatgaccttgagaaataggtatcatccctattttacagatgtgaaaattttgcttaacgttatagatgtaaagattcaaatttttcatttgtacacccctactttgtgctggctccgtgaatctgctggaatttttttttggttgtcacatcatggctgagtatcatagcagcattgtctcaaaattcttacttgctatattcccagtgataaaatcaaatcagctctgcctatgactaatcttcagttcgctacgaccatttcatccagagctggcagaagggtttcatctgtgttctaatgccaaacaataggcagaagctgcctggacctttgcactgggagactgtttctgggcttggcacaaaaaagtgattaattagaagtgtctgctctaggttcgggagcagggagtgacagcacaagtatcatacatttgccacgcttgatgtaatcttttctggaattatagttgtccccacttattcatggttttaatcacctgtggtcaactgtggtccaaaaatagtaagtcaaaaaattcaagaaataattcacaaattttaagttgcatgccattctgaatagtgtgatgaaatcttgcagcgtcccactctgttttctatggatgtgaatcacccctctgtccagtgtatccacactgtctacactacctgcccattagtcgcttagtagctgtctgggttatcagatcgactgtctcagtatttcagtgcttgtactcaagtaacctttattttacttaataatggtcctaaagcacaagagtggtgatgctggcatattataattgttccattttattattagttattgttaacttcttaatgtgcctaatttacaaagtaaactttgtcataggtatacgtgtagaagggcaaacatcggatataaagaatttggtactatctgaggtttcaggcatccactgggagtcttggaatgtatcctccttggataaggaagcactgctgtacttatggggtcagtcatttcccagttagtatttacatgtgctacattttctcctatttatggcttagcagtggtctttttggtttcatattacttctttggctatccaagtttaaaaacttgaatccaattgtgtgaaggtgctgggaaacctagttatttctcttcttcatgtaatcaaacattatctgtataccgaaggtgatatcaaataaactaatacaggtattccacagaaacaaccagtaggactatccctgcattagattttataatctgttaaaaataaatttcacaagatatccaataaggatttgccaatttttgtgcttgtgattgctaaatacaaaattgtttgcctctgacaaaacaagtccaatattaaataggttatataatccatttgcaatttcgtatataaaattttcccaagtttgaagactagcttaggggtttaaaaacaacctaggttgattgtcataagaatttcaccatttaactcattggctagatttcaataaaagtgattttttaaaaaattatggctttcaagccctctaaaatcagttacttttttaaatttacgtatgctttagataccagtttacaaattgacttctgagaagaacatgttttctgatatctatacaaagaaactattaaatcattttccctgaaatgacttaaaaatgtaaacatagaatgtagcaagaaaggagtgaaaacgtgtacatattctcttttttttttttttttttttttttttttttggagacggagtctcgctctgtcacccaggctggagtgcagtggcatgatctcagcttactgcaagctctgctttctgggttcacgccattctcctgcctcagcctcccgagtagctgggactacaggcgcctgccaccatgcctggctaattttttgtatttttagtagagacagggtttcaccgtggtcttgatctcctgacctcgtgatccctcccgccttggcctcccaaagtgctgggattataggcgtgagccactgcgcccggcctacatattctcttatatacctatgatagggttatgtcttgatagcctgtcataagttgaaaacatcataagtcaaaaatgcatgtaatacacctaacctatggaacgtcatagcttatcctaccttaaacatgctgagaatacttacacttgtccacagttgggcaaaatcatcaacacagagctatttcatgataaagtgttgaatattccatgtaacttagtaatctgttgaaagtgaaaaacagaatggttgtatggtactttaagtacagtgtttactgaaggggtatcactttctcaccattgtaaagccaaaaaattgtaaatcaaaccatcgttggctgggcatcgtggctcatgcttgcaaatcccaacactttgggatgcgaaggtgggtggatcacctgaggtcaggagttggagatcagtctgactaatatggtgaaaccctgtctctaccaaaaatacaaaaattagccgggcgtgttggggcacccctgtagtcccagctacttgggaggctgagacaggaaaattgcttgaacctgggaggtggaggttgcagtgagctgagatcacaccactgcactacagcctgggtgacagtgagactccatctcaaaaaaaaaaaaaaaaagttggggatcatctgtattaaggttataattaaaattctggatttattgtgttctagaataaggaaggcagaataaggaagtcacagtaatttttttcctacaaaaaaaaacttaagaggatgaagttctaagaactattttatgtattgagtcattcataattggaatattttatgcttagcattagcatactgactcttaattttaaaatgttggttctggaaacagaatttacctgcttcaaattaaattattttctttcagaattttacttctcccaagtaccctaaggcacattaaataagacagcacaagtcatatggcagcctctagagaatatttatcttaattgcattgatcttacttcataaggttaaatacaatttttccccaagttatatatcatttttattgaggttaatgttgagtcaagatctaatttcagcagcttcttaaagttatttgaactgtttcctccagctacatgatacttattgttcatttgaaatttcaattcaccatgccttactccactcatacatagctggatatgctttttaaaatattgtggtttaaaagaagagtgtgtgctagttaagtgaagaaattttagaagacttctatttctgaatatggcaaacttgataacacaaaaaaaagtgtggttgtttgaaaaacatggccttatattctttgacactttttccattaaaaggtgaagtctttacccttccctttgaatctgggcaggttttgaagccttcaacaatagggcttagcagaagtgacactaaatgatctatgatgctaggacacaaaggaccactcagcttgttggctggaataattgctcttggagccctaagccaccatgtgagaagctcagctgcctggaagttaccatgctagaaaggccccatgtaagttgtccagtggacattcctggttgaggtcaggcttcctgctatccttacaaggcaccaagcataaataaaatgccatcggattattgaggcctttgagtcacccccagcttcttgatgtctgaagccctagacatcatggaacagagatgagccatcctcactatgcactgtctgaatttatcacccacaaaatccatgaatatgataaaatggtggttgcttcatgcttctcagttttggagttgtttattgttcagcaatagatacctggaacataacttggcacttgaaaaacgagtgctttcataatataacctagaatatgtggtgttgattttgggggccaggtagcaggtgggagcctgatggacctttgggaacatgaggtgaagtactgaaggaaatagaaatgttatgggaagttggaggaaagaggactcttgttagtgttagcagacagtttggtaacactgtcacctgtgataatgtggaaaataggaaatacacctaatgaactcaatgatctagataagagatttctatgcagaatattgaaggtgtctcctggctttctctgtctgcctataataaaatgtgggcgagcaaggcactaaagcatagagcttaggggaaaaaaaggggggaacaagtgggtttttccagctagtaaacagatctcagagtaagaaagaacctcggggtaaagatcaagtcctagctgctgttaggaaaatgtagtctcaagggaaacatggagtctagggcgtgacttataaacctgtacttagaactcacaaagctttaaggttgggcctcagactctttttaaacaaacgagagtcttctaaggatcttaaaagtgctgtgtagacactctccattaaacattaaatatagcctttttttctttttctttttttgaggtggagtcttgctctgtcaccaggctggattgtgcagtagcgcgatcttggttcactaccacctccgcctccctggttcaagcgattctccttcctcagcctcccaagtagctgggactacaggtgccagctgccacgtctggctaatttttgtatttttagtagagatggggtttccccatgttggccaggatggtcttgatctcctgaccttgtgatccacccgcctcagcctcccaaagtgctgggatcacaggcgtaagccactgtagccagccctaaacataggctttctaagagagacagatgaacgaacaaatataagaaccttaagggcattgttccatagcagcctcggaagaggcccaagggagagaaagacttcctaggagagatttctaggtgtgtctaataaaaagttcataaatagaccaggcatggtggctcacatctgtaatcccagcattttgggaggctgaggcggttggatcacctgaggtcagaagatcgagactagcctgaccaatatggtaaaaccccgtctctactaaaaatacaaaaattggcctggcgtggtggtgggtgcctgtagtcccagctacttgggaggctgagacaggagaatcacttgaaccggggaggcagaggttgcagtgagctgagactgcatcactgcactccagcctgggtaacagagcaagactgtctcaaaaaaaaaaaaaaaaaaagtttataattttttggatttttttttaatttggataattttttaaaaattatatcagttttggcaaggcacagtagctcatgcctgtaatcccagcactttgggaagctgaggtgggtggatcacctgaggtcaggaatttgagaccagactggccaacttagtgaaaccccgtctctactaaatatacaaaagttatctgggtgtggtggtgcatgcctgtagtcccaactacttgggaggctgaggcagaagaatcgtttgaacccaggaggcagaggttgcagtgagccaagattatgtcactgcatttgagccggggcaacggagtaagactgtctcaaacaaacaaaaaattagttttgaataaaagggacagaaatagtatgaaatgaaaggagatctttcattttattctgaaattctgaaattctaactgcaggaagcaaactgagaatatgtatcagatgcaaaagcaatttgaataatatattaatagctacacattgatgtaagagctaaggacatttttgttttgtgttccttatttaagatgggaaataattgagtttatttagatgctgatgggaacaggctagtagctgggaaagacagaagattctggaaaaaatggggattgatgacatagcaagtctctaagaagaaaggaattgagagaacagattttgaaaggaggagagagacattttccactgagatagggaagagggtctggtaactttaggaggatggggctgaaggttggcccctattttcttgacaaatgtaaagcaagatcatcaaggaccagcaacaaacttagagttccaagacatacttttcttcctttatggcaatgatacattcatttgttttatactttcagattaaaattatttttattatcaatcttaaacatgagaaactgtataaatcattctggtttgatcctgaaattcatcacccattatattctccaagagatttgcctctgtccttttcgtttgtttgaattcctattaccactagtgctcatattagataccggggactgaaatccagggaggttaaactggtgatggtcatccacaggttcctggaagggttggacactacccaggagtcttcttattttattactgtttctcactagtgatggttttgttttccattacatttcttaatgatatgtccttaccggagactcagaaaagtgcactttgtcctgttgcaaattttcatcaatgaggtgaatatattaaaattataagggctagataatgtatcagatagcaaaaatattatttaaaatgttttcagtgtgctatagtaatagtctaaatgaacaaaaggaattttgaaagggaagaagataaagttttgcatttagttttcaaaataggcaattgcaagaaaaatatatgcctgacatgattaatgaagaaatagaaaggggtaacttgtagtactggatacaaaaacttactgtaaaaccatattaaacaaaacagtacaatattggtataggcaaagagagacaaatagttgaacagtccagaaaaagcccatccatagaacaaactcatctgtatgtttgcccatatacagctgggcaagatcaacacaaagcctattttataataaagtattgaatagctaatgtaatttattgaataacctattgaaaatgaaaaacagagtggttgtgtgggtacttgaagtgtgatttctactgaatgcatatcattttctcaccatcataaagtagaaaaattgtaaatcaaaccattattagttggaaaactggtgagctggattaaaaaatggaaatgtatccttacctcttcctatatagaaaaatcaattccaaatagatcaaatattttaatgtgaaaaacaagtgaattttttagaaacactacaaaagaataattctgtaacagatatggaaagacttactttaaaaagtataagccgttgtgaaaaagactgataaatttgactatactgaaattaaaatttataatgatcaaaagcatcctaaagagattgaaaaataaaaggtgcacactggaagaagagatatgcaatttattaaaattacagattaatatgcagaatatgcaaataaatccacttattaataaagacatttcaactcaatagaaaaggcataaagaagagtttcacaggggagataggacagccaataaacaaataaaatgaagttcagcctcattagtaatcaaggaaaaacaaattaatatcacagtgaggtaccattttaatccccattagactagaaaaatcaattagccctacaatattaagtatagcaagaatgtggaaccacagaccacttactgctgatgagattgcatactggtaaaatgacattggaaagcaagtgtgcattttccagtaaagatgaaattctgcatactctgactcttctttaggtacacaccttagaaaaactcttggacatgtgcataaggaggcatgtgcaagaatcttcataacaaattattttttgagacagggtctagctctgcccctcaggttggaatgcagtggcgtgaacatggctcactatagcctcaacctcctgggctcaagcaatcctcctgcctcaacctcccatgtagctaggactaccagtgtgcaccaccatgcccagctagttttatttttatttttgtagaggaagggtttcgttttgttgcccaggctagtcttgaactcctgggctcatgcaatcctcccacctggcctcccacagtgctgggattacaaatgttagccaccgtgcccacccataacaaacttcttaaagacatgaaaccagaacaaacttaaaaaccctccatcagggaaatggataaatgaagcagtgaaaattaacgaactacagctacatgcagggttataaatgaatctttaaaacaacacggaattctttaaaaagcagaaaacaaacagcatgagtctatttattggaagtttaaaaacaggataatatatacaacatattgttaaggatatgtatgttatgtagtaagcaaacacgaggcaatgataaacacaaaattgagaatagtggcttccttccccagtgtccctggggaggatgtggatgcagtcaggaagcggttcacagttggcttcaaaggtgttagaagtgttctgtttctcaacaagctggttaatgaggattctagtgtgtacctatatgtttatttcataagagcaaaagtacgcaacatagactctttggtatatgtgtttcacaacttaaaaataagcaaataagaaatacacttttatatgtaggatttacttcacaattttaaaaatcagtgcattaagtggaatcatgcagtatttatccttttttgactggcttatttcttagcataatgccctcaagtttcatctgtgttgtagcatatgacaggatttccttcttttttaaaaaagctgaatattattttcttacatgtatatataccacatgattccatttgtgatacatctaaagtaatcaaactcctagaaatggaaaggaaaatggtcgcctagtgctgggggagagggggaaatgaggagctgctgttcaacgggtctagagtttcagttgcataagatgaaaaagttctagagatctgctgtagaactaattgtgcttctagttaacaatactgtactgtacacttaacattttgtcagaaaggtagatctcatgtgtttttaacacaataaaatacataaatcagtaaattcagcacattgaaaaaaagagtggttagggaaccataagttgcatgtatgtctggggttcagatcattgtaaataagtctccctctaaagtgtgctcaactgtataagatactctggatcctctcagcacactggagcctcacttttggttctgagcacactgcaggggagaatgactactacgccctgtgtcagggtagtaagtgatcctgaatccatggcctataggatgtttgaaggaatgtttagtctgatacaaagcagaccaagctgtcttcaaacataggaaaagttgttcttgggaagagagagaagtatgttccaaagagctagatttttcggagggctaatgttgcaggaaaaaagcctttggctccatcaaagtatcccagggctcctctggaagagaatacgatgtctcacgtgggggtgagttgaatcacatggtggcaaggtgaccatctgctagggaagtcataggaaagtctcttccacttctgaaactcactgactcagtgacagtgcttatcaattaaattaacaaagtgatctaggttaagcactgacgcttcaacaaggactccatttattctctgctctttgatgaatattagctgtgactcaagacttgggaaaaatatttaaaccttctttacagatctatgagtgagaatcaaaatggtatcctgacacttcggctttctggcctctgcagcgggggccatgtaacctcctgcttggagaaccaggctcttatgtctatgaatcatagaaaactacttcaaaccagaataagcaaaaactatggaatttatcttaggatttaacagagctgtttcacaaaatcctacggcaggaagcacagtcgagccacatggaatccagactgggaaagtgatcaggcagctactcttgatttctctctacctcattgtctctctcaggatgtctcaatctctgtggctacatggtttcttttaatactgttaatcagcccattagtttcattcttctctctgcagatgagcttccttcactcttccacatgcagtgctgcctcacaggtctatgtgcatgcttaaagccatttccaaattcctggtggagtgtcttgatgctctgagcttggatcaagtgtccatgcctgctgtgcatggccagttatcagtggcaggaggtagaaatgtagtctcagggtttgtctctataggtagaaggtagatttcagagaaacagagcagctaatgaactgaactgatactctgaacattttcaggcaaacctctaactcacagggttatgaggatcacatattgtaaggtacatagaacatgtgacccatagacatccagttaatgttagtttcctctcctttatttctgaacctcagttttttatgtaaattagaaaacaatatcatgactcatttagtatgtgaaaatcataaagatggtatatgtattagtctgttctcctgctgctgtgaagaaatacctcagactgggtattttgtaaaggaaagaggtttaattgactcacagttcagcatggctggggaggcctcaggaaatttacaatcatggtggaaggcaaagaggaagcaaggcaccttcttcacaaggcagcaggaaggagatgtgcaagcaggggaaatgccagacacttataaaatcattagatctcaggagaacttgcgcactgtaacgagaacagcatgggggaaactgcccccatgattcaattacctctcctggtcctacctgtgacacgtggggattatgggaattacaattccaggtgagatttgggtggggacacagagccaaaccaaatcagtatatgtgaaaggactttgcaaacttaaaagtaaaatagaatcataatttacttccctatacttcgttctagcaactccaggcatccacagctggagttccctgaggcagatggcttggatctcttactaccatatctttggtctcctcctgttacatgccttacctttgtgggtttgtctagtttctatcgtgtagatgcactgtctggcatggtcattgtccagatcctagtaagagcaaattactaattttcaagtctgaatcagtccaatttataaagttgtttttttttttttgtttttctttttgtttttttcctgatcttctatgcccttacctacggagcaaaatcaatagacaaaatgaaagttcatctgtgcgtatatctatggccagataggactactctggaaattttgactatttcattcacatcagctaccaactggcaagcaattgatcatacttgttttgctatttcaaccaccttaatgactaaattggaccgaccacttcttatttagtcattctgtagataaactggggtggggctggaaactgttaattcagctgtgtgcattagacatgctccctactcagctcttcaggtagtgtcacactgataacatatactaattcatattagaagatgcagaccgaagtgtcatttgctaggacttcaacccaataaaaatactgaataaaatcaagaaccatgaacatgatccgtgttgtattttttaccattcctaatcaatatgtacaactttagtaatgtttttatattgacattattggaaatgaggtaatgtacataaatggatttccctgataatttcaccttcctccttcagtggcatgaaaaaaattaactacttttggatggcagtttcaaaaacgtatcacataaatctaaagcaataaaaaaacctaatctaaatacagcacacccttggtatttgtaaagacttttcctgaggtctttgcctgccctcaagattgaagctacaggaatgtttgtacagaggcctgactttctcatgggttatatttatcacaaattttaactttcactaatgttgtgtcctcatataatggagatagcaaagaagtacaactcgtagcatgggatgagtcatgtcatatgtgattctgaatgcagtagtgtggaggtggaggtgaggtgaagagcataggccctggagccagttgctgggatcagatcctgacttttctctttaacagcttagtgacgttgggcaagttccctgactttttcttgcctctctctcatttataaaatagggataacaaaacttacctcaaggcattattgagaggactttgttttgttttgtggttttgtttttttttttagacaagatcctcactctgtcgcccaggctggagtgcagtggcacaatctcagcccactaatacctccacttcccagattctagcaattcttgtgcctcagtctccccagtagctgggattacaggcatatgccaccacacccggctaatttttgcattttcagtagagacaggatttcaccatgttggccaggctggtcttgaactcctgacctcaagtgatccacccaccttggcctctcaaagtgctgggattacaggcatgaaccaccacacctggctgacttagtaagttttatcacattacttggcacagagtgattgctaaataaatgttagatttaaattaattacaattatagagaacaaaatattggacttgagatatgcattctgcctagggatgggtggcaggctcatatgctagcaaggtgacttgaagttcacagaattcaaatttgtgtcttagctaactttcaaattttatcacaaacttttagggacatgatgaataagtcaaaattattattttcaaacccagtaatgtcagaactttattgtaatcacaatatttctctcccaaacatctcacttgtaataaaaaaaaaaaagaaagaaagaaaaaggccgaagatttaatatgcagttcccaagatataacattgatttgtggtcaaataatataggctaagccgcttaaacattttgaatttgctcccacatggtgacaaattttttttttttttaacagaaagaattgtttaacacgtttcatctttgaagtcctttttggaaagtattagataaactttgatatttttacctaaaatcatccatcacttctcagtaaatcctttactggaaatgtgaataccatcccagtggagttaaaatgggcccagaagctgagaaatttgctgtatgagaaaataaaatctagggagctctaaggtctgagttggtatgattttatataacaaagtcaattacagccataactgctctctacttactgagacctaatttaaactaacatcatttcaaataatactccttgagaactaaatcctttgcttcttaggtaagtaaaactctcttttgacttcaaagggagttttgccgacctttagaaagcagtttatgtttctagtcatattacccttatgtgatcccctttttctctatacttttgagttccttgatgtctgaaaattctgatggatattagtggtgcaacttccatgctagtttgcattaatgtctctccccttcgcttcaactgtttaagtagcttttaagaaaaattatgttggcatgctcccgagaaattgcacattgtgatagatataattatcttaaaaatagatcaatatgtatttaaaatactagggagtgtgttttataagacagtatatggtccatagcactggcatgatgaacagatgcatatattgtttttgctctgctgctctaggaaagcactttttaattgcacgtatgggtcatgtaaaaaagtagagaagctataccaaagtacttcagcaattaatattttttaaaattgatgatatacagcccattagctcttttggttcctttccagtgaaaatgccagtcttccttaccagtcttccagtcttccttacctttctgaagcatgagcagaaatcaggttttctctcttggcaagtcaaagctaatttcactcaatagatttatgcaaattgatatttcagatgaagatgtctcaaggagaggtcaagagaaggtcccaaatgggatttggtttcaaagggcaaataagaactccagactcatttgttttcatcaatattttgctgtacccacgatacatatgtcataatcaaattcagcctgaacagggaagcctaatcataatggtggtgcctggctctagagttgagatatattcatataacatgctctgttcccctctttgccgtcaatcattattgcatttcactttggggaagtaatgaataccaagtttagttgttggagttgtattcttaattaattgagattatgtgattataactaagattttggcagcagtggctagcagagacttattaacgatgatcaattatgaccaggtggactttttgacagctgatttttacctgacaatatgtgtaaaggttttaattaaataagtagagctaacaagctgacctcaccatctgctgttatttctcttcctgggtagatcattccattccttgcataggaacgagtcctcttcattgcagccccctttcatttgctcagcacagaacttacaattcatctgtcagtatggccagtggttgagtacctatttatagtccatgatagcaccatgaccaaaaaacaattttccaaaaccagttgctgaggatctaaacaatcccattcttgctccaaaccaaagaaagaaaattaggcccctttctcttttgtccagtcaataatggcttcacatcaaggaagtctagaacctgaaatgcttgctttgctgtcatgattgttggcagctatagtgacatggtgtgataatgccagtgacccaggtaaacacaagcagagtagtggagctgctgtgcctggctgaggtccccttcaggactgaaccatctgttgctggcagtgtgggcacaaataactcacagatgtgtcctcactcccacccatacccccattatttatccttagcccagggagctgcctcactctgggctacatcaccctagctacaccctgagccccagcagttgccatctaatgattggtcaatgcaggggtagaaaggcctgaccccttgtctcaaactgagacaattgtgagaggccaactgtgctccaagctggctgcgggatcactgaggcttctttggtaagaatatctcaatttaccttttctctctacctactcttttttcccctcacccctcacaatgctgtttgtgagttccccaagaaccatcctgcaagcaaatctctttctcagagtctgtttcctggacacccgagctacaacatacagtgatgacacagagcttgcttgcaaacaaagattgtactgatttttgtgccttaagactgatttcacacttctatgtgtcttttctatgaggaagagagagactgtggctttatcctgcacttcattatggatacagtaaaggaaaggctacatttcattggaagtactcacacatactttttcagtgtgtattgtcatatcagacatacctaaaacactcatgtattcagtcaagggcttcagggcatgaattgactttgaattgacttagcaatgcttgctgtccatatcttctctagttagatggagcattcttctatttccttcccctacagtggtcctctactgtaactcctagctattctcagaagctataggtttatcccccaaattactttgtgtaccataagagtttggttttgggcaagctaaaattgagatgcttataagacattcaactaggctgggcgcagtggttcacacctgtaatcccagcactttgggaggctgaggagggtggatcatctgaagtcaggagttcgagaccagcctggccaacatggtgaaaccccatctctactaaaaatacaaaaattagccgggcgtggtggctggcacctgtaatcccagctacttgggaggctgaggcaggagaatggtgtgaacccaggaggtggagcttgcagtgagccaagatcgcaccactgcactccagcctgggggacagagcgagactccatctcaaaaaaaaaaaaattcaatcaaagatatcaatttggctgcttgataatgaaattttgaactcagaagaaacagtgttagcataaaattgctataagaaaccacaagagtaggatgagatcatctagggagagagaaaagagggtttagggtaagcttgaataaaccaaacttaggggcctgggagaagatacagaacctacaaaggagactgagaaggagcagccagagagagaactaggacagtatggtatcctgggagccagggtgcttcaagaaggatggggttgtcaactgtgtgattttttccttttcaatgatggctttattgagatctaactcatataccacaaagtttacccttttaaagtgcagaattcaaagacttgtgcatctaatttcagaacatttgcattcctcctttgtcgaaatagaaaccctgtattcattagcagtcatttccccattctccctctccccagcccctggcattctctaatctactttctgtctctatggatttgtctcttctggatatcccatataaatgaagtcatacaatatgtagccctgtgtggctggcttctttcatttacattttcaggatttaccgcattgtagcattacccgtacttcatttctcttttattgccaaataatattctgttacatagatataccacattttgcttattattcatcagtcagtgaacatttgggttgtttctacttctggggctattataaatgatgctgctatgaccgctcatgtatatgtttttgtgtggtgtgtttttcagctctctatacaatctagactcaagtccctagccagagatatgatttgcaaatatttttctgtcattctgtggcttgtctttttactttcttagtggtgcactttgaagcacaaaagttcttaattttggtgatgggcaacgtatctatttttaattttgttgctgtgcttctggtgtcatggtcaactttgctttgaattctgcaagactgggtaaagtgaagacagagaaacaaagacaaatttggtgatggaagtaacttatgatctggaagaaggtttataaagttttggggttgaactcctaatgcagtgaatcatgagggcctaaagagaacacataaatcaactcttggacctgaggtacatggagtctaagagaaaacacagcctccattggaatgggctgcaacttgcatgggaagcgttcataggggatgtgagcttttaggtaagacgaatattcagaaaagaggttaaagacagaatagtttagtgatcagtgtttgggagtcagagaaggtatagggaagggttggggagctggtgtatgatagattgagtcacttcgagggaggggaatacattctcttttttttttttaatactttaaattctgggatacatgtgcagaacgtgcaggtttgttacacaggtatacatgtgccatggtggtttgctgcacccatcaatctgtcatctacattagatatttcttctaatgctattactccccttgccccccaccccccgacaggatccggtgtgtgatgttcccctccctgtgtccatgtgttctcattgttcaacttccacttatgattgagaacatacagtgtttggttttctgttcctgtgatactttgctgagaatgatggtttccagcttcatacatgtcacagcaaaggacatgaactcattctttcttatggctgcatagcattccatggtgtatatgtgccacattttctttatgcagtctatcattgatggggatttgggttggttccaagcctttgctattgtaagtagtgctgcaataaacatatgtgtgcatgtgtctttatagtagaatgatttataatcctttgggtatatacccagtaatgggattgctgggtcaaatggtatttctgattctagatccttgaggaattgccacactgtcttccacaatggttgaactaatttacactcccaccaacagtgtaaaagcgttcctatttctccacatcctctgtagcatctgttgtttccttactttttaatgattgcccttctaaatggcatgagatggtatctcattgtggttttgatttgcatttctctaatgaccagtgatgatcttttttccgtatgtttgttggccacataaatgtcttttgagaagtgtctgttcatatcctttgcccaatttttgatggggttgtttgtgtgtttcttgtaaatttgtttaagttctttacagattcgggatattagccctttgtcagatggataaattgcaaaaattttctcccattctgtaggttgcctattcactctgatgatagtttcttttgctgtgcacaagctctttagtttaattagatcccatttgtcaattttggcttttgttgccggttgcttttggtgttttagtcatgaagtctttgcccatggacatgcccatgtcctgaatggtattgcctaggttttcttctagggtttttatggttttaggtcttacgtttaagtctttagtccatcttgggttaatgtttgtataaggtgtaaggaaggggtccagttcctgttttctgcacatggctagccagttttcccaaccccattgattaaataaggaatcctttccccattgcttgtttttgtcaggtttgtcaaagatcagatggttgtagatgtgttatttctgaggcctctgttctgttccattggtctatatatctgttttggtaccagtaccaagctgtttttgttactgtagccttgtagtatagtttgaagtcaggtagcgtgatgcctccagctttgttctttttgcttgggattattttggctatacgggctcttttttggttccatataaaatttgaagtatttttttctaattctgtgaagaaagttaatggtagcttgatgggaatagcattgaatctataaattactttgagcagtatggccattttcactatattgattcttcctatccatgagcatggaatgtttttccatttgtttgtgtcctttcttatttctgtgagcagtgttttgtagttctccttgaaaaggtccttcacatcccttgtaagttgtattcctaggtattttattctctttgaagcaattgtaaatgggagttcactcatgatttggctctctgtttgtctgttattggtgtataggaatgcttgtgatttttgcacattgattttgtatcctgagactttgctgaagttgcttatcagcttgagtttttgggctgagatgatgaagttttctaaatacacaatcatgtcatctgcaaacagagacaattgtacttcctctcttcctatctgaatacgctttatttctttctcttgcctgattgccctggccggaacttccaatgctatgttgaataggagtggtgagagagggcatccttgtcttgtgccagctttcaaagggaatgcttccagctttttcccattcagtataatattggctgtgggtttgtcataaatagctcttattattttgagatacattccatcaatagctagtttattgagtgttttcagcaagaagggtgttgaattttatcaaaggccttttctgcatctattgagataatcatgtggtttttgtcattggttctgtttatgtgatgcattacatttcttgatttgcatgtgttgaaccagccttgcatcccagggatgaagctgactagatcatggtagataagctttttgatgtgctgcttgatttggtttgccagtattttattgaggattttcacatcgatgttctttagggacagtggcctgaaattttctttttttttactgtctctgccaggttttggtatcagtatgatgttggcctcataaaatgagttagggaggagttctttttctattgtttggaatagtttcagaaggaatggtaccagctcctctttgaacctctggtagaattcagctgggaatctgtctggtcctggggctttttcaggttggtaagatattactgcctcaatttcagaacttgttattggtctgttcagggattcgacttcttcctggtttagtcttaggagggtgtatgtgtccaggaatttattcatttcttctagattttctagattgcatagaggtgtttatagtattctctggtagtttgtatttctgtgggattggtggtgatatcccctttatcatttctttttgtgtctatttgattcttctctattttcttcattagtccggctagcagtctattttgttaatcttttcagaaaaccagctcctggattcatgaattttttttttttttttttttttttgagacagagtctcactctgttgcccaggcaggaatgcagtggcgtggtctcggctcactgcaaggtctgcctcccgggttcacaccattctcctgcctcagcctcccaagtagctgggactacaggcacctgccaccacgcctggctaattttttatattttttagtagagttggagtttcactgtgttagccagaatggtcttgatctcctgacctcgtgagctgcctaccttggcctcccaaagtgctgggattacaggtgtgagccaccatgcctggccctggattcattaattttttgaagggttttttgtgtctctatctccttcagttctgctctgatcttagtgatttcttgtcttctgctagtttttgaatttgtttgctcttgcttctctagttcttttaattagggtgttgaatttagatctttcccactttctcctgtgggcatttagtgctacaaatttccctctacacactgctttaaatgtgtcccagaaattctggtacgttgtgtctttgttctcattggtttcaaaggacatctttatttgtgctttcatttcattatttacccagtagtcattcaggagcaggttatccagtttccatgtagttgtgtggttttgagtgagtttcttaattctgcattctactttgattgcactgtggtctgagagactgttatgatttccattcttttgcacttgctgaggagtgttttacttccaattatgtggtcaattttagaataaatgtgatgtggtgctgagaagaatgtattgatttggggtggagagttctgtagatacctattaggtccacttggtccagagctgagttcaagtcctgaatatccttgttaattttgtctcgttgatctgtctgatactgacagtggggtgttagtctcccactattattgtgtgggagtctaagtctctttggaggtctctaagaacttgctttatgaatctgggtgttcctgtatttgacacatatatatttaggatagttagtccttcttgttgcattgatccctttaccattatgtaatgcccttctttgtcgtttttgatctttgttggtttaaagtctgttttatcagagactaggattgcaatccctgctttttttttcatttaaatttgctttgtaaatattcctccatccctttatttttgagactacctgtgtctttgcacatgagatgggtctcctgaatacagcacaccaatgggtcttgactttttatccagtttgccagtctgtgtcttctaattggggaatttagtccacttacatttaaggttaatattgttaggtgtgaatttgatcctgtcattatgatgctacctggatattttgcccattagttgatgtactttcttaatagtgttgatggtctttacaatttgctatggttttgcagtggctcataccagtttttcctttccatatttagtgcttccttcaggtgctcttgtaggcaggcctggtggtgacaaaatctctcagcatttgcttgtctgtaaaggattttatctctcctttccttatgaaacttagtttggctggatatgaaattctgggttgaaaattctttaagaatgttgaatattggcccccactctcttatagcttgtagggtttctgcagagatgtctgctgttagtctgatgggcttccctttgtgggcaacccaacctttctctctggctgcccttaagattttttccttcatttcaaccttggtgaatctgatgatgatgtgtcttggagttgctcttctcgaggagtatctttgtggtgttctctgtatttcctcaatttgaatgttggcctgtgttgctagtttggggaagttctcctggataatatcctgaagagtgttttccaacttggttccattctccccatcactttcaggtataccaatcagatgtagatttggtcttttcacatagtcccatatttcttggaggctttgttcattccttttcattcttttctctctaatcttgtcttcacactttatttcattaagttgatcttcaatctctgatatcctttcttccacttgattgattcagctattaatatttgtgtatgcttcatgaagttcttgtgctgtgtttttcagctccatcaggtcatttatgttctctaaactggttattttagttagcatttctggtaaccttttatcaaggttcttagcttccttgctttgggttagaacatgctcctttagttcagagaattttgctattacccactttctgaagcctacttctgtcaattcatcaaactcatactcccgtccagttttgttcccttgctggcaagaagttgtgattcttttggaggagaaaaagcattttggtttttggaattttcctcagcattttgcactggtttttcctcatctacctttgatctttgatgctgatgacatttggatggggtttttgcgtgggtgtcctttttgttgatgttgatgttattgctttctgtttgttagttttccttctaacaggcccctctgcttcaggtctactagagttcactggaggtccactccagaccctgtttgcctgggtatcaccagcagaagctgcagaacagcaaagattgctgcctactccttgctctggaagcttcgtcccaaaggggcacctgccagatgccagctggagctctcctatatgaggtgtttctcgacacctgctgggaaatgtctccccatcaggaggcatgggggtcagggacccacttgaggaggcagtctgtcccttagcagagctcaattgccatgctgggagatctgctgctctcttcagagctggcaggcaggaatgtttacctctgctgaagctgcacccacagccaccccttcccccaggtgctctgtcccagggagatgggagttttatctataagcccctgactggtgctgctgcctttctttcagagttgccctgcttagagaggaggaatctagagaggcagtctggctacagtggctttgctgtgctacagtgggttctgcccagttcgaacttcctggggatttcatttacactgtgaggggaaaacccctactcaagcctcagtaacggtgggtgcacctcccccaaccaagctccagtgtcccaggtagacttctcactgccagcacagcagtctgaatttcaagccagtggatcttagcttgctgggcttcatgcgggtgggacccgctgagctagaccacttggctcccgggcttcagcaccctttccaggggagtgaacagttctgtctcgctggtgttccgggcaccgctggggtacaaaaaaaatctcctggcagctagttcggtgtctgcccaaaaggccacccagttttgtgcttgaaacccagggccctggtggtgtagtcacccaagggaatctcctggtctgcgggttgccaagaccatgggaaaagtgcagaatctgggctggagtgcacagtacagtccctaatggcttcccttggctgggagagggagttccctgacctcttgcacttcctgggtgaggcgacaccccaacctgcttcagctcaccctctgtgggctgcacccgccatctaaccagtcccaatgagataagccaggtacctcagttggaaatgcagaaatcacccaccttctgcgttggtctcgcttggagctgcagaccacagctgttcctattcagccatcttgtgaagactcaggaatacattcttaacaatcctttgtctttgcatcactagaacaagagtcaaagtccagaggtgatacagccagctagagacctctgattgccaaggagcaaagagaagcaaggtctagcactctcagcttataagtgggaaaagcatcaccttcccccacacgacccacaatggaggcttccctcaaatggcagtggggattggattctgggtaataccctttccccaaaacacaaaaatctgctacctacatacatggtcaaatttttgtgtctattttaaaagacattttcagataaaattttctagactaggcgagagattcaacatcaaatccacatatctgattttctatcacttttatttatttttatttacttatttttttgagacaaagtctcgttttgctgcccaggttggagtgcagtggtgcaatcttggcttactacaacctctgcctcccaggttcaagtgattctcttatgtcagcctcccgagtagttgggattacaggtgcccaccaccatgcccagctaatttttgtatttttggtagggatgggtttccaccatgttggccaggctggccttgaactcctcacctcaagcaatccacccgccttggcctcccaaagtgctgggattataggcgtgagccactgagcctggcctgattttctatcacttttattttatttattgtttgagatggagttttgctcttgttgcccaggctggagtgcagtggtgcaatctcggctcaccataatctctgcctcccgggtttaagtgattctcctgcctcagcctcccaagtagctgggattacaggcatgtgccaccacgcccagctaattttgtatttttagtagagatggggtttccccatgttggtcagcctggtctggaactcccaatctcaggtggtctgcctgcctcagcctcccaaagtgctaggattacaggtgtgagccactgcacgtggcctgattttctatcacttttacatgtgcatgtttggcctggatggtttaagacatgaatttgatctaatcagccttagatattttgggagaatatagccttcaaaaatgtttttaaggcatcatgtaattcttaagtattttcaacgcatgcacgtgtgcatgcacataaacgcacagaacactcactgaaaatattctttcatatatatgtaaaaatataccaagtgtgttggtttatcattttctacgtacagcttactggcacaaaagtccaaaaagaagcccttgcaaacatgatttaattttattgacacaccttgcatcaattttctaattcaaattctacatgcaatggttaggattcattctaaactgcttaagtactgtagaataaatttgatagaaggtccttccccctaccacacacacgataatttaaaggttctaggatgggtaaatggctctgctacataactagttatctctgccttcaatgtgtaacttctgtctctaggcccaagaccgcagctgcaattcattttcagctggcagtgaggggaaaaggctttagtgcagggcaagcagctatgagttgtcccagaatttgcatacatcgcttatgatcacttgctattggcctgaatttagtcacgtggccattcccagtttaaagggaagctgagaaatagtctctgccatgagcccagctaaaatacagggattctagtacaaaaggaaggagaaaatggatactagggggttagcaatctctaccaaatcagtggcatctgatgtgtgaaagtttactagtttttccacagttaactcaatctttgtttcaatgaagtataaagaggaatgtcttgttgaacaaggaacctcttcctgttcctttcagaggagagaggcagtaggcattagatagaatcaagaatatggggacaaagaaagaatataagaactatgtgggtttataatccaagctttgatatttactggctctgtgactttgagtaaactgcttttcgtgtgcttcagtttcctcattaggatgataggaaagaaagtagttggaatagggtttgggttataggattcactcagttaatacttattttatctactgagggtaattattaataattccttttagctaatatttttaatgaaatattctgaaactgttattagtatcgttctactatgagaagtacttttcaaagagcagtcgtggccctgttgagttgatttcacctctcatcttctgaaacttttccaacttcatttcttcttactcctcccctgtgattcttttcattcccaacacctagctgcttcctgccttggctcattctgtttcttcctttcaatcccttccagacagttcatactcacaactttttcacactttcatctcaaattattccccaagcaactcttatctactcccactgctggagcacctcaggcttccctacattggagatgcccatttaaccatcctctcttgtactagtttatatggcattctggtctctctggctgacactgttacctgcctcccaaatatccactgctctcttttgcttgctattagaaacccaattttattcaaggcagtgatatgttcaccaagtaaaatgtttactatcctagcctaccatgcagctagagataactgtgcaacagttctggcaaatgagatgtactggtgtctgtttagggatttgggatatttttacctataaaaaagggagacattgttaaaaaaattatcctgacactagttaaaacagtaagacaggctttattcaggagtattgtaatgggtgccaacacaatcacaataggggagctttgtcaagctcaactctgaatacagtaaagacacctggggacttacagccaatgagaaggatgaacggttattggatggaaaataaataactcagagaagatctcaagggtagggggattcttgctaaactgacctgacagcattgttgctgaagacaggccagggtgatcagatatcaaggatgggtgatgaggactttttgatcagactgagatatcaggggacctagttgaaataaagcaaggacctagttgaaaaaagggctcggaattcctacctagagcaatcagacaagagaaatgaataaagggcatccaaattggaaagaagtcaaattatccttgtttacagatggtatcttatatttggaaaaagactccaccaaaaaactattagaactgataaattcagtaaagttgcaggataaaaaatcaacatgcaaatatcagtagcatttccatatgccaacagggaacaacctgaaaaagaaatcaagaaatttatctcatttacaattactgcaaataaaatacccagtaattaaagaagtgaaagatctctacaatgaaaactataaaatattagtgaaagaaactgaagaggacataaagaaatggaaagatattccatgttcatgaattggaagaatcaaggttgttaaaatgtccatacttcccaaagcaatctacagacttaatacaatccctatcaaaataccaatgacattctacacagaaagagaaaaaggaatcctaaaatttatatggagccactaaagacccagaatagccaaagctatcctaagcaaaaagaagagggctcagagagactttgtaaacatagctgttttgctcttccttctaccattccccattcacccccacctttcttataatctggacctgtgatatctgaaactgcagcagtaattttgtgcccatgaagaaatacacaggaggaaaaaagcaccctcgttaaggacggtgtaatgaaaataaagagctggagttcctattggcatcattagtcagtaaacaaatgccagcagccacctgactcttcatttgtcttgtctttgcatttccagctgataaatctaccatttccacatatttcctgtgtccctcccacctcaggtgaaatttctgtcctatttggttccagagttaatattggaagcagaaaatactttaaatttattcctgctttagatcccacccctgactctagcattgacttactctagcaattggcctgacctggcatggggttacccagcactctacatgaggctccagaattgcatcctcaatgtacctgcttcatctttcatctgagatgtgatattctggggagaattatgggcttctcagttgctctctgaaaagatcacttccacctcttacctattttatgtgaataagcttctgagtctttgttttaagcccaagtcttccatgtgagtgtcagtttatagaactggactttttacgctccccatcctgactcctgctggacattggctgtctctgaccctggtctaaaggctggcactcttttccccttgagaatgcctaagagacaccagtgttagccttctgagcatccatgctctttggtttccctgcagacctgtggtgaccccctgctttctcatcctgaacccaaagcatggataaaccatgcataagccatgactggagatgtccataagatttgggctttgtgtgtgtgtttaaaatctagactatgctcagctgttagctcttacagctgctcagttaccccagcagaaggtctgacctggtaggtgattctagtgtcatagcagtcccattgtcttgtctcattacaagaaaatggtcacatcttagctataaatcctttgaaactttgataattctagttacttgggatttgtggtttgtccttttaataataccattgagactctgagggttagttaattctctttttaaatttttaaaaagtgaactctgagagggtatttatgaacatgtaatagtctaataattgttgaatgaatggataatgagtcactaagtccagggaaacctataggtcagaataacaacagtgctttcttttcatatttctgtcttctgaacagcttcagggagtgtggcctgcttgtaattggtaatgaaaataggagactttaattccttccagtgctgtcttgtttgattagcaccacaatttgtgtccagtagttacacggaaaaaaacagttatcttggcatttaagctagtaattccaaatgtgacacaaatgacctggatactgcttgtagtggaaaatacgaaagaggcttaatgtaaaatccaaccttcgaggccttttgtggccacttctgctactcagcatccactcatgcctgaccggcaccattccctggttttaatccacctatctggttcaccagctgttgcttggctcattacatttgacaaggttcccaagatggtgatactagcctccctggtactttttttttttttttaactagggagaagaaagaaatattttcatcttctcattgcagtttttaatgaaacgtctttttttttcttgttatatgtggagtgatgactagtcagtgaaaaagtactggagtgtgaagaaaaagcagcagaaaaaaatggtagaaagaaatggcaagttactatttagagacttaaaaataaacagaagggcccacttagctttcctcatccgctggtcctatctcagaggttgtgcctccatgggctcgagtcaatcacagtttatctgattcattttcagttctttggagacagcaatgtttgaaaattcggttcctttctattgcagaaaagcttttgagccacgccaaacaagggtcctgtgatgaaatccacaaaggccttaaactgaaacctcccaaatgaaggctaaggtctgaagaagactacttcacactgtgggccagtgagtgagccaggggaccttacttcacctttttatttttttttctgtagattctgactctaagaaacaattgagtgttttgaccaacaacaaaaaaatcaaaagtctctaaggacataagcaatagaatattttagtgtagaaaattgcaagcaataaaacaggtaaaataataaatacatgtattccaaagaaaaatacatcaaaggccattacagcaagttacattacaataaacatcatagtcatgtgctgccctgtgttctgatttctaactttcacctcccctcaacatcagccactcatttccatggcactgtctggactactgatcacccagaactactccaaaatgacaatacataacgttccactcctggcccatcacttcctccttccagctctcactccttccatatccctttatccttccacatctggccttatccaaacctccagtcacattcctccaagtctatcagagccccaaagttttgaaccaagatgaaggcaaccttcatctgccttcctggaagctagactttggccactgaatgctgctggagaaagttgcaaaatcacaccaaatggtgctatcacagattcatgatctccaatctcagctggccttccacatggcccaggaattcttatatatgtttagacatcattagctccaacaagggtggcccacccttcacaactctccttaggcccactttaccagttcacttactctcagcaaataattcttctcctgctacatggataaaatagggtcaccaggaatgaactttttaaactctcaccatatctctaaaaaatgttgatctgtattcaacgccaagagctccagagaaagaggcatccctcttcctgttcaagaccaatctctttcctgtcccctgaatcccattcacatcctcaggaacatcttcatctaccctacaggctatttctctccctgacacatcctattatttctactgcagatctcttatttgtcctctctgcttctctgcctttagtaagatcctccttactgcagacctgtaggagcctctcgctggtcttcccgcctcctccattctttgcttctcccaatccaccctcgtaacctatgagtaatcttgcatagcaatactaaaatataagcctgagcagtctttcttccattcttaaaatcctttagaggctccttatcaccattaggaaaaaagttcaaactccctggcatatcatgcccctcataactgggtctttccctaacctctccagctctatctcttcgctgtttgccacctgatgcttctgcaatcaaaaccctctttctctcccccacatactactatcttccaggtctctgcttatgcaggtaatctcttcctgagatgtcttttccctgtcttgtcattcctgattggtcaaaatctttcataaaaggctaccacctctgtgctgccttctctacccccacttcaccttataacactctactctaggttaaatgccttggcattacagtagcatccttctcatgattcttttctattctgtatcatgcctgtatcatttattcatctattaagctgtttatttctttatgcaaattaactacagaaaaattgaaactggccgggtgctgtgcctcatgcctataatcccagcacattgggaggctgagacaggtggatcacctgaggtcaggagttcgagaccagcctgaccaacatggtaaaaccccgtctctactaaaaacagaaaaattagccaggtatggtggtgcatgcctgtaatcccagatacttgagatactgaggcaggagaatcacttgaacctgggaggcggagattgcagtgaaccaatattatgccactgtactccagcctgggtgacaagagtgaaactctgtctcaaaaaaacaaaacaaaaccccaaaaaacccctataattttctacctagatttaacaacactaaattttggcctatattctaatatacatataattctttgatagtgggtttataaatactattttatggcataaaattttcagatagtattataaatatcttttcatgacacaaatcacatacacatcataatttttaatagctgctgagcagcattacattgtatggatattttattaaagccattctccattgttagtaacttagaatattacaaagtttcattattataatctacattgcaatgattatgcataaatatttgtatgcatatttgataaggatattttcttagaatcaactcttagaggtggaatttctgggtcaaggagaattttagatggtgttgggagatattttgcctaatagaagaatcactatatttagatgctggtctgtttctcttccttcccattagtctggagccacctgcaaggtggaaacgttgtgttagttgctatgtccctgggaccacactttaagtatcactgcctcatgtcagagtcaagcatgtcagagattcatgccatctggctgactgctgttctctaagaatagggaaacataaaataggacttcaggatcaccagcgccaaactttgttctactattgtcgagaaaataaatcagcccaacagcatgataaagcagtgtttgaacctatgtgttgaatgggtacatattatgtgaagtcaacctttatgggttgtgtcactcatttggtgattaataaatttttgatcacctagagacatatcttgtgatattaatatacatatatcactagataatatacatgtctccatttttcacaattaagaggaatttcctggaaaatggcaagcattatacttccatgaatgcctataagtgtgtgctcttggcaagccctaaataatgccttagtcacccagataagtctagtcttcatcataaaactactagaaggagggacaggggctcattctgctaatgttttcatcctctgataaagggccagctaagagaatcagctgcctgccatggggagccctcagcacacttgtaaaacagagttgaaggtgacttccctctgctcagcatcactcacaggtggcaggatggtcttggctgtggcagccagtaggcattgtaacatggaaggtcaaaggccatttcagcacctcaagaaaatgcacatttgctattgccacccaggagttcttttcagcactatatcactaatattttgtacatctggtttgaggaagttttctgaatgacacacagcttcccaacaactttaaaggatgatggaattttctttaaaagctagtaacaggaatatggggaaaaggaaattagtgtctggagacactacccacacatcagggttgttcaaagacttttgacttgagttctgcagcaatcaagcactcaaggctcacagttcaagatgaaccccaggctcttagcctaaaacgtctgcaatcacagctgagcatgatgagatggagaagaattaaaacaggttcaaacttactaaatgatgtaaaatcactaccagaaaattatatcccatgaaatacttgaggccaaggtgataactaatcagctcatttctgtaaaatgttttgactcttgcagagaaaaatattaaaaatagtttctgcaaatgttccatctcactttaagagtaacggatgccccaggccctaggtcttctcccacaccactctctactgggagagttgggattctacttctactctccttcccctgcttcccaggctgagatttcaggaagtagtatagtgaaaaaaaaaaaaaaatgagacagttgtaggtcgttaacttttaattgtgcaagtaaagatattgggaaaaaatcctctcatgtactatcactatagttcaaaagcagaggatgttgtaatgtcctagaaaggtagactgaagagaagttcttctcaacttggggcaattgggaatttaagacaacatatatatccctatcatgttgctcttttttttttcttattttacaaaaaatgtgtgaaaacttcataatggggcaacactggcatttgggaaacactcctttagtgtgtaacagcatgttttccatgtttcccaaacacatcccttaaagcagcgttccccaacccctaggccatggtactggtccttggcctgttaggaactgggccacatagcaggaggtgagtgactaggccacagagcattattgcctgagctctgcctcctgtcagatcagctgtggcattagattctcacagaagcatgagccctgtggtgaactgcgcatgcaagcgatctaggttgcgtgctccttttaaagaatcttaggctgggtgcagtggctcacacctgtaatcccagcactttgggaggccaaggcaggcagatcacctgaggtcaggaattcaagaccagcctggccaacatggtgaaaccctgtctctactaaaaatacaaaaattagccgagcgtggtgttgggcgcctgtagtcccagatacttgggaggctgaggcatgagaattgctttaacccaggacacggaggctgcagtgagccgagatcatgcgactgcactccagctgggtgacagagtgagactctgccctaaaagaaaaaaaaatctaatgcctgatgatctgggctagaacagtttcatcctgaaactatccccctaccctgtctatggaaaaattgtcttccacacaaccagtccctggtgcctaaaaggttggggactgctgcctcaaagcactgcatttctgtttccagtctgttctcgggcacattctcctcctgatctcctccccaggcacctagcttcccctgcttactctcatccttttcttcctcctgctattcttttcctctgaccccacggaactctgactccattatgggccaacatctgccttcttacctcttacttgcatttctctccagtccgctcctttaaattatatcccagatatcctgattatacctctttcttagggggtttcaccattgctgagtgtgagagaagggaagtagcaggatcagcccacccagttcacatccacaaacacctgaggagattggcaaggtctacccagccctggggttctgctggagctcacctaatccactcctgaggctgttcctgcttatttttgcccaggattttccggtttctagggagtgctttcacttggtggttcctaggcctacctgtctctccgtttccactacgatgttttttggggaaggtaaattgtaaaactgatagttatttggctgaaaatctggaaaattcaaaataaatgatcacccataatttcacacttaattattatcagcttggtgtatttttttaagcatgcaattttaaaaatgtagccataatcatagcatacatatacttcaaatcttccttttttcatttcatatattagtttttcctccttgttaacagtcttcaaaaacattcttaaaaatagtgttatataccattccattgattgactgtatcatattttatggaaccatctttatatcacatttcttttttctttttcaaattttattttaggttcagggggtatatgtgcaggtttgttacatgggtaaattacgtgtggctggagtttggtgtacaaatgattttgtcacacaggtagtgaacatagtacccaacaattttttttaaccctcgtccactttccacccctccaccatcaagtaggcactgttgtctattgttcccctttatttttttgtttgtgagacagagttttgctctttttgcccaggctgcagtgaatggtgtgatcttggctcactgtagcctctgccttccaggttcaagcaattctcctgcctcagactcccgagtagctgggattgcaggcatgcaccaccacctctggctaatttttgtgtttttagtagaaacagggttacaccatgttggccagactggtcttgaactcctgacctcaggtgatccacccacctcggcctcccaaagtgctgggattacaggtgtaagccactgcacctggcctattgttaacctctttgtgtctatgtgtattcaatgtttagctcccacttacatgtaagtgagaacatgtggtatttggttttctgttcttacattaatttgcttaggataatggcctccagttgcatccctgttgctgcaaagcacaagattttgttagtttttatggctgaataatattccatggtgcattcataccacattttctatatccagtccaccactgatgtgcatctaggttgatttcaggtctttgatattgtgaataacattgcaatgaacataaaaagtgcatgtgtgtttgtggtggaacaatttatattcctttcggtatatacccagtgataggattgctgggtcaaaggtagttctatttcaagttctttgagaagtctccaaactgttttccacagtggctgaactaatatctccagcagtgtttaagcatccccttttctctgcaacctcaccaacctctgttattttgtgttttaaacaatggccattctgactggtatgagatggtatctcattgcggttttggtttgcgtttctctaatgattagtgatgttgagcattttttcatatgctgcttggccacatgtatgtctttaagacgtgtctgttcatgtcctttgcctactttttaatgaggtggtttgcttttttgcctgttgatttaagttccttatagattcttgatatcagaactttgaagggtacatagtttgcaaaaattgtctcccattctgtttactttgttgagagtttctcttgctgtgcagaagttctttaagtttaattaggtcccacttgtctttgtttttattgcaattgtttttggaggcttcatcatgaaatctttgccaaagcctatacccagaatggtatttcctacattttttctagggtttttatagttttaggtcttacatttaagtctttaatccatcttgagttgatttttgtatatggtaaaaggaaggggtccagtttcagtcttttgcgtatgactagtcagttatcccagcaccacttattgaatagggaaccctttccccattgtttgttattgttgactttgtcaaagacaagacggttgtaggtgtgtggctttattttttggccctctaacctgttccattggtccgtctgtttttctaagtaccatgctgtttgtattactgtagccttgtggtacagtttgaagtcaggaagtatgatgcctccagctttgttctttttgcttaggattgctttggctatttgggctcttttatagttcattatgaacttgagaatagtttttctaattctgtgaaaaatgtcattggtagtttgatagaaatagcaaattgctttgggcaatatggccattttaacagtactgactattcctacctatatacatggaatatttttctatttgtataatctctgatttattttagcagtgttttgtaattctcattgcagacatctttcacctcccttgctagctgtattgctaggtattttattcttttttgtggctattgtgagtgggactgcattattgattttactctcagcatggacactattggagtatagaaatactatgaatttttgtacattaatttttgtatcctgaaacttgaccaaagttgaaactgaagtgagtgaaattgagatgtgaaaatccatacaaaagatctacaaaaccaagttagttttttgaaagaataaataagattaatagacttctagctagattaataaaaagagagaagacccaaatacaacacaataaaaagtgacaaaggtgacattaccactgacctcatagaaataacaaaaatccctcagagactattatgaacatctctatgcatacgaattagaaaacctagaataaattgacaaattcctggaaacatacaacatcccaagattcaactagaaagaaactgaaatcctgaacagaccaataatgagttccaaaattaagtaataaaaaaaacctaccaactagaaaaaggcctaggacggagagccagatagccagatagattcatagccaaattattcaaaacatataaagaagagttggtaccattcctactgaaattagtccaaaaaatttaggaggagggacttctccctaacaatctgaggccagaatcattctaatatcaaacctagcagagacacgatgaaaaaaaaaaacttcaggccaatatctctgatgaacatagactcctgatgaacaaaatataagcaaattaaatccagcagtacatcaaaatgtgaatccaccactatcaagtagactttattcctgggatacaaggttggttcaacatatacaaattaataaatgtgattcattacataaacagaagtaaaaacaaaaaccacatgattatctcaatacatgcagaaacggcttttgcttaaattcaacatcccttcatgttaaaaaccctcaatgaactaggcattgaagaaacacacctcaaaatagtaagatccatctatgacaaacccatagccaacaccatactgaataggcaaaagctagaagcattcctcttgtgaactggaacaagacaaggatgcccacttttaccacccttattcaacacagttctggaagtcttagccagagcaattgggcaagagaaagaaataaaaggcatccagataggaagagaggaagtcaaactatctgtcctcatagacaatatgattctatatctagaaaatcccatagtctctgcccaaaggctcctagaacttatgactaacatttctatgacttgaattttttgcctattgtttatccaaatactcatgttccattttgaaatattttcttagcataggtttacagtaatggagttatatggctcaaaggacataactattttttagactcttgatccatattgccacattttgttctgaaaaagctatcctaatttagtgccaccagctgtatcaattagtacgactttcacaatactctttctacaattgggtgctgtcatgttataaatttagctaatttaataatacatttagcggccgggcgtggtggctcatgcctgtaatcccagcactttgggaggccaaggcaggtggatcacgaggtcaggagatcgagaccatcctggctaacacgatgaaaccctgtctctactaaaaatacaaaaaattagccaggcatggtggcgggtgcctgtagtcccagctacttgggaggctgaggcaggagaatggcgtgaacccaggaggcggagcttgcagtgatccgagatcgtgccactgcactccagcctgggcgacagagcgagactccatctcaaaaaaaaaaaaatttttttttaaaaatacatttagctaatgttacacatttagctaatttaataataatttaatatgctataacaaatgttatttcactatagttttttccctgattagtagaatggttatttttccattatttgtttctggttcatcttttataaattatctattaaaatattttc

SEQ ID NO: 862 - DNA, 273517 bp, Homo sapiens
aggccatgaacataatgtatgagcaaggatgataagaaacactagttttgcactagcaaaacaaaacagggacagaataatatgagcagtcataattcctcatcagtttcatttttctatttcaagtgctgtagatcattgatcatgttcttgcaaatacccataaagtctacacattgaagatgaacaattagggtaaaagtgaacataaaacattgatgtaatctgttctgttacccactggaggaaggaacctataaaattatccaaagttttaattacggaggattaagagacttgcccctacaatatcttccaatgttttcattattgaggattaagaaactttccccaaaacactttaaagtagcattaagtggtgaaaaaaaaaaaactgtagagagaaagagatcacatgcctcccacagggtagttgttaaatgagtatttcttaaatttaactgaaaatatataaaaggaaagaaaaaaataagttttctatgaaaaggaaaaagaattcgagatgatcaaaaaggttaacatactggaagacagtgtggcatctgaggaataaaggttggtatcatctactgggcagaattgttttgaaaactggatgagatgtttgcaaatatactcagcaaatgtcacacagtaaatacattgaaattgagaaaaaacactgaataaaagagagaaacctgcttttcactgctactaagtaaggtgaagtggaaaagaggccatgcagttaggatcctctttcttggtcctttcatgatccaggagctgctgcttgtaaagctgctctggggcagacatttcaatttgtctgttttcttgacaacttcagttataagctttgctaatgtttataagttcccattggagaaaaattggttagtgaggattatgaactgaaggaaaatgccttcaaggatgggttggtaagattaggataaattctaatattatacaaaaatagtaagattatactctacatattttataccaaatttatttctcctgtgctgagtacagtaactcataaatcccactcactctgtccccaagcatgaatgaagaacacgagaaaatacatcagggatttaaatgaatgcatttttaagttaaggaactcatatttgacaagaatggcttatgttttaggaaatactattttgaatcaaatcgaagttgaggtgggtttttttcccctacttttttaatcgtggaggaaaaaaaaagccaaacatcaatttctaatggtaggtttgctctgacccttcccattttactctgcagcaaagacctcattcagttcctgaaaaaagccaagccttcatcatggtcacttcagattatataatgggagctgctctgaactatccaagcacaaagcaggtctccaaaaattgctcacatgctaaagcttgatattgtcaggtgtctataaatgcatactgaataatgtaaattggtaacctgctgacaatgcatttgcataaatcaagtcaatattcatgtaataaaatcaccactgagccttttatctttcctagtactgatcattctgtagctagtaaagtcctagactaggctggtaacttaaagttaatgaatggaaagactggcatcctagaagaacaactaagaaaaacctaatagaacttagtgatgagaagctagttctcaagaggaaaaaaaccaaaattaggaaaaagaaaatgacaagactcaacaattccacaaagtgagcttttcaaagtccattctttctcccacattattattgtccttatgtctaacaagtactctgatgaacaacatatcataaggctccttgcatttttcacagtataaaggggaaaaagccatatagctcttacaaagttaaacccaaaagacagtcagaccctgagagtcaaacaagtaaaatggctttggccttaaatcaaaagctaatagggcctgaccacataagtctgaccctttaatagtattctctcctagcttggcaacccaagtgagaaaacaaagtgttgaggttatctaagcctgtgtgaagacactggatgctgcattcaatgttagctacagctatcacattgctgagggaaagttacattaaatcagggaaaaaactattgtcactaagtctagacttttgttttcagagacaagaaaatgtgaaatttaagcatcaaatatgatatcacgatgtatcaagaagacttgaatatttttggtaaatatttacagttcctaccacagttttagctccttcatagcggggggtcttatactttagtgttgtctcccactatttaggaggtgctcagaaagagagtcttcactgattattaactcagcagaactctcaggatgtaaactatagactaaaagtactcacacactgatgccgtatttgccaaacattaaaaggaacaggcttgttgagtgttgctacaaagagtagaggcaggtcaaaagacaaaaactaccaggaaacagatgaaaagccatctaaagtaataataatagtagtcttatgagacagtaaaatatctgccaccaaaaaaaaaagtggtttttaatccaatccacttgcttaaattatgatgtcaaggtctggtactcaactggctcgttcataatatctgagtgaagcctggaaatgtgcattttcaacaaacacagttctcatgtaggtagaaaacaacatgtaatcctggctaagcaactgtaccttagcaaacctgtgaacagatttcctgagtttggtaaaagcgacttttttttttcaagatggagtcttgctctttcacccaggatggagtgcagtggtgccaactcagctcactgcaacctccacttcccgggtcaagcaattctcctgcctcagcctcccgagtagctaggattacaggtgtgcgccaccatgcctgactagttttatatttctagtagagatggggattcaccatgttggccaggctcatcttgaactcttcacctcaagtgattcatctgccttggcctcccaaagtgctaggcttacaggcatgagccaccaggcccggccaaaagtgacatttttgaactgagggtcatgtgaaatttaagtctttgtctctatgagattatgtagttgggtaaaataaagtaacaaccagagcaaaaacaataacaatagtaatacaagaaacctaaaaacatatattacttgagacatgttatagtaccatttttaaagaactcaggctctggatttaaaatgacctggattcaaatcctacacaatttactagctctgtgaccttgaacaaataacttaccttctctcagtcccaatttcttacaacagttagctaacagagaaattatgtagagtaacactgtgttacataacgcacactcaaaattataaacaatgaagagtaatggtacaaatatctaaacaaatctgacaagttttttggtaaaaaaaataaattccaaaagtaaaaaagccccataatctcattaacttaaaatacatatgtggccaataaacacataaaaagatgttccacatcattagttatcagggaaatgcaaatcaaaaccacgagatactacctcacatctactaggatggctacaatcaaagaaatagataataacagtgttgatgaagatacggaggaagtgaaccccatacactgctggtgagaatgtgaaatggagcagcagcttccgaaaacagtttggcatttcctcaaatgcttaaacacagagttaccatataatccatcaattctactcctagctatatatatatgagaattgaaaacagttattcaaaaatttgcaaacaaatgttcataaaagcattattcataatagctaaaaggtggaaacaatctaaatgttcatcaactgatgactggacacataaaatggggtctatccatacagtgaatattattaagacataaaagggaataaaaagtagtgatacatacaacatgatgaaccttgaagacatcatgctaagtgaaagaagtcggtcacaaagaaccacatatcatgtaattccatttatatgaaatgttcagaataggaaaatctatagagacataaagcatattagtggttgctagggacagagtgaatggaggtggcatggtggtgacagctaagggatgtggggttttctttgagggtaatacaaatgttctaaaattattctgatgaatgtacaactctgtgaatatactagaagtcattgaattgtatacttcaaatgggtgaatcatatggtatatgaattaaatttcagtaaaggtgtttttaaaataaatatatgtaatatatatttgcacaataaaaaatatagtatatatagttattttcttctaatattggattttccccctagaagtagctccttatcaccaagttgtataggtttttcttagtcattcttctataatgttactctttcctttccatttcatatgtaaatatatatatgtgtgtatgtgtatgtgtgtatgcgttcatatatataaagaaggaaaacatccctctatagtacagctctatagtatagtatccttctatagtacagctctatagtatagtatccctctatactacagctctgtagtatagcatccctctatagtacagctctatagtatagtatccctctataatacagctctatgatactcttcatgcccagcacctgttcctgtggtaaactgcttttccctccattctatgtcattctagtacggctgtcagtcacatgaaatccccaaatcccactcctgccacagaaactgcacaggaatttctgccaatgaactgtctcagctgtttatagttccatgcttccaggggcctatttattcggcttggcttttgattctgtgatataaccacattttatctaataaatcctcttcttattttgcttagataatctctgagtttaggctgcttgcaattacaaaactccatttgatatatactctaaactgttttaatctcttcacccgaagtaatgctatgaacaatttgctgttaatcctaccacagtattttctatgcatatacaactacacatccacatatatatcttatcataatactatacatagtattaatgtaccataattgattttagcatccttccattaataattctaacttaacttagttttacttattcatttttcttttaaaatcaaggggaatacggagaatccattaaaaaaaatcatgttaaaatccaagaaatatttatggaatagacttggtagctgaagatcgtgttttttaacacaactttagataatataaaaaaaactgaaatataatctctaatcaatttttgtttacaatgtagtttggcaggtaatatagaaaaattataaaacaattatatgtcaggatgtaagcaaaattgcatgataatcatcttataccagttgaagccatgaaaattcaattcaattttattaaatgtcaactgtataatgttttctgatatgtggattgtattggcactcaaaggaccacccaaaaagtttatagcttagcatacttataatccagttagtcaacattttataattgtcacaaatataaaaattgataaaacttccagcaaatttaaatatatttaagacaaaaatgttcatgacttttataataatacttcacatttattagtacttactaaatcttattatctaaattatttttcaaagcaattctatgaagcaggtattgttataatcacccaagggcaccgctgtagttgtaactggcaaatcagagaactgaagtcaagtctttctatctctaaaatccctttcttaatcaatatctgttatatcaaaattattttaatgactaaacagttgaactgaagagtgtttataatatccaattgcattctcacatcagtattaacaaaaaagctgttagcaacaaatccattgtctgaatcagctcaaagacttattaaacttgagatcttcttgttacatgataagttgcagtatcaatttcttcagctctatcatgaaggtgaattcagattaattcaagccacctagctgacttgcagtctttacaaacataaaaacaggttagtatactctcttaagggtgtagttattctgcatgagaaacaggtatacaattccataagaatacaagataatttgaaacatataataaccatgttgttacacagtagaccttcccatatttatgcatatttaattataatatttattaaaaggctaatgagaccattttgaaacacatttactgaaaggctaatccagtagtagaatacaatctgtttatcaactgaagaacacaatacgtgacatttgtacactgtaagagaagaccagaattgccaataaaatatcattgaaaacttcaagtaacccttatggtaaaaaaaaaaaaaaaaaaagtcctattaaagataagaaacatcatgtacagtatcacttcctctctcctacaacataattcaaacttaaactgatatgtaaatgaaaatttatattccagtcaaggaacgtacccaatgagagtacataaattatatatgtattatgcaagataatagttgttacagacatttcatcaaaagccattttaaaaactgcaaaatatgtcaagatgtttacatggtgaaatgaaatttcataatatggcaccttaaaacaatctcacattagattgctgcacctcagaaaagcactattgatatttcactgagccaaagaataatcataattcccttatcaagtgaatatagtggaaaggaaccaggctgaaagtcaaatagaaacaccattttctcaaataataatatattattaataatgatacatatctgaaggcttaagtttcaagatccgaaaattccagaagtataaaatgccacatattatcaaactctaaataacaaaattgtctaacatgtaactgcctactatttgctcatcaagtaaataagaactcattttaagattaagaaaactagcaagtcagttcgagtctgcaatttttagacgaaataacattcatgaacaactttattttctaacattaataacagatttcatacatccacgtaagtttaggtaaaaataaaatccatgtatacattgcaagtggcaactgttctccatagccaattcagtattatgaactatctaaataaaaatcaaaagtaagttactagaaaatagtaaaatagctccatcgaaaactcttctgtgcatattctgcaacattaattaacttaaaatgattaaatcactgctaatttatttgtcaggaaaaaataatattttattataatatctaaaaaatttgaaggcacttcacagtattacgtctttttgttaacaccatccaatggtatatttattagttgtcatatgaaggccccgccatgagagtttttaaacatttattaagaaataccctctatattcaaagttagatatttaatatctttaaggaatctgaaatagattatatattcattgactcctacaacatgcttcagccagataatgatcgtttgtcaaaatatgagcaagctaatcgtgtgatcctccacacacagactgataacaacactcagaatgcaatagaagcaaaactattcacctaaatggacatgaaaggactagtgctagggttcagattttttttctttaaaattttagtcccttgaaatttaacttcttgaattaacatgcagctattgaaaaagcagcagatatgtaacaatatttttactaacagctattccctagggttccttaattataagcagcagaggtatgcaagatggaaatacccaattaggttttcctggaccaatttagcttgtccagctattgaatattttcacaataaatagtcacagttgagtttgagagagaaaaattagccctttagttagcactaaaactagtctaaaattggccatctggcttgtctctgatatactctgatatcatattgtatcatcagacattgtaaaaagaaataccaggcataaactgctaaccttagaatacaatttaacctcagtattctccacaaaaaagtaacagaatctgtttctctaaggtacctgagttgattctaagtgaaaaatatcaggttattctcactactatctattttccatgtttccagaatgagagtgcaaatctgagcaccgtatttaaaaataaatagatctgagaataaagaaaaccatgttttcacccagatgcctgcatttccatcaacaagtgctgaaacaccacgcgaactgttgtagctgattaacccagcatatttctaggaagtacattagtttggtattagtagggtgcaaagtacaaaggtcagagagggaagtagagaagggccagaccacatcacaccttacagcagatactactaagctgagatttttttgacctgtaagacatgggagtcactgaaaaagtgaaaacagaggagcaatgtaagcagagactggatgagattttcactctgctagcagcgtagagctactttagtgaatatggtattccctagccacgtgtctactgagcatttgaaatgtgaccatgaccacaagttgaaagaatattctggataaactagatcaaataaactatattattataatcaataccacctgtttatttttatttttaaatgtagccactagaataggtaaaactgtatatatgccttgtataatacatctcaattggacagtacttgtatagatgaaaaactgtgaggaggaaaatacactaacaatgatgagaacaaggtagactattgcaatcgccaaggtgagagaggacagtctcagccagaatattaagaatggagaagaacaaaagagaaaagctcaaaagaagaaagaaaagatgcaggacttggtgactgactgagtataaggagtcagagagaaggcatttgttcattcattcattcattcaaacacatcattattgcatgcctaggatatgcaggtaccatgatggttatactataatgagctaaatggaagtcggaaatgcttaccaactctctggtttgagaaactgaggaaaggctgttatcacccattgaaatagcaaacaggaaagaggaacacttttattatcatcaaatgtatcaagtatgaagtgtgtgtaggttatttaagtggaaatgtctgggaagcaattggatgtcatgatctgaagtgtaacagaaatgcctacgctgaagctagagaatatggaaatagcagcagacccataaaagggtttgctccaggagaggttgtagagtgataaggtcaagggtccaagacagaacagtgacacaaaaattctgaaaaggagagagaggacagacagcaagttcactaacaaatagccatgtatgaacaagaaaaattcataaagagtagaatcacaaaaaccaaaacagaagaactttttaaggaagtaacattcaatagaatcaaatacaaaagaaaagtacataatttcagagaagcattgaaaagtatacacaatgccagaaaaaaaatcaaaaagtatttggcaagtcagagatcactgatgaccttcatgaaggcgatcccaatggtaagaacaagcaggactgccaaagactccaaaaggcgaaagagcaaaggagaggcaagaaagaccaagtataaacaactgtttctaaaatcttaactataataaaaaaataataaagtagtgagcacagaatcaagggatggtttggggtattgtcattttttattttggacatgagagagacctgagcatgttcaaaagctcagaaaagcaatcagtacagaaaagctgattaaaggggcaagaaatggaataactaatggagcaagagcctgaggaactgggagagaagacctagaacacagatggacaggcaaacctgaacagaagaaagaacacctcttcgtccagaaatgaaagtgaaggtggctcaagaggcaaagataaattcagaagcaggtaagaactctaggttctgtattaaaatattactcaggttatacagtaattaccgggcacctttagctaacagtagctgcaaatgtggttccatacttccaaggatttaatatttatagcaaatattcgaaagccaaggacacagattcatccaggtaggggagagtcatctttaatctactctgtggccagtcatctatactctactacacaaaaaataaacctgtgagaaatgattgccattagtcatggaggaagaaaatgtagactagagtgattggggacagggaacccacatatctctctacggtttctatctatgcacatggaagtagagagactgaagagaataaagagggtttctctcctgtctatataaccctaattagttccttcccaaggcaagagtcatagttatcatactttgccacagtttaaaccttttagatgaagttattgtgctttaaagaaatgagcccagattccccggacttctactctgcctgtttctgggagtggtaggcatgcctaggcaggatctggtcctccaggctgagtggtcataattattttgtgtgattaaaaagaatctcttggcctgcccatcctcatctctactctgcttcagtgtctccacctacaattgaatgagtgaagagtattgggcttcactggaccagaaaaccgagctacgcctacaaaaccaagactcatggttcaacactcctcattgaaaaagtcagacattgagggctatccagcctttgtccaccttttaaacagtactttatttccctgttggcttctatacatttttataaataatgcatcagtccagaatcccagaaggcaggaggggtaggtggaggattcaataatcaaaatctcaccttgaacctccaaaaaccctagtgacaaactaaaatgtgcactaagtttttctgcctctttctttttcatttttctttttctcactctgcccctcctgaaatccccctccttccacttttatatgttcaagcccatgaatattcagtttatatgtcaccttatcaaggaagttttctctgacctgtccagttacatttcagtatcactgcctcatctatgctcttgtgtcttatttatatctcaattaagcacttggttataattagttatttaattgtatctcccagccaggtgaggtggctcacatcttcaaccccagctacacaggacactgaggtgggggaaacatttgagatcaggagtttgaggttgtaatgagccataactataccagtgcactccagcccgcgtggcagagtgagagcccccatctctaaatgatgaagaagaaggaggagaaaggaggagaaggagaaggagaaaggagaaaggagagaagagagaggagagaggagaaaggagagaggagaaaggagagaggagaaaggagaaaggagagaggagaaaggagaaaggagagaggagaaaggaggaggagggaaaaggagaaggaggagggaggaggaggatgaggaagagaagagggggaggagggggaattgtatctccactaggaaatcaggtagagattgctgaattcagctttgtatctcaggccttgagtacattgtcaaggttggtccccactccaagtcacaattcattcctacttctcccaaactcctaaagcactttgtagggcagaaactgggccttgctgcactctatcagcactgcccctctattattgaaagaagacagaaagaaggagatcctgaaggcctttgtataataggtaaaaatcttttgactcttcagccaatcactgctccatttggcctctagctaaggaatctcttaagcagcaagcaaaaaatatgattcataaacaagtgaaaatgagtcacgtagcagtaaacagaactggggccagaaaggcagctttggagttgtccccattcatttcaaaaagagcattttacatactttttacatatttacattttatgtatttttttaactggataaagttaggaaatacataaattgtactaaatttagaatttctaacttgattaataatgacaaaacaccttataaagtatattacagcacacaaagtacttcctaacacttccattttatagttgaggaaatgaatttttagaaaaattaggtgggttctgtaaggccttattcatcaaccaataatgaacaaatgcctattttgtgcaatgcactgggatttcagcagccctgccctcatgcacctctttcttatagggaagacgtgtaataaataaaatgtatatgtcaaatggtactactgggaaaataaggcaaggtggaggtgggggggcaagggtacagttttgaataagatagccaaagaaggcctcactgacaagtggcatttgagcaaaaagggggtaagaaagtcaagtggttggtaccctaacctgaactattaaccaaatcttggatttgcattgcttacactcctttcaatacagcaatttgccctttataagagaaaaagatgctgacattcaggaaagcagcaggggaagcagtatcctgttctctacattttgggcacattagaaaagtggttcagaaaatcctgtacaagacccatagcgctaccctaggccgaagtgagtccacaaccacacattcggatactccaaaaagatgccaagtggtccttttcattgacaggactagcagtatcactccaaatggtaaaatgttaaagttgtaactagagaatgtttgatctttttattgctgtttttaaaggcagatgtcctgagtggttcattgtggtttctaccatataaacgtcattttactctactggttacttggctgtcataagacagaaaatgagctgccataagaaaagctgatggaaaaggaaaaaaattacaaatatctgatcccatacccaggtcactgtcttcatctaaggcataatttatcttttccaatgaaatatgtgtacatctcaattaattatccacttaccctctactaatcagaaataagatttggttcagtaaggcggggtgaaggaataaactcaacctaccaattgctccacatgaatttttttttttaatagaggcagggtcttactctgtcacccaggctggactgtgcagcctccaactcctgggcttaagcctcccgagtagctaggactacaaccacatgccaccactcccagctaattttttttttttaagaaacagggtctcgctctgttgtccaggctggtcttgaactcctggcctcagacaaacctcccaccacagcctcccaaagcagtgggataataggcataaaccaccactcccagcctgctccacatgattgataaataacctgatataataatctagacaagtcaatctttgctgaataaataacttccccatgagtaatccttcctatgcccagttttccccaatccttaatatcattgctctttttagactcatacattcattcacttaacaaacataaactgaatgtttaagataaggcaaatactttgtatgactggttttctatttgaaaatagagtgtgtgactatacaaatacatatatacataaaggtacatcaatttatatacattggccctatgtaacccccatttgagaatatttctaagcatgccagctactcaaattcaagtgtgaaggtatgtgtatttgggtgtgtgtgaatgaatgtatgtgagagacaaaggcagacagagagagggaatggataagaagcaagtaaagttacagcagacaaggacatgaaaactcataaaagactcatgataaactgtaaatacatttaaagaaaaagaataacacaagccttcactccccttccctgtgcgatcataatcactgcccatcaacttctctgtccatatcatgtgtgctccctgtgttccttgaaggttatgtataaccaagatctacctttaatgtgtttggcaaaaatatctgtgccataaactattagctgacaagcaattatattctaccttgtaaaagaaaattaggcataaaataaccccacaaaaagaagagaatgactgtttcacaaaagaggcaaaagagatttaaacaagataataccataagtttctatctcaccatccattaattttaaatttgattttgcttcttatatcacatagcacttattcaaaaatagcagaagaatacttctatctatctgttgtcctgtaaaaagaaaagaaaatactattatttgtatttcttgttcaaacactctaaggataaaagtactgttttcaaaaatgatgaggttcctgcagataacatttacccacaggatttgaggcttttttgtgacataaagtgcagagtactttgaggatggttacagatgcaatggcacagaaaaggcttttaactttggctcatttcctctgaccaccatgtctccattctaaattacaacctctcaagctacagatcctttaaaactagcttttaaaccagctttctgtggtatcatcacaaaataagaacactttgttacttgaaaataaaagcacaaaattattggactcaataactgttctcattattgcaaaccaataaacaaggttcaacaagaactcgttttagctattgcttatcaagctgccaaaaaataaatccaaaagaaaccaaagaaaaacctgccttaacaatatagatggtttcttattcataaactatctttaacatcaaaaatggctagcatgtatgccagtgttattgccttgcataacagaatcttaagctaagcactaaagttctgtcattcacatctagaataataattttttttacaaaaactaaaatacggccaggcgcagtggctcacacctataattccaacactttgggaggccaaggtgggcagacaacgaggtcaggagatcaagatcaccctggccaacatgatgaaacctcatctctactaaaatacaaaaaattagccaggcatggtggcgcgtgcctgcagttccaactactcaggaggttgaggcaggggaatcacctgaaaccaggaggcagaggttgcagtgagccaacatcacaccactgcactccagcctggagacagagcaagactctgtctttaaaaaaaaaaaaaaaaaaaaaaaactaaaatactaaataaccccatttttaatagaaatttgttttatgatataacccataccaaatgctacctgctcagccaaatcacttttagagtccacacagccctttatatctaaaagaaaataataaaagtgctaggaaacaagaagtatctgggccagttacccttggttaggactgagaaattagctggcacagacagcaagaccgggaccaaatattcaaccagttggctggggatagtgggttgaggtcaaggagatgacccatacagctgtaaaattaagtataaaaaggggaaattgggcaaacaaataaatatactgaggataatgggagccaggttttctaatgttggagaaggaacctacaagtacaaaaaggggaaggaagaataaaccctgtcgtttggaatcgaggagatcagtgggaacatatatttttagataatcactgatcaatagatagatagatggagatgtatatgtatatatgtacgtacatatatacatgtaatgtacatatgtattagtccgttttcatgctgctgataaagacatacccaaaactgggaacaaacagaggtttaattggacttacagttccacatggctgaggaggcctcagtatcatggcaggaagcgaaaagtacttcttacatggcagtggcaagagaaaaatgaggaggaagcaaaagcagaaaccccggataaacacatcagatctcgtgagacttattcactaccacgagaatagcacaggaaagaccggcccccatgattcaattacctccccctgggtccctcccacaacacatgggaattctgggagatacaactcaagttgagatttgggtggggacacagccaagccatatcaatatatgtatgtacatgcatatatgtacatacatatatacatataatgtgcaaatctgtatttcctaggtttgttcactgaaaagatctagaagcaaagacacctcagtagtaaagagcaatcttagacccagtagcaaagagcaaccttagcatccactaaaagaaaccagaagtctttggtagcgccagggctggggcaagaaaagtacaagataagcttgaaccacaccttttaacatgaggaactgagaacatagcatcgcttttgtggtaataatgcccaaaataacaacttattcataaggaaacatcagataaacccaagtagagaaacaaaacatagctgtactcttcagaaatgtcaaaatcattaaagataaggcaagattaatgaagattccagattgaaggagagcaaagagccagggcagctaaatacaaggcttagattctggacatataaagaacatcattgggacagttagtgaattatgaattgaatctgtgtaatagacggtaatattgtatcaatactagtttcctattttggtggttatactgagattatgtagggaaatgtccttatttttagaaaatagtcactgaagtactaagggagtactggggcatcatgtctccaatgtactctcaagccaaaaaaaaacttcaaaataataataatgtgtaatggtaagaggagagggagggcagattgagagagagagagagaatatgataaagcaactataataaaattttaatattgaaaatttgagtgaaaatcatatcagttctttgtactattcttgcaatgtttctacaagcttgaaatcattgtcaaatgattaaaaaacaaagacatgtttggccttaaatgcccatataactattaagaaaaaccttaactctctatgaagggccacaatctgctctgaattttgaatataaaaaagtatgcttgtgctagaggctaatacagcctatataattctaagggcactaaacaaataaaataaggatgttaaaaggtgtcttgaacgtgtctaaaatctgtaaaatgttaattctcacagaatacttggcttagaaagatgatgtacattggggaattataaatataaggataaaattgcaaaatttccctgatagtcacaaaataagacctatgtagacaacagtatgcatcacccagatcccccttcaaagaagcactcactcatggcccatatatgggcagtgcagtcagtagacagccgccaggtcagtagacttcaacatcgccacagctgcagagaaccgccctcccttggggtattcgacatcctcagacagggcaggggtaacttgagacaactctgaaggccacactgtctgagggccccactggcttgtctagggttctgtcaggcctgcctcacagtttggcttcctcccctgctcaatcctgtatctttcttcttcctttccccagggatgatccctaaaatacatctcacaccccaaactccatctcaatgtctgcttctagggaacccaacctgccacaggacctcttttgtgacttgacaaaacatagcttgatataggcacattttataattttgtcttgtgagtaggtaactttatttcctcaaaagacaggtataaatttttttcaggtaaattctgtctctaaatctcatccatttaccttctcatgcggtgtgacagaaaaagtgtactttccccttttcatgttagccaaatataaaagataatcattgtttaaacaacaaatttccctcttatggtccattagctcctgctgcttgttcctgtagtgaaatagaaatacaacaaacgatttccatggcaataggtaataatctagcaaatgtgaatttccgacttagcaacagaacaaagcaagaagaaattatggaactgcagtggggctaaatttcaatttctgtgtatttttagtatcacattttaaaacaaaaaagcacaaatgcagacacattaacacgtaactatgaagaataaaattctaattataggataaattcaagagacctcaataatcaacctgtaatatcactccttacttcactactaaaatatattcaactaacataaaacaccttaccttacaaatttgagaattcttacacttatttgaaagcctattatctactataatagcagtcccaattactgatatatcctgttattttcatttttagtaataattataaacatggcttattgctaatatgtaaacgaaagatgttcaaaggactaaagaatctctaggaagcacaggaatagaggaactggaaagactgcaagcatcaggagcagctctcttgctgatactccattagtcaaggctctccactcccttgtggaacatgcagcaccctgtacaggctactctctagtctgcacctgctcttcttcccacccctgagcttcacactcaccaagaggggttgttttgttcccacacttattaccatttcttcttgttatagtaattatatagtttaattatattattcacaatctgatgaaatatgagtgcagaaaggattatcgtatccaagaaagtaagtacaacgctttgcaaagatttgataaagatgaatcactaaaactatgaacaaattagatatgggcaatgttagactgtggacagttacagaaaaaataattcaaatctaggattctacactcagattgctttgtaagtgtcttaaatttctgcacttttaaataacccaacgtgaaaattataggtaatgcactgccttcgttttatacagaatgactatccaaagatgcaaattttttaaaataaaaagcttcagccttatacaatcagaaaaatggcaaaaagacaaacaactacgataagagtatgagttcaaggaaacctgaatagaggtccttaatatatgacaacacgaccatacctctctttcagttgcctccactctccagatgggattcctgccctctgttctaaaggatgacattgagcactgcccgccttgtccttgacctcagatatgcacttcttcaatcttaggctaactcttctcggttggcaacagaggttcagaaagtgtctccttgcttcaatgtcctctcctacctttgtatatgcaaattcttcattaccagcttgattgcatttatatccagcatacagcaatgtgcaaactatattttctctttggctattagcgacccaaggaggacctcagacaacaacatacttttagccccaaagtcacatgggcaatcacatttccaatcttttaagcacccttccaatggatatactgtctaaccaggaaaaagattaactggaccagtcaagtctctttttcctattctagccacatataaatgatcaatgcccccacccactggaaatgtacagaagctacaataaaaagaatttcctgcccagggccaagaatttatagatttagattctaaagcatctgatgtgactacttttttattttattgccttaacttccttagctacaactgaacacacttcccatcaacctattacttctttacctccctccagttttcctggcctttaactcaatgcctctcctaagtatgcttgagctgtgtttactcaagccacctctgacatcaagtgagaagtgtttttccttctaacaccaaccaattctgacacaaactcgaagtcccataattcaattaattctgataataacaaccaggagttagcatcagaatttttagtgctcagtcccacaaatcaaggtccctaggttacacacacttctgtccaacttggctataaagtctgaggtgggagggtcctcccctcacttcaggttcagtaatttgctagagtggtcataaaactccaaaaaacactttacttaccattactggtgcattaaaagtaccacaaatgaagagccagatgaggaggtaaatctagtgaggtctggaagggtccagagcatagtagcttttgtccccatggagctggggggtcccacccacctggcatgtggatgtgttcgccaattataaaagtctcagaacccaagcatttaggggtttttgtggaggctgcattacataagcgttattcattaaatcactggccatcagtgattagctcaatctccagcccctttgccctccccagaggttgtcacatgagattaaaagtcccaagctgctaatcaaggcttggtctgttgggcaaccagcctgcaacctgaagctttttaagggcccaccaagaataacctcactagaacaaaagatgctctcatcaccctaataactcaggaaattccaaggatttctgaagctctctgctgggaactggaaacaaaaaaagaaatatctttctacactactataatgctttaatctcttttttccactttttcacagatcttacaagtgaatagccagttacttgttccctggctctgcaacagctctcctcccattaccttttgtaaaaaacttgtcccatttctctttcccttccttcctccttcctcaagttttgcaccaaacaatgtgcagaatttagaacactgcatattttcaattaaattactctattgtctgctgtgctcagggaatatctgcagtctgtaaactctgcatgctaggaagagctatttaatcttgctcctgacattttacgtaggagggaatggtttacaggctcagtgtctctagaaagaacactccccaaggaacaacgtatttatttctcaatgttctttttctgttttactcttaaaatctttcctaccaccatccctcacgcccaagagtacaactttgaaatctaatgtataaaactagcagaaattaaagtttatcctatacttacattaaaagctactcctacttgaagatatgcagacccctccaaatccttcttttgattctctgctcacataagtgggttttatgtacgtgtgtttttttccacaaaggagaggcccaaagatagccaagagatcaggattggaacagtttcttaacatcatattctcacattttcaaaatttcctcctttattagtgataaactttttaaaaactgatttcaaaataggaaacagttgttcatcagtctgctagtctcactttcaccaatcaacatatttcattgatgataatataatttttaaaatattttatcatctctggaatcaagatatatcttacagtcgataatatcatagtttaactgacaatatttttgataaagtacatgaagaaatactttatcataaatacataagacaaagataaaataaatgacacaaagatgaatcttaggtttgataaatatattaagttcctctctcaacagtttctggcttacctcagatataacctatgtaaagcatttagcattaaatgtagtataacagattttcattgctgccatcattgatgacatcaacatcatcaacatcatcatcatttctaaacaaataacaaaagtctcagaaacaaatatgaatcaagttagggttctgatgtgttctccttattctatttcttttctgagtgccatttttgtttgtttgttttctatcctaattttctaaatttttcatttgtccccatattaaaaaactgtaaacactctgatggggttatgtaaggttgtgctaaatgacttagctcagagtattcaagccgaaataagttagttctttcatctcaaagaaataagtaaataaataaagtaataaagttctttcatctcaaagaactttaaatatccgtccctgtcactagctaccaaatcaaaaacctaggaatctcattggaaaatagactataagacaattccatggttatgagttttaaaagataactctaatcgatcatcctttttttgtacttattttttgtatatttgtaaaatagtagttacatgaagcaaatagtatcagtgtaaggcccattcacttttcaggctactcgacatgcagaaatggtggccattgatcaggtccttgattggtgtcatcgaagtggcaagggtctttctgaagtatttgaacacactgttatatgtcactgtggagctgtgcattatgtgtgcagctgttcgccacctgatgagtatcctttgacttcatgagttaatgtcttgtaccattcatgtgaacatgagagtggccaaacatatagcgcagcaggaagcagagggcagctgtgacgggactggccagcagtggttaggatggtgaaaacactaagaagccaaaggagtcaagagtagtcagacagagcaggtgtggccaattgcctcaatcatctttttctttcaaccaaaagtatcaagttatattttctattttttcttccacatcactcttctaccctctgccatttttttctttctccataaatggaaacctaaaatgtatttctaccataattagaaagcaatcaataaaaaattttagtccaattttgttcgtgtctccacacattactacatgaactcagttttactttatactgtattataatcatttgagcaaaatttctttatttcttgtaaatgaatgtgctagtataagaaatatctacattttaatgaaaatcatagtacaggtacaaaatttctaaaagtgagaaaatgaagcaaacacaatacagctttttggtacttttacatatgtaatctttctttattctgctgttgatagtttttgcctttcgcccatttaagtaagttaattgaaagcatagtataatttaatctctattgtactaaaaatacacaactatctatagtaatattattctgccacattctcaaaaaaactattgggcattaattccatctggactctccactaaataagcattagtaaacaaatttacttaaactataaaattcatattactgaatttgcatatatccagagtgtctgaagaagagaaaacaaacatatgagaaaaagctcatcatcactggtcattagagaaatgcaaatcaaaaccacaatgagatgccatctcatgccagttagaatggcgattattaaaaagtcaggaaacaacagatgctggtgaggctgtggagaaacaggaatacttttacagtgttggtgggagtgtaaattagttcaaccattgtggaagatagtgtggcaattcctcaaggatctagaactagaaataccatttgacccagcaaacccattactgggtatatacccaaaggattataaatcattttactataaagacacatggatatgtatgtttataaagacacatggacacgtatgtttactgcagcactatttacaatagcaaagacttggaaccaacctaaatgcccatcaatgataaaccggataaagaaaatgtggcacatatataccacggaatactatgcagccataaaaagaataagttcatgtcctttgcagggacatggataaagctggaagccatcattctcagcaaaccaacaaaggaacagaaaaccacatgttctcactcataagtggcagttgaacaatgagaacacatggatacagggaggggaacatcacacaccagggcctgtggaggctgtggggcaaggggagatatagcattaggacaaatacctaatgcatgcagggcttgaaacctagatgatgggttgacaggtgcagcaaaccaccatggcacatgtatacctatttaacaaacccgtacgttttgcatatgtatcccagaacttaaagtaaaataaaaatgaaaaagaatagataaatatagttagcaaattatatgtatatatacaatactatcataacaatatacaatgctagtctgtagtttgtaactttttctcataaaataaatgaagctttagaaaacatttttcactgggtgcggtggctcacgcctgtaatcccagcactttgggaggccgaggagggcggatcacaaggtcaggagattgagaccatcctggctaacacggtgaaaccccatctctactaaaaatacaaaaacaaaattagctaggcatcgtggcaggcgcctgtaatcccagctactcaggaggctgacgcaggagaatggtatgaaccagggaggcagagcttgcagtgagctgagatcgcgccactgcactccagcctgggcaacagagcgagactctatctcaaaaaaaaaaagaaaacatttttcactataagaaaataaaatcacttataatagacatatttccaatatttacattctctgtagtcctctagtcctttatctagacatatatactatatttttcaaatactggaattatagtatacatcattttgtaacttgcttttttgtttgacaatattataggagcactttcaatattcatagtcttcgaaaacatgatttttgaatggctgtatgaatattccatcatttgtaaatattgtagttgattttgctaacccaccactattggacagttactaccataataatgcagtagcgaacatccctttatctttgctctggtctctgatttatgtcttggaaaaaaattctaaaagttgaaagtaccaagtaaagacatgtaaatactgtcaagccttttgatgcctaccaccaaactgttctttctccaatatctataaaagtacagtttaaagaaaccatcaatattgtgttgctggtatgatggatgaaaaagtatgtctcatttaatttcatgccatttcatttacaagtaagattaatcactttaataaattcatttttcattttcttttttgaactatctgttcatgacctttgcctattatccttcggatgtatttgctttttattactattttgtggctgttttttatacaggagtgatatgtttgatgttgcaaatacttttccaggttctcattcactttatcatttcatgtttttttgacatataagagactttcattttgcataatcaaatttgttaaacttttccttcattatatgtccctttggttttatatcgaggaaggcctttctgggcctactatgaaataattcatttatactttcttctaagtattttatgacttacatttaatattatttctatatttaacccatctgaaatgcattttgtatacagaattggagagagctaatcatgtttttttcagacaaaagtattttaacacgtcaagtttaaaccataaacacttttcggattaatttttttccataagtttttggggtggaggtggtatttggttacatgagtaaaagaaaactactgactgatatccttgatcaacacagatgctaaactccttaacaaaacactagctaacctaatccaacaacatatcaaaaagatagtccaccatgatcaagtgggtttcataccagggatgcaggagtagtttaacatacacaagtcaataactgtgatacaccatataaacagaattaaaaataaaaatcacatgatcatctcagtaggtaagaagtattcgacaaaatccagcatccgtttatgattaaaactttcagcaaaaatcgacatacaagggacatacctcaatgtaataaaagccatttatgacaaacccacagccaacataatactaaatggggaaaagttgaaagcattccttctgagtactggaacaagacaaggatgccccctcccaccacttctcttcagcatagtactggaagtcctagacagagcaaacagacaagagacagaaataaagggcatccaaatcggtaaagaggaattcaaactgtcactgtttgctgaaaacatgatcatttaccttgaaaaccctaaagactcctacagaaagctcctagaactgataaaagaattcagcaaaatttccagatataagattaatgtacacaaatcagtagttcttctatacaccaacagtgaccaagcagagaatcaaataaagaactcaaccccttttacaatagctgcaaaaaaaaaaaaaaaatacttaggaatacagctaaacaaggagttgaaagacctctacaaggaaaactacaaaatgctgctgaaagaaatcacagatgacacaaacaaatagaaacacatcccatgctcatggatgggtagaatcaatattgtgaaaatgaccatactgccaaaagcagtctacaaattcaaagcaatctccaccaaaataccaccattattcttcttcacagaattagaaaaaacaattctaaaattcatatggaaccaaaaaagagcctgcatagccaaagcaagactaagcaaaaagaacaaatctggaggcatcacactacctgatttcaaactatactgtaaggccatagtcatcaaaacagcgtggtactggtttaaaaataggcacatagaccaatggaacacaatagagaacccagaaataaacccaaatacatacagccaattggtcttcaacaaagcaaacagattaatttttttttgacccagtatctctttctgttgcccaggctgcagtgcaatggcataatctcagctcactgcaacctccacctcccagattcaagtgtgcttcagccacctgaatgcctgggattacaggcatgcaccaccatgcctgcctaatttttttatttttattagagacagggtttcatcatattgcccaggctgatctccaactcctggtctcaagttatccatcagcctcagcctcccaaagtgctgggattacaggcatgagcctctgcacccggcctagatgtattattaatgcattattattaatgtatcctttcatactaacaacacctaagttgtttttaacatgtactaacatttcctaccttttaaacatgtagtagtatatcctatcatttaaacatgtactagcatatcctatctttaggctcctttaatatagagtcaaggttctccttctccttgcttcccatgctaccagcactataaagtaagagaatcaacaaaacatcctatattataaagagtagtttgacgttttggctctatgtagaacacatcaattatatctataatatattaatttaaaaagtgaactcaattcctctagctattgaaaaagatttgccccagaagtcttttctgagtccttagtcccactctccatctgaatgtgatacctctcctgtgtgttttccaagacctctcaacgtatctgatcacagcccttatcaccttatatttctgacttactagtcagtcccccaactaaaccaaaagaatttcagaagaactatgtctcagatattttatcactatcacctagctcatagtaagcagtctgtaaatatttgttaaataaatgaatgagtacaagactacaagacttttaattcctttcaggcctgccagtgactaacgattgcaacagtgaataagtcacttaacattttagactgtggtgaacaattcagaaatcagtaatttcttagcacaaagatctcttaagatttttcaatctcaaaattctatgatgacatgacctgtatccccagaaaccaattttacacaccctgctgctacatctcttgcttggtaatattcccctatccccaccagtctgacccttccagacttccttgaccttctccagcctaccccactgtccatttaaaatgttctcaccttgtgctccttaaggcttttctatggatcagccatctatatctgtagtctgaacaacagtgcattttactgtaccttccccatgttaaatttgtgtgtagatatactgcatggcttattcagaagatatcggtgatgtgaaatgcttaggtgtgaggttaaaaaggagctctcaatctcttgcttaccccatagacttatctttggaaatgcgtatgacattagatcaatgactgcatcctactctaaaacaaaatgcctcaagagtattagtattattttataattttacaacttttcttgtttccataatgatcaacagaagtgacatgattttgcagtcatgccaaaaaagaaaaaaaaaaggattatactgataatctcttcccaaatatattctggtgaggaaaggtttattttgttgctttttgctttttgtcatttccttgctctagtttagttgtttttaatatttccataaatgttgggagtaagtttactttggacagaacagatttgcttctatttttaagaatttgagagcatgtggtgagattgtttatcttgttgaaataccccaaaaactcagcctcttgatctaaaatgcaatccaataagttataacatgagttaaggttaatctgtaaataaaatacaattccaatttgctagtgaatacttacctgtaaatactaaagacagtattttaactcaaacattttctgattgccaacctattctaagtgttatgggggagcaaaggcaattaaagtcaattttctgcctccaaggagtgtattctgattaagacagacctgtgcttaactaacaataacacaaggcagaatatggttctttaaagaaaaacaaatcctgtagtagcaaaagaattttagcattaaaataatatatagataagtaggattaaaactgcagttctaatacctttccaaatttcaatgtacttctttgaataagagaaaaattaaccagtcatgtcctttccaaagaaacactacagattacacatcctgtagcactctggaattatgggctctgactggtagtagactactacttctgttcaagaggttctttaaatattcacgaagtctgattgagaaaaatgttaagcaagtcatggtcatactgagcaattcaactggtaaaccacggactgcatagctacgttcaacatcagatggaaggaataacttgagaggctattaaggaatagaattaggaagactataggctcattattaaaccattatttatttagcactgccaacattccaaacacagtggtaaatgcaagactggtgaatacaatccataaaaatattctctgagagactgtttatcatgttataaattcaaggttttaaaaaaataatagaagccaggtagggtggcatgcatctctagtcccatctactcaggaggttgaggcaagaggactgcttgagcccaggagttcaaggctgtagtgagctacgactgtgcttgtgaattgccactgcactccaggctggaccacatagcaagaccccatctcaaaaataataataataataataataataataataataataataataataatattaagttaggaaaaagcaatcctccattcattcacaatgtacatgtcctatatattcaaattaaaaccaagcaaaagccttctgttctgaaactaactttctatgaaacgcccaacttgtattcccagcaatatcaagtttccttattcatctctatagattacctcatataatgaaatggaatcatccttttccagaattaagatgctgcttttatcactttacttgctcaaaaaccttaaaagctttcatttacagatgggcacggtggctcacgcatgcaatcccagcactttgggaggctgaggcaggcagatcacctgaagtcaagagttcaagaccagcccaggcaacacagtgaaaccccgtctctaataaaaatacgaaaattagccaggcgcagtagcatgcaccagaagtcccagctactcgagaggctaaggcaggagaattacttgaattaccaggaggcagaggttacagtgagccaagatcgcaccactgcaatccagcctgggtgacagagtgagattctgtctcaaaacaaaacaaaaaaagcttcaatttactataaaatcaaattaaaaatcctcaaggtggcattcaagaatctgcatatctgtatattaaaactatttcctaataccttcacaatggaaattttctgttccagacacattgccttcatagtccacgaacacattatatatatttatgtctatttacatctattctttcttttctttctctgagacagggtttcactctgtcacccagtctggagtgctgtggtgcaatctcggctcactgcagccttgaccccccccccccaccccgccaggctcaggtgatcctcccacctcagcctcccaggcagctgggactacaggtgcaagctaccacgaccgtgatatggtttggctctgtgtccccacccaaatctcatctcaaattgtaatccccacatgttgaggaagggacctggtgggaggtgactgtatcacagggcggtttccccatgctattctcgtgatagtgagtactcacgagatctcatggtttaaaattgtttaataggtcctcccccctcactctctctctctctctcctgccaccacataagacatccactttgccttccaccatgattgtaagtttcctgaggcatttccagccatgtagaactgtaagtcaattgaacctcttttctttataaattacccagtctcaggtagttctttatagcagtgtaaaaacagaataatacagcccaggtatatatatatatatatatttttaaacagggtctcactttgtcacccaggttggtgcaatcacacctgcaatgttggtgcaatgtaccaggttggtacaatcactgcagcctcaagtagtaagtattcaaaatatatgttttgtttaaagggggtcaataaaataatctaagtcaactattttatttattacacatgaagaatcacaggaaaaaagttaagcagctattccaaattacatagtttgaaagctacatcccaaacacaaaacccaatattttttgggttgtaaagaatcctgcagaggattgtgaaagggtagaagtgaggatccctttctgtgtaatattgttaaagttgggatcctttgattacatgatagcttgaattctaaatacagagatgccatcagttaaatataaaataatattggggcaaaattagccatgccacttggaagtcttttgaaaggtttgtgtttatttttctaacctatatattactgtaagaggcatacttggaacaacccccccacaaacacatatactaattaactaatccagcagcggcataacacacagggagttttatcctttatgaaggcctggcatatgcatcacatttaacacagccctagctcacagtactttatctacttggctagaaaacaaatggccacagaaattcatgctagtcaatccattttttatatattttggagtaaaaaggatgtaaattcatctgagtagataactagcatacaaagaattcaggttgagtgtgctacaattaaaaatggtcaccacaagaagctgaaatattaggagtgttcaggggcattactgagagtcttcaagcaaaaagggttttcccagctgtcactgtaattacaatgaaaaaattttacttcctaaggatttcatctagaacacattatacataacagaatatacatgcattcaaatgtaatagacacataaggaataccaattttgactaccttcttcccacaaatcacaagcgacctctgagcacaactctcaagacttttaaatgctttctggaactctttttccatttagaaataagtaactacatacaacagttcacggaaaactcaaccacttaactatttcagtgaaaacaggtagaaagaaagtctataaactatactttttatccatttgaaaaaatttaaatttggaaaggaatcacttcattcttaaggtcccaacaccctaaaaataaagtttattctaaattttcacatttgtcaaagacaataatatcaagcagtagcccacaattccctaaaggaatgatgtcaattggtatttcttaaattaattcagtgacctacagtaatgtgagttcttggtacataatgtctgtcagtaggcaatacaaaaatttcagaatcacttctggtgtctgaactccaaaatgcaacccaaaaaatgtgtctaaagtagttccttaattcctacttcaccttgcatctgttacttatagcaacgtcagaaaaataaaaattacaccaggtgtagattgctagaactacagttctacaaattaaatacagtacaaatttaaccaagacttctggtaacatacaatcagttatctttctgagctaagacattacaagtctgtaactccttttaccgactatggtttagtgagtttcacatgtgcttacacagctcatttttagttacttactagacaatgtgcaatggtgtacttttataaaaatttcaaaggtctcaagaaatggaaatactcaaatttaaaggatttatctgttatctctgaactctctttctctgcttttactgctcccaagtatacaggcaccacgaacacagagaccagctaaaagttcaggaacagaaaattccaactacatcatcttaacaaataaccccacacattatagtttaaaaatagcatatttgaaaaaaatgcactaaaaattattattagaacttcacactcaaatctctaaaaagttatgaacattttatattgtaatacacataaattctaaagaatatcaaagtataatatcagagaaacaatatgtgtaagattataaaagattagagtattatctgtttggatttttacatgaattatttatgcacttaaaaacatagttgaagtgaggagaaacataaatgataacctaatcacattctctgagtttccctcctaggtcactggctgctccttctcattttcctgactcccattattcctaacctctaagtgttggactaccctaggaggggtataggacttttgtctttctctattcactgtctaggtcacaggtcagtaaactctacctgcagaccaaatgtagcttaccacctattaatttttataaataaagttttattggaacgcagccacacccattttcttaattattgtctacagctcctttcacaatacaaggtaaaaattgaatagctgcaacaaggactagatagtgcttctgatcctttacagaagaaaaattgccaatctctgtctaggtgatctcactaaggtgcatagctttaaatataatgtatatcctgaaaattacccaaattctatcttcagtcctgactcagatatgaatgacaacttctctacattatatttggatgtcttataggcatacaaatttaacatgtctaaaaggtaaaatttgctttctaccacccctgccactcctttgcctcttgtatctcaatacacaatttccattcatccaattgcttaggccaaaaacttcagaatcctccttgattcctctatttctctcatactccatatcccagccatcaaaaaagtacatctttaaaatatatccagaatctggccacttctcagccactccaatgctaccaccctaactcaagtcacaaccattttcacctggactattgtagtagcctccttactgggtccctatttctgttcttggtcccttacactcaatttttacagagcatctagagtgatcatggaattccattactgaaaacacttcaaaagccatgcaaggtgtggcctcttgttatattctacctttcctccctcttactgactctggtcactccccacatggtcttttactgtcaagcatggtcctgccttagatctttgcatttgctcttctgtctggaaaagtttcccccaacttatctaggtggtttaattcctcattttattcaggtctctgatcaaagattacctcaagttagaggtcttccttaatcactctctctaaattagtgactcctatcaattctatatccctgttaataggtggattccctagaaaacaggctctaagattctgggatttgcatgcattttggggagtgcccttaggaacaacatctgaaagggagtgaaggaagcaggacaggcagagaaagaagctgaattgcagtgtggttctaacagaggtttaagccacaggaacctctgcagtgggtatagtttttgaaaattatcccacatgaggaaaagagacagggtctttgagccgacatatacataatgaaattcccagtatccccagagttggggtgtaaccttgagtaagacacataaatatgtgttttagggaaatgcaaattaaatccaaaataagatactactttacacacactaggatagctaaaatcaaaaaagataaaaaataacaaatgttggtgaggttgtggggaaaatagaaccctcatacactgctcatgggaatgtaacatggtacacacagcagctccggaaaacaggtttggcagtctcttcaaaagttaaacataaatatatcacacaactcagcaataccatacctagaaatctgcctaagagacatgaaaacatatatctacggaaagaattataaaagcatattcatggtattattcataatacctaaaagcaacacaacataaaagtctagcaaatggtgtgtggattaacaaaatgaggtgcatctaaacaaaaaataatattcagcaaaaaaaagaacaaaatacagatacatactgtaacatggatgaacctcagaaacattacactcagggaaagaagccaacacaaaagaccatttattgtgtgattctttttaaatgaaatatccagaaggggaaaatcaatagaaatacaaaatagattactggttgcctggaggtaggggtaagaaataacagtaagtgcaaatggccatggggagtattttcaggatgattaaaacattccaaaattggattacagtgatggctgtacaaccctatacattcactatatcatcaatttctatacttagcatgagtgaattttatgaaatgtaaattacatataaataaagacataaaaaagaaaaataaatattactggctgattcttaaattgactaataataatggtgacaataactactactcactgaaaatttgcttaggttcaagaattgttctgagtgcttcatttgtattaactcatttaatcttcaacacaatcctacgaagcaggaactattttattcctatttcagagatgagataactcaggcatgggaaaattaaatagcatgctcaaggtcatagaactaaatatatattaattaacttataaaaataaaacattctaccttaaatgctaagcaacagcacttatctaaaacaaaccaaaaaagtagaagataataccatatgtgtacatacatggtaagttccctgtaagtagcgtatttaagattttccaataagtgaccaacttgcaacacttctgattatctgtatagccattgaaacaagtaataagtataatatttattataagacagcttggccagtacttggtgcatattcagtgagagacttaattactgtagacaaatataaagaatgctcatgatctaatctactgaatcactatgttcatacagacacagaaatatcactatgggtacacataaatacaactttattctgcaacagtcacgcataaacacacacacaaactctaagtcacacaatctctataataaagatttttctagtgcatcatatcacagaactgcaagcatatcattttgttcctgtaactgaaatgtacaatgggacaagatgagatgacagtgtgttttatctttttcatatgaaagttcagtaataaatttcacatggcagtaagccaatatgaatgaaatacttggagatactaacttctcatgtatctaccaataaaacactctcaaatttacagatacccctagaaaagacagctgataaccacattgtatgtagttaatattttttttaaatatgaaggcatataaatgatcagcaagcctgacatttagatatttgacaacaatgtattttaagcagtctaataaaacacaaagcacagatgtagaggaaggaagatatgtaactaaaaccacattcaccttcaattcctttgcagactagcactgaaaaacctacatcagcactttctgtctagatgatatattgatacaaagctagaataaaaatggtgataaaaagtaccatttgtaattgaaaataaatgttgctaagtgctgacaagcttctgtcagttaaattgtttttatttagaaatattttgcatttcctctattattcttaagaaactttgtaattaatttttgttccaaataatgtttttgtgtattgattacacaaactagtaatatttacatttaagacatccatttaaagttgaagaaaccatttcataatagaaagccaattcctacccttaattctcttaaaatttaacgtccacctagaaagcaatgcatcagtaataaatttatgattcaatatggttatcagcccacagctaaaaatttgcagatctgtataaccaagcatattaaaagtccccatggataacatataaccatgagtaactctcataattcaacatgcactacagtaagaaccattacaactgcatgttttcattgttaggtcccaatccatttttaaaagaagctgtacatgtacatcaccaacttgcacatacatgcaagtaaaattaaattacctaaagggtatcttctgaaaaacctgagagttttttttaagacatcagtataaccttggttaaataatcttatggtctctatataaagatttgaaatttctgaaaataaaaacatacagtaacataaagcttgcttctaagagtagccagattcaatattcagatttagaaaaattacattcattaaatttaagtgaaacaaataattatgctgaacttctacaggattgccctcaaaatcctatacataactagaaaagtggacaaaatatataaagctatttcagatagtggaccaatggcagaagaggcatgtgattattaacaaaagggaaacaaatcaggtgatatctaagactgcccctattccaacctagatgcaaagtccaaactgtggtataagaatggggaactcagagcctcatggtccaaataagttgagaaacagattagagtttgaagacactgggatggctggaatttgtgggacatattaaagataaaaagaacgctatgcagagattggcataagaatactcatgaggctttgaataggaatctgtgctgcatagggtgaaactccaagcagccaagtgaaaaatagcaggaaaagatcaatttcaggggagttataaagtgaacaattccaagaatgaagagcccttgttgttgaatacccagagtattctgtagagactccagaaagctcatgccttagtagtgagtctaaactagctctaaagattaccctagatcatccttgaaaagcacaaaaatagccttgaaatgagcaggctgatctgcaaataatttaaatgcctaccaaaaaagtggagggtggtggggagagagaccatttaaaagaaaaaccaaaatgtaattagtactacattagtaaccaaaaagaaaaaccaatgtaaattagtatgtacattgttcaaattcagctgaacaatgtaaatactaatattcaatgcctaacagtgaaaaaaaaaattagagacagacaaataaaagggaggaaaatgttgcccacaactaggagaaaaatcagtcaataaaaacagatccaattaacaaagataacaaaattaacattaaaaggccttaaaacagctattaaaataagttcaataagattaaagacttaaaggaaatatgaacataacgagaagacaaagagaacatattgagaatcaccaaattaagtgtctaaatatttaaaaatatttttgatacgaaaatgttgcagataagacactacagaaaatatcagtgaagctggaaacatagcaacataaattattttaaacaaagtatgaaggaagaaaatattttaaaaataaacagtcttggtaacatgtgagggcaacaacaatctaacatttttataattcaagcactaaaataagaggaaagaggtcaagaaaatatttaaagaaaacatgcccccaatttttctgaatttaataaacaatatcagcctacaaatccaagaagttcaacaaagcccaggaagaataaagaaaaaccatgacatgatataatcaaattgctaaaaaaaaaaaaaaaaagtaacaaagaaaaaaatcttaaaagtacccagaaaaaaaggcacataatataggagtaaatataataacacatgtcttgtcagaaattatgcaagctggaaggaaatggaatgacattcttagagtgctgttagaaaaaaactgtgagactaaaaatcatacagccagatcaaatatttttcaaaaatgaacacaaaggcaaagatgtcattaccgatatacccaggacctagccaaagcccacaacacccctgaaattctcaagatcaagttcaaaaaaaggggtccccgtgaaagtgaccatcaagatggcaccacctcaccagacctccttggagctcttcgtgtacctgaacgaagtcacgggcaagcacggcatgggctgtattgacattatggagaactgcttcattagaataaagtccagaggtatctacaagaccccagcaggcaccatccttcaacaggctgatttagacatcgaggacttcactatggatcgggaagtgcacaaaatcaaccctgagtgtaaatctgtccaccattgcatcaccaagtcccaggagcaaatggaaggaaaagtgcaggtgcccatcttcaagggccaggtgcacatcctcagccaggagtctctactctctctctacaaggaggagctggtgagcgtcaacgtgcaggggaattatgagccaatcgatgccaccggtttcatcaacatcaattacctcagactgaaggaatatcattatttccagagtaaggtcactgtcaaatagacccatgtacaatggagacctggggcctcctcactttgcagctctcccaactacaggtgctaattgttgtgacgatttgtaattgtgacttgttctccccagctggcagaatagtggggctgccaggccccaactttgttccctgatctccctgaagcctgcaaaattggtcatcaaagggaagggtggaggacaaatgcaggagtaagctataaaatgacaattaaaaaataacaattctaaatatttatgcacctaataatgaagcttcaaaacacatgaagtaaaaactagaactgaaaggaaaaaaaagaaacccataataatagctggagatttcaacactactctctaggtaattgacagaacaaagagaccagaaacagtaaggatataaaatacttcagtggcaccatcaacaagttgacctatttgatatttacagaacactcacccaacaatagcagaatacacataatttgctaatgcacgtaaaaaaattaactaaaatagggcatattccaggccttaaaaaaatggattgaaatcactcaaagtactttctttgatcacaaaggagttaaaacggaaatcaattaaggaacaagtcctgaaatatctggaagtcaaacaatataattctaaataatcaatggaaaaaagaaaccacaagggaaatttaaaaacatcttgaataaaatgaaaacataatataccaaaatttgtgggagaaaactaaagtactgctcagaacagtgtttccccaaatgtgctacacactaaaaatcacatagggagtttttaaaaatcccattgtacctcatatcaatttaatcaattaaataaaaatatctggggatgggagacagaattattaatttttaaggattccccagacaattccaattggcaacaaaatttgagagccactggtttagaagaaattttttttttaaataaacttctacgttaacaaggtagaaaaagaaaagcaaattaaaatcaaagtacatagaagggaagaaataataacaagcaaataatcgaagaaataaaaaacaaacccaaagctgctttttggaaaacatttttaaatgataaatagctagatgaccatgggaataaaatagaaaagacacaaattaacaaatatcagaaataaaaaaggagatattatccagatacttcagacatcgaaacaaaaacagaggactattgtgaacaattttataccataacttggataaattaaatgaaccaattgattaaaagacacaaattataaaactgaatcaaaataaacccctcatcaatctcaaaagtttaactcataattaacaatcttcccaaaaagaaaattcctggaccagatggtttcactggtcaattctatcaaatatttaaggaagaattaaaccctatacaaactttttttagaaaagaaaaaaagaagaaatacttcccagcttgtttatgaagccaccaagcctccaaatccagatagagattacaaaaaaaaaataaaagacagaccaatgtatctcatacatatagacataaagaaagatctttaacaaaatattaccaaatcaaacccagcaatataaaaaaaaaatacatcatgatgaggtttggcttatccaggaatgtgagatgggtttagcatccaaaaatccaatcaatgtaatttaccatattaacagattaaaaaacaaaactatatgacaatatcaatagttacagaaaagcatgtggcaataatccctcagtcctaatttaagaaaaaaaaaaaatctcagcaaagttgaaacagaaagtgtgccagttatcaacctcttgcctgtcagctccaaatttacccttccctgtcctgctttgtgatgtgggagctagaccctgtatcttttctttgccagctgctgtaacactaaattttgttagcagagggtgctggagagaacaatgcaagatgaaggagcttctctttctgcttccgatatgctttgttctcctgtttttcttatggcaatcagcatcacaaagatacccagtgatactcacatcccagcaagttgcagcagcacctccataagcaacttcccagccagttccactagcatcccaagtggtttcctggcaagtcgcaagatgttccaaccagcagtttcccggaaagtttcaaaaacacccccatgagaatctttgcagtgaacttgaccccctcctcaggggctggctcacttccaccacataccacagaagcaagaagagaataaagtacactagaaccagaaagagaagccccttcctcctgttcccctgcaggaagattccgagtgaatttcaatgtcacctctgcaggcaatttcccagcaagtctcaaaaagacccagagggtagcttcctgaatcaacaaactagggtgcatccatgtaatcaaatattagtgagtgatttaaaaaatcataacctataaagccatggaaagacatgaaagagtcttagccagcatactgctgaaagaagccagtatgaaaaagctacatattgtatgatcccaattaaatgacattctaaaaaagacaaaattgtataaacagtaaaaagaacagtagtaggagtaatgggcaggaggaagatagagatgaataggtaggagcatgggatttttagggaagtgaaactattctgtatgatatcacaatgatggaagcatgacatgcatttgtcaaaatccatagagctgtacaacacaaagaatgaaccctaatgtatagactttagttaataatattgtatcaatattggttcatcagttttaacaaatgtacattaatgtaagactatcataataggtgaaactgtgtacagggaaaaagggattatatgagagctctctacaaaaatataaaactgcactaaaaaatacagtctattaatttttaaaaaaacacattttcaaattttcccatagcttcctgtagtgggcagaattctaaggtggcatcccagattcctgcccactggtgcacacactctgaagattcccttccccttgggggtgggtagggctttaagtatgatagttttcactcccagtatgatgttacattatatgacaagcatgaaaagattgtattaacgtaattaaagtcccaaagcagttgtcttcgagtttgtcaaaacagagatgattctgggagtccttaaaagggagtgggtcctccttgaaggataagcctcaaagcttgagagagcttttcctgttggtcttaaagaagggggcctgtataggagccatgtagcaaggacttacaggaggggacctctagagaccgagagcagtctccagacaagagctagcaagaaaatgtggacttcagtcacacaatccccaaaaactggattatgccaacaaccacatgaacatgaaaaaggatcctatgagatcccagatgagattatagcccaggggagaccttgactttagtatataagaacttgagcacaaaattcagctatgcccagacttttgccctacaaaaagtctgagataattaatttatatttttacaagccactaagtttgtggcttattaaacagcaatagaaaactaatacagtctgttaccttcaggttgacaaatcaccaacgtcaacaaaataggctaaaagaagacattttggaattttgtacattttgacaattgaagtgaatttcatagtcataaaaatttacttattttgcatatagttggcatttgatattttgaaaagccaaattataactagtatatatgacacaaccacagcctatagaaaaaaattacacacctgagaataaaatgcaacaacaaatctatcaggaagtaatttaggaataaaattctcaatttcaaagaaatttcacataacaacttaaaattctacttaggattttacaaattgctaccaagtgataattaaatgtttttaatttttaaacatatacaggttttaaacaacaacaacaacaaaaaaacagaaaaaaaattttgaaacctgcaaataaaacatatcatgagtcctaaatttctgaaaagagatttgcataattttccttaattgtacactttaaaatggttcataatattatgtgaacttcatctcagttttaaaaagttaatctgagcattctaaatattaattataattattacatgtagatctacggagaacatctattcccagtttttgtcaacacccaactacgcaaataaaatcaacagcacataaacagaaaatcatcagctatcccattaaagtacatattgaaactttatatacgatgcttgaaaggtcacctgttcactgcattaaaaatttcttccccgtgctaggcatacaatgaataaaatatgcagtctttcagaaaactgtatgtaatgatatgtcatagcagttcacacaattgtactaaacaatatgcatgctttctgtttttctatcaattaaatattcaggaattactgtcaaatgccatgtcatagcatgacagagatttagcccagattttgaaatctggtttgaaccactagaattagcaaactaagcagcaacataaaatattaagcatgtcaaccaaataatccactttccctctgtctttggagatgccttattaaatttcctaagagaaaaataaaagtacttcatgtaaaaagttttaacccctgctttgaaaacacatattttagcccatcatataaggttttttaatatgattggttctaataatcatatttttaaaatcccaaccagaagaagcactttaaaagtattttttcagtttaatatgcacaggtctgccagcataatatttgtccataattaagaaaattgcttacttgctcagtaggcaatacatgaatcatatgtagtataaaattagaccacaattgagagtttaatccctaaacaacatccaaagttaagcagaatatggtatgatacataatacctttaatataattaaatgagccttaattttacataaatatattaataaattagatatatactatccaatacagtaaccataaactacatgtatctatttaaactgaaaataatttaaagtacataaaattaaagattcactttcttagttgcactcaccacatctcaagtattcaacaaactaccatattaggtagcacagatatagaagatttctatcattgaagaaacagtacttatttgacagagttgagtttaccataaaactcatcataaagcttaagcttcaggcctcctcatttgaaaatgtccctgcaggtaccctagcaatgtgtccatgattatatattttagtaaaatttgtaaaagtaagatactttgccaatgaaatatctttctccacttcctcttcttctccaccaatctcctgttgtcgggtggagggcgtcacagtgagcaacctggggatcatgcaaagggtgatatattcagtttgggtgatacattcagaattggtagcacattgtttttagtgggatatatgtaagtggttcttggtcatttctatgtgtaattagtttaccatctgttccagtataggaatggcttctaggaatacatccctttcccaactgtgctaactcacatggggtcctgatatgaaggttcgtagtcagaggtctatgaagacccctcaatgtgtaacctctgtcacgaatgtgtcccatggcaacgagaactaaagatttgtggcaaatgggagagaagcagagactgaaatttatacagccagaagctactctgtggaaaattcttccaataaggagacatgaaatagaataagcagataattccatttgtaatcaatgcctagtcaagttttctcttattaggaatagagttgatagtgcatatacaattataaatgtagcagacatttcttttttctttttgatgggactcacaatgaaatagaacttttcagacactgcgtttgcaaagcccaaatctgcagctgttctataaatactatgtctgtgagtgaagctgcacagtttatacagctcaattatcaataataaaaacaaaatcttcctaaccatagtacaggaaagtccaatttatctttctaaatctataaaaaattatattataaagtcattgtcatctgagaggggctcaaacattatgtatcctatagatgtggaaaaggtagtttaaaagtgtgatcagcagctatttttccaaatattattatgataatgtcactgaccatcttttacgaaattgtaatcagttgtgatttcttttctcattctaaatacatattgacttgtatataaatttgcatctgtaattttgtattttttttaggagggctgcctccaaatggtctgcctcctttcaggtccccaataaaaccttgatctgaccctgatgctagaaaattatgtcttgattaaaatatatattcactaattagtaatctctatgtattcctttcttcatcctagatgtactgcaatatcaataacccagtcacatcattgtcactgaattctaggatttaaaagggtaaatttgaaatacgtcccttctgctcactctggacctaatctgatatcttttcagccttcggtacaaaaagctcacacctcactagcactaatacaaatgtcattcctagtaattaggttacactgagtgcctttgagctttgcagtgctactgccagtgaagttcttaatacatttacagtcatggttatttaaaccactaaggcttttctttgagtaaacaatatattgatcaaatcaaatgctagcctgacaataccaattaatttaagaaaataaaaaatacacaaaaatttctgttatctaattatattgaagagattgctcctaaaacaaacatttgtaaaaccacctttttgtactatgaaaattatatttgtacacatacaaatataaaaatgcccaatagctaaatgccacttatgcaaatagtccctaagttttctttgatttacagtttatttcatactctttatatttcattaagccatccttcaataaactattttttcaatattgtgttgcgaagatattctcagcctgaaattacatcaaataaattacaaatcaaatttctgaaagccactgccataggtggaaatcaaatcaaatgcctagcttcacataaatggttaaagctttaaataaattgcatttatataattgccttacttgctgctgcctcctacagctgtagaataatgttattccaatatatgaagaatatattggcagacaagactaaaaaattttgaattattaattaaaaatgggaagttttattaaatacattaaagaactgaatttagacttggaatacatatattcctgtagctctgtttctctgattaggccctgactgttacacttttactaaagattttttttaaaaggaagaaaaaatttcttacctaagaggatttggagctgtgaaaggaaatgggccccaaaatcactaagctaaagggaaaagtcgatctgggaactgcttaggacaaacctgtctcccgtgctattcaaagtcactcctctgctcactgaaataaatgtgtatctgattgcctcctttggagaggctaatcagaaactcaaaagaaggcaatcatttgtctcttatctacctatgacctggaagtcccctccctgctttgagttgtcctgcctttctggacagaaccaatgtttatcttacatatgtttattatgtctcatgtctccctaaaatgcatgaaaccaaactgtgttctgaccaccatgggcacatatcgtcaggaccaccggagaccttgtcacaggcacgtgtcctcagccttggcaaaataaactttctaaattaactgagacctgtctcagattttcagggttcacagaacaaaatgataatttactgcccttactcaaaaaatattgtcctattcatagaaaaagaaaatgataaggtggtttccagacactggaagtagtggagaagtgttacatagttattgcttaatggatacacggcttcagtttgagactatgaaaacattctggaaatggatagtgaggatggctgcacctgcaccacaataagaatgtatttaatgtcattgaactgtacacttaaagatggttaaaatggtacattacatgttatatatattctatcacaataaaaatgtttcaattgttctaattatatttacatttttatattcattttttctgagattcagcctgaattgaaaagtgcttcattataaataatagaaattaaatacttaagttggtcattcaaactcacaataaaatggagaaaagaaatcaagttttctaagttgtgactctgtgagcactttactaccacacaaattgagagatcacaaaagaaattccgaacttctctgaccaaggacagttgttttgaaacaaataaaaaaactatctgtacaataaaggtacaggtgaaactttcttttttttaaacttcaagttctagggtacatgtgcacaatgtttgcaggtttgatacataactatgcatgtgccatcttggtttgctgcatccatcaactcatcttttacattaggtatttctcctaacgctatccctcccccagccccccaccccccgatagtcccccgtgtgtgatgttccccgccctgtgtccaggcgatctcattgttcaattcccacctatgagtgagaacatgcggtgtctggttttctgtccttgtgataatttactgagaatgatggtttccagcttcagccacatccctgccaataacatgaaatcatccttttttatgactacatagtattccatggtgtataagtgccacattttcttaatccagtctatcaatgatggacatttgggttggttccaagtctttgctattgtgaatagtgctgcaataaacatacgtgtgcatgtgcctttatagtagcatgatttataatcctttgggtatatacccagtaatgggaccgctgggtcaaatggtaattctagttctagatccttgaggaatcaccacactgtcttccacaatggcagaactaatttacagtcccaccaacagtgtaaaagcattcctatttctccacatcctctccagcatctgttgttccctgagtttttaatgattgccattctaactggcatgagatggttatctcattgtggttttgatttgcatttctctgatgaccagtgatgatgaccattttttcatgtgtctgttggctgcatagatgtcttcttttgagaagtgtctgtttatatcctttgcccactttttgatggggttgtttgtttttttcttttttttttttttttttttgagacggagtctcgctctgtggcccaggtgggagtgcagtggcgcaatctcggctcactgcaagctccgcctcccgggttcacgccattctcctgcctcagcctcccgagtagctgggactacaggcgcccgccatcatgcccggctaatttttttttgtatttttagtagagacggggtttcaccgtgttagccaggatggtctcgatctcctgaccttgatccacccgcctcggcctcccaaagtgctgggattacaagcgtgagccaccgcgcccggcctgtttttttcttgtaaattggtttgagtactttgtagattctggatattagccctttgtcagacgggtagattgcaaaaattttctcccattctgtagattgcctgttcactctgatggtagtttcttttgccatgcagaagctctttagtttaattagatcccatttgtctattttggcttttgttgccattgcttatggtgttttagtcatgaagtccttgtccatgcctatgtcctgaatggtattgcctaggtttccttctagggtttttatggttttaggtctagcatagaagtctttaatccatcttgaattaatttttgtataaggggttaggaagggatccagtttcagctttctacatacagctagccagttttcccagcaccatttattaaacagagaatcctttccccatttcttgttgtttttgtcacgtttgtcaaagaacagatggctgtagatgtgtggtgttatttctgagccctctgttctgttccattggtctatatctctgttttggtaccagtaccatgctgttttggttactgtagcattgtagtctagtttgaaatcaggtagcatgatgcctccagctttgttcttttggcttaggagtgtcttggcaatgagggctcttttttggttccatagaactttaaggtaccttttccaattctgtaaagaaagtcattggtagcttgatggggatggcattgaatcaataaattactttgggcagtatggccattttcatgatattgattcttcctatccatgagcaagggatattcttccacttgtttctgtcctcttctatttcattgagcagtggtttgtagttctccttgaagaggtcaccacatcccttggaagttggattcctaggtattttactctctttgtagcaattgtgaatgggagatcattcatgatttggctctctgtttgttaatggggtatagaaatgcttgtgatttttgcacattggttttgcatcctgagactttgctgaagttgcttatcagcttaaggagattttgggttgagacgatagtcttttctacaaatacaatcatgtcatctgcaaacaggaaaaatttgacttcctcttttcctaactgaataccctttatttctttctcttgcctgattgccctggccagaacttccaacactacgttgaataggagtggtgagagagggcatccttgtcttgtgtcggttttcaaagggaatgcttccagtttttgcccattcagtgtgatattggctgtgggtttgtcatagatagctcttttaattttgagatatgtttcatcaatacctagtttattgaaagtttttagcatgaaggggtgttgaattttgtcaaaggccttttctgcatctattgagataatcatgtggtttttgtcattggttctgtttaagtgatggattacgtttattgatttgcatatattgaaccagccttgcatcccagggatgaagcccacttgatcatggtggataagcttcttgatgtgctgctggatttggtttgccagtattttattgaggatttctgcatcgattttcatcagggatattggtctaaaattcttttttgttgtgtctctgccaggctttggtatcaggatgatgctggcctcataaaatgagttaaggaggattccctctttttctattgaatggaatagtttcagaaggaatggtaccagctaatctttgtacctctggtagaattcggctgtgaatccatctggtcctggactttttttgtttggtagcctattaattattgcctcaatttcagagcctgttattggtctatttagagattcaacttcttcctggtttagtcttgggaggctgtatgtttccaggaatttatccacttcttctagattttctagtttatttgcgtaaaggtgtttatagtattctctgatggtagtttgtatttctgtgggataggtggttataccccctttatcattttttattgtgtctatttgattcttctctcttttcttctttattaaacttgctagaggtgtatctttgggacacatttaaagcagtgtgtagagggaaatttatagcactaaatgcccacaagagaaagcaggaaagatctaaaatcgacactctaacatcacaattaaaagaactagagaagcaaaagcaaacaaattcaaaagccagcagaaggcaagaaataactaagatcagtgcagaagtgaaagacacaaaaaatccttcaaaaaaatcaatgaatccaggaactggttttttgaaaacatcaacaaaattgacagtgaaacttttttaagtaaaaagatagttaactatactaatggctacactgagcatgataattattgcagatggtcaatggtaaagcaagtgtagttgtttcagctgtagagataacgtaattaaatgaacagtatagacatctgatcaactttgaataatcaatcttatcacgtataccaacatgccctgttcttcacaaaatccattcacaaattctaggatgtatgattttttaagtgaattctgattcgttagaggttaatgtttacgaatgcaaacagcatctgtagaacctgatttacggtaaggtactttctactcatcacagtatctccaccgtttaacactgttacaacgcaagtgcacaacaaatatctgtttaagtagccaggaaggaaggagagaaggaagaagagaatgagggagagaaggaagatagatgggtggtttcggtagattcttaaaacccatccgttaatactcagtgtttggctgtggtatgaataaaagagagaggctagagactacaagtaattaacagactgcgagggccagtgtcccagactaagccatgctaatttttagatattactcgtgacttttttctctactgacaaaagctcagcatttaaatatattaggtgacacatatatcacaaggtacctgaataacagctgggattcattacatctgtataatcatctatgcatgatgtatagccatgctacttaaaactatatcttaaatatgaagactcttaacagagtaatttcatacattccaaaatatttctcttcattgtacattaattaaaactatattttcaacattttataataaatcattctaaaagccaaatattaagcaattctaccacaaaaccaaaacatttgaaacaatcaccatattttgactttgcaacttttgtaaaatatgtggttatttgggtcacagaattgtatcacatttgttgactaccaggcaaaattctttgacaagtgactttcaggtttacacagtctgctgccattatagcaattatatggcataatggaatgctagccatgtgtacttctgacattcctctaaatccaggtcattagtcattacatgaagtcattttaagtttccttcatcaattgccctctgtagttttccagctgtcatttcatttgttagtttcaactgaaatgtaaatgtaatagatgtaaatgtttatttagggattgcttcccctttctgtttttcacataaacacttacatacttcgattccttaaacacaacatgttttggcaaaactaatctatagtaaagggggaaaagtgagaaatgtggttccctgtgaggtgtgggagcagaaggtgactgagaaggaccatgagaggactttctgggatgatgttaatgttctgtatcttgatagagattagggttacacaacataggcatatgttaaaactagcaaatgttcacttaagatttatatacactattgtatttaaattttacctcaaaagaaaaaaaaactgtaaactattcttgaactctagttaacaatacgcatgttgaaagtatttagggggaagtgcctatagtttactttgaaatgcattataaataaataagatggactgatggatgaatagagggattaaaatatagatagataagataacagaaaagtgataagatatgagtggtgagtatactggtgttcactgtaattgtcttttgacttctctgtatgtttgaaaatttccataataaaatacattttcaaatttaaaaagtcatttctccaaaatccttttaattttcaaattcactcagtaaagaaagaggaatcagcaagtgttcccaaacattttgaaccataatcttagttacccacctgctggatcattcttagatcatttcttagtagtcagaaaaactggtccaaataattaagactcgataaaaatcttgctaaattaatcaaacatataatttattcatctactccttcatttattccacaaatacatgtcaaagacctctaagaagcagatgtctcttctaaatgctacagaaaaagagaactgaattgtaatacaacgtgatatacattaactgctataaaaacacgacagggagggcattttcgggaccatgaagggtgagtaaaattttgccagattgggtacagggagcagaaagttcatcccagggtatggactatcatgtaggtaaccttataatacataaactttgttttacagctaaaaaaggtaaattatatatttctggtagttgcttctcaaatatgtcaaaataatttaaaataaatatatgtacattaatccctcctttttgtatcttacatactgattttagaagattctgcaatcttttcaatcaccagtataatttaggttttgcttattcaccactaaatcacagcaacatgtatttcatttataataattaaaggtatgttcgttcacatttgatggtattaccactgagaggttttttgcaataacatgttttccctggaactcactttgggaaacaattctctaaagtcttgaaatcccaagagtgcatactcagggattagaaaggtttccctagaccaggatgcaaataaaaatgcaaatctttcacacagcaactctgcccccaaaaaactgacaaaggacaaatatcaaagtactgtgtaaattgtctacaatctatttagagactttaaatatgttatgttgtcctttttaaggcatgtggctggtcacatttcctttgatgagtagtttgcctttctaagcaacctaaccaaaattctggcatatgtgagtttactgcaatattatttctttatgatctgcaagatgtggatatcactgtctatctcacatgcttaacgtgaaggttatatgagatttttttaaataatgaaagtcagtgtttggtgtttaataaatagtagtaattaacaataaaaaatatttacccatatacctattcaggcaattgtacaaccatgcttttaaatttgagccaggaactgaggtgagccagaattcatcttattttatgagtatagttacaaagtcctaactcatagtctcattgcattactgatcactttaatgtcatgataatttttcatttgctccctttcagatccaaactccttacttcactgatcacccaagactggtactctttacggagttcgctagcgaagaccttagaattcttttatcatttatctgttagtggctgaggatagaaatatcagtggaccttcacctcaaataatcctctaaaaaaattcccagcgactgagttgggccagaagttcagactcaagatactttgtaatttgtttcaaattattttctgtaggtactatcaaatgatccctaagccaaatgaaatgctttgttctaatgactgaaaaaatcagttaagaaaggcaggattaatattagggcacttcttaggactggacagtgcattataaaagaaaatgaagaacattcagagatccaagagaaaagagacttctagaacaaaaaataaatagaaaacctgatttcatttgttagtacaaataataatgactgtcactatttaacagaaaactacattaccatattgaaatagaaagaagtgagaattcgaagctataactttgagatgcaattaagtgatccaactcaataaaccttaaacagaagactgtttctattcagagtgccagaacagtgtgaatctgggaacaaccttggaaaaggatcttgactatggatcagatattaatctccatgctatgtttccattatgccaaaaaattaagcactcttaatatttacgacagtattaaattataaatctagccccacatatcaaaaaattttaaaatagttacatctttaatgtcattaagagcaaatacagagcctcaggctcagttctattaggtaagttcatatcactgacattttcttcccatgaaacacattggacttaagatatagctatgaatataattttgctggaatactaatgatattcattttaaaatctgagtgctattagtacccactttcaatttttcatctttcatgatacgctcctggtacaagtgtagtctgtgtagcaacacactcatgctgtacacctcattggctcagtcctgtcagcagattgagtgcatttgaatctttatgttcctttttttagaatttgcaatattctaggagagtgattttctttattgttcccttatattgtatttcacccttacagaaaatgatagagtaattagaatcttattttccaaataagtcactctgtcttctttgtctaaaaaatatattttctgtttcacatatagatgataaagactaaagcagtagaaaaatgaataccaaaaatgtcaagagaaatagggggtttcaattgtaattttttaaagtaataaggactggaaaaaaattctatataaaaattgaatgattaaaaatactaaaatggttccttactgccctaaataaaacctttacaagatgcttcatatgtgaaataaattaagaatcaattcaaaagaagagaaacttttttcagtaaaatgggtaaaatcttttaaaaaccttttaaaattttctttgatacagtaactttctaaagaaatgttcaagtgtctatcaattttactttcacgaaagaaatctaactctgctttactgacaatgcagtttattttaaaactagagcagtacaaaaaggtcacaaaaagactttctgaaatataaaatcagtctaagataagcaaagctgaaatgactatctataccacctttccaaacctattaatgcttcaaactatattattatacaaccacaaacaaatatgtacatactctctactagaacatctccatagttgccgtgaatcattctttcattttccataagtacttacaaagctccataagtacttacaaagcagtatagtattcaattttaaaagtgtaaaaataaaatacacagagttttgacaaatagaaagtatcagataaaacgcgaatgaaggctagatggctaggtggatgggaggtgggtggatggacagatacataagtagttggatgaataggtgctcaggacatatgaatggatgaatatggtgctttctatcaaataaaagaacatgcaatccttttttcttctttcattaagtaacacttgtatattaatctaggtgttgcccatgagcttcaagagcagcttcatgaatctctgggaactgcatgtagggaaatgcatgttgatataggtacacacatgtggggcctggggaagggggtaagcatgcctataggcatcaacacaaaaaaaggccccttcttctaatctccagaaacaattaacctactcttttcaaaaactctactttgccagtctttcatctttcagcagaagaggcaaggcctgagtgaaaagtatgatgcctcctctggcttggcagcctaaacaaacaagctttccacacatagaccagggaagcttccacacccacatctggtgctaggcatggttcctgaattcaacagcaggataatacctgtccactatgtaataaaggcactaaaagttagctttaaaaaaaaaaatcaacatagaattcctgatttcatatttatgaaatagcatcctttcacaatagcacagaagaattaagtaaacaatttaaagattcacatctaattgagctccaactcagataaaatagcctgtgtttcttaaattgagactcccacaactaaattttgcctttcaaaggcaaaagaattttgaagaaatggtatcttcctagagatccctttggggaacatttttacaaacacttttcatgtgggcaaaataatttcactagtttgtttattggacatattggcctgtactttcacaaatgcagacccaaaaatcaaaatcagagatggaaaagggcaaacagtattatatagcaagtatgcttggataagaatcaaagtagaaggcttagggtttggctctaaaattagccaactagacatgagtttctgagcaagaatgatcataatgtagtttagttccctttcagtggctattgccacatgtatacaaaacaaacataaggaaatgcatcatattcttaagatactcatcctctcatccatctggttttatctcataaattacaaagtcctatttgaaattcttattataatattaaaattgggaaaagagcaaaattagagaatacataaggtaaggaatattgaaaattaataacaaagtaaagaaatacgtttgaattttttcacaatttctacaatatgcctcctgaataacctaactgaaatatgtctgacaactacagctatggaatctaaaagtaacagaatattattattttccttcctggtaaaaaaataaaaagcatataaatttatacatttttaggaaaagctaaaaatgtcatcaagtatgccttttagccttctttaacttcttttcaaaaatctaaatttataatagatctatagttctgagactatataatcctgttagcctaaaaagagataaataattataaataaaattattgtatttccttgatttatcagactctccatcctcaaaccaaaatccttacttaattaagcagggcaaatataagcaatcacttagaaaagtggtgtgataactattttaaactattaatctttttaaaagtaagcctttttaggagatctaagtagtacactcaaatattgtcttggatgctgggtgcacaaaataagaacctataccagttcatgaatatttttattgttttctcttttacccagggagagaaatagacaaaagacactattaaagttaaatataggctgggcatggtggctgacatctgtaatcccataactttggaagcccaagggaggtggatcacttgaggtcagcagttcgagaccagcctggacaacatggcaaaaccccatttctactaaaaatacaaaaattagtcagacgtggtggtgagtgcctgtagggccagctactcgggaggctgaggcatgagaatcgcttgaacctaggagacagagattgcagtgagccaagatcacgccactgcactccagcctaggcaaaagagtgagactctgtctcacaaaaaagttaaatacactgtgcccttttttatcttgaccacaaaaggtctccatctcagtaataggtatcatacttgcagtacctccgtggcatatgcccaggatttatagatcttttgttagataacaaaatccagataaattaagagagaaaatgcaacctgtggtacaataatacccatcattaatgaacttcggactttcccagtatttcactagtcagtgtaaagagaaattgttgtacgctcatgagcaagtcagtttgcttggtctcagttttctcatacataataaagtattttacacattccttttattaatctataaactctataagcaaggatcatggtaccctaacacccgcccaacataggcagccaaaaaatatgcatgtgcagaatgcaagatcacacaggttttttccagccaactttatcttcaattatataattttttaagtctaatatttgggtggataggtccataatgcatattaaaacaaaaaagagggtggttagggccacaaaaatgtggtagaaataattgaagatcacaaaagaagaaacaatttcctagagttcaagtggcctccatcaaactttaccaaaaccctaccaaaagctctaattctaaactttataaaaaagtcatagaagtataatttctctttcagaagtaatggcttttgttgttgttgctgttgttgttgtttctagttgagacctttgctgaatgtctaagaattggaaaaacaatgaagtcaaacctttcctaatttctattttaagatatttatactttttccaaactttcctcagatttaaaaaaaaaattgtattctttggaaaacaaaaagttagtactcagaaattcatatttggtaaaccactccagtaaattaattgaacccaaagagggggtcatgggaactgcaacttgaagccagttcatcagaagttccagagacctagacttgagactggtagaggaggaatagggaaaggtgcagtcttgggaactatgccctaaacctgtgggatctgacactatctccaggtaggtagtgtcaggactgaattagaggacacccagctggtgtctgctgcttggagtgtgggggaaaaaaaaccccacacatatggtcacagcagtcttctgtgttgatgattgttgtggtgttagagtagaggaaaaacacagttagagagagttttccttaaacaaatggtgtcagtgaagcaagattagctggaacaccatgatcaggtgggatttatcctagggaagcaaggatggttcaaaagacacaaattaataaatgtgatacattgcataaacagaattaaggacaaaacccatatgatcatctcaacagatgcagaaaatgccttcagtaaaattcagcatggcttcgtgataaaaatcctcaacaaactaggtatagaaggaacatacttcaacataataaaggccatatatgacaaacccacagccaacattttacttaatatggaaaagttgaaagcatttcctctgagaactggaaaaggacaagaattcccactttcaccactcttactcaatatcatactggaagttctcactagagcaatcaggcaagagaaaatattcaaaggcatccaaattggatgcctcttcactgatgataagatctagtatctagagaaccctaaagattccaccaaaaaaaccttagatttgataaatgaattcagtaaagtttcaggatacaaaattaatatacagaaatcagtagcatttctatacaccagtaacgacctagccaagaaccaaatcaaggaggcaatcccacttccaacagctacaaaaaaaaagaaaaaaaaaaacacacctgggaatatatttaacaaagaaggtgaactatctgttgtattagtcaattctcatgctgctatgaagaaacctgacactgggtaatttataaagaaaagaggttcaattggctcacagttctgcatgtctggggaggcctcaggatacttacaatcatggcagaagacacctcttcacatggcagcaggagacagaatgagtgccagaaggggaaatgccagatgcttatctcatgagaactcactcactatcacgagaacagcatgggggaaaccaccccagtattagtccgttttcacactgctgataaagacataccctagactgggcaatttacaaaagaaagagatttaattggacttacaggtcaacatggctggggaagcctcacaatcatggtggaaggcaaggaagaacaagtcccatcttacacggatggcagcaggcaaggagagaaatgatgaggaagacatgaaagcagaaaccccttatcaaaccatcagatcctgtgagagttattcactacaatgagaactgaatcatgagtgaaactgctcccataattcaattgtctcccaccatgtccttcctacaacacatgggaattatgggagtacaattcaagatgagatttgggtggggacacagagccaaaccatatcagaccccacgattcaattagctccacctgtcttgcccttgaaacgtgaggatattataattcaaggtgagatttgggtggggacacagaacaaaaccatatcatctctttaagaagaactacaaaatactgatgaaagaaagtgtagatgacacaaccaaatttttaaaaatcccataaccatagaatggaagaaataatattgttaaaaatgaccatactacatggagcaatctacaggttcaacacaatccctattaaattactaacatcatttttcacagaattagagaaaacaatcctaaaattcatatggaaacaaaaaagaccccaaatagccacagcaatcctaagcagaaagaacaatgttggaggcatcacattacctgactttaaattatactacgaggctacaggaaccaaaacagcatggtacaggtataaaagtagacaggtccatggtatagaatagagaacccagaaacaatgccacatacatataactaactaatcttcaacaaagtcaacaaaaatatacactgaaaaagttctatcctatttaatacatagtgctgtgaaaactgaatagcctagccatatgcagaagaatgaaagtggacccatacctgtcacaaagtcttatgttctggtctttggattaggcaatgattttatgaccaagtcctcaaaagccaatgcaacaaaaacaaaaatagacaaatgaggattaaatacagtaaaaagcttctgcacagcaaaagaatcacaatcagcagagtaaacagacaaactacagaatgttttccacaagaaaaaaaaaaaataaccccattaaaaagtgggcaaaggacatgaacagtcatttttctttttgtttttttgtcttgtttgttttttgtttttttgttttattgtttttgagacagactctcactctgttgcacaggatggagtgcagtggcgcaatcttggctcactgcaacctccacctcttggattcaagagattctcctgcctcagcctcccacccaggattacagctgggattacaggcgccttccaccatgcccagctaatttttgtatttttagtagagacagggttttaacatgttggtcaggctggtctcaaactcttgacctccggtgatccacccgcctcggcctcccaaagtgctgggatttacaagcatgagccactgtgcctggctgaacagccatttttcaaaagaagacaaacaagcagccaacaagcagccagtcatgacacaaggtgaaaaatgctcaccatcactattcatcagagaaattcaaattagaagcacaatcatacatttctcataccatctttcaccagtcagaatggctactattaaaaatcctaaaaacaatagatgttggcaaggatgcagataagtgaacacttataaactattggtaaaaatgtaaattagtacaagctctatagaaaactgtatggagatttctcaaagaattaaaagtgaaactaccattagatatactgatcacacttctgggtatctatccaaagggaagaaatcatcatattaaaaagatgcttgaaattatatctttatcactgcactagtcacaatagcaaaggtatggaatcaacctaaatgtccatcaatggaggatttcataaagaaaatgtggtatatatacaacttagaatactatgcagtcataaaaaagaatgaaataatgtccttggcagcaacatggatagaactggaggccattaccttagtaaaataactcacaaagtcaaatacttcatattctcacttataaatggaggctaaacaatgagtacacatggacatacagagtggaacaatggacactgcagactccaaaaggtgggagggtgggaggtgggtaagggtttaaaaattacctattgggtgcaatgttcactattcaggtgatgggcacactaaatgccaagactacaccactatgtaatatacacatgtaagaaacctgcacttgtccccactaaatatatttttaaagaaattcacaattggacaagcgattttaatatcccaaaatacaggaaaaaaaactatgagctacaaattatagaagcagccagccaatcacagctgccacagcttgggcatctcactttcatttagttagatccaccccgggcaacagttcttccagacccttcagtgttttgggggcatccctatactcctgcagtgggccccattcatcaaggatagcagctatcagaccccctatagatgtagacagccagcctagaatttcctccgcatacttcctctctcccaatcccatcatcttggcactcatgggattttcttcaacttattgccatgcataccaggtgtcctgccagacctctgtggacttcaattagatggcactatgtttgagaggccaaagaagagacccagaattagtaaaagagacaacagagtttattaagggaacatatgtactgggcagtccaatggcggaggctggacaggagaacctgtccagtaagactccagaaaaagcaaaaaatattaaaataaaggatttattacataaattatgtcatatccacttggccctctatttaaaatccattaggatattaaacataaaaaccaacaggcaacatggaaaagctttgtttacaaaaaaaaatgacattgggctggaaggaaatacactacactctaaaaaggtatacttttaaccaaacaatgtataaatacaaaaacaaaatttctcagcataatatttcataaactagaaaacttacataaaaatgtattcttaagtaagacagtacggacttgtctcccaagtctttttttcttacacacacacatacacacacacacacacaccccacacatatatgaatactttttaaacattttttctcattatgtaaaaaatcaaaataaagtaacccaaaaatttttaagccctaaatattttattatacttgtaatactgtcactaagttaaactcaaagaatctaacattaggtcattagacaaaactgcactgtgttaatctgtttgcactgctataaagcaatacctcagactgggtaatttataaagaagaggtttattttggcttacagttctacaggctgtacaggaagcagattgctagcatctgctcctggtgagggcctgaggaagtttccagtcatggcagaaggtgaagggggtgcaggtatggcaagagagcaagcaagagtggagaggtgccacactcttttagacaaacagattttgcatgaacttagagcaagaactcactcattatcatgaggaacgcaataagcttttcattagggatccgcccccatgacccaaccacctcccctaccttcatcattgggggttatatttcaacatgagatttggagcagacaaacatccaaactgtatataacgcacttattcttttttaatgaaaatcagtcaaaatatatctttaaaaaaatacatccacagccagacacggtggctcgtgcctgtaatcccagcactttgggaggccaaggcgggtggatcacctgaggtcatgagttcgagaccagcctgaccaacgtggaaaaaccccatctctactaaaaatacaaaattaaccaggcaacatgccacatgcctgtaatcccagctactcaggaggctgaggcaagagaatcgcttgaacccgggagacagaggttgcactgagccgagatcacgcccattgccccacagactgggcaacaagagcgaaactacatctcaaaaaaaataaattaatgcatcccactgctatcacagtttttaaaaacccaaagtgaaaacaaataactgtgtcagactatctttagcaacaaaacgcaaaaacgataacgtctagaaatatatgtaaaataattttaattataccatttataaaagattttattttttaaattaccagttcttttcattttactatttcttctaaaccagccatctggccgctttcaccttacaatgtatggtatctatttttatctgatatattcctatcttatttattgattatctgtctggcccactggaatgtaaactccttaagaaatttttttatcttgttcaaaacccagagtcactacatacaaatgtgtaggttttacacatgtgaatatcattacagttatgcagtgcacaacctgcagaactgaatatggtaggtctggctgtgaacaaataattatcagacatgtaataaaacgccagagatcttaacagttctgtgtcctccctagtggtgatgcaaaccctctctaggcatgcatgccaggaaaagctgttcctcaacattttcaattcctaaatattctttaacattatgttacacaagcatgtacaaattatttgctctttgctattccatgaaatctataacagcaaaatatttctgaggcagaaaccaactcaacggagttacctattaaaggccaatatgaatgaattataatagcagtaaatttttaaagtatttttcaccaaaaatactaaattgtttactattagacacatatcaattatttttaaaataacatgctgacagtctcaaagaatactgtaaatctatatatcattaatgtaatccatttttatgttcttaaacatctaaaattatagaactacatttttttataaactgtcatctcttttttattaaaaaaagaagatttttatgaaaaacctctgagtttaaattactattatattcaggagtcccacacccactgtttccaaacatagctctttttataacaacttctgacaatcctctagagaacaaaaattcacttttaatcaaagttaaatgctagaactgtttcctgggaaatttaattcaaggtaaacaatctacttgatattgtcttattcacacaaagctgtgttgttagaagaaatgataatgaaatataaaacctttctcttctaggttattgtttacaatctggacaaagctgataggcaaaagaaagcagagaaagccaatgtgaaaggaatgtgtaggattagtcacgcttcttcccagaagatagatgttgaccagtaagactatcagttactaaacacagccctctcattctacacccctaacacaatctcttaaaaaagaaattacaacttccaatctccatttgtcaagtatcttgaatttaaatatacaggtcttcacaaatatgaactaaaattcaacaaagttttgtctactatgtgctggacactaataggataaaaatgactaggaaacacttcttgcctcagaggaactttgcatgcaaatgacaacattacttggcaacaaaagaatgtggacacaatgtgaaatcaagccggggtccagcagttagaatcagcccttccttgactacaccagggacatactactacaaatcattctgtcttataccccagcatccagctatcctctggaaatgcttctccctgaagtttacatccttgcttagctatttcactcatctactccacggctaatcccttcatctctgcttctcagaaatggctctttccaatcctcccttccaatctctactccacaattctagtggcccagtctcaagcttcccctccagtgctctcataccttctcaaagctgcaattctagtcctgaagatctaggcaggggaaactggtactcacacattacatcaaggaaagacctcagaggtacacacaccagtggagataccataggttcagttccagatcacctcaataaagtgagtcacacgaattttttggtttcacagtgtatataaaagttacatttacactgaactgtaatctattagatgtgcaattgcattatggaaaaaaaagtacacactttatttttaaaatacttcattgctaaaaaaatgctaatgatcatctgagcctttggcaagttgtaatcttttagctgtggaagtgtcttgcctcaatgttgatggctgctgactgaccagggtggtggttgctgaagagtgaggtagttgtggcaatttcttaaaacaagacaatgaagcttgctgcatcaattggctcttctcttcatgaaagatttctctgtagcatgcattgctgtttgattgcattttacccacagtaaaacttctttcaaaattagggtcagtcctttaaaaccctgtcactgctttaccacctaagtttatgggatattccaaatcctttgtggttgtttcaacaatgttcatagcatcttcaccaggcatagattccatctcaagaaactactttctttgctgatccataagaagcacctcctcatccgttcaagatttatcacaagattgtagcaattcaatcaaatcttctgactccacttctaattcaaactgttttactgtttccaccacatctgcagttacttcttcccctgaagtcttaaaaccctcaaaggatcaacttcttccaaactgctgttcatgttggtattttgacctcctcccatgaatcatgaatcacaaatcccatgaatcagttcttaatggcatctagaatggtgaatccttttcaggaaattttcaacttaatttgactagatccatcagaggaatcgttatctatggcagctatagcctaacaaatgtacttcttaagtaataagactagaaagccaaaattattccgtgatccttgagcaacaggatggatattgttagcaagcaggaaaacactgatcgccttgtacatctccatcagagctcttgggtgaccaggtgcattatcaatgagcagtaatattttggaaggattctttgcttctgagcagtaggtctcaagaatgagcctaaaatattccacaatctatgctatgaacagatgtgctatcatctaggctttgttgttccatttatagagcacagtcagagcatattcagcataatgcttaaggggcctaggattttcagagtggtcaaggaccattggcttcaacttaaagtgaacagctacattagcccctaacaacaaagtcagactgtccttcaaaactttgaagccatgcactgacctctcctctgtagctagagaactcctagatggtatcttcttcctatataaagctgtttcgtctagcttaaaaatctgctgtgtagtgtaggcgcctttgtcaattatcttagctggatcttctaggtaacttgctgcagcttctacatcagcacttgctgcttcactttgtacttacatgttatgaaagtggtttctttccttaagcctcatgaactcagctctgctagcttcaaacttttcttctgaagcttcctcacctttctcaaccttcatagaattgaaggaagtcaggcccttgctctacattaagctttggcttaagagaattttgtggcttaatcttctgtccaaccactaaaactttctccataacagcaataaggctatttcactttctcatcatccatttattcactggagtagcatttttcacttcattcaaatacttttgctttgcattcacaacctggctaactgttcagcacaagaggcctacctttcagcctatctaggctttcaacacgccctcctcactaagctgaataatttctagcttttgatttaaagtgagagacatgcaactcttccttttacttgcacacttgccattgtagggttattaattggccgaatttcaatattgttgtgtctcagggaataggtaagcccaaggggagggagagagatggaggaactgcaggtcggtggaggtgaagtcaagtcagaacctagcacttactgattaggtcgggcatgttatatgagtgtgggtcatggtgcctcaaaacagttacaatggtgacatcaaaaatcactgattatgataatcatagcagatataataacaaaaaagtttgaaatattgtgaaaattaccaatgtaacacagagacatgaagtgagcacatggtgttgaaaaaatggtcccaacggacttccttgacacagagctggcacaaaccttcaacttgttaaaaaaaaaaaaaaaagaaaacacagtatctgcaaagtgcaatgagatgaaacacaattttttaaaaaagtgttcttgtatacaactaactggaaaataagacagtgtaaaactcacatgaaaagctctgcaagtagtccgggcactgtggctcacacctgtaatcccagcactttgggaggccaaggcgggcagatcacaaggtcagtagatcgagaccaccctggccaacatggtgaaaccctgtctctactaaaaatacaaaaattagctgggtgtggtggtgcgtgcctgttatcccagcttctcaggaggctgaggcaagagaatcgcttgaacccaggaagcggagattgcagtgagcagagatcatgccagtggtactccagcctgctgacagagcgagactccatctcaaaaaaaaaagctctgcaggtaatatagtctgaaatatttatcagaggaatgtccaaagccatacagttaagcgttcactgcaaagtagggattcctttttgggagccacttaccatgctccacaaatcaatctcacaatagtctcagtgtaactacactaagtatagttctacttccttagtggaactgtaggaagttatagccaaaaactattccaggttatttgccatttcaatcattggaagtagctatagagacatgtacttgagaacttcatcatttacagttgaatgattttctagaccttccaaatactggattttacccctttcatgaccctttgctccctatataaactttcatcaatgccagaatattgaatgaaatcaccctgaaatcagccatcatatcaaagatggctacaagatacatctcaaaccttcagaaaatggtctgtgctaatgagaaggccgaagtgtcaaccgcaatatgtctgtataggtacctcaaatgtgacaacaactaacaaaaaaaacactctggtacaaataaactagtactggatgcagctaataaagcacatgatactataatgttaaatacatacactaatagaattttctacaattctctgttacgaggtcctttgtaaatcacaggagagtaagtggttttaagattaaatttgcccatatagttaattgccacttcacagcaagtactgtgaataaaaaatccaaattgagctggtttggacctagttacaaataccatttaaacagaacagaaaaaaagcctctatgttgacagggataacaccaaagtggaacacaggcctcatacaaccatctagaatctctcagtttcaccttcgcttcagacatactgaggatttttcatttgagtttttctttccagagcatgtatcacaaacttcaaagataaattagtaaaaatacacacacataatagcataggttgattttatgttttttaagatgaaggttttaaggttatctcattcaatccccttcattttaaaaatgagaaaataaagctccaaaaaggtaattcacacatggctacatgatatatcagagacaataatttctctgttaattacttatacctctgttcaatacagtaatccaaattttcaaatgcaataagttattttacaagcctatcaaaggaacttgctactttaaagacaactggagtactacgaccactgtcttaagagaaggaaaactgagtgggctggttaaggatgcagaggaggataaaatcacagtcactctttgacccaaaatcaacttaatttccagaatgcctagtaagcttgaagcagcttggtgcagctaagcacaaagagctcaaacatttatcaagtctcctctgaagagttctaaatatggggacatcctagtgtgctgctttacatttcttcccagtccagactgcacagaacagaactctcctcaaaatatcccagaaggacttcagaatccattttttcaaatgttttgacacaacactgaaaaggtgcaattattaaaatatcggaaactattatattaattcaaatatgttcagctaccactcattcttcttcctatttttaaatgtggggatcactaagtatctttaaacttagtgtattttcaattttttttctctacagccacagtgaaaggggtggaaagttaaaaaagaaggaatttgattttttatctattagaaggaaggaaaagtttaggtggcattattatatgtgaaaactgaactgtaaagcatacagtatgtgcatcttcacagggtatataatttcaaaaggtgaaaaatgtttaaatagattttaaaattatttctctgcaaatatcacaaaatattaaaagtataggcttgctatgaaagtatctttaaatgttgtgtttctatttttaaaaaatcactttgtcacttgagagaaataaggttgttactttttttctattttccccattctcatatccttcatgtttttcttcattaattacattgtcctttttctgagggtttaaaatattgtgcatattcatgtatccgctgatacatatatttatggtctagctcagctaatgcattggtgaatatgttcacatagatgtatatgtatatgcacacacatgcacataacaagaaagatggcacagtggctaaggctctttctagagtaagactgcttggttcaaattctgcttccaccacttacaagcttggacaagtttcttaacctctcagtgccataattttcttatctataaaatggggataataacagtaagtgcctctaggggtacaaataggactaaataaagatttaatatttatagtgattataacagcgtctagcattgttaagtgcctgcaaataagtgttgaatttttttaaattattttttacttttcttcattctccttctcttcattttcctcatcgcttctactgctacatctttatcaagtatttaaccatcaaatccagccatacagacaaaatttatatacttcctacactcagaaaataaacaacaggacactgttaaccctgatgataatgaatatacctaaaacaaagaagtaagagagcaaaaatgataagcaagaacagaaactatatggcataatgcagtggtcttcaaattggagtagatatgcccctctaattacagtaggaaggtctgtcccttcctactgtccttcagcataatatctattggagacattacattattcagtgatacatgaaatactttagacttacgtttttcttgtaacagttatatattaatcaagatgcaggtttatagtctaatgttgagccttagaagatttttctaagaaacagctaggcatataaatatatttaaggaaatcaattgctagatctaaacgtccataaaaatttttcctaaaaatgacctatgtgagaaagtgcctctcaagtatgatatcctttcccatctctcttctcacaattatccttctctagatttatagggaaaaaaaagtcgtgctcttacacatccccaagaacactgcaggacattgttttgggcagacaaactgtggggagccaaaaaaaaatgaaatctcatatatttttccactacaggtgctctcagcttaagtgaggaccagctccccaagtcagaaaacatcttaccatctttactccttcctagcaatttattccccctttcctagaagaatgaaaaaaaaatagacacaaacatacatacatacatacatacatacataagtttaaactggtttggccttcaaaggaacaaaatcatacaagatcatgatgaataataaagaagtataaatgtgaagactgagaataacgaaactttaaaggactaatggagaattagaattcaagcacgttctctaagacatgggcattctcaaatatattctaacgttctaggtttcagattacatgatcccttttatggagtgctaaaagggcggagattgggaaatgggattaattaaagaacagggaagaggaggagccaagatggccgaataggaacagctccggtctacagctcccagcgtgagtgacgcagaagacgggtgatttctgcatttccatctgaggtaccgggttcatctcactagggagtgccagacagtgggcgcaggccagtgggtgcgcgcaccgtgcgtgagccgaagcagggcgaggcattgcctcacctgggaagcgcaaggggtcagggagttccctttcctagtcaaagaaaggggtgatggacgcacctggaaaatcgggtcactcccacccgaatattgcgcttttcagaccggcttaagaaacggcgcaccacgagactgtatcccacacctggctcggagggtcctacgcccacggaatctcgctgattgctagcacagcagtctgagatcaaactgcaaggcggcagcaaggctgggggaggggcgcccgccattgcccaggcttgcttaggtaaacaaagcagcctggaagctcaaactgggtggagcccgccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcacacagctggagatctgagaacaggcagactgcctcctcaagtgggtccctgacccctgacccccgagcagcctaactgggaggcagcccccagcaggggcacactgacacctcacacggcagggtattccaacagacctgcagctgagggtcctgtctgttagaagaaaaactaacaaacagaaaggacatccacaccgaaaacccatctgtacatcaccatcatcaaagaccaaaagtagataaaaccacaaagatggagaaaaaacagaacagaaaaactggaaactctaaaacacagagcgcctctcctcctccaaaggaacgcagttcctcaccagcaacggaacaaaactggatggagaatgatttcgatgagctaagagaggaacgcttcagacgatcaaattactctgagctacgggaggacattcaaagcaaaggcaaagaagttgaaaactttgaaaaaaatttagaagaatgtataactagaataaccaatacagagaaatgcttaaaggagctgatggagctgaaaaccaaggctcgagaactacgtgaagaatgcagaagcctcaggagccgatgcgatcaactggaagaaagggtatcagcaatggaagatgaaacgaatgaaatgaagcgagaagggaagtttagagaaaaaagaataaaaagaaatgagcaaagcctccaagaaatatgggactatgtgaaaagaccaaatctacgtctgattggtgtacctgaaagtgatgcggagaatggaaccaagttggaaaacactctgcaggatattatccaggagaacttccccaatctagcaaggcaggccgacgttcagattcaggaaatacagagaacgccacaaagatactcctcgagaagagcaactccaagacacataattgtcagattcaccaaagttgaaatgaaggaaaaaatgttaagggcagccagagagaaaggtcggattaccctcaaagggaagcccatcagactaacagcggatctctcgacagaaaccctacaagccagaagagagtgggggccaatattcaacattcttaaagaaaagaattttcaactcagaatttcatatccagccaaactaagcttcataagtgaaggagaaataaaatactttacagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaaggaacgaaatcaccagctaacatcataatgacaggatcaaattcacacataacaatattaactttaaatgtaaatggactaaattctccaattaaaagacacagactggcaagttggataaagagtcaagacccatcagtgtgctgcattcaggaaacccatctcacgtgcagagacacacataggctcaaaataaaaggatggaagaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcgtgagtgacctacaaagagacttagactcccacacattaataatgggagactttaacaccccactgtcaacattagacagatgaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaacctcactaaaagccgctcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactcaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacagacacctctacgcaaataaactagaaaatctagaagaaatggatacattcctcgacacatacactctcccaagactaaaccaggaagaagttgaatctctgaatagaccaataacaggagctaaaattgtggcaataatcaatagtttaccaaccaaaaagagtccaggaccagatggattcacagccgaattctaccagaggtacaaggaggaactggtaccattccttctgaaactatcccaatcaatagaaaaagagggaatcctccctaactcattttatgaggccagcatcattctgataccaaagccgggcagagacacaacaaaaaaagagaattttagaccaatatccttgatgaacattgatgcaaaaatcctcaataaaatactggcaaaccgaattcagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaacacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaagaatcacaagcattcctatacaccaacaacagacaaacagagagccaaatcatgagtgaactcccattcacaattgcttcaaagagaataaaatacctaggaatccaacttacaagggatgtgaagcacctcttcaaggagaactacaaaccactgctcaaggaaataaaggaggatacaaacaaatggaagaacattccatgctcatgggtaggaagaatcaatattgtgaaaatggccatactgcccaaggtaatttacagattcaatgccacccccatcaagctaccaatgactttcttcacagaattggaaaaaactactttaaagttcatatggaaccaaaaaagagcccgcatcgccaggtcaatcctaagccaaaagaacaaagctggaggcatcacactacatgacttcaaactatactacaaggctacagtaaccaaaacagcatggtactggtaccaaaacagagatatagatcaatggaacagaacagagccctcaaataacgccgcatacctacaactatctgatctttgacaaacctgacaaaaacaagcaatggggaaaggattccctatttaataaacggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaaccaaagccaaaattgacaaatgggatctaattaaactaaagagcttctgcacagcaaaagaaactaccatcagactgaacaggcaacctacaacatgggagaaaattttcacaacctactcatctgacaaagggctaatatccagaatctacaatgaactcaaacaaatttacaagaaaaaaacaaacaaccccatcaaaaagtgggcgagggacatgaacaggcacttctcaaaagaagacatttatgcagccaaaaaacacatgaaaaaatgctcatcatcactggccatcagagaaatgcaaatcaaaaccaccatgagatatcatctcacaccagttagaatggcgatcattaaaaagtcaggaaacaacaggtgctggagaggatgtggagaaataggaacacttttacactgttggtgggactgtaaactagttcaaccattgtggaagtcagtgtggcgatttctcagggatctagaactagaaataccatttgacccagccatcccattactgggtatatacccccaaatgactataaatcatgctgctataaagacacatgcacacgtatgtttattgcggcattattcacaatagcaaagacttggaaccaacccaaatgtccaagaatgatagactagattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacactgcatattctcactcataggtgggaattgaacaatgagatcacatggacacaggaaggggaatatcacactctggggactgtggtggggaggggggaggggggagggatagcattgggagatatacctaatgctagatgacgagttagggggtgcagcgcaccagcatggcacatgtatacatatgtaactaacctgcacaatgtgcacatgtaccctaaaacttaaagtataattaaaaaaaaaaaaaaagaacagggaagaacaagagaataaaggaaaaaagcagagagaaggcaaggcaaaatgatttattaggaaaggaagaaaccctttcaaacaaagaaatcctacgttttctctcgatatatcactagaagcatatgcaagaaatcaatatatacttttttaaaagaaaggattaagtagaagataagagaagatacacaggtcatagggaataaaaaattaatagtgcctttccacacagacttgaaacaattctggtcactgaagggcagtaaggctggggaaggtatctcccttcctactgtccttcagtgtagtatctattggagacattacattattcagtgatacatgaaatactttagacttatgtttttctagtaacagttacatattaatcaagatgcaggtttatagtctaattttgagccttactttagtttttatcagcaacaatcttgtataatctaccatgactatacatatgcatcaggtttagtaaagcaatttatgatacagtctccatatgtgaaattgaaagccagaagctaactattattttaacaagctgtcaagatatatagagttttgccaaagaaacattgattacactggtcttttgaaaagtagataaaacttagaattccctaagcaaaccatagttacacaaaattgtcctgagattcctatgaagcacatgactcaaatgctaccaaaatccttcataagtaagatttatttccaataaattatatatctctgttttagaactctgataatttgcagcccattttccagtaacatgtttttatcattttctactgctgaataaaaaagaaattaaaggacaaagagaagatcatgagtgaactatccaaattttattacaatcttgaaaaatacacatccgttgacttcctgttcctctgccactaaatctctgtggggaggtccaacttccaattctctgaagtcgcaaggtagaggaaataaaactaaggagcaggttgctatagctctccaattcaaaagcaaattattactctatttaatacagcaatctactataatctcctccaacactcctgatcctctttacagtactcttttctatagtacttatctcctaacaaaaaaatgtacatatttactatacctattatgtcacttgttgctagaaagtaagcttcaaaagggcagggatctacatcattttgttcactggccaatctcaaatacctagaacagtgtctgacacatagtaggagctctactgaataaataaactattactttaccagtatcaaactccccacctgaggtagcactacctaaactacatgttgttccgattctaattgcatgtgatttttctaatcttcgtgtcattatcatagataagtgtccattgctacaactggaagtaatctgtgcacactgcagccttcattgaaacccagataatacttctgttcgtagctgacctcatttttatggcatcccactgtatagcttgcttcttcactcttatttaggcagtgtcttcgcagtttcctgccttgaatacctcttgtatacatttaccaccttaattatttgctgtgtacattttccttgatgccttctccccactatgacagcagattccctcttctgattttccactgatcagcacggcccttcaaaaaccttcacaaaagcccgttagaaacagattgagagacgcatttgtgaagctatttaacaaatttaagtgtcatttttaaagtattcattgtaaattggagcattgtttcatatcggtatcattggagcattgtttgatatcggtaacttgctttaaactgattaagcacatgtaaagatacatgctaccaatagaagaggatgaaaccgagagatcatctttatggttaatagggagtcagtgacaggaaagtaaaaagactgaaggatgattttgggaagtccaggtaattgtctggttatccctcaccaatgtcttgatccaacccaagaatcactctaacacggcaaaactcaatccttcctgttattttatttgtggcaagagaaagatccctaaaataaaatgcatttataaaatgattgccttataataagcactcaataaatatttgctgaataagttaatggatcaatgagtatttccctatggtttgggaagtttagccaaattaaataccagactttcaaatgtaaagggttacgtctcaaaaatatacctcacccagctgatacacataacacttaaataactgtatctgcatgctcagtaagaacttcatgcattcatatatttaatacatcatcaaagcattgtgagacaactttctaacagtgaattgaaaccatataaaaaactttggactttttgagggtttttggtttttgttttttattagagatggggtcttgctttgtcagctaggctggagtgcagtgatgcgatcgcaactaactgaagcctcaacttgaaggtctcaagtaatcctccatctctgcctccagaatagctgggaccacaggtgcaggccaccacacgtggctcatcaagtgacaacttattctcagtcaaaattcatgggtaaaaataaagttaaaattttttattttaattttgaaaaagtatatattttgtgatcatagctttgattctgctctccatcaaatacatttaattttccatttctccatatttaagcgattaaccccattaaaaaatgggaaactattcattctcaactcactaaaggaagtataaaaggaattaaatacaaagacccactcaaatatagctaatttcattaatatttcctgtgtatcatttcaaaaaaaattactaaaaaatattcctaagattcttcttataatttttatagtttcattattaagaattattgagataatttattttaattagatgggcttttataaagtatataatcaataagtgtttgtagatcccttagttttaaagcttttttttaagtttctctttacccaaaaatataatctggattaaattcaatttactgacccaaagatataaatgagaaattcaaaaccattaacactctaacacagctagatggaatgatgaatgattaagggagaaaccataagaaaacatcaggtaatcatctttctagcatggtctgaatgaaatccttcccatgaaattaaaatttgatacaaagtctatcaggaaaacttctaaactttaagatttgtcaggaaaattgtgaaacactgaaatatgcaaaatattagtggatgtcctatctagtatacccttccagattatctgagtcagtcagaatatgagcctcacattgtctttctgctactttacaaccatgcagttgtaagacacagaataatacaaacaattcttttccataaaaatgcaaataaattgtgtccagtgaaatgaaatggataattggcctgtggctattaaccagttttgcgtctgtttcacattcatttcagcatccttgattgcccatatatgtgtgctcttaaaattctcctttgaattatttgtaacatcttactgatcccctcattaattaatgagcttaataaagtctttgatacccattctttttacatttgaataaaagacatgattttaacctttctttaaaagtatcccttgacagaatctatcactaaaagtatgacttttgatccaccttccataaacaggctttcttaaaatttccattaagtcataagtcatcccattcaaattactcaaaataaaatactgcagcatcaatattttgaatccaaatatgaatgaatccaaagcaccatcattatatgatataagtttactatttatatatccctagaagcaaaaaggctgccaattaaactaagacataatgcttttttatcaattagatttcattttttggatatctgtatcatatattccactgttctgccccatgcctctcatgtagatagatgagtatatattacttatccttctaagcctaaatcataggatttgggaatcatcagaatacctgaagtgcatataactcaattaaactttgacattatgaccacattcacacatgcacagataacaactccatcaaaaccaccacctacccaacatggattttgagtccatcaattcaaagaagcatcccagtttcaggtatgttcaaatatgaaaaaatagacatcttagaatgcataaaacaccacaaatataagtgcaaaaacatatagcaggattataaatggcaaatagcttacaatcagaaaacctgtcactagagggtcatcatttccttaaatagtaacactagaataatccacacagactgctagaaatttatgaatcttaaaactgatagtcaaaatctcaatgaagccaaataactctttagggcaagaaaaggtgagatccttgactgaactaaggttattcaatctcttgtttactaaaacagtggtaggggtggtttggtctctagcagaagggcaaacaagatggtatcacataatggagctggcttaaagcaaaataataaaaatgaaaaaacactcattcctctacttctaagaaaattatattcttcctttttgatgtactgctgacattcctttcctctcttcaatcctagattagttaacagcttgtaaaactgctgttattataatgacaatctcaatcaactacatcataaggctttttgcctaaaggatcatctctccaagttgtaatctctttgaagactaaggagacaaaagtctctcttgaacactaaggtcttttccaaattaaaaacaaaatattctaaatatttatgaacgatatcaatcagacttcctgctaaatattacttcttagtttttagccttttgtaatatgttataaaagtttccattgtctttgtattgttgaaggctacaatattgcctagcacatagtaacagcaaataaatgttggtaaactagaaactgactctcacagtggccttgattctcacagttaacctagaagtaagtaccgcaacaatgtttattcccatttcatatataaagaaactgaaggttggagaatttagggttttgctctaaaatcacagttaataagtggcattgtcaaaactgaatcccaggccctttgtctccaagaccagagcaattcttacagtaacagactgaacatcccatgcctagatttccttccctctctcttctcttacctactacatgatacttgactcaggattctggtttgctgaattactgaaaccacatcaacagtgagtcaatggtaattctctacctggttacatttacattttagcacagatattgtaagataaggtgcagcagagattattggaaatacacatattgacagtcagatagctcacttctagtggaactagaatatttaattttcctgtgtctcaagtcctttatctgcaaaagcaggtgaaatgcagatgatcaataaggtcttttcctaactaaaaacctaacattctaaatatttatcaattatacaaaatcagatcacctgctacattttacttaatactggccttgaaaaaaaaaagaaaactataaaaacctgtctgttagattctgcagtgggccaaaaacagaatatataaacaaaaatttaaatatattccaaccatactacttgactaaggacactgtctgtaccaatttaaaactagaaggttttaaggataaatgagatctatacaggcacaattgtcacagcagtccttctaggtatacaagatactgaaacattttactgacctataacttactttttcatacatggcaaaactatatttttctcattacaaatgccctagctctccccacaaagttattgtgaagtctccaaatattgctaatttgtcccttaaagcaaaaatataaaacactttgtgacatatgaaaaatgttcaccatgtcctttagttgcttcaagatatagcatataaatctttgagtttctaaacagaaccatactatctagatatttttgtctaaaagatttaaagcttaaatgtgctacctttttttctctcttgcagctttcaagtcacttagcctgctccagtctccaagatatacattatttttccaataaatcaataaataaaattggtatttttgactacttcttagtataaatcttgtctttgtatcaacaaatgttcgagtgcattttcattgtatgactaaatttctattaaaaatgtaaataatttctgcttactctatcgagtctttaattaaaagtggtttttaaagagtcaaaagactttgatcaatttttatagaatgcaccagggcacggtggttcacgcctgtaatcccagcactctgggaggctgaggcaggtgggtcactggaggtcaggagtttgtgactagcctgggcaacatggtgaaaccccatctccaccaaaaaatacaatttagctgggcgtgatggcgtgcgcctgtactccccagctactcaggaggctgaggcaggagaatcacttgaacttgggaggcagaggttgcagtgagccaagatcatgccactgcactccagcttgggcatcagaacaagacaccatctcaagaaaaaaaaaaacttatggaatgctatcattctgtcaaaaataaacataatatgctttctgttttaacaaatgaataacttaccattgtaccaccctaagttaccaggaaaactaccctaaattaccaataaaattgttcctcctatctttctcctctgcctctgctctacttcccttcaaaaagttctttactccacaatttccccaaacagaaaattttcctgattctcctatccctctgttctttctgtcactctcttcaagatccttttcctcttctatcccaccagcatccccctttgattctctgcctatattctccttcatcttgattcactccttcacagctcatctgcttccacaagatcaactaacatttccatactgatgaatccccaaagaacatttttagcctttatttttaaccagtctctgattctgtatttccagtttccttcaggatatgtctccttgaatgactggatacactattagaattcaaaacttctagtttctctacatcctcctaatctccttgtatataaactcaatacttggggacatataattatcctatgtaatcctaacaatctaaaatcttcaccatttgctagtccttacacccagaatgaactatgttatctgctttatgtcaccacaggatgctaaaatgttattgaaaatagccactaaaaaatgtagcaaatgtttctaatacaaactgatgagttcacaatattctatgagtaaatataatagagttccctctattttcctactagacatctgtttctgatttttcaatattacaaagaaaactgttatcttatcattatacatattttcatatttaataatatctccttagtgtagcagtccagaagtgaaattaatggggaaaaaagataaaagaattgttaaggttcttgataaatactgacaagcttatttccaaaacaatattatcacaacgttagctccatgagtgcaggaatcttgtcccttgtgcatatgataggcactagtaatacaacaatgataaacagtaagcattcaataaattttatttaaataaactaatcaatcaaccaatcagatctatgaaagtacttacaaatgataaacaaacattcctttatatctttattatatcattatactatatttacttactccccctttaagagtaaacatgtcactgctttgagcaatgaaatacaagcaaaagtggtatgtgatacttctagtcaaaagtttcaagtgccatttatcatgtcctttccctctgtcacagcaacctaaatgacaggcaaaagtttctgttactattatatatcatcgataatttcttatagtaaaatatagcttttcccttaaaacatatcctttttactgatcagaaattcaccgggaactccctcttcagtgcagggggatcctatggtaggaggattacaagtgtgcactgtcattcctaagaaagaatatggagcaataaaggaaattgctaaagtctggaaagcattcttggctttctgctttgaaatgaagctgacttggaaaatcagagaatttgaataaagttatcttagatttcaatgaaagaaaaatgcttcatggagtagctctttgtattactgcacctctagaggccccagaagacaactaaaaaccaggcaatatgctttattttgaaattcagctgtgtgggctgagatgtcaccttagcatgagggtcaaaggagtacagggagagagggtagccagagcctcagtcacaaattgtaactcacacttaaactcatttgaaatgcaataaacaaactaaacagaataagcacacaactacttgggcactcgaattgagttttttaagaaattttaactgttattatctaaatgctattagataaggaatatttctttcacaaatacagctgaacacattgatgtttaagagttttagtgcaaattccaagaactaaaagaaaatagaggaagacaaattagaaatgagaagctaacttaatgccaacaaattaacctttcagaaagttagaaagaaagaacaaaagagtcaggctattttattattgttttgtttatacttcataagcaaaggtattcgtgggagattttttaataaatgttttccttgtctttttttttaagtggttaaagaagaaaagttaactaggagaagataggaatgacagcagttatttgcaaatttttccacaaggaaaatcctatcaaaatccttctttgatattatttgtccttataatttgttcccacaattgccaaaaaaaaagattacagtcaggttgcatgattatctaaagcccaacatgatgttctatgtttttatcacaattcaagattactgcatttttcctaccataatattaattaatggtcaatataaaaatatggactatattgaaccccaggcaaaaggaaaaaatacacccacaaaactgtaagactatgacactagtaaatcattattcagcattttagtatagttccttctcatatttttccaagccatgtttttgcttgcttatttgattctatatacatgcttaaccatcttattcatttatttatttaacagcataatctttttccatgttaccataaactcttcacaggcttcactttaggtatggtattccatcaagtgtacattccacaatttatattttgacttagtgctggatagttgctttcaatttttgtaccattacaaataattctgttaggaacttattaaacataagcctttccaatatttcaaattcttttcctaaaatacgttcctcacaactgaattactatatatcaaaaacaataatcaaaattaaaagccaatatggtatctgggatttggtacaaaataatacagattggggaagcagatgggagttccaagtgaagcacatttaatttttttcaaaataaaacattcaaacaaaaaattaaaagcaaaaaaaatcatcctgaaatacacacacacatacacgcacacgcacaggaacacacattctagcaaagatgaaagtatttttatggctcttgctacacattgccaagttgcttccctaaagagttgtaatcatttttattcccaatatatagcttaaggtttatagtgaaggcttttttaactcctcttttctttgaagtctttgtttgtacattgactttggcatgtctctgcaacctactgcaaatttttcctattgagatatgttcctgagttttcactttattctggagactggaaatcgctcttatgatgctctttgctcatcatgcaaacttgattccatgtagaataatagttggataacagtacaatgatttacctacaggaatgtttttcatattgtttacaaggcaaaaatacatttaacataatgtttagtaaaaactggaaacaactgtttctgtatcacttgcaacgtcacagcattccttcaaaatgtatttactgtcatggaaaaaaataatttgccactataatgttgagtttttaaaagtaggctataagattgtttgtatgaacaattccattttatatagatcatacacacacacgtgcacaaacacagagataaaaaaaacctggatgtgtatgtactatagtatcttcttggggagttgataagtgatttttacaaacatctttatacttatttatatatttttattttaataataaatattctaaatgtataatttttaaatcatcaaccaaagtaagactcaaagtataaccagtaattgtttgagcaacttattatgtacacatgtcaatttccagcttgcttacataaatagtctcccaattggatacatcttagtgaatttataatcattaaacaaagtaatgaataacatgatcatcacctgaataagattatttttcttctaaattttcaaaacacagctttgtgcccaatggttttccaaaactgcctcatattaacaagaaaattttggttcaaagtagagattaggaaattaatgaaccaatgaaacacagttaattacatccagaaattaatgatcaggatattaaaacttggaaaatatagaaataatggttttcctttattaaaaattttttttgaattattgtgaatacataatagttgtatttatgaggtacgggtgacaatacaagcatacaatgtgcaatcatcaaatcagggtaactgggatatccatcatctcaaacatttatcatttctttgtgtgatagagcttttcttaactagaagttcaacgataaaatgtgcttacagacctaactaaaaccctatcatgtccacctctaagaattctaatacagttcgtctatagggccctagctctgcccctgccattaagtttgtgtgaccgatggcaaggtctgcatctccaaaatcagtattttacatcagttgatttctaaggtcttcgtggctctgtggctatatatacacttaaaaagaaactgaaaacaaatctgatcaataaagaactttttcatgacatatggtatgttattctgcagggttgccataacataataccaaacacgaggtggcttacaacaacataaaggtattctcacagttccggaggccagaaatctgaaattgaggtgccaggaaggctatgtccctctgaaggcagtaaggaaggatctgttccatgcctttctcctagtttctggcagcctcaggtgttccttgacttgcacatggccatcttctgcctatatctcttcacatcatcttccgtgtgtgtgtgtgtgtgtgtgtcccaatttcccctgtttataaagataccattcatattggattaggacccatacaaatgacacctcattttaacttgattacttctgtaaagacccagatcttcaacttttctgggggggatccaactcaacccataacatgtgacatgctggttaatctctgttgccctctaaatccattccctgctcctttctgctccacatcccagaggctaacctctgtgaactgcatcatccatgcttctttaatttctagcttcaagttggcaaatgggaggcacctgttcaagatcacaagacaacagaagagagaagggagggtatttgttgccactccatacccccaccaggccacttttttggtagcaactacattcagctatccacagtcctatttccctgtccactagccccgctcccataattctagctctcaccagaatgggtaattccattcccacctctttttccttctgccatcaggctatgatgacatcccactgttgctagtccctgggcacttcactattgttcaatggttgcattctgcactaccacccatccctctataatgaagtccattcattaaactctcttcattgtccccattgaatgtaccgtctgtttctcaccaaggccctatctggtacacagggataagtcaattctttagagtatttacataatttgtttatcaaaattctaaaaagtagtttagcctcagcatggctgccacaaattgagatttgaaataattggtagtaaagacatcactttctgtcatatatacatttgctactgttttgctcctttcctccttcacacttatatcttaatctagaaggatatggcagaggtcaggagcatggattgtgaaggcagactgcttcactttgaatctagcctctaccacgtactagattacataagtccagttaatttacctctctgtacactaataaaatgggcataaaggtaataatatacaaggccaggattacaggtatagcttacacctgtaatcccaatactttgggaagccgaggtgggagaatcgtttgaagtcaggaattcaagaccagcctgagaaaaatagcaattaccttgcctctgcaaaatatttaaaaatgaaaacattagccatgcatggtagtgttgacctgcagtcacagctacttgggaagctaaggcaggaggattacttgagcccaggagctgaatattacagtgagctatgaccatgccactgcactctgcctgggcaacacggcaaaaccatgcctcataagtaaataaataagtaaagtttacaagtcacaggacagctatgtgaaatatatgccaaattacttacattaattttttaactattaaatcaattaatctatataaagtgcttagaacaatacctggcttgtagtaagtgttctatgagcattagctgctattattatgattaatttttcctctgatgtttttcccttgacctacacattaagtcactctagcctcaatcatttttacacggaccctacccaaccaatcaaatgtatgctgggaatatacaaaaaacacagccaactcttttttattttattttattttttcccgaaacggagcctagcttgtcacccaggctggagtgcagtggtgcgacctcgcctcactgcaagctccgcctcccgggttcacgccattctctcgcctcagcctcccaagtagctgggactacaggcgcccgccaccaggcccggctaattttgttcttgtatttttagtagagacaaggtttcaccgtgttagccaggatggtctcaatcatcttctgaccttgtgatccacccgccttggcctcccaaagtgctgggattacaggtgtgagccaccgcgtccggccaacacagccaactctttaaattttcctatgtaaactacccattgtccaaaagatcagtaacacctgtcactcctgccataatgggctctctgacccctatatggtgtacatcctaagtcctcaagtgttttatttgcttacgacgtatttttgataattctgctctcagtcaagattctgataaatcatcaatcccctacctgggctatttcagctatatgtcaaacactacactcccactcacttcctggggtctattccggcttttaaaagacagttttcaaacccctacttcagccaaagaaatggtccttaatagtgattttcctcccaaaatatgtgtacttagttttgtttaattgtttggggatggggaggggtagtagtgtttgagaccaggtgtcactaaaaaaaaaaaaaaaaaaaaaaaattaaaaattaaaagaagacatttatgcagccaaaagacacatgaaaaaatgctcatcatcactggccatcagagaaatgcaaatcaaaaccacaatgagataccatctcacaccagttaaaatggcaatcattaaaaagtcaggaaacaacaggtgctggagaggatgtggagaaataggaacacttttacactgttggtgggactgtaaactagttcaaccattgtggaagtcagtgtggtgatttctcagggatctagaactagaaataccatttgacccagcaatcccattactgggtatatacccaaaggattataaatcatgctgctataaagacacatgcacacgtatgtttattgcggcactattcacaatagcaaagacttggaaccaggccaaatgtccaagaatgatagactggattaagaaaatgtggcacatatacaccatggaatactatgcagccataaaaatgatgaggtcatgtcctttgtagggacatggatgaagctggaaaccatcattctcagcaaactatcgcaaggacaaaaaaaccaaacaccacttgttctcactcacagatgggaattgaacaatgagaacacatggacacaggaaggggaacatcacacactgtggcctgttgtggggtggagggagcggggagggatagcattaggagatacacctaatgttaaatgacaagttaacgttaaatgacaagttaatgggtgcagcacaccaacatggcacatgtatacatatgtaactaacctgcacattgtgcacatgtaccctaaaacttaaagtataataaaaaaaattatcaaatttagtcgctttttaggaaagggtaaggagttggggagagaacatgggaaaagaaatcctcattgatctttgcaaattataaaccatctttttaaagtaaaaataaacacacacaaaacttatttaaaaaattcccttacttggcttagcagaaatatacctcagttacgataactataatgaacaaaaagtgattactgttactgtataaaatggccctgagatgtagttatgtactatatctgtgtatttatataagtacatttatcaatacatcagaaataactagatctcaagaaaggttcaacttagaaataagagtacagtaggccatccatatctgtgggttccacatccatggattcagccaaaagcagatcaaacatatttgggaaaaaactgtctgtactaaacatgtacagacattttttccctcttattattccctaaaaaatacagtgtaacaactatttacatagcatttacattgtattaggtgtcctaagtaatctggagataatttaaagtatacaaaatgatgtccataggttatatgcaaatactacaccattcacatcagggacttgagcatctttggattttggtacaattgagaggtcctggaaccaattccccatggatatgaagggacaactgtactaagtatgagctaagagtagtagcaggaaagttcataagtaaaaaaccagattgaccaaatagcagattaaatcactgatcagcagaagacccaagtggtcaaaagcacagcccctgaggcgagaaggccctggtgtaaatcctcaccccagcacctactgggtgaccttgggcaagtcacccaatctctatgtgcctcagtttcctcactgtaaaattacagttcttacctcacagtgctattggaaagattaaatgaggtaatatatgtaaagtatttagaacaattcctgacacatagtaagctcttaaaaacttttagttctaaaatttccaattctatatacagtccagaaatatattcagttctgtaaagatggtattcattttaaagggaatattttgttgcagtttttggcttcttttctcctacttatgtgagtcacactgctcatactcacttaagcataatacaagtcattttacagaataaatgttcaaagatggctggtatgtatattgaaaacaatatgccaactcctgagttcatgtctagacttcctcgggattacagagacggtaaggttaattacccttttaactatgatcattgtttattaccttgctttagttttgagaaaaggacaaaacattctgagtatatgcaaaaatattctagttgacaatatattcattactgtttatgacctctagtattctttcaaattaagtaattaagtatttaaacaaacactcccgaagtagaagcaaaaatcactttctcagactatttagcacttcttaaaggtctccaagaagtagtacactccaattaatatttatcctcttcctcagagcatcgatgcttacactgcctaagggaaacctgttgtcagctaaggcaaatgaggttaataacaggatttggctaagaagaaaaatatgttgcactttagagaactaacatctcatctcatctcaaatacgctaggagaataaagaggccaggaaacaaccaattgtaaaaatattagtaaataggtaacaattaaagtcattctttctcatcccaactagatatactaatggccataattactttttacttacattagtattacctcaggggatctattgttttcttataaaagtcagctgagctgtacagcttaaccaagataatctgctatattagtttccaagtatagaaagcatatgtgtaaataaaacatacatccctcattgttacctggatgttattaacccttgcttcccaacaactaaaatatccacacagggatttacttacaaaaaaaaagaaatatgcttattaacctaattatgggtatcacataaatacattgtatttgcccatttattattattatagcaaggctgtaggggccatactatccatattggatggctagtttctcccagtagccatcaagaagcctaaaatttcatcatttgaaatatttttaagtcttgacttttagaggagagagaactataaaagagaatgtctagagttaaagatagaacagcagtctaggactcatatgcaatataagaagaaaatggaatcagcagaagttctaagcaggaaagtgatattatccaaatcatgttggaaataaatctgctagcaatgtggaaaatgtactagagaaaacatatcatagtcaaagaaggagagatctatgtggcacctggacttagtaaatggagaaaagaaaaatattcaatagatatttttcaggtagacccaaaaagactctgtgtctaactggatacagatgataagaaaaacctagaagttaaagatggaagtgactctaactttgacttgtgactaaatatgatggcaataatcaaaatagtaaccagaagaagaaaaaaagtttggtatgggctaggttgggtttgagaagtctgaggaatatcatcatacacatatatccaatggagagctaaaattacaggtatgatgcttcaaaaagaaatcaggtaggcaagaagttaagagcagtggacaaagggaaaagagaagagggccatttctgagggctctgttctgttccactgatctatatctctgttttggtaccagtaccatgctgttttggttactgtagccttgtagtatagtttgaagtcaggtagcgtgatgcctccagctttgttcttttgatttaggattgacttggcgatgcgggctcttttttggttccatatgaactttaaagtagttttttccaattctgtgaagaaagtcattggtagcttgatggggatggcactgaatctataaattaccttgggcagtatggccattttcatgatattgattcttcctacccatgagcatggaatgttcttccattcgtttgtatcctcttttatttcattgagcagtggtttgtagttctccttgaacaggtccttcatgtcccttgtaagttggattcctaggtattttattctctttgaagcaattgtgaatgggagttcactcatgatttggctctctgtttgtctgttattgtgtatatctacaactatctgatctttgacaaacctgacaaaaacaagcaacggggaaaggattccttatttaataaatggtgctgggaaaactggctagccatatgtacaaagctgaaactggatccctgccttacatcttatacaaaaattaattcaacatggattaaagacttaaacgtcagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtcaacaggcaacctacaaaatgggagaaaattttcgcaagctactcatctgacaaagggctaatatccagaatctacaatgaactcaaacaaatttacaagaaaaaaataaacaaccccatcaaaaagtgggtgaaggacatgaacagacacttctcaaaagaagacattaatgcagtcaaaagacacatgaaaaaatgctcatcatcactggccatcagagaaatgcaaatcaaaaccacaatgagataccatctcacaccagttaaaatggcaatcattaaaaagtcagggaacaacaggtgctggagaggatgtggagaaataggaacacttttacactgttggtgggactgtaaactagttcaacccttgtggaagtcactgtggtgattcctcagggatctagaactagaaataccatttgacccagcaatcccattactgggtatatacccaaaggactataaatcatgctgctatagacacatgcacacgtatgtttattgtggcactattcacaatagcaaagacttggaaccaacccaaatgtccaacagtgatagactagattaagaaaatgtggcacatatacaccatggaatactatgcagccataaaaaatgatgagttcatgtcctttgtagggacatggatgaaattggaaatcatcattctcagtaaactatcccaaggacaaaaaaaccaaacaccgcatgttctcactcataggtgggaattgaacaatgagaacacatggacacaggaaggggaacatcacactctggggactgttgtggggtgggggggaggggggagggatagcattaggagatatacctaatgctaaatgacgagttaatgggtgcagcacaccagcatggcacatgtatacatatgtaactaacctgcacattgtgctcatgtaccctaaaacttaaagtataataataataaaataaataaataaataaataaagagaagagggccaaaaaaggaaccagcaaagcatacaaagctaaaacagaaccaagaaaaaaggatgtaatatacaacaaagggccagaaaacttcaaggaggaagaattcatactgtccatttctgctaagagatgaagaaacatttgtatcgtggccattggatttagcaatgagaagatttgagaatttttccaaagagtttttgtagaatattagagatagaagtctgattttactaaactaaggcagtaagtgacttaaggaattgaagaggactcacagatatttcttcccagaaatatctctttccagatgtttggaaataaacatcagtactctttccagatgcttggaaataagagcaaaatgtactgatttacccgcaaatcttgacagattctagggaatgcaagtctctgtcattattgtatagaagagaggagaaaacaaaaggtaattaaagctgactctaaagtctctaaatttgattcatgggtatagatataaagattccataactttagcagcaaggtccaatacagtagccaaaagccacatgtggttactgaacacttgaaatgcaactagtccaaactgagatgtgccaaatgaaaccaacaccagatttttaagaccttatttcgaaaaatgtaaaatatctcattaatattttaatattaattacatgtggaaatattttagatctattgggttagaaaatattaaaattaaaattacacttgtttcttttctcacttgtttcaaagtgttagtagacaatttaaaatcacatatatggctcacgttatatttcttttgaacgtccctgaacattcaaaatgttatcctctagaataaatactaaactggaagaacaggattcagaaaggttccatcacagccagcctatatatatatcatattagtgtgaaagttaatgaaggggacacccaggacaacatcatgactttaagaaaataaagtcctaactaattaagtggcttactcaggtcacctagctactggaaacaaaacccagactagaacctagtccgtgggtatttcctctattattccacctcttgaaatgtcagtgaaaatttaactgttatatacgatcttattctgtaccacattcaataaaatgacttgtaaaaaaatcttaaaatcataatctccataagagtatcctttgttcaccagtcaacttgtaatttaactaatattgttaacgtatgtcaactcacgattcagttttgttgtgttttactttgggcatgtatatatatactctgaatttatttcaaccaattccacatgaattttaaagagaatatcctcctttcaagtacacatctctttaaaaaaaagttctaagaaaacatatctggaaaagttcagagaaactactctcaaccattattatctgccatttgatagtggtaacttactaaggcatcatgttgctcattaatgtaatattcatacaaaattaaaagttatattcaaaatatagctatagtatatgatgatatactgtatttcaaattctggcaagatttaaaatcctgctttgcccaataaaatcttcaaagacactcaaccattatgttgtaggtaaaccacagttccagaatcaccaataattgtaaccaaccaaaatatttagctgtaatttcttcaatatactccaacaactataaatgtatttatgcttttcattaagaaaagacacaattatttaaaaaattagtcttttcatgctaactttccatgtgaaattgaaaagtaaacatcacttgaaactttaaaacttaattttatgagacatcttaataagctaataactgttgtagtcatggtagttatttcctttgtagaaatactgctccaaaaatagtgctatgctgagtgcagtggctcatgcctgtaatcccagcactttgggaggctgaggtgggtggatcacttgaggccaggatttcaagaccagcctggccaacatggcgaaaccaagtctctactaaaagaaaaaaaagaaagaaaaaagaaaaaaaatgcaaaatagtgctgataaaaatgaatgaagattatttgattaagcaacatgcttaattttgtacgtataccctatatttattttaacaaataaaactattattgtcattccaaaatgacattattaaaaataataaaaataaagaatatcagctccacttcttgaatatttgctgttatttcaatgttatcacatagataaaaggatggtgaaaatctagctaatagagttagctatgcacagggtgactatgcttccaaagaggagctttccatggcgatctgcatgtcttcttttctttgcctggctgtttgtggcccctcttcacataactggagttagtgtattcatctattccaaagttattccatctggactcctatgtggcagcctcccccaaaatacaaaatacaaaaaaatacaaaagtacagagccagatgtcactaagacctgagctttaccacatccttaaaagttttcaagttttccttggttgtatatgtccctttttggcttactatatagcagatgctaagtgtcccactgttgactgttcttagcaaggcgtaatccagcatggagctacagagaatcactgctccttcaatactggcagactgaatgacattgttggtgtttatgtcaacctacttcatgttaagaataactgacagttgatagtcatgacattgcataaacatctgtggtagattcaatatcaatattctagagaatatttgcaataagcagcatttaacagcatttgttcagccactatggaaagaagtttggagatttcttaaagaacttaaaacagaactatcatttgacccaccaaacccattactgggcatatatcaaaaggaaaataaatcattctaccaaaaagatgcacacactcatatgttcatcacagcactatgcacaatggctaagacatggaatcaacctaggtgcccatcaacagtggactgaataaagaaagtgtggtacaaatacaccatggagtactacacagccataagaaaggatgaaaccatgtcctttgcaacaacatgaacgcagatggaggccattatcctaagaataaattaatgcaggaacagagaaccaaatattgcaagtactcacttaaaagtgggagctaaacattggtcactcatgaacataaagatggcaataatagacactggggactacttgagtggggagggaaaaagggggaaaaaggttgataaactaactattggctattatactcactacctggatgacgggatcaatcataccctaaacctcagcatcacacaatatacccaagtaacaaagtgcacatgtgccccagaatctaaaataaaagttgaaattactttttttaaagtccacaatatgataaagtgtgctaaggaatcatacctccttgaaaataactaaaaacatcacttctcccatttataaagcaaaagtgaatattcaaagataactgcaggaggttaagttcattagccaatattcccctagcacctaaggcagttttccgcttttttttttcagtatgctcttattactgcctaattatccatattgcttttcttcctttttgttaaactgaaattcacccaagcagtttaacctttcatttagaatcattaaatacactcccctcccctcactgataattggcctctttctttattaactgatttccccccttgatttattacaaaccttttttgccaaatttggatccattctgttaatacattctttaccttcttgcaactcaattaacacagtgtcattgttaccaaagctttcctattatttcttcaagttcttattgctctttaaagatcatctagtagaataatgaatttttaataaacccggaatattttaatgattcttacttaattctatggtaaaatttatgtgagacatactattcttcacactgaaatgtttcctactgtactgtcataatactatacggtaactttctagcaatccaaatacacaaatccttgcaatataacttatgacttctaaaagtacagaaagccatattataattatcatatccatagctaaatcaaaccaagccagcttcttcaacagcagttccaacatccatacaatttttaataaagtgaaacttatacttgtgccatcagtaagtattaatgtaacctctgagtatgagtaaacctgtcactagattatgcaaaggaataacctttcatgggcccttgaggtttctccttaatggaaataaacaatttttttaaaaggcattcctgttctcttcttggaaagaaatactttcctgagctccaaggcactgataaaatttggtgggtgtcgttttaaggcctttccctttcttatcagctaccgacacatttcccagccttgccacctctactcaccaaaacagtgccttttttttttctaaaaggaaaagaaaaatgaaaggtatctactgaccttggatcaaataaggttatgtttaagtttagtttagagatttcttccacttttccaagacctaaaatatgaagcagaatatagactatggtatctttatttagcaagaaccagcggacactgtgtttaccagtgggaaacacatcttaagttgacaagagatatggagataaccagaacaaaattaaccattagaatattaaaaactctactcccagaataaattacaaggaacaaagaaacaaagatttctaccactatcttattttgagtaattttaaataaataggaaaggattttgatctcatccttctgtaaaacgtctacctgccaacatttatgtttgcaattttcaataattgcaactacagacataatctttataagtatatattcatttgatgtctttcaccaataaagacctggtgttccaagtctcctatctgttccagaatttctatttcatgtgccaatatagctcttctttaaaaaatttcaagtcagttttgactccaactttaaaactatgcaacatagttttctgatatcctgagggattaattcttatgttgaacttcctaacaattccattttgatccctaaagctattttcatgcattttttaaatgaaagagaccttaaagatcaactagtctgtacctcttattctgcagatgatgcaattgatccaaggaacagttaaagtaacctgtgcagggtcactcagccaattaaaaatgatgcaactcaaagtagaaacaagatgtcccaaagcctagacccatagtcttgcactgaagaactggcaaatagaggctttcagatttgtttcacagaaaagaaaataatactttttaaattagtcaattatgtaaataaaatcggtgttttcaaacacttaataatcttttgtaaaagtacatttccttgtacatagtaaacgtggttttagaactgtttgtattttttattgcttaagatgattttctattggcactgtaacaaattacagcaaatttggcggtttaaaataacatttgtttattatctaacagctctcaaagacagaagcctagtaggtttggctagatcctcttcttaagatctttcaaggccaaaatcaaggtgtcagtgggactaggtccttctatagaaatcccaggataatctatttccaggctcattaagttgttggcaaaattctgtgtagttgtaagaccgaggtacttgtttccttgctgatctttgattgaaggttattcttaccttctagaggcagcctgctttcctctgcccatggcccctgaatcttcaaaggctgtaacaatgtgttgcatccttcttgtcctttggatctctcacttcatatgctgcacttccctaactactacttctgcctctgtttctaagggctcatgtgattgcactggacctacatggataatccaggataacctttattttaaggtcaactgattagtagccttatttacatctgtccctttggcaatgtaaagtaacttattcatggatatatcatcttattatattcactatccagggaattagagcatggaatctgcttggaaaccaaagttctaattattacatttagctcatatttattgatgcatccttaaggaaatgtgactggttttctacagatcacgttgttcaaactctaacaaaataaataactttgcattcctaatatttatatatccatttccaggaatggctctgattggccctgcttaggtccagtgcccacccctctaccaaccaccagggctggcttcatggcaatgtgaccagtgcagtcacacataatcctgggctcagaagggaccccacatttggggcttaatgctctgaagctaccaacttgaaattcttaaccctttgaatttgttttgtacatgaagtccaatagaacaattgagcatgtgccaggggcttgtttgtctgaaaaagaatgcatttctctttcattttttaagaatatttccaacaggtacaacattctagattgacattttttttccttttaccactttatagagatgtcattcagttatctcctgtcttctatcagttgaaaagtaggctatatttttgcttctttgaaggaaatgtcttttttcctttgaagacttttatcggccggacacagtggctcatgcctgtaatctcagcactatgggaggccgaggcaggcagatcacctgaggtcaggagttcaagaccagcctgaccaacacagagaaaccccatctctactaaaaataaaaaattaaccaagtgtggtggtgcatgcctataatcccagctactcaggaggctgaggcaggagaatcgcttgaacactggaggtggaggttgtggtgagccaagatcatgctattgcactccagcctgggcaacaagagtgaatttctgcctcaaaaaaaaaaatagacttttatcttctttggttttcagtggtttgactgccatgtgccctaaatgtgctttcattgtatttattccaatagtgctttttcattctgtggattgatgtctttcattgattttagaaaactcttggcctgaatctattaagataatgcttcttcctcaattcctactctcctattctcctgggactccaattagatggtagtcagccttttccactattatattatttacactattgattgtgtgttccattcttttattcctcccatgcactattctatatattttctaattgacccatcatccagttcactaattctttcctcagctgtctaattttctaataaactaatctattgagttcttcatttcagtcacagtttttatttctagaatttctttaaattatttttatggattcttattctgtgctgaaattatccaccttttcatcactttaaaaaaatattgatcataatttttttctgtttttggagagagggtcttactctgtcacccaggctggaatgcagtggttagaccatagctcactgcagccatgatctcccaggctcacattatccttcctcccatctcagcctctgtagtagctagactacaggcatgcaacaccatgcccagcttttgtttgtttgtttgtttgtttgtttgtttgtttttggttaagtagagaccagggaagtcttgctatgtcacccaggctggtctcaaactcctgagctcaagtgatcctcccacctcggcctcccaaagtgctaggattacagacatgactcaccacacctggccaattacagttatttaatagtccatgtctaatcattccaatatctagattactgtgagactgtttctatcctttcttgttttatattgtttttcttggtcctggcttctaatatgcatggtataattttttattaaatgccaagtgttgcgtataaaaaaattatagaaactctgcatgatgtctcttgcttccagcaatgacagacagttgaagtaaaggcagaccaccttaaaatcaagattgggtttatcaaagaatacattttgatttttgtaagtagtggcctatttatagttcttcctaactcctaggatatagccccacaagaattccaatgaaaagcttagagtgttttaccagggtccttcttcctccttcctgaattttagcttgcaggcactgtgaaactgccaaaagttctgctcatcctgtcaccatcttagctattgctgcttggtttctcagcttggcctgtgttgcttgcaaattgacagaacccaaggtgaaaaatgacaccaaatacagggctcacttcagtgtgtttcctttcattcttagatctttagctcttggtagtgctccaatgcctttagatatatatatttttctaatccagtttttttcattattcacagtgtaggccttagtttgaaataaactagtccatttacagccagaaatagaaatcagccactgactgatctgtggcctatctttatgtatgcctctatatcttattaattccaaaagtatttaagataagttgacacccttatatgacggttgatttgccttgtgttctatttcctgcttgaaacctaaactgttcactactctaatatcctaattaattttgttgtaattattatgtaaacttacattcaaaatgcttctcctcgatagctaaatctgactccttacatataatatttaacgtgtatttgggaggtcctttgcaaatgccgtcttgtacttactcatttttttaaatataagaaacagcattctcagagactagattatttcagagtaaaaatgaaaacatttataaacataagcactagtatttaatagaatgttgcctgtataattttgttctttgaaaacttatagttacctctcaaaggatataaaatttataaaacaggatgagcagaagctatgtataactcctatggttacattaacacaaaatctcggtaattcaaaattgaaatttattaaacatttctaagatgtaatttgtctctgaactaagaaaatgtcttattacataattaagtgtataagcattgtgaaggcagtttatcctactttaaaaaataaattgctgttaaggactgtcttaaggataccaacttttttttttttttttgagatggagtctcactttgttgcccaggctggagtgcagtggcgcaatctcggctcactgcaagctccgcctcccaggttcacgccattctcctgcctcagcctcccgagtagctgggactacaggcgcccaccaccacgcccagctaattttttgtatttttagtagagatggggtttcaccgtagccaggatggtctccatctcctgacctcgtgatccacctgcctcagcctcccaaagtgctgagattacaggcgtgagccactgttcccggccaaggatatcaactttttgtatggctatgaacagcatttaaaaatcagtttaatctatatcaaataataagaataataatacctatactatctcattttatttattttaaaaatgtcacttgtacatatacttagtaatgactgcaaattactatggataattgaaagtaccaaaaataaactgcaacacaggatttccctccccagcattttactgtcaaaaaaaaaaaaaaaaaaaaaaaaactggaaacctaggtacttcatcctccctaaagaatctttcataaaagtcatggtctttctacatttggttcctaaatgtactacattaactacaaactcagaaaaatgtttggccatagattttaaaaattgggaatgagtacagatagaacagataagtatacacaattatattttcccagctcaattgataactggcttttaatacaattatgggtcattattcagtattattattactgtggccaaaacatgaaattccatttttagcaggttccaattaatttccttggttggtcaaggaacctttcaagatttacaagcactcaagacacaaagcatctttcgtttttcttttttcaaatgctctattctatttcatctatttcccttgctcaaatctttatgactctttgttcatacttatcgatagagaagcagccaccacactggccatctatcagaaagtggtaatgagtttagcatgacaaaaaccagctgttgaaactgctgtattatgcacactgtatgttcataatacagtaatattgctattaatgaagagactgctatgtatttcaggaaccactgtatcagaaattcaactacagaaatgggagtaaaataagagatgtagacataccagggccagaatgacttctttggtgagaatcaatgttattcaaccatagcatcgtaccacattatatggagacattataggatgatggttaagacacagctttgatgtgaggcacttcaagcctttgctctgccacttattaatatttactatgtccttaagcaggttatttagcctctctatgctttagtgttctcatctataaaaccggggataacaatacctactttactggtttttcttaataagaatcaaataaaagtgaagttagaactcctaacccagtggctaacaaaaaaataagcagtcaataaacactttaaaaatattatgttttttttttttctctccatagattatgtgtctttttctctctgcctttggacctgatcactccgacactcttaccaacaccaggtgtttattacctatctttagaagtctacctttgcttcataggaactaccttagtgttttccatctcagactttgggattttatcttagttcacttcagacatactccagggatacagcagtgtacaatgggaaaagatttagacgtagtgttatcaaatagaaataaaatgtatgtcacatgtgtaattttacattttctactaggcatatttaaaaaggaagaatcagccagatgcactgcttatgcctgtagtcccagccactcaggaggctgaggcaggaggatcacttaggcccaggagttcatgcccagcatgggcagcatagcaagacccaatctcataaactaaaactggaagaaaaagaggaaaaagaaacaggtagcattttagtaatatatttatttgcatgaatatatccaaattattatgattttaacaagcagcaatcaccacatttcaagtgttcagtaactataggtgcttgctatattagacagtacaggcttagagtcaaatgaatgtggattcaaattctggccttgctttttacttgccatgcacttgctgtaaatctgtttcattatgttaaaaattactatctccagatattgtgagaattaaataaaaacagcatactcaaagcacttagcacaatgcttacttacaggcatgctcattcaatgagaattccctcacaccaaccttctactatagaactgaacactggctcaatacagtgaaatctgtgatccagattaagaggaaaggaagagaaaggaagccccccatcgtccttcctttctagctctctataaactgtggccatttctcccactcacacagctctccttctttgcttcctagcagctataaatttgactcggtagacttatttctagaatccctgaacccttgtagtcatgacccaagtatgtggttccaagaaactaaaaaaaaacccatgcctgaaagagaaatcctaccatctctttcttctctgcccctgtggtatccacctccccagctggccctactgcctagtcagacagagtttctcctttattcaggggttctcactgctgcagcttcctcagcctcagcaactgccattaacgttagtgcttctctattgaaagagagtctggcatcaaacattaaagaggctgagcagcattctgcaaaataactggacagtacccttcaaaagtgtcaatggcataaaagacaaagatcaaggaactggcatatactgaaggtgactaaagagacataaaaaataaaaaatgaaaatatgggatcttgagtaggatcttggcccaaaaaaaggacattagtgggaaaacaggtgaaatctgaataaggtctagacctattcgtctaataagattagatctaataatattctactgatgtcaatttcctggtttcaatacttgaactatggttctatataatgttaatattaggggatttgtgggaactctctacactatttttgcaacttttcttcaaaacaaataaaagtaaaattaagttaaaacacttttaaatgtgattatttaggactttattatgaaagaacctctgtcccgatggacttgttaagtgatatattattgtgaaatagtgcaacttatgttaagccaggaaggccatcacacaggttaacgaaaagtcaattccaaggtatagaaaattcaccttactcaccactatgagtttgtaaatcactaagagagtatgatgccacctacatatactatagtgaggacttgatgacagcaaatcatattttgtgcaaccaataatgttattaaataaatgtagctactgaataacatacttaaacaataactccactgtgaccaactttttacagaaagaaagagacagtgaaaaataagaaagatatgcaaaaaaataatatgcacccacctccctctgccagatctcccatgctttaggaaacaacactggtcaaccaactctgaacaaaaccccttgcaatagaaaggacagtctgctttgctatatatgtgtttctgtaacatgaattaacatagacaattggtaagtggagaaaagatttcagtgtaatgcagaagttacattggttcctatgtaatttttttcccagatgattaatgttttgccttattagtacaggcaactgaaggctacgtatactaatggcagcaaaccaggaaggaatcagtattatacattcagcctttctctgagaagtgctactgcaaagttaaccctgatctttgtttataaataactaaataaataaaacaaagtaacacaaaacaatgaggagagcatacaactctggtatcagtacattttgtacaaagcttacaagcttttctctatttatgacttgtaatgataatgtctttctgcccttgcatccacagacagcctcaacccttccttataccacctaccaccaagctatcttcaccttttatgttttaagtaaaacactacttttactgcagtttaattattagaaacttcatgtcttttaaactgtgttagtatttttattgacattgttattgttttcatcagtgctctggttataaagttgaataagccctactgatttaagtaagaatttggaaactgcaaattttccagaaaagcacacataatattatagtagaaatggtgtattaccacacattctgaatacattgtctcaagatttttttaatataaaaaggttatactggtttgttttcaaagattacttatttatcaatgaagtatactgttaatatcaatttctaaacaaaattacgaagtgtattttatcatcagctttaaatcgaacattttaatatacacttctgtatgtgtcacacatttcttaaataaataggatgttccaatgtagtaacaaaaattatcatctatgttaaaaacaaactgatgcattgtataagaaaagcaaatattcaatatttgatataaattaaatgtatattatgaactgcaatcaaaccaacatcaatcttctaaaatgaagcagtttctaaattgtatgaaaatacatggatatggtctagaaagcatgtttcatcataagactaaaaagatactttttattaggcagggtctcactgtcacccaggctggagtgcagtggcacaatcacagattactgcagtctcgacctcccaggctcaatcgatcttcctacctcagcctcccaggtagctaagaactacaggcacgcatcaccaaacccggctaatttttgtattttttgtagagacagggtttcaccgtgttgcccaggctggtctcaaactcctgggcttaagggatccacacaccttgccctcccaaagtgccaggattacaggcctgagccacctggccctgacctaaaaaaatactttaaataatgctaaagaagaatttagcatcagattttttgtttctttctcaaagcaacaatattgcttcacgatcatctgttgttaaatatataatactagtaactaagcactcttttatgtaaatggctcctcctaagaacaagcacatgaaagtttgtgttatttgtacatgacaaagatatagcacataactgagtcattaaaaacacagttcaggccgggcgcagtggctcacgcctgtaatcccagcactttgggaggccgaggtggatagattatgaggtcaggagatcaagaccatcgtggctaacacggtgaaacccgtctctactaaaaatacaaaaaattagctgggcgtggtggtgggcccctgtagtcccaactactcaggaggctgaagcaggagaatggcctgaacccaggaggcggggcttgcagtgagccgagatcccgccactgcactccagcctgcgcaacagagcgagactctgtttcaaaaaaaaaaaaaaaaaaaaaaaaaaaacacagttcaactggaatagctataatttatatatcaatcccaatttgaatagaatatttttgaagttaatgtatataataaatatcaatcactatgaatatttatataaaatagtagtgtgctctttttaatatactccatgatatggtaggatacttttatggacccatgcaaccctgaatatcaagcagccctgttttatttttcaattatctatttaagtccacttggttagagatagtcagcatgtttctcacgggaaaaaaaaaatactgcacaattgtctgcgtatagtgtgacctctttcacttgggtgggtatcctttccatcaccaactaagtgaggatataaccttgtcaaaccaaaggcaaaagaataataagcatatgacaggctaacccagcatggaaaaggttgtttaggaggttgcaaaaatagtactcggaatgacaaaataaaagtacacttcaaagagcaggttaatatttttaaaagcactcaaaacctgagaagcatttaatccccctccttggatgtctgccatacaaaactccacttgaatttatttcattagtcactaacgagatttggttaatatgttttcaaatgaatactggtagaatagtctgaaagaaacacatttatagaatatctatttccacaaagcactagccaaaggtaagtacaaataagcagatgatgtcttgcttttaccaattataaattaccatccaacaagaaaaaaatccttccaattcaagaatcagaaatacaaatgggaaaagtatttacccagtagcaggtttttactgtctccaaatcaaatggcagtaacactgctaccttaattgctacccctaactggcataacagggaatcatactacaacatttttataagtatttgaaaccagaagaaattagacaagtttggctacagtcttcctagtgtaaatttacttttaaagcaaacaaacaaaaatctccaaaccatttaggcctgtcctaggactatgtattatatcattgtgtcagttatacacactttgacattccttttctacattaagactggaatgaaatttttgatcctgaccagtcatcatattataacagtgaaacagtgccaccttttggacccaaacagaagcatccagtgctagtctttcaaacttcctttttcagttaaactcctgatgtacataaatgtcaatgattttcatgtcataattatcaccttctaggaatactttttaatctatacaaaccaagaaaacattggggtaacaaaaaagttgcttaccaagatgcaaaatttcaaaatattccaaagtagtaccaaatgcatgtatttttaataatttctaatcaacatttcattaaatacatttcaccaaatccaaatatgttagtcaactaacatattttaaatgcaaaaaattctttttatagcattgttacactgcaaaattgattttttaaaaatgcattgtatttaacatgtattcaatttaataattggcaatatgatattaacagtggattaccagttaaatcagcataagtataaataattttatatacaaatatagtatgcttctgagttacttacaccaatgatacaatgtcaccacggtgtacttcaaaattcctcactttccagtggttcaaaagcaccacatcagatgactggctccccccaggattcaaagaaggctagaaaataaggagaaagagacacttctatcatttgtatttttcaatcttcatggttcttgcacttcacagctcgagtggactgaaataaaacatttctaatacagtacctttctataaattgctgttctaaagtaactgcaaatgatgagttttcaaaaaggctcactgggattcttcacagatgaaccagaaaaaaataaattaccaatgcttatttgaaaggaacgtgtgctagacattaaaatctttagtaaactccaataaagaggtatgaaaagccttaagaataatataaaaacatgaggaagaagtgagtcaaacctcctaacaaaatatccagataggatctaattccacagtagtacacatcattgttccatctggggaaaagaagaaataatcccaaatcacagtcatgtccacaaatcttcacagtcatatgaaaaactgaagggggcaaaagaaagatgtgataggattaccattataaaatgtatggatttcccactttgacctctcttttctcaaaagagcacatatcctaagggtcctggtcccagtttgagcctaataaggggctttcatcctaggattcagagaagtctaactgtgcctgagggttaatggatcaagaactgagaaacattttgtgtaagaatttttctaaaggtcaggaaccatacaggcacaaaaatttgactggggaactatgaaaccagcatacctgtcatttggacaggggtacagacaaagccaatgaataacaagcttgaggcaagaacagggggacaaaataattagaaaagctaagatagccttttcactgttttttaaattttttttcattttttatttcaataggttttgtaagaaaagacagtgttcggttacatgagttaagttcttcagcagtgatttctgagattctggtgcacccatcacccgagcaacgtacactgtacccagtgtgtaggcttttatccctcaccaccacccacattttcccccaagtccccaaagtccaatgtgtcattcttatgcctttgtgccctcatagcttagctcccacatatcagtgagaacatacaatgtctggttttccattcatgacttacttcacttagattaatagtctccaattcctttcagattgctgtgaataacattatttcgttcctttttatggctgagtaatatatatacacaccacattttctttatccactcgttgactgatgggcatttgggctggttccatatttttgcaactgtaaattgtgctgctataaacgtgcgtgcaagtacacatctttttcatataatgagttattttttcatataatgagtttattttcctctgggtagatacctagtattgctagggactgctggatcaaacggttgatcgactttagttatttaaggaacctcgatgctgtttttcatagtggttgtactagtttacattgccaccagcagcgtaaaagtgtttccttttcaccacatacacatcaacatctattattctttgattttttgattatggccactcttgcaggagtgaggtagtattgcattgtggttttgatttgcacttccctgataattaaagatgttgaagattttttcatatgcttattggccatttgtgtatcttctcttgagaattgtctattcatgtcctcaatccactttttttttttttttttttttttttgagatggagtctcacaccgtcgcccaggctggagtgcagtggcatcatctccgctcactgcaatctccgcctcccgggttcatgccattctcctgcctcagcctcccgagtagctgggactagaggcgcctgccatcacgcccagctaattttttttatttttagtagagacggggtttcaccatgttagccaggatggtctcaatctcctgaccttgtgatctgcccgcctcggcctcccaaagtgctgggattacaggcgtgagccaccgcgcctggcctcagcccactttttgctgcggttgtcctttcttgctgatttgagttctgactctccaataatgctaccatgggaagtggccatttctgtggtgacaggaaaggtgccaagcttcctctccgccttcactgaggggctgatgacagcagccagtggagacacaacaacaaccagggcagaagcaaggaaaatagtgaacgcagggcaacagccagtccctggagcagtaatgacgtgccttttgttaaagattcctgggattatttgcagattttctacaaagcaagagttgacaaatatgtcaaaattctgcatggaggctattatcttgacactatttttgatccagggttttgcagctgaaaaatactggttatccttgaacacctcaaacactttcagaactttcaccaactcctttagtgataatacctaaatccctaacttaaattccctgctactcatttcacttaactacctgacaaaaaattcaacaggattaaaatggaatttgttatcatttcaacaaataaatttttttttgagacagtctcttctgcttttctgcctcagcctcctgagtagagctgcgactacaggtgtgcgccactatgcccagctaatttttgtatttttagtagagacggggtttcaccatattggccaggctggtctcgaactcctgatctcgtgatccgcccgcctcagcctcccaaagtgctgtcattacacacgtgagccaccacgcctgccctcttttttttttttttttttttaagagggtctcgctctgtcacttaggctggagtgcaccggcatgatcatagttcactgtagccttgaactcctgggctcagtctcccagttccagttcccaggtagctaggactacaggtctacaagtgcataccaccacatccagctaagtcgggttttttttttcctttttttttttttagagatgggagggtcttgctatgttgagcaggatggtcttgaactcctgacctcaagcaatcctcctgccttatcaaccaaagcgctgagattacaggtaggagccaccatgcccagccctttcttattttcttacatccgggttacccttttcccagtcaaccagtttaaaaacttagttgtcttcttacttctcatccaaccagtcagcaagctaaagggatctttttttaatcataatgtcttctacttctggcacgttttctttcctctctagtatcatcatatttcaagcaccaatcattatgtaactcatgctatatctacactaatcagtctctcacctccaacttagaaatgattccatttctttctagttatatgatcttcagcaagttacttaacttcattatgccactcattactaggaaaatggtgatgaataataactattatctaattaataattaaataataatagccaatacctacgaagtacttaccatgtgtcctggtctaataataatagccagacatgttaagtgcttaccatgtgcaagacactgtttaacagctttacaaatatagttgacccttgaataacacaggtttgaactgcgtgggtccaacaatacacagatttttttcaataaaagttacactgagtgtgcctgcctctcctgcttccctttcccacctcttctacatctgccacccctgagacagtaagactaactcctcttctttctcctcctcctccttagcctactcaatatgaagacagtgaggatgaagtcctttacgatgatcctcttccacttaagaaacaaaaatatatttttctctttcttatgatgttcttaataacattttcttttccctatcttactttattgtaaaaatatagtatataatacatatagcatataaaaatatgtgttaatctcactgtttatgttaacagtaaggcttctggtcaggagcagactattagtagttaagttgtggggtgtgggacagtcaaaagttatatgcaaatttttaactgcatgggagttgggtccctcaccccctcgttgttcaagagtgaactgcgctaccttatttggtaagatcattcatttaaagtgcttatggtagttcttggcccatacttacctctcagtaacttctattattgatatttctacatcacaattttaattttaagcaggtctgtactctctacccccaggttcctcctatgtctctatctctagtgaggaacagagttgatatggtagcataagtccaaagggctttactgagccatggtgctgaggaatggagcttttgtcatcacaacagtaggtcagattattaaaaggtgagctttcacaagggtatgctctctatctcattcatatttctcattcaaattctctatctccctcttcctctctgtctttgacctcagtatccacaggtcctcttccctaatttatttgtattctttttcctatataactgacactgtaaaggtgacctggagggagaccatctgggctctggaccataaagagaaaatattcctattgaactttcactgcattcgttttttttttcttttttcttgccataatagtgaaggaacaaaaggtgatttaattatttctgactgttctccttggtctcttttactggtgttttttttgaagtttgtgaccacaactcataagatcaaaaatcccaagttcaccatcacagcctatgattatttctataataatatttaaatatgcattataatcactcccttgtctctctttccaagagtctataagctctttttttttctaagttttgagaataaattatttcctatgcctatatttttgagatcgagcactttgcaggtaattaacacattttagtggaaagaatttaaaaaaatcaattagtggaatttccaaagattttcaaaattaacaaggtcaaaacaaagatcctattccagcccactccagcccccaaatatacttcccctccttatttaacagtagtaccacttaccctatcccccatactagaagactcataagtcaggtccagtttctaacccgctctttggatgcctcattatcagacttcccctctgtcaagaatgttttttccccacttggaaacttctagtcatttgtcaaagtccttatctgatggggactcctctgtaaagcctttaaaaagaataaaaaacatgctgcagttcccttaaggaaattggaaaattatatcttggtgttccaacaatggggatagaaaaatccccactgacccaaattttaacttcgtctttcccttatagaatcactcaaatgcccaacttttctaattgtaattgttagaaccaaaaggtaaagcattataaacaaaagatttatgcaagggaagaaaacagaaggaagcatgtctaacttccaatagtgaagtaagtattagaatcaacagtcaacacctgaatgacattgcttgattttataaaggaagcaacagagttttcttttaccttttctttcctccacaagtttaaattagctactccctcatgtgcgctcccatagcaatgcaggtacttaataggtatctgcctacagataagactcttccactcaggtgtaagtttctcaactgctgaaaccgtgtcttagccatttttgtacacctaatcccagaacagtgattggaaaataatatttctataaagtctaaaagattaaaggtttttaaaagcgtatttaaatcagatagtttctagaatatacattatctaaataatgtatacatctctttcaatgaaaacatattctagataagtatagcaataaattttttgtgtctcatcaagttaggcaatttaagagttagaaatagttgaatagggctttgttattcataatgaaataatggtaatcacaacacaataaactatcttgtttatttattaatctaacacttatgaatatcaacaaaacatcataaagaaaaaccttcttgaattgggaagttgttcctatggcactataagaaccacagttttctgtacttcactaaaaacaaaagctttattaaaaagaaaaaaaacaggccgggcgcagtggctcacgcctgtaatcccagcactttgggaggccaaggtgggtggatcacgaggtcaggagatcgagaccatcctggctaacacggtgaaaccccgtctctaccaaaaatgcaaaaaaaaattagccgggcgtgggggcgggcgcctgtagtcccagctactcgggaggctgagacaggagaacggcgtgaacccgggaggcggagcttgcagtgagcggagatcgcgccactgcactccagcctgggcgacagagcaagactccgtctcaaaaaaaaagaaaaaaacagtggccggtcacggtggttcacgcctgtaatcccagcactttgggaggccgaggcaggcagatcatgaggtcaggagatcgagatcatcctggctcaacacggtgaaaccccgtctctgccaaaaaattagccgggtgtagtggtgggccgctgtagtcccagctactcgggaggctgaggcaggagaatggcgtgaacccaggaggcggggcttgcagtgagccgagaccacgccactgcactccagcctggggcgacagagcaagactccgtctctaaaaaaaatatagagcaagcaattttttcaaatcgatgaagttaaacacatcaagtagaaattaaaagtcataaataataatttgatatggccacagaatctgtattttcttgttatattgttaatatttaaatcctagattccaagagactacatcaaaatataactaacttaaaataataaagtgtttgaagaaatctcagagaatatttaatctaggagtttccacctgtatctccaagtatttgattgtatcagatattcctgctagtagtcacagtgatttccagtagcaaaaggaaaaacactaacaaagaacaaaaaaagccaaacatctgctctggactgagtaagaaagacccaccctcacccaaggtgggcagacaccatacaattagttgagagcttggaaacaacaacaaggaagaggaaaggtaaatattctctgtctgtctctctcaacaacttgcattctcacactcatctatttctctgcttctaccatggaccactaaagttaaaaatcaaacttggagaagtgttttgaatagtccttgccctaaacacagaaaactatgttcaaatcttgtctccatttcttattaaccatattactttaaacagattatttaacctgtctcatttcctcatctataaaatggggactgactgcaggaacactgatctcatggagttgctacaagaattaaatgagacagtctacaaaacattacagtcatgaaacagagtagcagtcaacaaataggacactaatgatgatggcaacaataacaaaataaagggaaacaatatcaggtacagtatcctttccacaagatttaagaaaaattaaacatttaaatattgccctgcacatttctcattttacatagtaaactgaaagtattcaggcagaaaattctacccctcatttctaaattctttgttgattgtttcctcacttttttaaagcaagtaaagttaggatgcttttatgtggggccttaattgttctgcctctataaattaatccaaaaaaatttaatatgcataattagttatgaatacctataaaatacctaaagaattttacacccgttatgttttacattcttatttttaaaacatatacacacatacagatatatataaaaacatatgcatttaaaaatctaacagttcttagctctggttgatgaaatgatttccattttctccctccctactgcttacccctccccacaccttgttttcctctggctcagttgtatctcacaaattgttttttataatgaacatatatttagtttgtatgctttgctctgacctaagtactatatagttcactctaagaaatacaatataagtcagcatatttcaacagatgttagtaagttatgctaaagctagaaatagccaatatctatcaaatctgcttttggaacaagcataacacaaaagttaggctttaatcttttctctgatcaaagactatgctgaaggatttttatttgtcctacaaacaaatattattgtcaaggtatcctaaatcctcagcttgtgtctaacctcaaatcatatgacaggtttggaagaatttatctttcggtttacgaaaataaaattctcctagagaattaagcacagtcacagtacacttcctgttttgtaagacttaactgaagccatcaatcaataaatgatattattctggctttttactataaattttttattcattttttaattttaaagaatctacagcctatgattcactgcctccaagatataaagaaagcctggttttgaccttacttctttgggtacaatgctttcaaccttttcaggcttataaaaagcaccactcacactggctacatacaatctacaacaggtaaatatcaaactttgtgcttttaagtgagatggagcccagctgcagccacaaggacccaacagtagccctcagacttcttttgaagaaccattactttgaagacatatctgtggaggcgggggcaataacagaagaaactgaaatagtactgttgatttagactttttaacactgcagcactggccaagaagcatgaagtaagtacagttaaagtaaatgtacattctgattaagaattattagatgtcacacctttgaaagaatgcggacaatatggtctacaatgccgtctttcttcccttgctattcaggggtctccataatttgcatggcttctagaattctcagatttgtctcactaggtgtgcataataaaatagactataatgtacccaggtctgtacaaagctgtaagttagaaatggaacattccttttatatcatgggtacttattacccataccccttctgatggttaattttaggtgtcaacttgactagattaaggctacccagaatgctaagaaagcattattctgggtatatctgtgagggagtgttcccaggagagattggcctttgaagcactggattgagtaagaaagatccaccctcacccaacatgggcaggcaccatgcaattagttgagggcttggatacaagaacaaggaagaggaaaggtaaatattttcatattctctctcgctctctctctcctgacgctgggacaaccttcttctctttccattgcaaatcttagaactccaggtcctctgacttttagactctgggacttgaaccagcagcccccaggtctcaggcccttggccttggactgagagttataccatcagcttctgtggttctgaggccttcagacttggactgagccaagctacctggacctccagcttgcacatagcctataatgaaacttcttagcctccatgatcacatgacccaattcccctaataaattccctctcatagatagatacatagatagatagatagatagatagatagacagacagacagataaatatcctattcgttctgtctctccggtgagatctaattataatataatttcttaatttttcttttaaaagcaagcctgtaaaactacattaataaaataaaagtgaacatataacatattgatttaattcagaattacactaggttgttaatttttcattctcctaatcttaactgcatgttctactatagaacgccccatcaaagtgtcacaggcacgctcacatactacctgtaggaatgaaaatctttataaactatcaacaaggtaatttgccaaaatatatttaaagtcttaaaagtgatcttgtccttagacttgaaaatgtcacatttaaaaagatttcctaagaaactaattggacatatgtgcaaaggaacatatacaaagatattcataatacattatttacaatagtgaatagcttcttagtcttttagctaaaatcaagtgaataactgagccaagctcaataccaataataggaaactgattaaaccttggtttagcaatggttaaactttatggatattaaaaaatgattgtaaaaattacattgtggaaaaatatatatttggatatgtctggagaataagtgaaaaatgcgacatagaaaaaacaaactgctatgatccaatttcaggaaagacaggacggaagaaaaaagggaaaaaccttaaaagaataaagtaaagaaggaaattgtgcagaaaagaaagagagtaacttataatggtttagaaatgcaaacttcaaagtcagaagctgggtttaaatctatgcaatcttcagtaagttatcccatctctctgattgtatttcttcatctgttaagtgggctaacatagtatcttcatcatacagttgtgggtgatattaaataaactaatatatataaagtcaatactgtaatgacttgaacatagtgatcattcaataatttttcactattagtattatataataatatatttaaaataaataattctgaaaggtggtatcaattatttattttccacatttttctatgttttctaagttttttgccaatcaatatgcagtgcttttatattaatgtaagcactaagcaatgaattgtttttgaaggggaaagcatctgatttttatatcctcttattactaatatttttaaagtttgtgttctttaaacaagctcttcagtatttaagcatctctttaattcaggtcgctacaactagattgcaaggttcaaatctgcaaagtttctgtttcaatgcactaattataaaatactaccattaaatacgtgcattgtgtttcctagctaataaaacatgttttgagatagctattctaatttatagttctaattaaccatatcagaaatagatcacatatagtcaatgaaatataaaatttatataaacatatctgcatattaacctgaagacagactgctatatataaaataagccagctacacggaaaaaccccagcaagatacatgcggaatctttaacttcctcataaaactgaataaggctttcctattcattgctaagtttttcttgctcagaaccacttttctgtctcctaacctaattaaaaaaaaaaaggtcatagtaaggtgtgtagcacagaaaggaagtgattcaacaaataacaaagattttaggaggctgcatgattccctcagaagcatgtaactccaaagaggccaaattccccaacatatacaatggtgtagcaatctattcacatggcttatataatatctgtgaacaaatctgtgaagataataccatggattttagatcctttagttcttcattgttgaacctgatgctgcattataaggaaaaaaataaaaaagaaccagtcagcatcctaacactacaaatgtgtatcaacaggaattttggtacctgggtaccctaaattacattgatcaaagctataagaacaaaggagctcaaatgcataggaaacagcttatcaaaaggaactgaaaagcattctggcagataaaaagggggaaaaaaggatatataccttatatcatttatctactgctacaaaacaaaccactccaaaacttaaaacaaaaatcatttattggttcatgattccacaatttaggctatgcttagctatgcaattagccagcttgtctggctgtgatcactcaggcagctgcagccatggaggcagcagtgttccaggagcaaaaactccctcgtgtaagcatctaccaagcctctgtttgcgtatttgctgatattccaccagccaaaatgagtcataaggccaagtcaagaatcagcataggtgaggatgacatagagctcagtaccgaggagcatgactcatgggggatggggtagacagggaatatcaatgtaataatctaccaaaactctgccctctagctccaatgaatcatatccctcacatatgcaaaatacatataacccttcctaagagccccaaggtctcctcagatgtttgcaataggattcatatccgttaattcatgatatgcatcaggtcccaggtcccagtatggaagaggactctagggtgcagctcatctcaaatcagagacttatgaagtgaaaagataaattatctgttccccaaacaccaaacatataatggaaagacagaaagaagataaccatggattttaaaaagcaatgaaaaaagcatagaagtcacttgtccatagaaagcttaaaatccagcagcatgtgttgtcaaggcctcccatctcatggagagaaatgtcctttaattaagattcttttctgttctctggaatggttccctaatttattggtctgcatggctcttagctctgccctctgggctttgggctcttttttaaaaaggaggcccggtggagccaagatggccaaataggaacagctctggtctacagctcccagaatgagcgacgcagaagacgggtgatttctgcatttccatctgaggtaccgggttcatctcactagggagtgccagacagcaggtgcaggacagtgggtgcagagcaccaggcacaagccaaagcagggtgaggcattgcctcactcgggaagcacaaggggtcagggagttccctttcctagtcaaagaaagaggtgacagatggcacctggaaaatcgggtcactcccaccctaatactgcgcttttccaacaggcttaaaaaaacggcataccaggagattatatcccgcacctggctcagagggtcctatgcccatggagtctcgctgattgctagcacagcagtctgagatcaaaatgcaaggcggcagcgaggctggggaaggggcgcctgccattgccgaggctcgattaggtaaacaaagcagccctgaagctcgaactacgcggagactaccacagctcaaggaggcctgcctgcctctgtaggctccacctctgggggcagggcacagacaaacaaaaagacagcagtaacctctgcagacttaaatgtccctgtctgacagctttgaagagagtagtggttctcccagcacacagctggagatctgagaaagggcagactgcctcctcaagtgggtccctgactcccaagcagcctaaatgggaggcatccgccagtacgggcagactgacacctcacatggccgggtactcctctgagacaaaacttccagaggaacaatcaggcaggagcatttgcggatcaccaacatccacttttctacagccaccgctgttctgcagccaccgctgctgatacccaggcatacagggtctggagtggacatctagcaaactccaacagacctgcagctgagggtcctgtctgttagaaggaaaactaacaaacagaaaggacatccacaccaaaaacccatctgtacgtcaccatcatcaaagaccaaaagtagataaaaccacaaagatgggggaaaaacagagcagaaaaactggaaactctaaaaagcagagtgcctctcctcctccaaaggaacgcagctcctcaccagcaacggaacaaagctggacggagaatgactttgacgagttgagagaagaaggcttcagacgatcaaactactccgagctacaggaggaaattcaaaccaatggcaaagaagttaaaaactttgaaaaaaaattagacgaatggatacctagaataaccaatgcagagaagtccttaaaggagctgatggagctgaaagccaaggctcgagaactacgtgaagaatgcagaagcctcaggagccgatgcgatcaactggaagaaagggtatcagtgatggaagacgaaatgaatgaaatgaagcgagaagggaagtttagagaaaaaagaataaaaagaaacaaacaaagcctccaagaaatatgggactatgtgaaaagaccaaatctacgtctgattggtgtacctgaaagtgacggggagaatggaaccaacttggaaaacactctgcaggatattatccaggagaacttccccagtctagcaaggcaggccaacattcaaattcaggaaatacagagaacgccacaaagatactcctcgagaagagcaactccaagacacataactgtcacattcaccaaagttgaaatgaaggaaaaaatgttaagggcagccagagagaaaggtcgggttacccacaaagggaagcccatcagacaaacagcggatctctcagcagaaactctacaagccagaagagagtgggggccaatattcaacattcttaaagaaaagaattttcaacccagaatttcatatccagccaaactaagcttcataagtgaaggagaaataaaatactttacagagatgcacatgctgagagattctgtcaccaccaggcctgccctaaaagagctcctgaaggaagcactaaacatagaaaggaacaaccggtaccagccactgcaaaacatgccaaaatgtaaagaccatcaaggctaggaagaaactgcatcaactaatgagcaaaataaccagctaacatcataatgacaggaccaaattcacacataacaatattaactttaaatgtaaatgggctaaatgctccaattaaaagacacagactggcaaattggataaagagtcatacatcagtgtgctgtattcaggaaacccatctcacgtgcagagacacacataggctcaaaataaagggatggaggaagatctaccaagcaaatggaaaacaaaaaaaggcagggattgcaatcctagtctctgacaaaacagactttaaaccaacaaagatcaaaagagacaaagaaggccattacataatggtaaagggatcaattcaacaagaagagctaactatcctaaatatatatgcacccaatacaggagcacccaggttcataaagcaagtccttagtgacctacaaagagacttagactcccacacaataataatgggagactttaacaccccgctgtcaacattagacagatcaacgagacagaaagttaacaaggatatccaggaattgaactcacctctgccccaagcatacctaatagacatctacagaactctccaccccaaatcaacagaatatacattttttttcagcaccacaccacacctattccaaaattgaccacatagttggaagtaaagcactcctcagcaaatgtaaaaaacagaaattataacaaactatctctcagaccacagtgcaatcaaactagaactcaggattaagaaactcactcaaaaccactcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgcagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaagatcaacaaaatcgatagactgctagcaagactaataaagaaaaaaagagagaagaatcaaatagacacaataaaaaatgataaaggggatatcacaaccgatcccacagaaatacaaactaccatcagagaatactacaaacacctctacgcaaataactagaaaatctagaagaaatggataaattcctcaacacatacaccctcccaagactaaaccaggaagaagctgaatctctgaatagaacaataagaggctctgaaattgtggcaataatcaatagcttaccaaccaaaaaaagtccaggaccagatggattcacagccgaattctaccagaggtacaaggaggagctggtaccattccttctgaaactattccaatcaatagaaaaagagggaatcctccctaactcattttaggaggccagcatcatcctgataccaaagcctggcagagacacaacaaaaaaagagaattttagaccaatatccttgatgaacattgatgcaaaaatcctcaataaaatactggcaaaccaaatccagcagcacatcaaaaagcttttccaccatgatcaagtgggcttcatccctgggatgaaaggctagttcaacatacacaaatcaataaatgtaatccagcatataaacagaaccaaagacaaaaaccacatgattatctcaatagatgcagaaaaggcctttgacaaaattcaacaacccttcatgctaaaaactctcaataaattagatattgatgggacgtatctcaaaataataagagctatctatgacaaacccacagccaatatcatactgaatggacaaaaactggaagcattccctttgaaaactggcacaagacagggatgccctctctcaccactcctattcaacatagtgttggaaattctggccagtgcaatcaggcaggagaaggaaataaagggtattcaattaggaaaagaggaagtcaaattgtccctgtttgcagatgacatgattgtatatctagaaaaccctattgtctcagcccaaaatctccttaagctgataagcaacttcagcaaagtctcaggatacaaaatcaatgcacaaaaatcacaagcattcttatacaccaataacagacaaacagagagccaaatcatgagtgaactaccattcacaattgcttcaaagagaataaaatacctaggaatccaacttacaagggatgtgaaagacctcttcaaggagaactacaaaccactgctcaatgaaataaaagaggatataaacaaatggaagggcattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcctgcatcaccaagtcaatcctaagccaaaagaacaaagctggaggcatcatgctacctgacttcaaactatactacaaggctacagtaaccaaaacagcatggtactggtaccaaaacagagatatagattaatggaacagaacagagccctcagaaataatgccgcatatctacaaccatctgatctttgacaaacctgacaaaaacaagcaatggggaaaggatttcctatttaataaatggtgctgggaaaactggctagccatgtgtagaaagctgaaactggatcccttccttacaccttatacaaaaattaattcaagatggattaaagacttacatgttagacctaaaaccataaaaaccctagaagaaaacctaggcaataccattcaggacataggcatgggcaaggacttcatgtctaaaacaccaaaagcaatggcaacaaaagccaaaactgacaaatgggatctaattaaactaaagagcttctgcacagcaaaagaaactaccatcagagtcaacaggcaacctacaaaatgggaaaaaattttcgcaacctactcatctgacaaagggctaatatccagaatctacaaagaactcaaacaaatttacaagaaaaaaaacaaacaaccccatcaaaaagtgggcaaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggtgattcctcagggatctagaactagaaataccatttgacccagccatcccattgctgggtatatacccaaaggattgtaaatcatgctgctgtaaaggcacacacacatatatattgtggcactattcacaatagcaaagacttggaaccaacccaaatgtccaacaatgatagactaggttaagaaaatgtggcacatatacaccatggaatactatgcagccataaaaaatgatgagttcatgtcctttgtagggacatggatgaaactggaaaccatcattctcagcaaactattgcaagaacaaaaaaccaaacaccacatgttctcactcataggtgggaattgaacaatgagaacacatggacacaggaaggggaacatcacacagtggggactgttgtggggtggggggagcggggagggatagcattaggagatatatgtaatgctaaatgacgagttaatgggtgcagcacaccaacatggcacatgtatacatatgtaacaaacctgcacattgtgcacatgtaccctaaaacttaaagtataataataataaaattaaaaaagaaagaaaggaggccaggctcacacctgtaaccccagcttcttgggaggcgggaggatggctccaggccaaaagtttgagaacacctgggcaacatagtgagactgcctccacacacaaaaattttaaaaattagctgtccaggacttcgaggctgattgcaccaatgcactccagcctgggcaacagagcaagaccctgtctctttaaaataataataataataataataatataaaaataaataataaatttttaaaaagaaatgctccttcataataaggtggacacaccccagaggtctctttctaaattgaccccattttagtacaagttaattcaacacccttaaaatgttgtagacttcccattaatctagttggggctcattccattccccccaaaactacatccatatcttccttcttttttctttttcttgccctgtcccccaggctgcagtgcagtggtgcaatctcagctcactgcaacctccgcctcccaggttcaagcgattctcctgcctcagcctccagagtagctgggactacaggcacatgccaccacaccaggctagtttttgtatttttagtagagacaggttttaccatgttggccaggatggtctcaatctcctaacctcgtgatccacctgccttggcctcccaaagtgctgggattacaggcgtgagccaccacgcccgacccttaatttttttcaaaccagatctttctttactttgaaagtgtcaggctgctgtggcacaaagccctgaagagtttacaatatattttgtctaattaaaaagatatactaagtaccaccttatatctttctgaggttttttttgtttttgcttttgtttttgtttgagacagagtctcacggtgtcacccaggctgaaatgcagtggcacagtcttggtttattgcaacctctgccttctgagctctggtgatcctcccacctcagcctcccaagtagctgggactacaggcgcatgccaccaagcctagctaagttttctatttttagtagagacagagtttcgccagttgcccaggttggtctcaaactcctgggctcaagttatcttcaagccttggcctccccaagtgctgggattataggcgtgagccactacacccagccctgaggtcttaataaagagtcttccagtcctgatttgatctctacccgaggctatttcttattttgaggatcttttgcctgctagatactgggaatgaaaaatagttttattttccaacccaaaaaagttctgggcaccctatatttcctctaatttctgctataagttcatttctctcttcccatatcttatataaagctatacgaagccagctgacaatttcaatattttcgcctggaaatctccttagccaaatctataagatcattaggtatatcttctatttttcaagttcttacagttcacatttttaaaaaatgtttaagtaccataaaacacagatcatcgtaattccagtccgcagtaacagatactttactatctttctgttttctattaacagttgtttgccatttgtccagcgtctgccaacactcccctcaccacattaccagccccaaactgccacccagtccccaaatcaatgctacatattttaggtttttgttatagtatcacttcactaatagtaccaatttttgtttcagttatctcttgcttcataacaaaccactccaaaactatatgtctaaaaagaacaaccaaaatgtatctgcttgtgatcctgcaattttggcttccctcagctggaaagttcaagatggcttcattgacatgtcaggcactcaactggggctggaaggccaggatgcttcatttattctccaaaatctccgtcatcaggatagcctgagtttttacatgtacccagctcacaagtactgaccaagctcctacttgagcagtatttgcttatatcctactgaccaaaacaagtcacatggtcagagtcattgtgggaggaaactacacaaatcaatgagggaggcctgattcactatggaatcattaccataaaaatctacacatatctcatactaaatgaatgggccatccattcagctgacaatcttgtgactgtgctttctgttgatcattttaaaagctacagaaataaaagatagtttatattttaaaaagaaagaaaaaaattcactgacaaaaaaataaaaattttaaagataactaaatagtcttaaaagcaaatgacaagctaaaaagtataaaacaggcattttaaaaaataaaattaaaaaagtttacgaagaaataaaaataaagttcataaaatagaaaaatgtttaattaaaacttaaaaattaaaaaaagaacataattataaaatgatatacccattggtataatattgttgtggtctttctactccttagctcaggtaggtccgagttcttgtcgcacaaccaggaagaattaggcatgcagacaccagagagtcagtaaagtagaatttaacaggcgaaaaaggaaagctttcagccaagagagggcacagagggtgggaggggtatggttcccctatctgaaggcagggaagtccccagtgtggctgggtccagggccttttatatactcagaatggggagagtgtgttgattggtttgtgagtatgcaaaaaatgttaaagcaaagacaccactcaaaggtgggcacgacagagtagaaaaccaattaggaaagggtaggtatatgtgaaataggtgaatggtggggatctatcagaggaaatcatgccaaataggcaagttctcaatccagtctgaggatgtaacttgtagcttggctttcaggctttaaactgtcttgggcttggaaggggggtttcactggggacccaccctatctgcctaggcatttggctgcttcctgccactctcaatattagaaacaataagctaaaattagcacaaatatatgataaataatttaacagacaaagagatgggaaataaaacaaattttttaaaagttataagactaagaattcaaaagtttagtaaacaaaggcaatcaggattttccaagcaaaagcaattaccatgtctagcaaatcccccaacaatttgccctcacccaagacatggagctctccttaagaaaatggttctcaaactttagtatttacagagtttgttaatgcagattccaaggtcctcacaaaacgattctaatttcataggtctgaaatggggctcattaatcttcattaataagtaccccagattatgtaataaaaaaggcccaaggaccacagcagctacaaaagggttttctcaaacaagggacagactatggggctccttatccttcgtgttgcacttattgcttgaagtgcttatgacaagcccacatttaaaatttcagaatcaaaagttaacatgctccactcccttagttatagctcaatttgagctgtctcacccttgtaagcttccctccagcaataaagcagcattttgcaaactacaggtcacaaccaatgagtgagtcagaatcatcaatttaataggttatgaccagaacagaaaatatcagagggcattgcacataatgatagtaattacaatttaagtattgttacatgaaacttttgttccagttgcatgtatgtgtgtatagtgcaaaatatattacttaatatgagtcatgagcaaaaaggtttgaaaatctctgccataaagaatatgatgaatttgtcaagaagctaaaaactttttaggagaatagttcaccagaaacaccctcaaagtctaagaaaaaaaaaattttaatgatcataatttcattttatcatatttctgtagggtttaattattcaggcatatcaatgcttcaaagaagaaatttcatatgcatttattccagcatccctctgaactagcaggtgagaggattatggtcccctttcttttagaaacttacagagtagagttattattaacccatgaaattaataattagagggcagtacaaaaggatttataatcatgagttaaacttacaatgctgtaggatttctaataagtgaatgacagaattaaagaaagttacatgaagaaaatagagcttgagtttagacttaaagggaacttcagaaaaagcagaggagaaaaggtataataatgagtcgtgttatacagtcagaataggctaaatgcttgtaaaaagaatttcaaaagctcagtggtataacacaatagtgagtggactgactccacacaatcattcagaaacccagttttttcgagcttgtacatctaccatcccctgcggcatcgtgtcctcaactggatcctctgctgtattgtattatatacatacatatacataaatatagatatagatattgatacagatatcaaaatcagtatagatatcctgtatattatgatgttttgacacgttaaaaaaaacattcctagctggggagacactgcctctgccagacctagccaattcttccagctagcaagagctcaaccagaagcatgcctttcatatacaaactaaccaatccagaaccatacctcctccagccagcataaccctggagacaatttcctctgccttcatcttcccaaggccaggtaccaggcaaccagggaccacccctacagcttagaatctgccaaaattattcaaactagccagtcctaaactgttcattctgccctgccttgccttgccttgcctgcacagaaaccccaaaaaggctttggcctagctgctattgtcatctgcttcctgaccactctggtgtctttcccatgtggccccacataccgtgctttaccttcctgtctctaggacctgtaagtctaataaactttgttttcctgagcctctcctctgtctgctctagtggccatacctaactaaccaactcataaaagaatacaaaacatctgccttcagccagcagacagaggagagagcatggaggatcacaaagatttttcatgggccaggcctaaaaatggcacttcacttcctcccattttccactggccagacctcagtaacctctgatatcaggaaagattaaaaaacaggacaagaaatcatccattcatcattagtcatccctcttacaactaaaacaccctgaacataacaccacacacaaaaatataggaggatctgcaaggtggaaagaagataaactagaggctaggaaccacaggacttgagaaatgacaccatcgctcccctggactttctttttgcttctcatatatcctagatcaggcactagggaatcctgcaacctgtagctaccaacaggccaagcaaaaaaaagggcctgaagacgtggtggccaacacctgtaatccagcactttgggaggctgaaacgggcagatcgcttgagctcaggagtttgagaccagcctgggcaacatggtgaaaccccatctctaccaaaaataccaaataaaattagccaggcatggtggtgcaagcctgtaatcccagctactcagggggctgaggcacaagaatgtcttgagcccaggaagcagaggttgcagtgagcggagatcgcgccactgcactccagcctgggcaacagagtctccctctgttgaacaaaaaaaaaaaaaaaggccttaagaaaagcctactctctctagccaaaggaccaggaaaaggaagacctagcagaacagaaacatttttgctaataaccatcctaatccagtcaaacatcaaaggaaaaactaccccaccccatcccccaacaccatggtgtcagcagggcccagcaaggagctggacttctaaccccactcagcaattaggagatggggcaagtaggcccttcacttccccgtatcaggtgtcaaagaggtggaatgagagtgcaagtggtgccagttagcagcccactttccccaccccagttagttgagcaatttctttagaagttaaacataaatgtaccatgccactcagcaaccccactattacgtatctgcccaagagaaatgaaatcatgtatatacacgtaactgtacacaaatatctatagcagcattactcacgataatgaaaacatcaaaacccaaacatttatcatctggtgagtggagaaacaaaatgtggtatattcatacagagaatactttttgcaataaacagacacaaaatgctaatacatagtacaacatggctaaacctcaaaaaaatctagtaagtaaaagagccagtcaggaaaaaccacattagtatggttctatttacaggaaaggttcagaaaaggcaaatctataaatcagatcagcagttgcctaaggaaagagatgggagtgaggattaacttcaaacaagcataaggttcctttctcaggtgatgaaaatattttaaaaccgggttatggtaatgattgcatgactccataagtttacttttaatactatttattgatattttattatataaaacataatttttaataaaaaattcaagtcatcccaaagcgttctacagattcaattgcactatctttaaaactctgatgtcatttttcgcagaaatacacaacacaatcctaaattcatatggaaccacaaaagaccctgaatagccaaacaatcttaagcaagaagaacaaagctggaggcatcacactacttaactcaaatgcaaaattatagtaatcaaaacagtatggtactagcataaaaacagacatatagaccaatgtaatagaatagagaatccagaaataaatgtacacatttatgaaaaatcaattttcaacaaagatgccaagaacatacaatgaggaaagaataggttcttcaataaatggtgcttggaaaactgaatatccacatgaagaagaataaaatcagacccttatctcacaccatatacaaaaatcaactctcaatggatttttaaagatgatgcctgaaactgtaaaactacctgaaactgtaaaactactagaagaaaacatagggagaaaagctccatgacactgatctgagcaatgatttgttagatacgaccccaaaagcacaagcaacaaagcaaaaatagacagctgagctcctatcaaactgaaaagtttctgaagagagaaggaaacaatcaacatggtaaagagacaatctatggaatggaagaaaatatttgcaaaccatatatctaataaggggttaatgtataaaatataaggtacacaaacaactctatagcaagaaaacaacttgattttaaaataggaaaaagacctgtatagagaattctcaagacatacaaatggcccagaagcatataaaaaatattcaatatcactaattatcagggaaatggaaattaaattaaatgtgcaatgagatgtcacctcatacctgttaggaaggctattatcagaaattcaagagataaatgttggtgagaatatgcagaaaagagaacccttgtgctctattggtaggaatgtaaattagttcaaccattatgaaaaatagggatatatctcaaagaattgaaaacagaactaccagatgatctaccactctcacttctggatatgtatccaaaggaaatgaaatcagtaagtcaaagaaatatcttcactcccatttcattgcagaattattcaaaacagccaagatatggaagtaacctaaatgctcataaatggatgaagggataaagaaagtgtagtcagtgtgggtgtgggtttctgtatatatatgagtgcgtgtggatattcttctgcaggtgtatatatacacacacacagtggtatatatactatgaaatattattcagcttttaaaaagaaggaaatcttgttatttgtgacagtgtggatgaacctagagaacattatgttaaatgaaataagccaggcacagaaagacaaatactgcatgatctcacttatatgggtaatcaaaaaaagctggactcacagaagcagagagtagaatagtggttgcaaagagctgagaagtagggaaaatgagaagatgttggtcacagtatacaaagtttcagttatgtaggattaataatttctggaagtctaatgtacagcaaggtgactatagctaataatactgtattatacactcgaattttactaagagagtagatcttaaatgttctcaccaccaaaaagaaggtaactatatgaagtaaagggtatgttaattagtttgtggtaatcatttcataatgtctacacatatcaaaatatcatgtatactgttctcactcacaggtgggaactgaacaatgagaacacttggacacagaatgggcaacatcgcacaccggggcctgtggtggggttgggggatgggggagggatagcattaggagatatacctaatgtaaatgacgagttaatgggtgtggcacaccaacatggcacatgtatacatatgtaacaaacctgcacattgtgcacatgtaccctaaaacttaaagtataataaaaatatatatatatcatgtatactttaaatatatgtaattgttgccagtttacctcagtaaagctggaaaacatcattacatcacttacaatgggtaaattcaatggtatataaattatacctcaataaaaatgtgttttaaaaagtagatggactggcataatgaaccaccatgtaatccatcacctagagccaacaattatggattcatagccaatcttgtttcatctgtaacccttctacttttattcttgccatattattttaaagtacatctcagctattatgcatttcactgcaaattttataatattcatactatgaggataagggttttttttaacataacagcagtaaataccattatcaccccaaaaaacaatgtatcaaagcacaagtgatataagtagtgctttgcttgaccattttagataatctcttgttgctttctgctattttcattctcctctctttctttcaactacatttagtatctgatagctccaatttctaaagcctttaaagtctagttcggctaatggttgcttctgactctcacttacagagctcattttctcatgcaatatttttactgggatataatgttcatcaaactttatctttgggattctataaggcctggttgcaagctgcatgtgcccagggaatttggtgcctgaggctgctctaaacccaggccactgtaaattaatatctcagtttagggtttttcaggtgcagtgaatgtgaattcaaacctcaattccacatcagggctttctctctcagagcctagacaatttttcttacagaacagatttttgctttagtctacccatttcctaaagatgtgtctcttctatggtcctgactttattaagaatttctgttccaatttcctgccttctatgagcctatggccttgtcttctgatccccatgtggccattgaaaccaaaagctctaaatgaccaggaattgacaaatatccatgtgacagctactgactttaatgtatacttactgccctggaaatgtattcccccttattgtggtctctgagaatttcccttgcttccctgcaagttagttacacatttttaaagtttttaatgttttgtttttaattttttaagagttttgcactgggaatatttcaagatgtttcatctgctatatttccagatagtctaatcccttcttataaactttaaaatctttagactttttataagagaaacgtatcttccatcaacctgagcggcacagtttaaaatctttttcccccattataacataaagcttaatttctatatttaagtcctaaatgtactacagaatcataccaaaattaaataacttactaagtacatcattccataaaccaaaataaaatggaataaaacatcactgtgagaaggaatagtataaacaggcaccaaaacagtgacaaggcacaacttttattagttattatttagtgaaatggacagcactgtcagagttggttcaagccagagttccaaaattcaatgattgtctgagcttacgtaaagtacctcaactgtctgagcctcagttgtttcaaatgtaaaatttagaacttgagtcatttcttaatgtatttaaagctctatactactatgaataaagtgttaaattttaaaatcagctgaagaaaagcattaatataccaatcagcaagcatcgtgactcaggaagaatgtacaagagtatcaagaattaaaggggcatgatgtatgcaacctactttcagatggtttaataagattttttgagggtatatattcatacacgcataaatacagagggagaggaagaggagggggaggaggaggaagagagagagaagagggagggaaaaaagataataaaataaatatactaaaatattgaaactggtgtatctgggtagagaagccataggagttctacgcactactcttgcaacttttgtgtaaatctaaatttacaacaagtttttaaaaagtgtaataaagttggtatttaaataacagatataaccctggctatataaaacagaaacacatagttattctatcatgggaagtgaagaaaaatccacaaagggacattacaaatttatcactcaccaactgtttcaggaacacacgtttgttgctataaatacaaagtctctattaatgacaggttacagaactatgtaaaaactcataactcatcctaaggggtaaaacatcaggtgagatttctgagccaaaagtaatttgggcagaaagcacgcaagtaagccaataaagcattccaacattaaatcctgacttcctttgacgtcagccccagcagaccaaggtgagtgacgacacagagaagtcagcacaggaggaaatgtgtgccagcttgtgcccagtatcttggaagtgcaaatttaccaggtaacataaaactccataactctatcttaaatgctggtatataaatcacaatgtatctcttttcttaagagtctgtatccagcttctcagagttcaaaataagttacaagcaataatgactgttgagtattattaagctgactgtaggttaaaattttttaaaaaaaacatagattgaaagagagcttgctttttgatgatacttttaatttcaaactcagcaggaaacaagataatcacaggtagctgaaagtcaagacaatttaaaacccataaatgtatgttattgatgaacaaagacctcaatgctaattaaactgcattttccttcatattctgtaatttcctaatatattctgcatacattatctctaaggtctgacctagagatacagtattgtgtagcagtgttttcaagtatttttgccctctggccatgcaaatgaaaaaaggaaaatggtacactatgtaaaaattatgtatcaattgcaaaaaaaaaaaaagataatgacacaaaattatttattttacttactttttaaagtcttaaatcttagttttaaatgtggaaagcatataccttttatcaggaccagtgaccccactgcaggaattctcactcaaataaaatctaaaactttggcatgaggtcattaaactattcctagggcacccttttacgctaaaagcctctgtaagcgattaaagttctaatttgaataattacattccacctacataaattccctctgtagtttcaactgtatgcaatatcagtcttcatttcctgaattaaattaatgtcgtgtaatgtggtgcttcttttttaaaaaaagaagtacatctactttcataggtaacctttcagcaaccagtaaaagtgattcatgtgcatgaggggaataggtcagtatgaataatcattaaccaacaatttgtgccagcatttattgtgtcgagcattgcaaaagggacaactcatataatgaaatgaatgcagctatacggctttataaaaatcaaatattttataaactaaatcctattttccattgaatttaccaatgcatcattagaaactttattttttatttatggcttgcctttaattagctgatacttcccatgtttgatcacccttatctttctagtcaaatacttaatgaattgcaaattaatactgaaaatcctaacttaaaaaaagaaccactgagtagtgtttaaaaagtaaataagtatttctcatagagggaatcttaaaaacatgcttcccctaatcacaaaccaacagaatttttgaaagaccgaaaaacaattcttacagcaaaatttgttactcaaagtgaatttccagtgtaaccaaaacagtatttattcaataaacccaaaagactagtattacacctccctttaatgagatttaatctttcgatccttggatatttcttaaataatgtgtctaccagttgctgagtgaccttcaagagtggcttttcccagagtaaagaaaaacagctgtgttccttgcaggatgctcagtgacttccagagatctccacaccatgccaactatttcagtccttgagtcattagagaaatttaaagagaagaatttatcccaattgtcaaaaattctgttgaaccccatgacataaacgtgtttagttgatcaaagctgtatagtagcaaagatgtcttcaaatatgttgaattagttaatccctaaatctcattattataatttctgctcttaaagaatttaaagtatgatttactggcatctagtgaaactgtaaattaaattatctattatacctagagttggtctcaaattcatgaaatatagatccaattgtaaaaacatattttcctttcttcctagaattccattctactttgattctgaaaatagcatcctctttcctctaggaaatgtcacctgtactccaatccccaattcccacagaacaatgtgattcaaagagatgctgtcattttcttacagatcacttggcctagccacaggcttggggtgtgtacttgttcaaagctggaccaatcacggtaccccattctggtggccaaagttgatctgtatagttgtatagataagggcatgtgacccaagctgaatacatcacagtccttccccaagatattccacactgaaatcaaggcagtaggagcaatctctctcaggcggtgaagaaactgggcatgcgagctgccagcagccatgtaccctgctatgcagagaaaactggtctgagagaactaagccaagatgcagagaagaacttaaaaaagacggagcactccagcggcatccaagtcctggctctagttgtccctgacaactgtctcactcgtgccttccttgtgtgtatataataagccttccaataaatcccctttataccaagctattttcctattaccagtagccaaggaaactatacaatataccaaacaaattctaacataatacatttgacttcttagggatagggcctaggaatactgcaagaaatcctaatacctctgcaaattcaaatatatctaatgcaaacctgggtttaatccatgaaccgacatttagaaataacatgatttaacactttcttcactgccttcttcactggggataagccttgtcctttcataaggcagtcaaggtcttgtgagcaagacctgtatcttatattttgcaatgaattgctctctcagcacaagccatgaacatagatgttcagtaggaatatattaggctaaaaatatgaagattgggatattatgattgccacatgatcctctggaatatcatcagatccaaagtaaggagattttgtgttctggaaaagtccttcttagaatagtgatagctgtatagcaagacagcagtaacaaaattgggggaaaaaaaatcattcttaaactgattatttgttaccaaaagatacatgcttgtgaatggattcaaagggatccttgggaccaaaaaggaatgtgggtggctgtgaagaaggcagttttaatctgaaatgaagaatctgactccaaagctcagcaaagaaagtctacgtttccctaaggattgagtctaagacaaggctgctaggaattcaagattaaagaggcaacgaatgtaaaatacattctatcttaaacatattaaagtgtatttaaagccatatgcctataaatctttctttctatgtttactgtacccctacattaagatattttggcattcaaagtaagtgaccagtttgctttgggctggtgatccactatggagagaacctgaaagacacggttgagagcagaatcttctgcccaagaaaaggccctaaccatgctcaaatgatggaagtagaatataaaggcagtcctgttttaaaaatgtagcttttcccaaagaagctaaaggatttcctgaccttctgtatctgactaccagaactcagggagaagttcaataccataattataataaataaagcaaactaattctaactccttaaagctgataactatgcccttaactagttctaactgaaacaaaaagaaaaaaaattaagctggttattctctgtataattttgattttttagaagcttatatattcattttagttatttgttttatacaactatttaccacaacgcatgaacttaatacatattgataatacaggaaaccaaatcctataacaaaatgcaaattctgcctaactgcttaaacttactaaaaaagctaggttctagacatcaactttaggacaacataattttctctaagttattccagaagactatttgcataaaacttttggaaatctccactccaaagttcttccactgtaaactgcacttaatcttttcaattagcaacatgcttaaagaacacaatacaatatctgggatcaatggtctagacatttctacaaactgaaatcatatacctatataacaagagagcaactgattgtgactcaaacccatcttgcaactacactaataatttggcattaaaaggatattctaatagagccatattcacagaaaacagtgtcatttagtataatttcttaagaatctccatttaaaattctcagaaaaatttaaactacagacccagagaactgatagttacttttattaacctctcctctgattataatacgactgtattagaagaccttaagaacaaattcagtaaagtaaaatttcatttcaatgcctttttataacctttcagttcccagaataggaataataattagcactctcatttctagtgcttgaaaaacaatgaagtatgtgctttaaagaacgaagttatatcattttcacctgcatcgatgctccttctactcttgccacacaggcgacccgatccaagaaagtcactgccacaggcaccgccacaaagaagcctttacaaaaggccttgatgtatcttttcacccacccttgtgactgtgccatacctaaaaatacaaagaaaacaactatgaaattagtctcaagaaaggtgaaaaacaaagacataaaaacagtacatgaaaagtaagagttaccgaagggcaatcttgtctcttaatatattacacactcattcctgtaaccattagaataaatctgacttacttaaagtcctaaagtgaaatacgtgaactcaggttaatgcttttccacaactcaagtccacttgctaacttcagtgggaaatttctccccacaaaacagtaagttagaaaaaaacaagcattccagaagtaaattcttttctgttgctattatgatgaagttactccttatacccctgatatctgttctcttctacagtaataaaagtttcagtggaacatgtggctgcccaactaaagactgttttccagcctcccttgcagctaattgtgaccatgtcactggatttgatcaacagcatgagtagaaaggatataattcttggttgcaccctgaaaaggaggatgccctcccttttcttccccattttataactgtaatactaacaatttggtggtaggagcaggggtggccatctcaaactatgagataaaagcttcaagtaaagatgacaaagcaacaaaatggaacgatcctaggtccgcaacaccatggaggcaccatactgtcctgcattgcttacatttggactgttaaatcacagataaatcacttgcgctgtttgtggtggcagtgttggtgttgttgttgtcgttgttgtttttagacagggtctcactctgtcacccaagctggagtcttggcaagacttttttggataagacttcaaaagcacagtcaatcatagcaaaaacagacaatggagattacatcaagctaaaaagtttctgtgcagcaaacaatcaacgtaatgaagagacaacctacagaatggaagaaaatataaggaaactatacttctgacaagaggctaatatccaaaaacgcataaggaactccaacaattcaatagcaaaaagacaacccaattaaaaaatgcccaagagcttaacaataatttctcaaaagaagacatacaaatagccaacaggtatatgaaaagaatgcgcagtcatgagggaaatgcaaatcaaaaccacatggatatcattccaccccagttagaatggccattatcaaaaggcaacaagtgctggcaaaggtggagcaaaaggaacccttatatctgtttatgggaatgtaaattaatatggccattacagaaaagagtatggaggttcctcaaaaagttaaaaatagaactaccacatgattctgcaatcctattcttaggaatatatccaaaggaactgaaatcagtatattgaagagatatttgcactcttatgtttatcacagcactattcacaatagccaaggtatggaattaatccaagtgtccatcaatggatgaatgaactttaagatgtgagatacatatatatatattatttcaccataaaaaaagaatgaaatcctgccatctggtacaacatggaaaaacctggaggacattaagtaaaataacccaggcacagaaagacaatattgcacgaccactcatatatagaatctaaatagttaaactcataaaagtagagagtagaagggtagttaccagaaggtggggtagttagtggggaggagaggttggggagatgttgctcaaaggatatataattatatttaggaggaatacatttcaggacatctattgttcagtaaggtgagtacagttaatggtaagatattgtattcttgaaaaatgtaaacagagtggatgttatatgctcttaccacaaaaatgataaatatgttaggtaatgcatttattaattagctagatttaaccattccacaatgtacatgtacttcaaaacattatgttgtatacaataaaactcacaatgttatctgttcactcataaaataaataaaaataaaaatactcaaccactaattccctcccaaatctttaacatgtcacaggaaaaagatgaatgataatctaaattggctaattctgaattacctactgtaactgacatcaatgagggctatatgtatgcaaggtaagtaagaccagtactcttgttttttatacttttatcaacatatattgcacataacattcacccaaaccagtaatctttttatacctaatcaaaataatgtaactcagactaactttagaatataagcaatttaaaaacatgttttcattcaaactcatctaacaactataatcttaagttaaattgcttatgagttcacacatctggtactcaagaaacgtgtttggcccaaggtactgattgtttctgcgagcagtcttaaccactatattcctaaaagagtaaacctgcttgacatgtttcattcattcatacccagctttaatgtgagcccttgagtgaaactaatttctcttcaatgacgtcttttgcctagaatcaaaacacctttactaactcattttatatatctctacaaaagatttaatatacttttccaatggactattttacaaagatcccatttatcatgtactacctccattaatataaaagaataaccttgacatatttatcaaatcagtaccttcaagatgcaaaagatgcattttcctcaatattagatttcattagctcagtctctctgaaaacacttctaaccacaggtttagcaacacaaacatcagtcttataataaatttaaaaacggaatgacctccacatctattctttttattgtttccaaaatatatataaataaataaataaatccaaagatttcagattataaaatatctgaatccacaaataatttataaaatgctcccatgtacataggaaaaaaaatagttactacgtagaagagaaaggaaacggctcaacagtaaataatcaattcctctttgaccagtttgatagcttcaaagttattttaagtggtctacacttatgtttaagtcatatacaactcccagataataattccagggtagtgttccccaagcttgccttgactgacatgcttaaaaatgaagatccccactccgactcagacctccaaaatcaaacacttcaggtgattcccttaatagagcaagtctggaaaatactgatatttgggtgtttaaaggtcagctgtttactcactcctcaagtttattaccttctgaaaatgaaaacaggggaaaagttagcaaagaaatatcaccctgaatgtctcctcacatttagtttacctccttactagattaagaaaaagtatctgcagaacaaacattgcacagaaaatgaacaccactaccagatcctactttgtaacctctacgtggttccatcagaaaatgacttccagtggattttctctttgccccactaaggcagttcaatcatccatccactcatctacccagtcacttactacctggctcattcattctttcaaccagtatttactaacggtcttccacaagcactgtgttaggtaccagggaatcataaaacagtgaacaaggccagtcccagtccctgatcttatcaagtttttacagtcaactatggagtgataagggtcaatctgaaaatcacataaacatacataagagttgtaataagtgctataagagagatacacagaggtcaggaaaggtctttgaggaagaggctgaactgaaaaatgaggagaacttctctagataaagaactgtgggtaggcaagggtattccagagagcagccatgtcacatgccaaagtccctgggtcaggagtggccatgttgtgatggacaactgaagggaggctggtgcagataaagcacacaggaagtggaagagcacagtgggacatgaatgggaggaggcaatgtaaatcccagagcagttaagacctcacaggccccgtaaggatttgcagcaaatgagaagtaactgaaatgttctaaaattgaggtgaatgatcctatctgcattttgaaataatcatctatctgaaagcctggataggacaaaaatggatatagggaaaccacattattctagtggtccagggcaagagatgatagttggagtagcatgatagtggagatggattaaaatgggcagatttatgtatatattttggaagttaaactgacaggatctggaaatagatggacaatggtgggagaaggaaggagataagaaagtgtcaaggggccgtggtagcctgtcaaagcactgctattctgttgttctcttgaattacatgtcaaaatatttaatactaaaattatgctcataattccattcctcaaactttttttttggcaaacaagcagatgtgctccctgccctcaaggagttacaatataccaaggaagactgcccttcaacaattatttccaatggatgagcattaaaagggacgatggccctgaagcatgacagcatgaagcaaggctgtctattcatcagaaaatgatcaaggaaggcctgccccactccacccccacccccaaaaaatggcatttgaggcaagacctcggcatttcaggtaaaagcagtaacatatatgaaggcctaggggcaaaataaaatgtagctgtttaagaaactaaaataagttcagtttggatagagtatatacagaatttattacgtgaatttttaattcagtaagcatttatttgctatcaagcagcaatgctaagtacagaggatataaagatggctaagcatacagtatagtaccattcaaaaactctcactaaacaataccttacatttcaacatacatttatatgtgcacataaaagtatttaaaattgaatatttatattgttttaattgtttaataaccactcatatgttacttgtgtaattattaaagtataccaaaagagggaagaaagcagcatcaaaatgctagcagtggttaattctatatgctaggaatggagacgattactattttcttctttgaatttttgctggtttctaaaacagaaagatggtatctgccctaggaagtcactatgatatacagataatacggggtaacactagtgttaatttctatcccatcacaatgaacaaaccacactctcaccccaatctctgctgctctaagtagtacaaataacactgagcaagattctttcctgtttatgcagcaatcaatatatttaactgactataatgttgtttatgtagccagtgcaggctatctatatttctggaaacttctggaaagttctgtcaaatattcgctacttttattttaagaggcacagaatggaaacatgtcttctctttgctgttcatcatgccctgcatgcatggaccttcacaaaacagctgaggatacctgcaggacagaaacggaatgcttccaaatatgatgccacagctatcttagttataaggtagtatgcatgattaaaatgtaaattaagggggaaacattaataaaagttgcattaaattcacatttcctgaattgtgagcctcctcttcttttccagtaatgctctcctacattacttctactccatgtagtcactggtccccaaaaaggagcatggtaatgagactcaggagacctgaggtagatatctgtctctgtctataaccagttccatgactttgaacaagtcacttctggcctgtttcctcatgtgtgacaagaaggggcttatttgggaggccaagcaagagggtcacttcaggtcaggagttcgaggccagcctgagcaacacagcaagacttccatctctaaaaatttaaaaattagcaaggcatggtagcatacacctgtagtcctatctacttgggaggctgaggtggaaggactgcttgagctaaggagtttgagactgcagtgagctatgactgtgccaccacactacagcctaggtgaccaaacaagaccctgtctccaaaaagggggggggggtagatttaatatctaaggttctttctaagccagaattctttatttctataactttttattgtcttttaactgtttcttaagaactttggcagatactaaaacaaacactgagatcactattgactaagaaaaagtgagttgcctttatggtttgagacttttttaagtattgaaaataaaagagaattaactttttttaaacaactggttaaaagacccaacagtgagggagctgaaaccagtgccaatgatgtaaaagaacattttaaatatagataaagacctgaacaccgttgctctttcacttctcatttccacaacctgactgctgaccagagcattgctaccatcgcctgcacaacaaagtcagggcaagtgtttttctgagagattataaaggagcatgtgggagatgtctcaatctgatatgtgctgatcctgctccaagccaaggaagcaagagcaataaaagctaccctggaaacaaggtacaagtggttgctattttcagaggctcaaaagaaaacgctcaattcagtcctgttttatctgaattgtgaggggcacctatatttcataataataaaacactgttaaaagcttctatcatgtaaatactaaagaagccattcatacatgaagaaatgaacacaacatttctatgttgtcatatccaataattttcttaaagttttatggcattcacatattggcaaagttaatgcacctccttgtctatgtaaattgccaaagaatcattcagatgatccggtcttttgttcacaccttaaatgtttaaaaccaccacagtaataagtacctagccccgacttcctctgggaaaatttcatctaagcaataacaatcaggtactaaaatcacccccagcaaaaagggaataatttttatcagttacctcattcttcttgtaactatggaagtcactgaggttcaaaacactgctcctgagaaaattattgcttaaaattgtaagtacacccagttcattgttgaagtgcttaaactgagaatattttttaaataagctttcagaatcaagtgaaaccatatttgccacctggcatacagcacttacaagtgagagtttcttggtgatgctgacctcaaccacataacaacccacactgtaaatttctctccttcccgtaacaacttgtggcttgatcatgcattaattcatctaaaattgttcttaagcctgcttatattttagcttgtacaaagtcaccaatcactcatccatggcaaccaggtggataaatccaccacaagtcatcctaattataaaaactatttaaaagttgtgtgggaggtttgaaggtaagaggaaaataataagttataaagcagtatcttatgtaaaatgtaacctttcaatcatcataagcctacacaaaatcaagattttatttataaagaggaaaccatcaaactatgaatatcagagaacacaagagtagggatccaagcaaatctgacacacaattcctgaatcagtcagtatatgtgtacctaccatgcaccatggaattgtgctaagagataaatatgtgttatagaacaaggtcagcatggtcctttctccacgtagagtttgcattttcattctttcaacattaagtgcctactttgtgctagacactatgttaagacaccagattgaccaagccatacttcctccccagagggacctgtgacaaggtcacaagaaacaagtatatgaccataaataatccagctatcatcctccacggatctttctagcagcccctggtaccaataacctggctcggcaaacagagcctaagcatgtgaaaaatcaggagacatttggatacatgtggtctaatacaaggataaaaaagaaaaactgatgaattacaacaattttggttccactggaagcagatcctggcaagtaatctatagaaagcaatttaaaaaattttttcaggactatcttgctcctttcacattataagtaaacaatattttataaacagacacttagtactctttagaacatgaataccagtatcaaattctttatctttagtcttgtctgacctagtagttctcacttgaaaattctcaggaaagaccaaaatggcacatacacaaaaaaagaaataagaaagaaagaggaaaaccagccaaaaataataaaggaggagaaatgtaattatgtaaggcataaagttagtcattttttggcaaagatacccaataaaaaagtcaacactgatacaatgatgaagctaagccctataaaattgcttctttcatggagataattgtgactttctgttggtaaactgataagcatctggatactaagagaagagaggttaaaactgatgtattcaatcttaagtcagcaatatgtaaaaacaaatgaatttgaaggtcatgctctagtacaactgatgtagagagaaaatacaaccaggaaacaactaggatacagaaattcataaaggcttcctgatttttggtaaggactccttcaacttgcaaacatcatgcatttatgcacacccttccctctgattcagtggaaaagcaggccccatcctatccaaggtgctcttcagaagcagcatcagcaaagagggaaagtcagtgaaaacctggtgggctttgaatccaagacctcagttcaaatcgtgattcaacagtgtggaaattactttatctcagtaagcaaaatttttcatctgtgaaaccttgcagggtttccagaggttcaaaatgttcatatgtgtttgttttcttttgtttacataagcatttgtgtaaagaaaatgactagatcatcaaataaaggatatttcttcagataaagcactagctatgtctaaggaagaggactagtaataacaaatcaaaaaaggataacagaattaaggatgtccattacagacaataaaccaataaagcccatcttctaggtgataagacacctaatacataatcattttgttctgctttgaacctcatgctgttctaagatttgaccagttaggggcaatcatatgtactgatattaaccagttaacaagaatgtattcagcactgtcttaggtgtcttgagatttttttaaaagcaaaataaaaggaaatataagacttagtgccagaattggaccacagggatagattatataatattcattgaggaaagaataaaaaggaagaaaactggaattacaggaaaaaaattcatgatgagaaaggctaaaaagaaaaaaaaaggaattagaatgtaggtggtgggtttaaaaatgttcattataaaattcttagaatgtttctgtatgtttaaaatttttcctcaaaactttggaaataaaagaataaattacatctgttaagtcactcagataaaagaaaaatataattagaatgaagatgcatacagcccatctgagatagcaagaatgctggccagatcagcgaacaggacctatattaagacaagtgagacataagactgaatattaattttttttttttttttgaggcagagtcttgctctgtcacccaggctggagtgcagtggtgtcagctcactgcaagctccgcctcccgggttcacgccatcctcctgtctcagcctccagagtagctgggactacaggcgcccaccaccacgcccggctaattttgttttggtatttttagtagaaacagggtttcaccatgttagccaggatggtctcaatttcctgaccttgtgatccgcccgcctcggcctcccaaagtgctgggattacaggcatgagccactgcgtccggcctgaatacgaatttttcttgttttagttgttttctttttttttttttcctcatcaatatggacatcttcatggctccagtatttttggaaaccatataaagcaaaatcctttaacaataatctaggactctctaagaactggctcaggccatcctaatcctataaattatccttatcctgtaactccaaatagacaccatttaacagcatttacaaccaaggcctaatctcaaatttcagttattaaaatgaaataaattctgcaaaaagtttaccataaaaattaataagacagtgaatagctttttacaggagaaaaatcctattaaatgataaccattagcacggagaagcttggtaagctttaaaccctaataaccacaaaatttggatttcaacactgtactttatttttttccaatttaatagaaaagcataactgctatcattaagtagaagctaaaggcaacgtgaattttaagctaacaatgtgaggacttaaatatgtatataaatgaaacagaccagctacttatccataacccaagcaaagcaattagaggatacttttcaccataagtccattttttcttgaagtaataatacagtgggttagtaaaaggatatattaccagcatcaggaatacttactgaatagctaagaagaaaatactgcattatttggcatttgggctgtgttcaaaattggctttaaaaaaattaagaaggcctataaatggaaaaagcactctttttagaaaaaaaaaatctcaagaacctttcaaaaatcaaaacttagaagaagtgagataggggaaataagaaaaaggtagtaacactcagaacctaaaaaaagaagggtacaaaatattagaaagtgggcattaggcaataacatgagtaatggaaaagtatcactagaaaccatgtgacagccagtttccaaagcacggtcatccaagtaccaagctttgctgttccttatctactttgctacctcacattttttcctactatctgacactgcttcatattcacttctcttacactgcagccctacttcggtcttattttagaatggtacaagggtcttattagggctcaacaataagcggaattgaaaaacttttttaaagaacatggtttctgggtctcatgaaaatcctatcctgatccctactcttcatgcctcaaatatattgctatctatactagaatgcaaatgcctttactagaatgccatatcaactcaagtcatacttacaacatggcttttcctttgatcagggttgggagtaaggagtaggaaggcttctcaaaagaatcaggccactagaccccaagggacaaaaatggaaagagaaagtcacaaaaaagtaggactgaaaaatacaatttaaccagcaaacttatagctagcccagggactattactactctttacaaaatgataaatacaaaaaaattagaaacacaggctcccccatcaggaaagcacattaaggctccaattagtctgtcaaaaataaaatctattcagactatggcttgaagatttggaaaggtgcccacagcccatgtatggcagctgcaagtccatggggagttcaaacagcaacagtgcagagtcagtactgaagatgcaagccagaggaaaagatttatgcaatttaaggtgaaagcaacagaaataaactcccttggaatgagtgcttatggtccttttagcttataagtgcaagtgtacccacaaacatgcatgcacacttgctgaaatggcaacaaaggccaagttagcagcatatgttaaaaaagaaaaagtaaaaataaatatataaataaatagaacagccaagaggccagagtataaagcagctcatcctgagtggcctggagataaaagcagatggagcacagcattacccagactcaagtgtctgttgcacaaaaagtccaggtattataacgagcctgtggtattacagcaaatggaactgcgatctcatttagattattctccactcttatatgccttgttttgatttctgcatacttgcctataaattggaagacactgttttaagatacctgtgaaatttcatcaactgtggctagagttgaaatcttaacttcaaccttaagagaaacactgaatcagaactacaaagctgacccgctcctaaatttctgatgatccatggaaactgtgtgagataataaatgtgttaagccactgatttgggtggttatttgttttgcagaaatgactaatacaatacaaaatgcacaaaaagacccaagggcgcaaagaaacttggtatttgataaagtcgacattcatattgggaagagaagttgaattaacaagttatgttgaaacaattagctacaatttggaaggagaataaaatcaaagctagatatttattaaattcattataagaaaataaattccagataagccaaacattatatgtaataaatagaaatataaaaataacaagagaaaataaaggcaacagtcttttaagggtagaaagaggtctttctgaacattttacaaaatccagaaaacatgaaagataaatactgatagatttcactacataaaaatcaaaacataccataaataatgttaaaagacaatcagcaggacataaaaaattataatatcagtatctctaaaattacacaattcttataaagtataagaaaaaagacaataattttgagagaaaggtatttcactgaaacaaaatatggacagtatataaagacataaaaagatgtacaaacacactaataataaaatcaatataaataaaaacaaagtactactttagtctatcaaactgacaaatttaatatggtaatatgtaccaaaatgttacatgaatataccttctgatgcagaaacaccactccaggaatttattttatggatgcaaagatatgatcaacgatattcaacataccatttttattgcagtgaaaaaatgaaaacaaccaaatgttcacaaatatgtaaataaattatgacatgcatacagtagagtaatctgcaatcattaaaaagaacaatatatcgttatattgcttgagattctcctccaaaaaagttggaaaattgcatttttaatatgaacccatttatgtgaaattttatacacacacagcatcatcctcatcgtcatccttatcatcatcatcatagaaagaggtcaaataataaagaatatgaaccaaaatgatgacagtatttatttgcaatgaaaggaatttcactttatgctttatatttttccatattacttaaatcttcagtaataggtatttagtatctttatatactaaaacaaaattaatattacagtcttttctgctacaatagctatttcttaatgtaaattagctcatatataggaaaatgacgtcagtcttatgtgaaagctatgctggttcatacacaattttccccagtacatgaaggttttgattcaaccaagagcaagtcttctcccaattaaagtgaaagtctcatttggtggcttcaagactttccactgttaaaggaggctgagcataccaacgaagaaatgcaaagatattttcccctgtgtttaaaatagaataaaatcaacagatcaatatcctagagcagattttcaactttgatgaaattggtctgtattagaagtagatgactttaaggacctacaacaaaggaagaaaaccagggtttcaagctaagactgatgtgatgctgggtgcaaatgcaaggagggagttaatagtgctcgtttttatgacaacttctattttctcagctctgtttacaaaatgtcactggtttcaaatgatctgttcctagccctattttctttataagccctaaaattttatggtttaattttgcagaattaaagatttttcaggaatgcatgtatgtcattaataggagaaatgcctctactattctgagtaaaatgcagtaaggtagagaaatgttccatatcaaaaagaaacaaaaaacaaaaaaaggaagcaaaaaggagaaatgaaggaagggagggaaggaaagaaagagggggaaaaagaggaagaggaaagaaaaaaactgcacacttcactttgttttagtgagagtgtctaacgaaagatattaaatgcagggcaaaacaatctcattaatattcttgatttataccacacattttgattctatatgagatatatctaaagaaatggtctttgccccatcggacacttaaaatctaaacaagggagtgaattaaacagtcatcaactatggtggggcaggaaaagggactaatccaattaactttaggacacagttatttaattatacccaacccaagggtatagagtcaaatactataggcggtatttgggctgggaagttggggggtggggaatgcaaacagtgagagaaacaattgtgaaactacttaagatacattgtaggactcagcaaatgagttgggagaacagtggtgactgtgggaaaagggagataaaaatacacagtgggaatcagggaagaatgctgtggggccctggaagcaaaaccatatagaagtagcaatgagtatatgtagtactcaattcttagggtctaataccattccctactccaaagaatcagcaatcttcagagtaaaggttgattctggggctgtggtggggaaggtttaagatgagcctgaaacattttctttggccactaagaagtgcttagaaaaaagatggaagtacatcaaaaggagacgggagcttgcctggtgatcccactggctaaatatgaaaaaaatttgattacttattaaataaagtcagtaatgagtttaaactactggaaaaacagctttgaatgtgctaattttctgaatctgagcaatactttaaaatatgggttttagcttcaaaaggtaaatcaggtaatttcattttatttaagtaataccatgaaaataatgttacaaactactaagttaaatacaatatgaaatattggtggtgggttgttttttgttgttttttggggtttttttgaaacaaggtctccctctgttgcccacgctggagtgcagtggcatgatcacggctcactgcagcctcaattcccaggctcaagtgatcctcccacttctgcctcccaatagctaggaccacagatgcacaccaccaggcctggctaattttttatattttttgtagagatggagtttcaccatgttgcccaggctggtcacaaactcctgaattcaagtggtccaccagcctcagcctccggaagtgctgggattacaggtgtgagctactgtgctccgcctaaaatattgttttaaaataagtcccctttatgatcattctcagaaatttgttagaaaagaagttcccttgcacatataaaaaatttttttcaatttataaattatccttctacactaatttccaaagaataatcattgagatgagttaaagcttttcactattctttgaatattatatcagcatatccaactgttaattgaatttgagatccactagtaaagcaaaaagcttgtgactttgaagactatttaaaatgtacaatgttttattaattatcattagtagtactattatacaatggttgtacccttgtaagtttgttaagaaacagctgacattgaaattgtctgcatctaaaggacatgtcaggaaaagcagagaaatcttaccaaaaaaaaaaattgaatcaacatctcttcttttggtatttacccctttcacatcaataaacatttactgaatatctgctaagtgccaggcatcatatcagtttctataccgaaagagtaaagacgtttctgtatagtatctatatagatattgaacattaagcattgttctttggaattattccagccttgagataaggctaaaagggccataaaaataaaatgaagaaagatggattttataaaggatagaggcaattggggatgttatggaaagacaaactacacagcattttatactctctggttcttctactttcagagaatgactctatcatccaaacagctgcccaaaggtcaacatggtagtgagccaaagtgagcattcatgaaaaaaatagaaatcatcctaactttctcttactttaaatcgttcaataactcctcattttctataggataatatcaagctgcttagatttagcatataaggctaattatgattagattcctagtctcatcacttccacttttttttttttttttttttttttttgagacagggtctcactctgtcacccaggctggagtgccgtggtgcgacctcagctcactgcaacctctgcctcccaggcacaagcaatcctcccacttcagcctcccaagtagcgggaaccacaggtatgtgccaccacacctggctaatttttgtattttttgtagagatggagtttcatcatgtttcccaggctaatctcaaactcctgagctcaagtgatctacccaccttcccaaagtgctgggattacaggtaccagccaccgtgctgggccagttcctctctttcacagcacatcatgcttcaaccaaacccacctccatacaatttctagaatatgccacacttttacttgtctctgggcccttatacatctctcccttctgtctacatcactcttcccacctttctttgttttggccagctttacccatccttcaggttagcttagatgtcactatcaggaagtccactccgactctccaaatctgacttagatttccttcctatgtgttcccataaaactctatgctccccctagcacagcatttatcacacctgattttctcatccttacccctaatcagttgtgagttctgcgcgagcagaaacacttgttcactactatacttaagtgctttgcacttaagtgctcagtgttcaatacagtttcattgaagaaattaattaaccacttagctgtccatataaactacatcatactcagaatgtgatataagttctggaggccttgattgaacagcactgcacaaccacatgccataaattttatgtgtgtgtgtgttagtttgtgtgtgtggtgtatgtacacacaaatgactgtctccatctcttacctgatagttttacttcacagctgaagatatttatgaagaaagtggtttttaaaagaaattatacttatgctgtaagtataaatatacacagaaagaaatatgtgggctggacacagtggttcatgcctgtaatcccagcactttggaggccaaggcaggaggatcacttgagctcaggagtttgaaaccaacctgagcagcataggaagaccctgtctctaaaaaaaaaaaaaaaaaaaaaattaacatagccagtcatggtggcacatgcctgtgctcccagctactcaggaggctgaggtgggaggatcacttgagccaaggagatcgagactgcagtgagctctgatcacaccactgcactccagcctgggtgacagagcaatgagaccctggctcatttaaaaaaaaaaaaaaaaaaaaaaggctgggcacagtggctcacggctgtaatcccagaattttgggaggctgaggtgggcagatcacaaggtcaggatgttcaagaccagcctggccaacatggtgaaaccccgtctctactaaaaaaacaaaaattagccaggtgtggtggcgcatgcctgtagtcccagctactcgggaggctaaagcaggagaattgcttgaacctgagagacggaggttgcagtgagcagatcatgccactgcactccagccttggcgacagaacaagactccatctcacaaaaagaaaagaaaaggaaggaaggaaggaaggaaggaaggaaggaaggaaggaaggaaggaaggaaggaaggagggagaaagaaagaaagaaagaaagaaagaaagaaagaaagaaagaaagaaagaaagaaagaaagaaagaaagaaagagaacatacgtcgattactacatatatatctgtatattgaacttcaggaagttgacttttctgtatttttcttcaataaatcataacacaacactcttgtccaaaagcagtaaagatggataagaaggatcaagtaactttcataatccacccaactataaggcattaagaatttttttcccaattaacagctgatttttaggaagtgtttagttagattttctttcaaagcaattatttttcagtctgtgcttcatggtctcctaatgattccctggagtctcaagggccagggggagcaggtgctaagtgaacagagttctgaactgcctcaatcagagccactctgctttttatctggttttttttttttcaataatggaattccaaccaagattttctttgaagaagggttcactacattaaaataagaataaaagaaaaaaagaaaaaggttaaaaaacactgccttaaagaatcagcagtggattgaggtttgcactatataattcaagctctaatgtatttcatatttcttggttagactaaattcaactgtcagctttataggcctttctttgtgctaaaatgagaaataccatttgaatacaaaaatatccaggtagagggaaaacaaaatgggtttttgataagtatatttattctctgatgcagctatttctaaatttacttattatttttaatggctttatttatgtaccaatcttcaagttaatgattcataacagaacaccaaaataatctaattgaacaacagaagcccactgtaaatgccagctgctgctatgtttcatatactgtaaacaaatacccacctcattttaatagtttcttagtagaaagattaccttaaaggaaaagatccaccaaactcatatttaaataataattttagctattttcgcaatctagaaacaacaggggctccgggtaactgaaactgggggtgctccatcataaaacatccagaagaccagtggggtgaatttgatctgctggtgaacacaatgaagactaataagcaaaaatgggcttcttccaacagaaacctcctgccaacctgtgcacaacattgtgcaattgcagaacggcacttcactggaagtcagggaaacacttgcaatcaagtccaggctctgtaacaagttaagtgaatccaaaacctttacagctgaacacataaaattattcaaaagctctaacgaggtgagaagcaaccaaacttgattttcatctctgggaaaccctatattagcactgtaacccacaaggccctcttccacttccaaactcctctggcattcactagccacaccttcatttggcacccaagagtgttagttaccgttttataggtaactccccaactaagttgtaagcccctaaagggtatacataggtcatgtctcactcttttctatacatcctaaaattcttagaattttgctaagcatttgcagatgctaaataaatgtatcttgactgtttgtttaattgtagatatggtttatattaccacccgtttacaatgttgatagtttcatatggttgtgtcagacgacattccactcctttaaatgccagtcaggagagtaacggagaaaataagcggccagatcaggctgtattgacagccatgcaactaatctgatactacctctccatgcatgcgtccctcccaaagaccaagtgcccactctgttctagggctaagtgttttctgttcctgctatgctttgtaccaagtcagaaataagatttggattcaagtcttagctatgccaatgagtaagcaatttgaatagatgaccttagctccaattatctatgattctatgattctaacttcaggcctttaccttccaatatcagaatggcccctccctcacagtactaaaattacttatcttccatgatatgtcccattatcatcatcaatacacccatgttcaaaggccatttctgacttctgctacaaggtcaacatactcatgaaattatttacacttctaaagataacactgttaaatttcttgtctgatctttacgtcatacctgcgttcatttaataaacacaagtgggtagttgggtaatatgggaaaagacactcatttagggaagtttctaacatattcctgctttcagcagcaaagataagttatggctccatttgcaaataagcaccaataatagtaaataaaactaaattatttttatactggtcactaggaaggttgttttcatcttaaacggcagcttagtagccttgagaataatctgatctctcccattttataagaaacttatttttattgtctcatcaacatcaaatgatattagggagtttcacaatgactgtgacaataaatggcttagaaagaaaattcagtaacaattttgataggttttaaggaatatatgagctagataaaaatatatgagccatatagagatttgatgcaatttaaattaatatctaccagttttgaaaaataaagtttctcagaacctaatgtagctttcttctgcaaaaaagacgaggcatatcacctaaaaagacctgtccctaaccaactgttatccaagtaattaaaaagaaaagtgaaaatttcacctcttcatacatgttaagcaaaaccagccataataaaatccctgatgaaaggtgagttttaaaaataaaagtgagacgtaggtaacagaatcctccaagaaatacttaaaaggttagttttcctcagccaaaatcatatcaacattttcgtatattttggatattaacctcagtacaaatattagattatcaaacataaaatataaaaatatttggctaatggtatagtaaggttttgtttcatttttaatagagtgattagccattcacaaaaatcagtcaatattactcctccataaattatgacaaaaaatatacaaactctgaatgaagcattaattgggaaaagaaaaaagctaaatatttttattgtgaaactaataaaataaaaacctcagtctagtagagaatatacactttgtgttgattaaaattttatatcactatgttaaacacagtaatactgaaaattgttattttaattacctcatttaatctctacattaaccttatttttatccccattttaaaagatataaaccgatgctcagagtgcttaaggaatcttcccaaggtcaaagaaacagtaagtagcagagctgaatccagattatttgaccctgtaaactaggtatttaagcactatgctacactgcctccagttattcataactcccaataaatattcaacactcccaataaaacacagggcacgatgagttattgatttcataactgctactgcagcattcagatactacttatttggaaaagtgttctgaatacacaattaattcaatccactatgtaaaaggtaaatgttcaagtctcattcaaatggagaaggggtagaaaaggaagaaaagtacaaagtctatatggaacatcaattaataaaaaatattatcagggttgtctttaaacttcacaattactgaaggtccttattatcttgctgtcatttcagcactctcaattgcctcttagaatttgaaatttcactgttgaaacaaaagaaacataaaatatatgtgcattctaaaaaattctgcccttttgcaatttatcttctacatttattacctggatcttctaacactcgactagaaactaaagcaatccaactgtatatacaaaatgtaaaactggaaatgccagaaaatcaacatgacctttcaaatataacattttccacaatcatttacttaatactagaaaaacattttacagtatttaaagcataatctttatgtgtaatactttcggcaaatataaaagcaaatacagaataaagtcaaccacatttttaaaccaaaactgcaattaattttaaactactactttttctccagtagttcattatctatctattaaaacattcataaccatattagtgtgctctccgtttcaaatacaaagctgatgttaaccactgtactagtcacctcctgtacctggtagggactgctagtataacaaacccctcccctgacaccaatttccctatattagtttgcttgagaacaaaaatatgtattgggcaaagaaatgagataagccttctctgtaagccagcaagaccactcttgattaatccccaacgtactggcctcaacagcatggcttctaaccaaccagaatcctcagtcaaaaatactttaaacaaagataaaaattagctagaagatcatgttaccctaaaattaaattttatttgagagcaaatgtatagcctttatattttctgatccaatcacatctttgttaaaagcaaaagatatgtaaatcaacactaataggatgttagattttccaagagagaatcacacttcagataaactactactcaaaatcttttttattccataatcaaatagcaatccttaagaatatacctttcattcccttttgactactttaagtatttccaaaagaagctgaacagaaaatacttttcttcagacttttttccgcacatctcctagcaggagagaaaaattagcaaaacaaatgaactcagaatcattaaaaggtgtggacagtgtccatcttatagctttaatacctaagaattaggaagaaaaagagatcaaggaaataaagcgaccaacataatacctggctgaaggacaaattctatacttaaaattaagtatggctctaaaaaaggatgagtttatgtcctttgtagggacatggatgaagctggaaatccatcattctgagcaaactatcccaaggacagaaaccaaacaccacatgttctcactcataggtgtgaactgaacaatgagaacacttggacacaggatggggaacatcacacaccggggcctgtcgtggggtggggggatggggtgggatagcattaggagatatacctaatgtaaatgacgagttaatgggtgcagcacaccaacatggcacatgtatacacatgtaacaaacctgcacattgtgtacatgtaccctagaacttaaagtataataaaaaaaattaagtatggctcctaccgactctatgaattcagttcatatttctttaatgcaaagagagaaagagcaaagttactgaatgaagagataaaagtgtaaaacatcaacaaagcaactaaattagatacctcacctatcacagagaaaatcaacaaggcccaatgaatttatatgtacacatttacctttggaataatacgtcatctgctttttgtattctagacatgttctattccattgactgggaaaaatcgaaaaggtggcctttgtagcagaggacaaacagaactcaggcttagtgtaacagagcagcaaaataaggtgagagaaaagcagctgagaaggggaggtttacattcaacatgtataaaaataatgtatattggctttttttttttcatgagggaaggaaggtaactggctaccctaagaatgaagcagaatcagcatggcaagaaacaaaacaggcagaaaattaaaggatccctgagaatggtttataccccaaacaaaacaaaagtgagacaaagtagaaaaaagaccaaaacccaaactaagacaaaaaccccaatcctctctcttacattgagagaagcagaataagacaacatcaagaacaaaatatctgcatccagaagtcagactcacacacacacatactctcagagcagcaggagaacaaaaggacaacatattttacaatattaagataaaactagtacaattatatttttaaatattaattttttttaaaaaagagaaagaacaggttggtcagctctgcccatagatgcttccaaaaaactccatagcagtcatcctaatggatgtgagacacaatttcactaggcctttgatatgcatttccctaatgattaatgatgctgagcatcttttcatgcccttattggccatttgtatattttctttgcagaaatgtcaattcaaaccatttgcccatgttttaatcttgttgttttttcttgtagagatgttcggagttttttgagacagaatcttgctctgtcacccagctggagtgcagcggcgcaatctcagctcaccgcaacctctgcctcccaggttcaagcaattctcctgcctcagcctcctgagtagctgggattacaggccaccattcccagctaactttttgtatttttagtagagacggggtttcaccatgttggccaggctagtcttgaactcctgaactcaggtgatccacctgccctagcctctcaaattatatactgtggatagtaaccccttatcagatacatgaactgcaggattctttttaaattcatttctctattccctaatttctcagagttggctatatgtaatgcagaagtacattttgagttgaatatatttcttctttgtttttattttttacctaatacaaaatttacaatactcaaaagaggaatacaatggaaaataacctccatccctgttcttcagctacgaagttccaatccccagagacatttttcatcttcttataattccctccagaaatattctatgcctatataagaaaatacatttcttaagtctcctccaaaataatctattcattgttctgcattttcctttttgatttactacatcctgaagattattacatttcagtatatataaactgccttatttttaacaacataaatatttcattatatatactataatttatttatccagtcccctaaggatgggcatttgtttccagtcattgccaagagtatccttaaatatatgttatttcacacaattacaggatctataggatacaatctagtagaaaacttaaatgctatatatatttcaaattttccaaactgacctcaatgaaaattgcacaaatccatactcccattagcaatgatcacacttgcctagttccctataccctcaatgacacattgtgttttcaaaatttgtttctttgccaattaggttttaaaaaaaggcatctcattagagttttaattttgcatttctcttattatgaaatattaatactctttgtatctttgtccatttttctatccaattgttggtcttcttcccattgagttgttcgtgctctttatatatttatgaaatcagctgtcttcctatgatatgaattgcaaacattttttcctagtttttctttgctttttgatatactttgttttcttaattctcaaatttaggaacaaaagtacttccactatgtctttgttcaaactatattccttattttgaatgttcttcccttccttcaaaggtcaattcaagttgatgtctctgctctctccctaatcactcaagatcaccttgattcaaaaattatttagtgagagcctactgcattatatttacaaataagtaaatccagtgaattttgtgatatagtagcacacagcaaggaaaatttatagaggccactaaacatttaaattgtatctgaaaaaatgagaagatatgatccaaattttaaaaatgaaacaaaggcccaggtaacgagaacttattgtctataaattagtctcattggggtacagaatgctaatgttgtagtgaaaaagagaaaaagctgaagaggcaagcagagccaggtaggataggtcttttaggccaatttaagtaagtttttcttaatctaagggcaactagaagccacagaaccattttaagcagcagaatgctggtcagagaagaattttacaaagaccactgactgcaatcttgagtttaaccagcacttcagtgaacagagttgaaactgattcaaatatcaaatatactcttatttattcaataagtgaattttaaaccactatggaatagaatgctacagaaaggtgaaataaggtactgtgctgctctacttccttaactgagggcttggaacaatcactgttgcaagtcaatttaaacaaccagacaatcagaccatgttaaagatgagacctctaataataaaaaatcatagttgattctcactttatcataaaatccaaaacggacaagtatgggcccaaattcatgcagttcactcaacaactgtactcttacttctccattgtaggctaaacaaactgtcataccccccccccctttttatcctgcttttttgcttgtttttttttaattttttatttatttaggttgggggagacagggccttgttctgtcacccaggctggagtacagtggtgtgattatggctcactgcagtctcaaactcctgggctcaagagattcccctgtctcagcctcctgagtagctgggactacccatgggcaccaccacaccagtctaattttttttttttttttgagacagggtctcactgtgttgcccaggctggtgtacagtggcatgatcacggcttactgcaacctctgcctcccagtctcaaacactcctcccacctcagcctcccaaggagctgggaccagaggcacatgccaccacgtccagctaattttttgtatttttgggagacacagggtttcaccatgttgttcacactggtctcaaactcccagactcaagtgatcctcctgcctcagcctcacaaagtgctgggattacaggtgtgagccactgcacctggcccatcctgctttcaacagatgacattaaatgtccagaaagaattcatgagatgttatgaccattgaatttccccacgtttagcctgggtagtgagaaaccagtttcagggagagaatattatctatcagggagagaatattatctatcttgtcacccaattcaatcctctaaaatgaccttctatgtgcttgctacaaaaaaaaagttcttccaaacaaatacattcaaaaaataaagtttgtttgactgcatgcttctctagaatgcttttaaaattttcttctccccattctcaatatcataaatcaggtaacacctaacaggaattgtctgtactatttcttatttgctggtgacaattcctttttgattccccatgtctactttaggggttagtggtttaacagtcattcttacatcttttgtcataggatattccaccgttctgtctttagatatatgatacactttgaagttaacagaagaaagtaaattagtataaatacaaaaagttgatattacaatataataagcatgtcaatggtactaacaggagatgacaattacacctttatctcgaagtaatcaccatcaaccattctcaaactcagaagtgtatagttttttttataattttaattcattatcatgtcacttaccatttttctctaagtattttaaactatagggacattttgattgaaactagaattgtattcaatacaacacctccctcaggaatttaactttacaagcctatttctattctcttcccaagaatctttccatctaattctaccttgccctcgtggcttaacccatacagagactggtcataagtgctttagaatctagcattttcttcctacaaacaggaaataatgtgtctctgacactatccaaaaatgtggcaacataatttatgcttttggaaggaagactaacatctcaagctgacaactaggtaataaatatgattaagacccaagcacacaatgagaatatcccaaagggtatacctttcagaagaagacaaggcttaatcagtgagacattttcagcaaaaaatacagtcatttttttctcagatgctcctaaataaccatctttttggcagtattgacttgttagccccaaatcattatttcccttctttactattaatcttcaaaacaaaaaaatttaagtctatgatagtaaccaagtctgactcattaaccgaacaattccccactattctctgagtttaaattcacataggattcttacaaacagcttatgaagtcctcaaaaataacccatgaagtatgtgttatctctgctttcccagaaggaaaatgaagttcacagacaaaaagtgacttgttcatgttcacataggtaataacagagctagcacctgaataaagatcttacatatccttttcactatatatcaccactttaacatctggatatttatatttaaagcctattttttaacttttaatatagaagttttaactgaatgtttagagtattagcataatgtagtcatatacatcagacaggtctcaaaaaatcttctaatatgttgtcataatccacatactcagactacaggatgtctcttaaacatgagaaatagtaagattctggccacgtgtggtggctcacacctgtaatcccagcactttgggaggccaaggcaggtggatcatctgaggtcaggagttcaagaccagcctggccaatatagtgagacctccatctctactaaaaatacaaagattagccagacatggtaacacatgcctgtaatcccagctacttgggaggctgaggcacgaaaatcacttgaacttgggaggcagaagttgcagtgagccgagatcacgtcatagcactccagcctggatgacagagcgagactccgtgtcaaaaaaaaaaaaaaaaacatagtgagactcataaaaagcacaagctaattcatttataaactgattcaaactgccctcacataataacagtgctaaatagttattaatatttaacaaaactaaataataattattcagtatttaaatctgacactaaaaaaaactcttattcaagcaactattaaacaaataagctcctgggaaaataccaagatccttagtaaataatctgcaataccaataaaactaaaaataaaggccaaaaaggctacatactgtatgattctaactctatgacattatggaaaaggcaaaaacattggagacagtgaaaagatcagaagttaccaggggttaggagaagggagggatgaataagcacaacccaagatttttaggcagtgaaaatactctgtatactataagcatacatacatggcattacacatttgtccaaacccacaaaatgcactacaccaagaatgaaccctaatgtaaacaatgaactttgggggataatgatgtgtccatgtagtttcatcaattgtagcaaacgtaccattctggtgggggatgttgatcatgcaggagaggctatgcatgtgtgagggcagggagtaaatgggatatctctgtaccttccattcaattttactgtgaaccaaaagaccctaaaaaaaagtctattttaaataaggcaaaatatctgcggcaatcttaatcttctcctatcaattattacttcacaggtcctctgttaactatttagtagaaagcatccttggctgtcaatgctaaccttctgcacagctcttatttacacacacattgctcctcataacatctgctctgcccactgtagcctgcttatcctctaatggtcatcagtatactgagtccaaagacagggaaggagtcaggtacaaatgagatggagaagacaggtagtggggctaaggaagcaaagaactgctaaagagggaagtcagcagataaatctgcaggagaaaatctgcagcaacaaggagaaaagaatcctgagttgatacaaatttgtttattggtttacataatgggaaaatcatatgaaatgaaattatcctaaaatacaaaacatgatgacattacaaacatttcccttctttaaaaaaaagtctttgctgtatacaattccgtaactagaacttgataatctgtttgcaatgtgtcccccagcgacaagcaagatgatttttcaaaagttgactgtaaatgctacatttttcaaaggaaagatatataaaagtgtgtgtgacaaagacctatgtctcagaataacttggaaaaaagtacaaatattaaatttttatgatttattgcctgaaagaaagttgtacacttttatattctgggtattcttaatctaagaagtcaagaacatactatgtattaccaaactgggcaagagttcaatgagattctgaaagttatacctaacgtactatgtattaccaaaaacatacaatatgtttagtaacaaatagtatgttaggtatgttaggtatgactgttagaggtgtgtgtgtgtgtgtgtgtgtgtgtgtgtgtgtgtggtcacttgcttgctttggtcatcggtgaggaagccaggctaagcaactaacaaagagtccaaatatctgagtcatttatgagaggctaagggctccagtggcaaatcagggacctataagacaggctcaaagatggttctggcaggatccaccaccaccatcactaccacctcagcaaaatacaaccttcttcatctgaagtttcagggaagcacaaaggctcgagttctgccagcagtccagctcagtaaacactgattaagcaccagtgaagtacaaagcattaggttaaaggtgataaaagacactgaataggaggaaatatagcccctactaccttaagaattttccagtaaaaaatatggtaagactataatccaggcaaggtagagcaagtactaaaagagaaatacaaagaaggcattcagaggtttcctcaaggagatgctctagaatgaaacctgaggctattactcagatgaccaacaagttcatgctatagccactgctcgtttataattttctcccattcaatgtactacttctacaccagagatgtgagaaacttgaaaaaggctattttgttctagctgattattaaagggggagaattcttgaatataaagtaagatataaggtaaagcaagcaggaaaggatttggagcaaggtgtgtcataatgctaacatggcacaaagcaaaataattcaacttccattcagttttactggtcaaaaggaatagcatcatttttgttttgttttgttttgttttgagacagagtctcactctgtcacccagcctggagtgcacgggcacaatctctgcccactgcaacttccacctccagggttcaagagatcctcctgcctcagcctcctgaggacctggcatcacaggcatgtatcatcacacccggctaatttttgtatttttagtagagacagagtttcactatgttggccaggctgttctcaaactcctgacctcaagtgatccacctgcctcggcctcccaaagtgctgggattacaggtgtgagccaccatcacttctataacacatttatatgctgctttaatggtttacaaaggactctcacataaatgcttacaatgaaactcaaagcaatcctatgtcaggtagagactgttatcctctcagagagcctaccctcacaagacagtccacaatgatccttgcctcatgtccttgtgtaatccactcccatactgaatcagggctggtctgtagaaccaattgaatacatctgaaatgatggtgtatgacttccacaggtaagtcataaagggcactgcagtttctactttggcagcttgaatctcgggaaagtcatctgccatctcatgagaatagtcccacggcaagcccattgtggaaaggaaccaacctgccaacaccaactggccagccaagtgagtaagccaccttggaagtgaatcttttagctccagtgatgctcctataaaacttccactcctgctgatatctgacagcaacctccagagaaccaagcaaggaccctcaaattgctgacccacagcaaccatgagataacaaacaatcattgttgttttcagccactaaggttttcatgttacaaaacaacagagaacccaattttacatatgaggctcagagaggttaatttaccaattatcatataggaatgagtagagaaaacagatctggaacccagtctttaggctttaggttcaatttgtcattaaacaataccactttcttctcaactaaaataaggtataatactgtaaggatgatcattcctacacgattatatgactgatactagtatgtcaagcttcctacagtacagagacacagtatatgtccctgcattcttaacgaatataatgggaatctccaaaataagtccatttgtggtgctccattgtgctctgtggagttgttactattttctggaaaatggctatttttaatgtgcatatcatgaaaataaacacttaacacatttagagaattttaatactaaaatattactgacactgagactacacacttaaatcttaattacaataagcatctgtgtaattttaaacaattagaatatatcagacaggaaatgctcaactgctatttctttaaggttctgcattttggctttaggtcttcaaccttgtagcattacacaaatgtagtaaaatatatcatcaaaatgctcgtgatggtaaaatattaaatcaaaatccataaagtagttcctatcttacaggacaaggtagccagctcttaagcctgtccacttctggagaaggtcaagagaacattttattgttataatcacatctgcatataatgttccttcacacaaatctcctcttttgagccatataactttgcaaaacaggtaggcaggacgggtatactaccatcctatttttcaatgatggccttagagaagtctcagtaacttaactaaggatacgtaactattaaaaggaattcaagaatctaatctacaattttttagctccaaatcccagccttttcttctaagccatgttttagcccagtggttctccaccctgactgccatgaggacacctaagatgctttgaaaatatcactgcctggacctcatcccccagatacttgatataattgcactggtttgtgttagctgtctaatatataataaaccagtgttggtaaattcacagaaagtttatatcacaagggagaaaatgctgatacgtctatatgtaaactgaaacatattaaccccctaagaactccctcaaacacaaaaatatcttgcaataaaatcacgcagaacaagaagaaagggaagatgagaaacccaagccccttctgctgctatcgtggggccattaaggaatattttattcccctaatcttactccccgaacctcaccatgccatatctcaagctatagctcaggtatcaccttttgtgagaccttcaggatcacaaaaataatgaagtccattttttgcatctatcttaccttgaactctatcatagcacatattgtccctcaaagcattgctttatttttattttattattattattattattatttgagatggagtcttgctctgtcacccaggctggagtgcagtaccacattctcggctcactgcaacctccacctcctgggttcaagtgattctcctgcctcagcctctgggattacaggtacatgccagcatgcctgactaatttttgtatttttagtagagacggggttttgccatattggccaggctagtctcgaactcctgacctctggtgatccacccacctcagcctcccaaagtactggtgctgctttatttatatatccatttttctcactgccctgaggggtccttaacccatttatgctggaggttgcaaattttttttgtgaaaaatcaggccttggcgatgaccttgagaagtaggatataaataactcccactagcttagcgctccaataatggagcactaggcataaatgcattaagatcagatccctatgttactcatccttcctgccatatatatctttgtatccagggcctttaccatagcagatattaatacatgttggctatgctgaatgatttttatgtttgttatcattatttcctccattctcctagcagacactcctgtgaaatttttcaacttttaataaaggaaaatggagtttttacgcacaactggattaggttagagaataatgtatgcaaaagggccagacgtagtgagagcaagacagcagtgaactgtggggcaggaaagaatagagtagaaaggacatttaaaattcatatctgacagttggggtcagatatgaattttgcaagccgggaaggagtaggcaaacaaagcgacaacctaatcttcattcacaaaaaaaaaaatatgacaagcaaggaatcaggcaactgtattttcaacatctccctttctatggtgtttctaactcacagcatacagacatgttgtttctctctcaaaaaataaaatctgaagcagtgatatgatttcactatgtatttgacttttttttaagattccacatgtgagataatacaatatttttctttctgcatttggcttacttcacttagcataatgtcccctaggtttacctatcttatggcaaaaagcagaatctatttcttttttaaggctgaataatattccattctatatatgtactgcagtttgattttctgttgtcttttgttggacagttaggttgtttccatatattcacacccatcaagatggctactaccaaataaaacaagagataagtgttggcgagggtgggagaaaagagaacccttgtatactattggtacaaccattatggaaaaagtagggaggttcctaaagaaattaaaaatagaactaccattacttctattttgtaccaattagccatccctcttctgtgtgcatgtatatatatatatatatacatacccaaagaaaatgaaaccgcaaccttgtaaagatatcagtcggaatttttaaaagctctctaggggattctaatatgtgtgcatacagagatggagaataaaacagtgatcccaggggagggggaaggaaattgagatgtaggtcaaaggacacaaagtagcagccatgtataatgaaagagtttgggaactcatgtacagcatcagtactatataatactgtattgtattcctgacttttgctaaatgagtagattttagctactcttgtcatacacacaaaaatggataactatgtaagatgatggatgttactatgtctcactacagtaaccattttactatttacatgtattccataacatgttattttccttaaatatacacaataaaatgtattaagtaaataccctgactgaagaacaattatctcctaagagggacccaagcatatctactctctattctcatgtccagcccccttcagcctcatctcctattcagtcctttacccacagcacgatagctttacctccaccactacaatgaaaccagtgacttctaacagtcattgatgattgtaactttacaatcatcatcatacttaatggccactctccttcagcatctttacatctttctcttttatggtttctcctttaaatttttacattctctaagactaatttttagcccttttctcttctctttctatacaattcctctatgtacttttatccgtatctatggatacttcagttactctccatatggtaagaacacacaaatctgtttctccagcctttgcaatctcttgtgatgttccaggatcctatatccaactgccttctagacatctcacacttgccaatgatatgccctgcgagcatgttaaacacaggtccaaagttgaactcattctcttctccctcataccttcttcctcttctcttttcccactcacaacccagaaacctaggaagcattctaacattctccctctcccatatcttttacattcaaacagtcacaaagaccagcaaattctccctcatcttacttttcctaaacattctcacttctctattcccactacttccacctttatctaagctttcaacctctcttatccctactgatgtactgtccttgaaagcttccagtcttgccatgaccccacacccaaccccactctaccctcaatctacccagcacactgctttcagtgatcttccatgacactcacaattcttcagtggctcactactacacatggtataagaagtgtaccctgaactggctatccagtttcatctaggaagtgtaccctgaactggctaaccagtttcatctcctttcactcctgaccttgtccttcacactctaatataactgacctacatatagttcccagtatacactatgttctcgtaatgccacacaactactcatgctgttagctttacctagaaatgctttctattgcttgtcaacatgcccactcctactcagttttcaagtctcagctcaaacacaaccactactaaaacccttacctggtattgcaggcagagatcaagagctcttgctagatttcatttgtacttgtacctacctctgttatagcaaatagcatacagtatttgaactattggtcaagatatctgtagtcctacagactataagatccttggtcaaagatgacttttcatctttatatcctcctaactagttcaattcacacagtcactagttccatgtacattactagctcaatgcagatagatatactaaaaaaaggaggggcgaggttaatgaataaggtacgagtcaatgaaagaacaagaaaatcaactggactttgagtatagaaaaaaaaacaccagatcttaagaacgtacagacatctttagtacagacatctgttactgtagtacagatatccattactaagtcctaaccattaaaaaaaatagaaaaatatggttattcaggtagtatgaagatgacaaagaaaaaaacttattattggactaagtagacattaagaaggtaagagtttccagcggaacagttgacaaagatcaacagagaagccagagaaaaagatggttctttctaggaaacaagtaattcattgatctaaattcatggactgagcaaaagactgccacctttctctcagttcacaacccctctcctttgtcattattctgcatgaccccttctgagtcctcactaccaaatccccaataccatgggtagttcccctccaatggagccacaggtccaggccagtgacttaatctggatgcaagggcaagggatagaagggtatctttgttcttgtgtctaggactttgaggaaaaatgaaacaactatttactgagaatttattttacggcagattctgtgccacattacactcactcactgaatttcacagtaatcataagtaattatcccatttatagatgaggaatttgtgtccaaggtcaacagttaagcaataacaggccctgcctgaaaacctaagaatgacaacctccagagctttttctatacccctcactacctcaaaatggagggagacgtggtccagccattctaggttggcactcaggagacacttacctccaaaacactattatatatgttgattagagtctacagtaccactaatatataataagcacacaatgagtttaaaaagctttccttagtacctttaggaaagtaagtactagatttcctggggttctgatctggaaatctaaatgctatttattcctataagtacattgttaactttacaaacaacagacttgaaaatgaacttgtggaatacaatgggttcttaagtaaggcttttctttaagaatattttcttgcttccacaaaaaatacaaaagccaccaaagatagaatgattttgccttgttaacttgtaagaacaatgacactagaagaaacctatgggaaatgtgcttatctgaccaggtgctcattttcggtgggctgtcatttgactaaaacatcatactaaaccctacagaccacagcttatgagagaaatgccacaaactatagcagtacagttaatatgcctataatctactgacaaaacatactcctcagtaaagtgaaaccagatgtctggtgtgaaatcagatgtctgtgaacttgtctttctcagtttccagagcagtatcagatatactaaatacacagctaagctgtatattaaatccacaacttggcaaaatcatgacagtttggacatgaagcatcagcatttttattgtaatccttataaaccaaagacatttccaaaatggaaatcctaagtttaagtactcagctaaatacagtaatatgtctttctcactttaagaatagtgtcagggctttttaaacacattatagaaattctttcccttcatttttcaagctgacactctttatccaaggctgtggaatgatctgataaggccacatcaggtgtcagtcctcgtcccagaaattctaggatcagatacaccaggtgaacccctgtgaaaagcaaatcccagggaggcttaacagctataggaaagttaggcactacatggctttccacaatcaaaaggaagatcataggaaagtaatgggtgaccacatagaaaaacagggagggaaatttaaaagtaagtacttctatgccaggcactgttttttcacacattcttttatatatactctttgttctgttttgatggataagaaatcaagcagcagagaaattttaatggcccaaagtgacacagctaataaaataagagccagaaatcaagctcatgtccaaaagactgtaaaagtcatgctacttctacatgaagttgtggggtggagtgaggaggggtggtaaatagccaagaagaaggagaaaaagaaagaaatttacaattttatcaaataacagtgaaatatatatatataaaacatgtattatgttccacatatgttccatatataatacgcagttaagatgtatacatgtttaacatatacttaagctgcatatttagtatgtgtatatatggaacaaaaagttgaagaaacaagtatcaaattgttaagtggtcatctgaaagtggactcataggaaactcacttattgccttttataccctcccagatttaattctaaataacttttttttgactttttattactcttataaccagaaaaagacaaagaactattctagcttagatcttttaaatgaggctaaatgcacagaaacccatgcaagttaaaaatggtctactttcgaatttatttttctaagtacatcatcctttacactctccatgattcctaatattaggtccttcttatggaacaactacaaaagttatcctcatctaattattatactcgtacactggaaaatgactataacattattcattataggaaacaaatcatcaaggtcagccatccttgtaagtttattactgaaagtactagaaaggcggaataataattctgttctcccacaacactgtatagacctgcaaaccactatgatcagtagtacagggaaagtcttgtaaattaacatgtaactattgagaaaatccacaaaactggtgaaaggcctaccccaaaacagccatctccaatacaatctcatcattctcaccatcctacttttatcaaagtgctgataaaagtgcgtagcacatggtaagagagaattagctattgaatcaatgaaggaacccattatcaataaacaatcacttcctgttttccataaattatgtggtcacctatcacttgagcacaaacaaataggcacgttcaggacacaggcagccagtatcagaataggcagcctatcacagagggcaattctacttttcctgtgtaagaatccaagaatgcagttttactacattcctgcttgtagctaatctgaatttcaactaatttaaaacggttatttatatgtgacatataggatgcataatgagctcccaaccttgtgagaggagctgtgtttcatttcaccatacaggggagagggaagcagtgtattaaagaagtgatagaaaagtcccacagaagaaccaatgaaatagaccacactgaaaatcacagtaagcctcagagaacttcagtgtcctttttggcaacttttcaaaagtgaatggaatgcttgccaggaggtaccaagagtgaaagcccagagaaaaaggcccagcctggtcatctctctcccctcaaaacatcttcttctgtaagcttgagagatcccaaagaacttcaacacttgtaatcttgttactaactttatgctttggggtcctaaaggattttttcaggagtacccttttaaaatgtaaacatccctaggggggttactgttcattatcaaacaggacctggattctttagtgctatggtctcagggattagtcaaagctggctaataagataggggccggagacagacaactagagaggaccaatgttccaaggtaaaaacaggtaaaggggaagtgcagttttctgtcgggtcaaggggctaaaagggatccacatgcccaagctgttaaactctatagactgtgtgaggctgaaaacagtccggggcctggagcctgtgactttgaaggtgggtcctccagttcccgatgaaaaggtagaatctgggcccaagttccccacgagcagttctggacatctagcccttctctctctcgctcgctctcaggataaagtcctaggtccttccacccctgaccattccttacttaccctttctcccgctcttcctcggtgagaaggggtaagtggttattttgtgccctcgcccaatttggccaaaaccctaaaagtaaaaaacgacagacagacacgtgctttaaaatcatgttgttcaagcctgacgctctcccaccacctgcccaacacttccaggcagaaggcagcgcgcccccacagcgctccctcacggccagagccgggggccggactaggcccctttgtgaggactgggagagggcgcgttgttggggcgccggctcggcggggaggagcgggccagctccgggccaggtgtgccgcctgtggcgccggtttctcaacctagttagccagtggcaccaagaagaggactaggctggggtggccgccgcacgcgcctcagataaacacgcgcacgcacacatgctcgcgatcacgcaggactcgcggccgcgcacccctccgcctcccggcaacgcccgccccgccggggccggggccgactcccagggaagggtccccagcccaagagaccaccaagggtcggcggctacgcgcccgccgacccctgccagcctcacagccccccacccgccgccggacgccgggcgcccgccctccgcacccgctgcgcagctcagcccgggggaagtccccgcgcagaccccgccctccgccggcggcaagctccgccccgctgccccgtcgcgcgctggccgcccgaagctccgcccccggcggaaaactggtctctggaccgcccgcccaggtcgggctcaaaatgcggcgtggatctgaaaggatcaaacacaacactaattcagcaagctattattgagcacttgccctaagctcagcaacgtactaatgggggagactacaataaagagccgaaaagtctatgaaactgtgtcttcagctcttcctcttgttttagaagccaggaaacagagaaccctcacagttacttaagtacagggcagtagtggcaaagcacctcactagcgatctctgggcaactcttcatttcattttttcctactcatgagcactcaggaaaactattcagttttgctgcctccaggtaaaacaaagtgagtaacacaggacaggcggtttacttgagagaaacgggaatttcatactgaagcttttgccctcaaatggtacaaactctttttttttttttcctgagacggagtctcgctctgtcgccagagcgacactgcaatctccgcctcccgggttcacgccattctcctgcctcagcctccctagtagccgggactacaggcccccgccaccatgcccggctaatcttcttgtatttttagtagagatgggatttcaccgtgttagcaaagatggtctccatctcctgacctcgtgatccgctcacctaggcctcccaaagtgctaggattacaggcgtgagccactgcgcccggccgaatggtacaaactcttaactgggttattacaacctacaaagaaaccttcttatccatgttattaattatcctaattcaatgtggtttaaaatgttgatgaaagtacccaaatcatggtgctccaacaagctggatgccaaccaggtactcgtaagtacttgcaattacaggtgcgatattttcattccatatcatcccaagatgcccttccttcacgtgaagcagccagaaagatcaactaccagattccgcatgattgaggaattgataaatagaaagggaagaccgaaaccggccaaattttcccttcgaagtgaaacttgagaaacttgcgtgcattttacctgagttcctttctcagcagataaactgtcagacctcccagatagtgtcaaggaaatgcaactttccagaacactacatctggacaatgaggtgcatctgctgcctgttcacaaactcctcttccttacccctccataattccctgctatagaaagccctaactttagtctccctaagacatgtttgagactggtctccctgccagcatcacctgcattaaagcctgtcttccctggcaatactcgttgtctcagggactggttttctttgctaggagcaacccaacctaggctgaagcccaggcatttagcagcagtggcacctagaaatactgaacagacataaaatactttttttctccttttcttactcctccagttgtatcttcattatttctgtctctattctccctctagatactgccaaactactctgtgcactttcagatcacttaatactaatgtaaataacagacattctggcactcttggttcaaaatttattctaaaggtttaagaatctactcagggtcttaaatagcctgataactaaaattccaagagtttcctaaagagagcaaaattgctctcctgtgaaggggatatgtcccagtttttcttacttgtcactgaaataattactgcaaagtaagctcttttcggccagtgcttaaggacttaatttcaagagcacttaggtgacaggaccaccctcatcaaatagcagtcaagaactatttggtaccatgaccccaaattgaatggagctcctggtcactaggaactgacagtctgggatggaatgtaggtgaataaacaacaaagacaggtgtttatggcctttattgtattgggaagtcaataaacatacaaaaagagttgctaggtctggcctgattttatcactaagattcatcaagtgtacttaaaaagaagctaatatctggaaagggcagaactatggtatattagtcagggtttcctagagggacagaaccaataggatagacatataaatataaagaggagtttattaagtattaacttacatgatgacaaagtcccacaataggctgtctgcaagcttgaggagcaagagagccagtccgagtctcaaaattgaagaactttgaatccgatgtttgagggcagtaagcgtccagcacaggagaaagctgtaggctgagagactaggccagtctctccttttcatgtttttctgcctgctttatattcactggcagcttattagatggtgcccacccaattaaaggtgggtctgcctttcccagcccactgactcaaatgttaatctccttggcaacaccctcatagacacacccaggatcaatactttctatccttcaatacattcaagctgacactcagtattaaccatcacatatggagacagtaaaaagatcagtgattgccagaggtcacagaggagggggatatgaagcacagatttttagggcagtgaaactattctgtatgatatgataatggtgatgcatgtcattatacatttgtccaaacccataaaatatacaacccaaagagggagccttaatataaaatctcaactttgggtgataatgatgtcaatgtaagttcatcaattgtaacaaatatactgctctggtacaggatattcatagtcagggaggctgtgcagatgtggggtacaggaatatataggaaccctatacttcctgctcaattttgctctgaacctgaaactgatctttgggagaaaaaagtttatgagaaaaagaagcagcagttagagcatcctattttattctaatttatcaattaaattctaagctgaatatttggctttatgtatctagttcaaatatatttgccttgtctccttatatattaaagcagacctctatttgttgttaataccatcaggggaaaatgaatcataaagtcctaactaaggtacaaatttaaactatagttaggcatcaaatctaatggtcaaagagatatttaaacaaagttaaaataattaagtttacagattccacaaatatagatattaaaatatattcctatctatacatacttaccattggtaagcaaataatagaaggtatcatagagtagcagttctcaaactactttttgatctcaagttctctttacattcttaaaaatgattgagaactttaaagagctgttgtttatgtgggttatatatgtccatatttactgtattaaaatttaagatagaaaaatgttagacatgtgtttgcttaatttaaacccattacatgttactgtaaaagttatttttataaataatgactactttttttccaaaaaattagagaaaagtggcatttttaacattttataaatctcttattatctggcttaaggagagcactggattctcatattctgcctctgcattcaggctgttgtgatatgttgttatacctaagatatgaagaaaattaactgtcatacgaattcatagttgaaaaagagaggaccttacaaagctccgggaagggtttcagtaacccctaggtgttctcaaacctcacttggagaattactgccaaatggccttttgcatttcatttgtttgaatgtcatatatttccacacaggcttctgttaacacctgaaattatagccctttacttatttcaagctaaaactcatatttgtcagctcatatcaaaccatgacatttcaataaagtttttaaaagcttttactatagcaactctgatgaaattgatattattatttgaattgatatgaaaacacttgagatttcatttatatccttcatctcaaacgttttggaaaattttgaatataaattgtaccatctggaaaaaatgtaagattggtatatagttattaatccaattttaggtatgcttataacaaggtatatccccttttataaaaataatttaaaagcgagcttaaaacaaaaacaaaacaagcaattacagttttatttatgaactaaatacttgattctaaacttactaccttggaataaaattttaaatatataacctttcatttttattacaaataaaaataatgtaaatcatccagtttggggttttttaatacaatttccaactaaaagaaactagagctgaccaaccaaatgtctgacttcagatctgggtcaggttatacacaagatgagcataggataacttgtcccacaaagccgggaatccattaacaacaaaatgtgtcaaagggacacagaaaccaatatcaaatagctcctttggccaaagatggacaatttaagcatcaaaaaaagtaatggatgcagttgttagaaacatactgaatatataaaaattcatgagttcttaatgatgttccaaaaaggggaggtcaataaaaggaaaaaaaaaatccactggacactattgcaagtagctagcattaagcccttattctaaaattgtccattaaaagaaaataattcaaattttctgatgtatctttcctgattaaactatatatcagaaaaccaaattggtgttgagggaaagttgttttttataataaatatgaaacaacagaattggaaacccaccatttagcaatcttgcatttaataaatgattcaggcaaccatcatcaatggatcaaaccaacagatgaaatgttcatgaggaacttcacaatggagatcagaccgtcactacctcagcctaataatctgtcattacaagtgggactccagacattgtgtgcttcctgatctaatgccatctgaagcactcagcacaactatgaaatgttatcacccaaaaaacatgaatgggatctaatcaagccttaaaactgacttctcacttacaggcttacaaaaaacatgagggttacaggaataagttaaatgacaccacaaagaggctgggcgcagtggctcgcacctataatcccagcactttgggaggtcgaggaaggtggatcacttggggccaggagttcaagaccaccctgggtaacatggtgaaaccctgtctctactaaaaataaacaatgagccaggcatggtggtgcgtgcctataatcccagctactcaggaggctgaggcaggagaatcgcttgaacccgggaagcggaggttacagtgagccaagatggcaccactgcactccagcctggatgacagggtgagaccctgtctcaaaaaaaaagaaaaaaagatgccacaaagaaggaaacaggtaaatctagaatggagtagaatggaggacactctctaggacaattgatgtagtctctacaacaagttaataactggacacacaggagagggaatgggtcaggagaagcctaggttaaaaaaaatacagccatgaaatgtaagatgtgaacctttatttggatcctgattgaaacatcacaactataaagacttgtaagacaatcacggacatttaactatggactggtgttagatgataccaaagaaatattattttattaggtgtaataatggcattgtgattatgtaagaaaatgtccataatttttggagaggcattctgaagtatgttgaagttaaatgacatactctctggaatttactttatacttcaacataaaaaaaaagaaggaagaaaaagagatagcataaataagaaaataaaatggataattattgaatctagatgatgaggggagttctttgtacttttccatggttttcgtatatgtatgaaattttgtataatgaatatttaaaaatataagtgacggccgtagctcagattttctagaaaacagtgcctgagacaagctcacatgttaaaattttcttgggggttgcagtactagaaaagcaataatgaaggaaaagggagaacagaggcagggacagagggaggaagatccatggtggtatgtttccaagctgattatagcatcccagtacatgcagttggttgcttagtcacacaggacatctcaagaaggctgtgtgaaaccactgggtaacaatcctccctcaggaggggaaaggttaaggcactttttttaactggatccttcctgccttctgtctctcattcatcaatgtttgttccataaagcagggcaagcatgtgggggaaaaaaggttgggggcagggaagtgaaaatgggttttatgaagtgactgagatttgtttaatctcacaatgtagaatttaaacaaatcagtgacttttgggtttagtgaagacttacctataattttagcctttttgaactagaataatcattctgcttgactttcttattacatcagtaaataatttattcaggtcaaagccattatttttgattaacagaaatcacagtcacataaatggctacagaaactaaatataggagaagggttctaccacagtgacctgaacatttgcatgcgcccttgcacatctccacaaaggccacatcagcaagacttgactgcagctgatctaagtcatggtggaattctgttgattctcctacaacatgagatcatgagaggcttgttaagagctgacccaaggccatttctcattcacctcccagtttctcattgcctcctgtgttttgaggaggtatgacactttctgcctcattctccctagaatacagcctcaggctgtaaaactgcttagctgaagcatgacattggttcctcaggaacagggtgccctatcatccaggttgtggtcatctggcctcctttgtatcagtgtcaccctgtgcaagggataccagagctggcatctttggctactcttgcttttgctttccaagtaagtaataaactgtctgaatctaaaaatggcaactcattgttttcttactagctgaatctatcacccttgccttaccttgacaaattctaggcaagaaatttttactttccttaatgctaaagaggtcctttactctttcctctttgtattttgctcagcctacaaagttagtagccagtaaacaaactgatatgaaaatatgaaagacttagattcacatttttagaaagagtaactgttctctaagtattttaggataatttttggccaacagttaaaggagccttccttctcctggccttgccttcaaattaattaataggctattcttacaaggcaggtcaagattcagtcctcttaaaaaataaagaccaatcagaaggattttcaacaaagtccctttattttctactcacacttaaacactatagttggtagggttcaaaaagtctgggaaagagggagacgaagcaagatggtgaaatacaaagctccacgaatcgttcccactaacccacaccaagttaacaactatctacatggaaaaaaacaccttcataagaacaagaaatcaggtgagcactcatagtaccttgctttaacttcatagtgctgaaagaggcaacaaagagagaaaaaatagtactgaattgccgatgccaccccctattcctccccgaccccaggagcagcatggtgtggagagtgtccttgggtgctgggggagtgagaacacagcaattgtgcggcgttgaactcggtgctgtcttgttagagcagaaaggaaaccccaaactcagctggtgtccacccacagagagaacatttaaactagccctagccagagggggacttgagtgcctgcaaacctcgccacccagggctacagctgtctgtctccaagtaaacttgaaaggcagtctaggccataaggactacaactcttaggcatatcctagtgctgaagtaggcccaggacagtggactggtggggcatgtgacatactgagacactggataggtagtcaaggaagtgctggcctcacccctctcctaacctcaggctgcacagtttgcagctccaaaagagacaccttcttccacttgaagagaagagagggaagaacaaggagaactttgtcctgcatctacggtacaagctcagccacaacaggatggggcaccagatagacttgcaaggctgcaaggcccctgttccaggccctagttcccagagaacatttctagacacaccctggaccagaagagaatggcttcaggtaacagcccagccacagtgggtagaaaatcaagcaagctctcgaggtccctgattctaggattttactcttgaacagcatttccggacctgtcctgggccagaggggtgtccactaccctgaagggtgagtcccaggccaggcagcattcatgacaagctgacttaagagctgttgggcattaagggaacatcagtggtagtctggcagtactcttcatggcccaggatggcagtggctatagggtaaggctcctctgcctttggaaaggggagggaagagtgggaaggacagcatcttgtggtttgtttaacagctcagccacaatacaatagaacaccaggtagacttctaaggtttttcactctagtctctgactcctagacaatggcacttctgtacccactggtgggctgggggaccttccctccctgaagggaaggacacaggcctggctggctttgccatctggtgatagtagagccccagggtcttcagcaaacataggcagtagccagggggtggttataggaggccttggtcaagtaccagtgctctgctggcttcaggtctaacccggcacggtcttagtggtggtggccacaggggtgtttgtgttactccatccctagctttaggtggcttggaacaaagacagaggctgtttgggagaaagtaagaagaaaggaacaagagtctctgccttgtaatctagagaattctcccagattttgtccaaggccatcaaagcagtactctgtgagtctgcaagaatcatagcattactgggtttggggtgctccctgaagtacatcacaacactcacgtccttgtagatcacaacacccaagtcctttcaaatatctggaaagccttcccaaagatggctataaataagcccagacagtgaagactatagtaaatatccactcttcaatgcccagacaccaaagatcatctactaggatcaacactattcaggaaaacatgacttcatcaaatgaactgaataatgcaccagggatcaatcctagagaaacagagataggttgaagaaactcaaaaacattcaagataacacagagaaggaattcagaataatatcagataaatttaagaaaaagattgaaataactaagaagaatcaagcagaaattctggaactaaaaaatgcaattggcagactaaagaatccatcagagtactttaatagcagaatttgtcggggaatttgccctgatattcacgtaggttcttttctatttttccgaagtgtcagccagtttgagaaataaagggacagagtacaaaagagagaaattgtaaagctgggcatccgggggagacatcacatgtcggtaggttctgtgatgccccacaagccacaaaaaccagcaagtattttttaaggattttcaaaaggggagggagtgtgcgaataggtatgggtgacagacatcaagtacttaacagggtaatagaatgtcccaaggcaagtggaggcagggcgagagcacaggaccacaggaccgaggtgaaattaaaattgctaatgaagtttcaggcaccattgtcattgatagcatcttatcaggagacagggttttgagatcaaccggtctgaccaaaatttattaggtgggaatttcatcttcctaataagcctgggagcgctatgggagactggagcttatttcatctctgcagtttcgaccataagagacaggcacaccttgcgggggctgtttataagcctaaaactccaggcgtgtattctctttctcagggatgttccatgctgagaaaaagaattcagcgatatttctcccatttgcttttgaaagaagagaaatatggctctgttctgcccggctcaccagcggtcagaatttaaggttatctctcttttttcctaaacattgctgttatcttgttcttttttcaaggtgcccagatttcatattgctcaaacacacatgctctacaatttgtgcagttaatgcaattattacatggtcctgaggtgacatacgtcctcctcagctgacaggatcaggggattaaagtaaagacaggcataggaaatcacaagggtattgattggggaagtgataagtgtccatgaaatctttgcaatttatttttagagattgcagtaaagacaggcataagaaattataaaagtattaatttggggaactaataaatgtccataaaatcttcacaatccacattcttctgccatggcttcagccggtccctccttttggggtccctgacttcccgcaacaagaattgatcaagcagaagaaagatttagggagcttgaagacaggctatttgaaaatacagccaaaggagaccaaagaaaaaagaaaaaccaatgaaacatgcctacaggatctagaaaatagcttcaaaagggcaactctaagagttgttgttcttaaagaggaggtagagaagggaatacaggtagaaagcttattcaaagggacaataacagagcccaaacctagataaagataacaacatccatgtacaagaaggtaatagaacactaagcagatttaacccaaagaagactacctcaaggaatttaataatcaaactcccaaaggtcaaggataaagaacaaatcctaaaagactggtggctttgcatggtggctcacatctctaatcccagcactttgggaggccaaggcaggcatatcacttgaggtcaggagttcgagatcagcctggccaatatggtgaaaccctgtgtctactaaaaaaaaaaaaaaattagccaggcgttgtggtgggcacctgtaatcccaggtacttgggaggctaaggcaagaagaatcacttaaaccgaggaagtggaggttgcagtgagccaagatcatgccactgctctccagcctgggtgacagagtaagactctatctcaaaacaaaacaaacacacacacacacacacacaaagcaagagaaaagaaacaaataacatatgacggagctccaatacatctggcagcagacttttcaatggaaaccttgcaggccaggagagagtggcatgacatatttagagtgctgaaggaaaaaaactttaaacctagaataatatattcagtgaaaatatccttcaaacatgaaggagaaataaagacttttctacacaaagaaaagctgagggatttcagcaataccagccctgtcctacaagacaagatgaaatgctaaagagactatttcaatcagaaaggaaagaacattaatgaacaataaataatcacctgaaaatacaaaactcactggtaacaataagtacagacacaaaaaaaaatgttgtaaaactgtaactgtggtatatgaactactcttaccctaagtagttgaagactaaacaatgaaccaatcaaaaataataactataacaacttttcaagacatagtaagtacaataagatataaatagaaacagcaaaaagttaataagtggggaaacaatgttaagtcatagagctttcattagttttctttttgtttgtttatgcaaatagtattaagttgttatcaggttaaacataatgggttataaaatagtattagcaagcctcatagtaacctcaagccaaaaagcatacaatgtatacacaaaagataaacagcaagaaatcatatcaccagagaaaatcaccttcaccagaatacaaataacacaagggcaggagtaagtctttacttatcaaaattaacattgtatgtaatagactaaactttccaatagaaaaacatagagtggccgaatggatgaaaaaacaagacgcattgatctgttgcctacaataaacacaactcagctacaaagacacacatagcctaaaaataaagagatggaaaaagatattctgtgacaatgaaaaccaagaaagaacaggagttgctgtactcatatcaggcaaaggatatttcaagacaaaacctagaagaaacaaaggtcagcatataatgataaaggggtcaattcagcaagaggacataacagttttaaatatatatgcacccaacagtggagcacccagattcataaaggaaatattattaccactaaagagagagatagaccccaaggcaataatagctggagacttttacaccccactttcagcagaaagacagatcttccagataaaaatcaacaaagaaacatcagattaatagacatttacagaccattccatccacgagctgcagatacacattcatttcctcagcacacggatcattctcaaagatagatcctatgttaggtcataaaacaaatattaaaacattcaaaaaattgaaataatatcaagcatcttctctgaccacaatggaataaaactagaaatcaataagaagaattttgaaaactatacaaatacatggaaattagaccatgtgctcctgaatgatgagcaggtcaatgaagaaattaagaagaaaattgaaaagtttcttgaaacaaatgataaaggaaatatgacataccaaaacccatgggacacagcaaaagcagtactaagagggaagtttatttatgttggtgcaaatgtaattgtggtttttgccattaaaagtaattaaaagtaatggcaaaaccacaattatgtttgcaccaacctaataactataagtgcttaaatcataaaacaggaaaacttcaaataagcaatctaaggatgcctcttaaagaactggaaaagcaaaagcaagccaaatccaaaattaggagaagaaaattagtagaagaaaagaaataataaagatcagagtagagataaataaaattgaaatgaaaaaaatacaaaagaccaatgaaataaaaagtaggttttttgaaaagattaacaaaatcgacaaacctttaaccaaactaagaaaaaaagagaaagaaatccaaataaataaaatcagaaatgaaaaaagagacattaaaactgatactacagaaattcaaaggcccattagtggctactatgagcaaccagatgccaatgaattggaaaatatagacaaaatgaacaaattgccagatacatacaacctaccaagactgaaccaggcagcaatccaaaacctgaacagaccaataacaagtaacaagattgaagccataataaaaagtctcccagtaaagaaaagactgagacgtgatggctacactactgaattctatcaaacttttaaataagaactaatgccaatcctactcaaactattctataaaatagaagaggagagaagacttccaacctcattctacaaggccaatattaccctgataccaaaagtagacaaagacacatttaaataaataaataaataagtaagtataagccaatatctgatgaatatcgatgaaaaaattctcaataaattccacgaccaagtggaatttattccagggttgcaaggatggttcaacatgtgcaaatcagccagtgtgatgcatcatatcaacagaatgaaggaaaaaaaccacatgatcatttcaattcatgttgagaaagcatctgataacattcaaaatccctttatgataaaaaccctcaaacaactggggatagaaggaacatgtctcatcataataatagctatatatgacagacccacagcaagcatcaaaatgaataaggaaaaactgaaagcctctcctctaaggtctggaacatgacaaaggtaccctctgtcaacagtgttattcaagttatactggaagtcctagatagaccaatcaaactagagaaagatgtaaaggacattcaaataggaaaggaggaagtcaaattatccttgtttacagatgatattatatttggaaaaacctaaagactccacaagaaaactattagaaatgatcaacaaattcagtgaagtttcaggatataaaatcaacatacaaaaatcagtagcatttctatatgccaacagtgaacaatgtgaaaaacaaatttaaaaagtaatcccatttacaataaccacacataaaattaaatacctgggaattaatttaaccaaagaagtgaaaaatctctataatgaaaatgataaaacaccaattgaagaaattgaagaggacaccaaaaaaatgaagaaatattccatatgcatggatttgaagaatcaatattgttaaaaggcccatactacccaaagaattacagattcaatgcaatccctgtcaaaatatcaatggcattcttcgcagaaatagaaaaaacaatcctaaaatttatatggaaccacaaaatacccaggttagccaaagctctcctgagcaaaaggaacaaaattggaggaatcacattacctgacttcaaattatgctacagagctatagtaaccaaaacagcatggtactggcataaaaacagacacagagaccaatggaacaaaatagagaacctagaaaaaaatccacacatctacagtgaactcgtttttgacaaaggtgccaagaacatacactgaggaaaagacagtctcttcaataaatagcactgggaaaactggatatttaaatacagaagaatgaaatttgacccctatctctcaccgtatacaaaaatcaaactgaaatggattaaagacttaaattgaagacctcaaactacgaaactactgcaagaagacagtggggaaaatcttcaggacattgggttgtgtaaaaatttcttgagccatactccacaagaacaggcagccaaagcaaacatgggcaaaagggatcacatcaagttaaaaagctcctgcacatcaaaggaaatcagcagagtgaagagacaacccacagaatgggaataaatatttgtgaactccccatttgacaagggattagtacccagaatatagaaggacctcaaacaactctataggagaaaaaaaaatctaataattcaatcaaaatatggaccaaagatgtgaatagacatttttctttattttttatttttttacttttttttaaaattatacttcaagttctagggtacatgtgcacaatgtgcaggtttgttacatatgtatacatgtgccatgttggtgtgctgcacccattaactcatcatttacattaggtatatctcttaatgctaaccctcccgactccccccacaccacgacaggccccagtgtgtgatgttccccttcctatgtccaagtgttctcattgttcaattcccacctatgagtgagaacaagcggtgtttggttttctgtccttgcgatagtttgctcagaatgatagtttccagcttcattcatgtccctacaaaggacatgaagtcatcattttttatggctgcatagtattccatggtgtatatgtgccacattttcttaatccagtctatcattgatggacatttgggttggttccaagtctttgctattgtgaatagtgccacaataaacatacgtgtgcatgtgtctttgtagcagtatgatttataatcctttgggtatatacccagtaatgggatggctgggtcaaatggtatttctagttctagatccttgaagaatcgccacactgtcttccacaatgattgaactggtttacagtcccatcaacagtgtaaaagtgttcctatttctccacatcctctccagcacctgttgtttcctgactttttaatgattgccattctaactggtgtgagatggtatatcattgtggttttgatttgcatttctctgatggccagtgatgatgagcattttttcatgtgtctgttggctgcataaatgtgaatagacatttttcaaaagaagacatacaaatagcaaacaggcatatgaaaaggtgctcaacataattaatcatcagagaaatggaaatcaaaactacaatgagatataatatcatcccagtcataatagcttacgtccaaaagacaggcaataagaaatgctggtgaggatatggagaaataggaatccttatacactgtttctaggaatgtaaattagtacaaccactgtggagaacaatttggaagttcctcaaaaaactaaaacttgagctactgtgtgattcagcaatcccactgctgggtatataccaaaaagaaagaaaagcaatacatcaaagagatctctgcactcctatgttggttgcagtactgtttataatagctaagatttggaagcaacttaagtgttcatcagcaagtaatggataaagaaaatgtggtacatataaacaatggaatactattcagtcataaaaaagaatggaatccagtcatttgcaacaatatggatggaagtggagatcatttgtgaagtgaaataagctaggcactgaaagacaaacatcacatgttctcacttatttgtagaatctaaaaatcaaaataattgatctcatggagatagggagtagaaggatggttaccagaggctgggaagtgtagtgggagggttgggggaggtggggatggttaatgggtaccaaaaacattagttagaaagaatgaataaggctgggtgtagtggctcacacctataatcccagcacttttggaggccaaggcgggcagatcacttgaggccaggagttcaagagcagcctggccatcatggcaaaaccctgtctctactaaaaatacaaaaattagccagggtggtggtgcacagctgtaatcccaggtactcaggaggctgaggcatgagaatcacttgaacccaggaggtggaggttgcagtgaactgagattgcatcactcactgtattccagcctggtgacagagggagactctgtctcaaaaaaaaataaaagaaaaagaaaaagagaaagtaccctaaaacttaaaatataataataataaaataaaaaataaaaataaaaaaagaaaaagagaaaagaaaaagaataagacctactatttgatagcacaacagagtgactcttaagtcaataataacaaacaattgtatattttaaagtaacttaaaaagtataattagattgtagctcaaaggataactacttgatgggatggatacaaaaagtttataggaataaataaagcaaattttgaactaacaaaaaaagataggaaaagctagaataaaaaagagaagcatcaaagatcaagctccatagacatgccctactcagattttcacaggtaggtgatctgcctctgtcttttatatacaagatgattgataatgatgttaaccaattacaactttgcctttcttatttggtacactgagaggcagggttcctctcttcttttataagcttataataaagtagaaaacagaaaaataagtgagggcaaaacataaaagctagtgaatatctcatctttttcatttctttatcacaacatatgtagattatctcttggtaatggaaatacataagccttgctaaatgactatcctagtaatagttgaccaaatccttagatccatgaatgaaggaagcagttatgtaggagacccgggcctgcctcacattttgtccagggatttcctggtactctacagtgggggtaaaaaaacgggggggactggttttgattgactttttattgataatcctgagatatctgaaagaattccttaaattatctaatgaattagccagataacaattacaaaccagcaatttatagtaactagtaatgggagaaacaattcaaaataaaaccacacatggtaaaaatttgttgaaataaaaaccaacccaagattcatatcttcatatcttcttaataactataaaaaccaaaaacactgagagagtagatttagctggaataataaacacaaaataatgaagcaatggctaagcctgcacatgatcaaaatatattattgactacagttaacaaattctattttcattcatctgagaatgtctttatttcccactgatttctgaagcaatatattttcatcagatagaattgacagttcttttctttcagtacttgaaaatgttttgttattaatacttccttttcgcctccagatgagaaatctgctctcactcaaattggtgtacccctctataagttatgtgctgtttccctctggatgctttcagtactttatttgtctttactattcaaaagtttaattgaaatgtcttggcatggatttctcctatttggggttcactccatctcctattgtgtccggaattggtgagttcttggtcttactgacttaaagaatgaagccgcggaccctcgcagtgagtgttacagctcttaaggtggcgcgtctggagtttgttccttctgatgttcggatgtgttcggagtttcttccttctggtgggttcatagtctcgctggctcagaagtgaagctgcagaccttcgcggtgagtgttacagctcttaaggcggcgcatctggagttgttccttcctcccggtgggctcctggtctcgctggcttcaggagagaagctgcagaccttcgcggtgagtgttacagctcataaaagcagtgtggacccaaagagtgagcagtagcaagatttattgcaaaaagcgaaagaacaaagtttccacagtgtggaaggggacctgagcgggttgccactgctggcttgggcagcctgcttttattctcttatctggccccacccacattctgctgattggtagagccgagtggtctgttttgacagggcactgattggtgcgtttacaatccctgagctagatacaaaggttctccacgtccccatcagattagttagatacagagtatccacacaaaagttctccaaggccccaccagagcagctagatacagagtgtcaattggtgcactcacaaaccctgagctagacacagagtgctgattggtgtgtttacaaaccttgagctagatacagaatgccaattgatgtatttacaatccctgagctagacataaaggttctccaaggccccaccagagcagctagatacggagtgtcgattggtgcactcacaaaccctgagctagacacagggtgctgattggtgtgtttacaaaccttgagctagatacagaatgccgattggtgtatttacaatccctgagctagacataaaggttctccaaggtcccaccagactcaggagcccagctggcttcacccagtggatctcccaccagggatgcaggtggagctgccagccagtcccgcgccatgcgcttgcactcttcggcccttgggtggtcgatgggactgtgtgctggggagcaggaggtggcgctcatcggggaggctggggctgcacaggagcccacggaggcaggggaaggctcaggcatggcgtgctgcagtcccgaggcctgccccgcgggaaggcagctaaggcccggcgagaaatcgagcgcagcgccggtgggctggcactgctgggggacccagtacaccctccgcagccgctggcccgggtgctaagtccctcattgccccgggccggcagggccggccggctgctccgagtgcgggacccgccaagcccacgcccacccgaaactccagctggcccgcaagtgccacatgcagccccggttcccgctcgtgcctctccctccacacctccctgcaagctgagggagtgggctccggccttggctagcccagaaaggggctcccacagtgcagcggtgggctgaagggctcctcaagtgccgccaaagtgggagcccaggcagaggaggcgcccagagcgagcaagggctgtgaggactgccagcaggctgtcacctctcattatatctataggtttatatcttttgccaaatttaggacatattaacaaattatttcttcaaataccttttcagtctcactctttctcctgtacttctgaaactccaataatgcaaatgctagctcttttgttattgtcccacaggttcctcagtctgttcaattttttgttctagtctattttctctattgttcaggttgggtaaattgttattatcattattattattgtagagacagggtctctgtgtgttgctcatgctggtataaaacttctgggctcaagggattctcctgcctgagcctcccaaagtgctgggattacagacataagccaccacacccagtcaggttggataaattctattgatgtgtcctgaagttcatcaattctatctttagtcatcttgactctactattgaacccatccagcaaattttttatttcattgctttatgttttagttctataatttctatttggttcttttttaacttatttatttgctgagatattttattttttatttgtgtcaagagaatttgtaattgctggttaaaacatttttataataactactttaaaatccatattagatcgttccaacatctgattcatcttgattttagcatctgttgattttcttttctcattcaaattgtgatcttcctggttcttggtatgaggaatgatgttcaattatattctggatattttggatattatagtataagactctggattctatttaatcttttttaatcaggtaggcctcctgttggggtgtagcaagaaggcaggtgattttgtatgtttggtctcccagtgggcccaccaacaccttccagacaaacatgcagtacttattcatcctgtccagatgtctatgggggggcggggtggggggcgggggggagggtattcattttctagtgctgccataacaaaatgcgacagattggatggcttaaaaaacagaaatttgaccaggcgcggtggctcacacctgtaatcccagcactttgggaggctgaggtgggcggatcacaagttcaggagtttgagaccagcctggccaacatagtgaaaccccgtctctactaaaaatataaaacttagcctggcatgatggtgtatgcttgtagtaccagctactcgggaggctgcggcaggagaattgcttgaacccgggaggcagaggttgtggtgagccaatattgcgccactgcactccagcctgggcaacagagtgagatccgtctcaaaaacaaacaaacaaacaaaccaaaaacagaaatttattttctcacagttatggaggctggaagtccaagatcaaggtgttgacagggttggcttcctctgaggcctctctccttggcttacagatggccacccactcaccgtatcctcacatagttgcccctctgggtacacatgccactggtgtctctatgtgtgtccttatctcctcttcttattaggaccccagtcagattggattaagggccaccctaataacctcattttaatttaatatttcttttaggaactatctgtaaatacattcacattctgaggtactggggattagagcttcaacatatgactttaggatgggaaacacaattcagcccacaacatgtgagttggaagttcagctaccccttgccctgttgacaccttcccagtcaaagtgagatattcgctcacacctctaagttcaggtgccactagaaaggtggaagcagatgattgattcacaccattttattacagcaggattggggtagaaattaggttctcaactctctgctgggcctccctgatgccagaggaggagagggagacaagcaaagtgccaactatccctgcctctaccgctttgttctgtctcattgatgccaggtggaagtgaagactcagcaacccactgggccctgcctacatggaggtgtgggggtaagtggagtactgaccagacttgagtcacacgacccagttcagttgttgatgctggatgggagtggagtctcagcttcctattggttaccactgacactagactgaagcataactgtgatgagccctgcatcccaccgtctctttgagtctcactgtgggtgcaagctcagctcattgctgcaccctgccaacacaaggtgagggatagaaaaccagatccctgctcagccaggcaaagccaccctgagtgggatcacagtgctgctgcctgcctccagtgagtggagtaaaaaatcagcctcctgtcctattctactcaaactttgagaaagggagggtgcagttgttacactggtatttgccctgagtagggcaggtatcgccaaaaagttctggctacggggaacgaacaggctcatcttggggctttttgtgtatgtttgttagtggctccaagttgaaagcttctgcaggaccctgtctggaatatatgagaggcaataaggaaatccagggaactcagtgccatgtcattccttgggtccccaggttcctaagtagttcaccttcttcttttcagtgttagagtcttcctgtgcttgtttgttgagttatggccagggtttttttagttgtaagaaagagggtctgggaggaatgaggctacttccatttgcccagaaccagaagtcctccttataaacactttaatagaagaaatgcaaagaagatagggatttttatggaatattccaacataaaatcagcaactgatctaaaacctgaattatcaaaaggaatatcaatttctaaaaccagggcaagctgacaaaataaagctgagctatataaaggtatgtgtgctgtaatactcaacttcaagatgcttttggatgagctcaattcaactaacatcaaaacaaaaggaaataaatttttctacattcggaatatttgtcacaaaacaaagaccaacactatcagatagggcaattcatgttttgtgtgttttaaatttttattttaagaataacttttaaatatttgtaacagctttcaattttttaattgattttatttggtgttagtgatacttttttagttttttctatcatcaggtatagatcatttttacatgttattaaaatacataatctcatcaaatgcagttaatattgtatttttatttttatagaaaacctctgaaacttttagcataattctatcatcaaaaatgacacaccactattattgtggtcacttatcaaaatttgaaaacacaggctcagcacagtgggtcacgtctgtcatcccagcactttgggagacagaggtggctggatcacttgacgtcagaagttcgagaccagcctggccaacatggtgaaaccccgtgtctactaaaaatacaaaaattagccaggcgcgttggtgcgtgtctgtaatcccagctactcaggaggctgaggctggagaatcacttgaacctgggaggtggaggttgcagtgaggcaagatcgtgccactgcactccagcctgggcaacagagcaagactctgtctttaaaaaaaataataaaaacatgtaaatatcacaaaaaaaaataggatgaattctgttttgagaattcccaggaatttgtattttttttaacctgaatcctgaagatatttgtcagggatttagaaacactataaaaggcaaatactgtcccaattaccttattaacaaagactttttctttttcaatgatcaagacttaatcaaaattgtttttatctcttcagtttatatgtccagacttacttggttattacaggcacagtgatgcagtgaaatcatgacctatacctaaacagcctgaaaatattcagcctataaaagaaaagacttaggtgagaatttaatagctgtcctcataaacttcgagagctctcctgaacaagagggattgcatttgttctgtatgacccaagaggaaagaattaggataaatgagatgaagttacaggaaagaaaattttgacttactatatatatccactttctagcaactagagaattctgaaatgagagcagactccctcaagcaatagtgatttcttgtcaaggtaaaaggctggacgaccatttatcggggatattatcaaaaagactcagtgtttgtgattttttttttttggtgtgtatcatctcattttgttctccaagtgacacacatagaaaatgtatttaaatggctatgtatgaatgaaaatagtaaagttcagagggtatattagttaggattctttgtaaattataaagcaatttgagctagcctgagcaaaaacaaaatacagtataagaataaatggtatttcacagaacctaaggccagtgtaatgcagctgtctctagggtcggactgaggccaaagctctctctctctctgtatcttcaccctgtttctctctaacaactgctttgttctctatttctgcagatgtattttctatgcttcccaaccacataatgggtaggagatatttatgccacagatccccaatttacatctctatcattcaagggaccagtccagaatgattgggtgcctaaattattctggactttatgcagccaattaatcacattattctcccttctgaatgctaagccaattaagaaatagccacagtaaaactggatgggataatgtggcttaaacttgaggccaaaatgtacttttctgcaactttcctttgcctttgaattgaattcagccagtccaggcagatatccagattgcatctcaggagatggcctgatctggcggcctgacctgacgagcttatcagatgggaaagacgtccaggaggtgagcacattgcacttgcacatatgcaaaaggagaataaaggatctggtcagacatgtgcaatgaccctttactgaaacctactaattaagtaagtcactccaccaactccctcagggttgagttgctgaaaaacggagataagggcagaaactttcctcataacattttcaaagatattttatacgatggactaaggtaggaatgtgcagatgggaagagaatagccttcccgcaattaccaattcttatttctggagatagggaagttaactcacccactttgaaccagttattcatctacgtccaatcaattatggttttaggagagtctctcgatgcataaacagcatggccaggggacaaccattacagataggacaggcgatttttggtaaaagatggctagacagatacatgaataagtacactcagaatgcatacacttcttcgtttacattataaagttattcttgactcataatatccagctacctcacgttcaaatgcaaatacacacaagtacacacacactcattcacacatgctctgcagtggaggactacccaagtaatgagtggataatccattacattaggaagtgatgttgccttgaggtcactgctcttcctgtgtaaaatttctggatgaggtccatttcctccccgaatccagttttaattttgttctcattttcttaaaatttagagattaaattacaaacgtaaccactctcaatatatctaatatacaacacttggggaaatggccatatagagaaatagcgacggaaagaaagctccacatagtggtcactggtctgtgatttattctgctggacagtggcagtttgaaaagcttgaaagaacaggtgacttatttgggcataattttgactcactcctttggcgtgtttcttgaccctatagtgaactttcagtttgtgttatttcttctttggattgtgtctgaaaatttcctaagaattgactcttctggtatgagtcaactatgggtccctttcaccagatttagtatttttcactgacattttcattcttgtaaaacatttctggttggctctcacatccattttggactccatttgctaaaatccagcaccacaaatcttgttaggtcatgctccaaattgaatagccaggacttgttcactctactcaggcgtatgttctgttttgttcgtttttgaagtaagtctgaaggtttcaccatccatatggtctttaatacatgaattaaaaactataaaattagctgggcgtggtagcaggggcctgtaatcccagccactcaggaggctgaggcaggagaatcctttgaacctgggaggcagaggttgcagtgagccaagatcacaccattgcactccagcctgggtgacaaggaaagattctgtctcaaaaaaaacaaacaaacaaacaaaaactatagcctggccgggtgcagtggatcatgcctgtaatcccagtactttaggaggccaaggtgggaggatcacttgagcccaggagttcaagaccatctgggcaacatagcaagaccccatctctaaaacaacaacaacaaaaaaaactatggcctgatacgaggtagctagcataacagaactccttcctttcttatcagctatggaaatattgtccctattctcctattttagctagtgagaaggactttggaaggatgggggtgggaggtagaagtatggtcagtctttctccactcttctgcttcttccaggatattcccattcctgtttccaggatcttgcgttttcttggtccagacatttatttatcctaactacaaaaaggagagtcaactcagaacttgactactgcaattcacatttccttgatttatttcttcatcagtacctcagcaattgattgattaattgattgagacagtcttgctgtgctcactggagtacagtggcatgatctttgctcactgcaacctccacctcccaggttcaagcaattctcccttccccagcctctcgagtagctggaattacaggtgcctgccaccatgcccagctaatttttgtatttttaagagagacaggctttcgccatgttggccagtttggtcttgaactcctgacctcaagtgatccgcccgccttggcctcccaaagtgctgggattacaggcgtgagccactgcacccggccagcaatctatttagaagctcagattttctctctgtgcttccagtcaagcaaatctaagttggtttttttcttctgcaccttatactgacagctacaaaaaatagatatatactaatattttctaccaaggccccccatggcttggtggagaatgatctgagatgtaagagacaatgagcaggttttcctacttacttcaatattgcagaaagactgtaagtttctatcctaagattggggtggtaggtgggagtgtgaggctcctcccaatctgacacctgccttaacttcactcattttatattttctgattaagaatctgttactccgaaccctatcacaggtagcactttgtatattaaataagattctctgttgccttaagctgtatgcaacagaaactgtatcgagccagcctaagcaagaaaagaatttaagaattcagaagggcactcaggcctaagaaagagatagaaaagttaccagatctttcttcatctctcatatcttcttctctctgcatgtttgctttatttatttattttctctgaagttaggctttctctgtttctctttccacataccaggtaagatcatggtcactcagcagcttccaacttcatatgtcttttctttgagaaaccaagggtagtatgccaaaaccattgttggttttttttcagatatgtccagggagaaaatctggttgaccagtttgtccttatagtgaaccttcatcagtggtgtgtgttcaatatcaaaacatctttctaattataaagaatcttcagttaggtgagcagatatttcatctccccaccttttggttcctaaaacaaagacatgtgacccaagtcccaccaatatgatgtttttgcctggaactttatcaagtgatacacacaatttggaatttttctatggctgtggcaccaatggcagtggcttctggttctggtggcagtagtggcttccagcatctgatgatacagtggtgactgctcggcaaagacagcagtcatgtcctaaccaggttctttctgcagcataattttaaatgtcctgagttatggcctcccttaattattgctcatttctttccaagcccaatcttcagttcttctcattgattctgtgagcgttcctaaactcttctaataatgttttttttcctcaaatataccagaatgattttatgttgtttacaactaagaacttgcctatattctaatgagctaaaccagtgggtaggggccttgtagagcaaacctgattgtcagaggtctacccctgtgaacaggaagaacagttcccagagaagacagaatcagtggacatcccaataagtgtctttttgcattaatattggaaaagttgtccaagaccatagaagagctgaatatcagaactttaagaagaatctgcacatctcactactcaatataggatttattcctttgtcccaaggattaattttaattcttgaattaataatggatggggatacctaaggttattatagaaaggccaacataagcccttcacaatctcaataatttgctatttcaccaaactgaaaaacctatttcaaaaaagaaaaggctgaattcaattaaacaacctggttctttcaaaataactggttacctaattaaaccttactattgccttaaactttgtaaacatatcttaaacactactatgctaagatggggcagaggaatgaattactgataaaattcatagttaattgaaaatgatatcaaaaacattttaatacttttcaccacataataaaataaaaactgtgtgatttgagtttttatctccttttatgggcctgtttaatttctgtaaaggagctttgaaattaagcaaaatagaaagggaaatagtaatttggataatcagtcccaaataaacaagaattgctaattgcatttcttgtacacaactaggagtaaattcaaaaactgaaagtaaattggacatgatgctcagagagtatccttgagcatgagtaactaaaattaaccagaattttaaataaactggggactcctagacttctgaagacatgaatgaggctattagaactctctttctcctactcatccattagcaatgtcgggaacagttcataaaagattaatgtttaaatgcttaagaatatatatttgaataccttgaaaacaccaagcaatgctttttaaattaattgataagtcattttatacttgtgatgtagacttagacttttttgtagtaacaagccagaaaacatctatccttctgagagataatatgtgaaagaattgtagaagaaatgagaaagatgattagtaatcctgtattgcttcttgagacagcaattctctcgtaagtggaaacttaggcaagcatcagtgatgagaaatagatacattttactctttacttcatggttgagaagtgcctgtaattcacctttcaaataagaggcaacatgtatagcataatcccacagtattatgaaattttggaggtgaaagggaccttgatgtatcggtaagctattgctctataacaagccattcccaaaactcagtggtttaaaacatttattattgttcaagcatctacagattagctaagggtaggctgagctcatctggggtgattctgctccatgtgtttctcattctccataaaccacaaacaaaataataataataataataatagtatttttttaagttctcacttgttgaaggcttactatgtgctaaaagcactttaaaatgttatctcctttacttctcacaaaaacattatgaggtaggtactactaatatcctaatttcacagatgaggaaacaaagaaggaatttccccaagctcaagaagctactgtatggtgaacctggagcacacagatgaaggtctacctgacactaaactttatgttcttaatcattctgttatattctgtttcatgaaatttactattccattttcagagagttctaaccactaagaagttattcttatattcagtgaaatgattttctctataacttttaatcactgatcttaatttggcccttgagtacatacaggataaagataataatcataaattaaatgatatagtaaaagtgcctgacaaacagaatgtgttccacaaaaattaatctaagtcagccccacaataggcataacagtcgttaataaaatgttcaaccgggcagggccagaattatttgcagttttacccagttggcacttatcctattatacagaaaactatccaacctaggataaatacaatgtttaagtccagatatactgtgtctataacatttcctttatctatcagcctagtaatcttgtcaaaaaggaaatgagccctagattgaataagcaacagacaattagaatttagagggtagagaggaggtaagggaacattaaataatgctttttaaaattaatcagcatatattttattaataagcaagcaggcaaaacctagtaaatgttgactttctttctatttggaaaaaatttaatttgttcaaaggtaaacttttgtttatattataggtttacctaagctgatgagagaactgagtacataatacctattgaggataataaacttgttaaaagatgattttcaaaatgacaaaatacaaatattaaaagagcatatgtgaaaatttttatttaactcattaattaatgaaggaccctgtaagatattacaagctattcaaaaaagaatagaaacagtcatatgtaggcaagcaggaatgttgaagtaaatgtgctaatatgtgcaaattaatagatcctataggtactaaattgtaatgtttggaatcatcttttctacagagaggaaatcaattatatctctatgataaaattcattagcatgtctatggaaaagaataatttgcattttactgtcagtcaattttttacaacttcctgagttgtaaaatagctcagtcaagggcagtccaaagcacaggttccaacagaatcagataaccttaccttggagagtaagccagacagtgtcagacgttccagaacacccagaattgtgcccattcaaaattcttcactagtcttcctgacaaagtttctagaagaacatcaaggagaaaaactgggggaagtgctgattacatgaaaatgtacactggttgaaacgttttacaattttttaaaaacatattatttgagactctttgagaaaaaagataatcccggaaaatcatgaaattatttttttttaatttttttgtcacatccttcaaataaactgttaatcatgatatacaaggtcagatggaaattgaaaaaaggaaaaattaacgttttttaatataccctcccatttgtctgccaaaattgtatttaaaagtagtgttatataattaatgatattttatattttcagatgattgctaacaagccaaagaaaaaaatttccctgatcgtatttggaattaaaaaaatcattgattgaatgaactagtaatattttatttagcatttccttgtatttagagtggtaagaatttctatgtcagctctgtcctctgcattgacaaatcagaaggtcctgaatcctctttactctgttatgagatcataaaaaagaaattaaaagtcaattgctctccactgaaaatcctagaattgagaatcaaggaataatcttctcttccaaccaaagtccctgtgtgactaaagatcagtgtaattttaaaatgtggcaacttgtatattaaaatgtcatatagaatttttaaaaatcttttattgagattcaaaaatagacaaagaaaatataataatggctaataagcacatagaaagatgttcaacatcactggttattagggaaatgcaaatcaaaatcacaataagacactactttacatccatcaaaatggctattgtttcttaaaaattgaacacactaggcattagtgagtgtcttacttcgttttgtgctgctgtaataaaataccacagactggataatttataaagaacagaaatttattctctcacagttctggaggctgagcagttcatgatcaagggactggcaagttaagaactggtctctctgcttccaagatagtgcctggaatgctgagttctctggagagaagaaacgtggtttcctcaactgacaaacaggcaggagagagagagaacctactcctgcaggcctgttttatagcagcattaatccattcataagggtggagcctcatgacttaaacacctcccatcatgccctatctcccaacactgttgccttggagattaagtttcaacatgagttttggagtggacgaaaacatttaaaccatagcaataaggatgtagaaaaattagaaccatcccatattgctggtaagaatgtaaaatggtgcagccactatggaaaatagtatggcagctcctcaaaaagttaaacatagaattaccacatgatctagcattctatttctaggtatatacctaaaataattaaaagtaggggctcaaacagatgcttgtacagcaatgttcacagcagcattattcacttgtagaatttaagacactctaccccaaaatacttatttaagctgaaagaatttgagaaaacagcagaatcaggaaggtcaccctcactttactccacccttcttttctgaagcaggtcataaaacttaggcaggattttctgaccttcccttgaagcaggtcatagcaccctcatgtgagaggtgccctctctaatacctggataaagcagccaaagacagagacacgaataatctgaacaggcaggccttgctaagtttccccaaattcattactggtagattacacccactatgtccaagtctacttctccacgtctatacatttattcatcaaacttggcataaaagtacacatgtttaatctgcttctttgggtcttcattgccttatgcaggctcccatgtcacataaaacttatattgaataaattcatatgcttttctcttgttgatctgcatttcagccatgaacctgggataagtgaggaaatacttctcttcccctatatcgcagtaggcaacaggtagaaacaacccaaatgtccatcaacaaatgaatggataaactaaatgtggcatatacatataatgaaatattattcagccttaaaaaggaatgaaattttgttacatgctacaacatggatgaaccttgaaaacattgtgttaagtgaaataagccagactcaaagggacaaatattgtgtaatttcacttatatgaagtacctaaaatagtcaaattcatagagacagaaagtagaatagaagttttcagggactgagaggaatagggatagggagttattgattaatggtcatagtgtttctgtctgggatgatgaaagagttttggaaatggagagtggtaatggttgcacaacaatgtaaatgtacataatgccactgaactgtacacttaaaaaaggttaaaatgataaattttatgttatgtatatgttatcgcaatgaggaaaaaaatcactagttggaagtcaagaatgttttaaagctttttcagagctccaagtgttacaggaaagggatcccgatccagatgccaagagagggttcttggatctcaggcaagaaataattcagggcgagtccatagagtaaagtgaaagcaagttttattaagaaagtagaggaataaaagaatggctactccatagacagagcagccccatggctgctggttgcccatttttatgattatttcttgatggtatgctaaacaaagagtggattattcatgcctcccttttttagaccatacagggtaactttcagatgttgccatggtatttgtaaattgtcatggtgctggtgggagtatagcagtgaggacaaccagaggtcactctcattgccatcttggttttggtgggtttttgtgggttttggtgggcttctttactgcaacctgttttatcagcaaggtttttatgacctcaatcctgtgccatcctcctatcttatcctgcgacttagaatgccgtagccatctgggaatgcagtgatgttgcgggaagtcagggaccccgaacagagggaccggctgaagccatggcagaagaacatggattgtgaagatttcatggacatttattagttccccaaattaatacttttataatttcttttgcctgtctttactgcagtcgctgaacataaattgtgaagatttcatggacacttatcacttccccagtcaataccctgtgatttcctatgcttgtctttacttcaatcacttaatcctgtcagctgaggcggatgtatgtagcctcaggaccctgtgataattgcgttaactgcacaaattgtagagcatgtgtgtttgaacaatatgaaatctgggcaccttgaaaaaagaacagggtaacagcaatgttcagagaataagagagataaccttaaattctcaccaccggtgagccaggcggaacagagccatatttctcttctttcaaaagcaaatgggagaaatatcgctgaattctttttctcagcaaggagcatccctgagaaagagaatgcgcccctgagggtgggcctctaaaatggcccccttgggtgtggccatcttctgtggtcgagctgtagggatgaaataagtcccagtctcccatagcgctcccaggcttattaggacgaggaaattcccacctaataaattttggtcagactggttgctctcaaaccatgtctcctgataagatgttatcaatgacaatggtgcccgaaacttcattagcaattttaatttcgccccagtcctgtggtcctgtgatctcgccctgcctccatttgccttgtgatattctattaccttgtgaagcatgtgatctctgtgacccacaccctattcatacactccctcccctttgaaaatcactaataaaacttgctggttttacagctcagggggcatcatggaacctaccgacatgtgatgtctcccctggatgcccagctttaaaatttctctcttttgtactctgtccctttatttctcaaaccggccgacacttagggaaaatagaaaagaacctacgtgaaatattgggggtgaattttgcccaatatctggctgaattttctgcgatacagcacagtatgtttcagccttattttacccagctcctattcaagatggagtttctctggttcacatgcctctgacacaagcactccaaactggtttccatttcaattttctctcattattttatttaattaataggcatttattaagagctttttttgctaaacactgtactaggcacagcaaaaaaattcaaaataataagatctttttttctctgaaatccatcatttagctcttcctaaactgggatttaaggaaagctgtttctttttttatggttttgtttctttttgttgggatgggttgttcataggtgtgctgaaaggaaaaacatttttcctctttgcaaataaatgagtgtttaattattaaacaaagttaaatggatttttttaactgtgaagacttcccataacctttaaaatgctaatgtattttttgaatctacaagactggatttagtaagtggcattcctaagcttatttaatcaagaattctttgtctctcagagcccaattaattaacatctccctttgtactgtggctgcagaagttgagctatgtggtggattctttttatactgggctaaatgtattatacaatctgtaattatggtataaatgtgtattttgttttatccctatgtgttctagaatgtgagtatgattttaaaagcatttttaaatttaaaaatgtagattaaacattagagacaataaagtcattataatttcttacctcaatttaccattttttttctcctttagatagcatttattattctggaaaaagggatattcttgttttggggagaaggatttgctaatggagattttgcagaaaactgtgatgctgactgtgatatgtaacttgtgagcatttttaataagaagaaacatagaatgccagtccttattcttttcttgataaaagaattcctaccgaattgtatccaatcaatagctttaaggacttgtgattttctctctgcctttgaataattgcaaatttttgatgctaattcttactccataagtttaaacgtccctatttttccgattactaaacttatactttaagtcacaacctacaataatatgcagacaatccctgacttacgatggtttgacttatgattttttgacattattatgatgtgaaagtgagatgcattcagtagaaatactgttgtatccatacaaccattctgtttttcacttttagtatacagtattcagtaaattatgtgagacattaaatcctgtattataaaacaggctttgtgttagatgattttgcccaactgtaaactaaagtaagtgttctgcacatgtttaaggtaggctgggctacattgtgatgtttggtaggttagatataataatgcatttttgccttacaatattttcaactgttgaagatttattgggacatatcccacattgtatgaacatctgtattcctgcatcctccatatattccttttttttttttttgagatggagtctcactctgttgcccaggctggagtgcagtggcatgatcttggctcactgcaacctccacctcccctgttcaaatgattctctttcctcagcctcccaagtagctggaattacagatgtgcaccatcacacctggctaatttttgtatttttagtagagacggggttttgccatgttggccaggctggtctcgaactcccaacctcaggtgatccactgacctcagcctcccaaggtgttgggattacaggtgtgagccaccgtacccagccctacatatattcttaattttgtgcttttccttcaaaattaaacacagtagaacaatttaagtaaagctaaagatatagcaaatttgagcctatttcatgattttaatattggtctcagttatattttcattagtagtatcattttcatgtgtctaaagtatcacgtaaaatgcattagaatatttaagtaattgcacaggcattacaaaggaataaaaatgataaaattgccaagatcaaccagctggtcatcaggcagaagcaccccgtgatactgtgaaatacttggttattggtgaaggatgaaagtctagattcagcataggaaagagaattgttatgtgtatatgtacactggatggaggtgctagttgtttgcaagtcaagcattctaaagcctaggactgcctgaactagagcaacaaataacaaagtatcagagttcaaggatttattctgaccggatgattttggaaaccttcctggacaacacattgggctgggttctgaagaataaataggattcccacaaatttttccagactgaggagagaggctaagatgtgcaaatagagggtctatctaggagtgtaattttggagtgcaaagtatagagtgcgtaagggatagtgaagtaaattaaactagaaaaaattattgaggccagatcattagtactaacaaatttagactttattctctaagtaactgagagctgaggaaagtttttgagcagagggcatggtttgtgtttcagaacaattactctggtgggcccatagggagcagatgagactggaatgaggcagggaagctaattaggatgttataattgtctagcaagaaaagatgaagacttgattgactgtcaaggaaacaataaataggagacattttgaaaaaattaactgagcttggtgaataaatcaattagaaatccctttggatgcaagaaacagaatttcttttgaacagagttgaacatacagagccttactttattcaagtagatgcagatagatgcagatagatcaagtagatgcagatgaatctactttattcaagtagattcaagtagatgctgctggtgttggtgcagaggcttgacaatatcagtgacatcatttctcagctctcttggtttttctttcatgttgttgaacaaccgtctcctccacggcctactttaggtgagtgattggctggagctgagtcacatggcagcctctagctacagtagaggctaggaaggtggggaatagtagtgtcttgatcacctgagactgatcatggtctgtaactatgggctgatcacactgtccttttgaaaaaacattattagcatggagtacatgggcattggatattaggtgaacaattaatagagtttgctacagtaactaattggctatcggagtgcagtgggttgaatagtgtccttccaaaattcctgtccacccagaacattagaacactacattatttaaaaatgtgtgttgcagatacaaataaagtaaggatcatggtgagatcatactggattagggtggaacataaatccaaaaagactgtcttataattaccaaagataaacaaagacagatactattaaagtgataaagacaggttttgttttgttttgttttttttgtctttttttttttgagacagagttttgttcttgttgcccaggctggagtgcaatggtgcgatctcggctcactgcaacctctgcctcccaggttcaagtgattctcctgcctcagcctcccaagtagctgggattgcaggcatgcaccaccacacttggctaattttgtatttttagtagagatggggtttctccatttggtcatgctggctggtctagaactcctgacctcaggtgatccacccacctcaccctcccaaagtgctgggattacaggcatgagccaccgcaccctgcctaaagacaggttttaattagtaattaactattgcaaaagggaagagaatccagtataaactgaactcaactttgatttgttttaaagagagaatgagagaataggaaaggggaacggtagggaccagagtcagggagtggaaatttacaaaaagtgagaagacgagtgtcttagtctgttttgtgttgctataacaaaatatcacagaccaggtaatttataaagaaaagaaatttatttagctcatggtcctggaggtgaaaagtccaaaagcatggtgccagcatctggcaagggccttcatgctgaatgataacatggtagaaagtatcacatggtgaaagaaagcaggagagtttgtgtacaacttcaagccgtttaaataatcaacattattccattagtgaaggtggagtatcaatgactaaaataacccccatatggccccaactcccaaaactgttgtattggtattaagtttccaacacatgcactttgggggacacatctaaaccacagcagtgagttggcccatgtaaaatcatctgagtttgctaactggtactggtcaaagttaggctcctaccctcccaaagaggcaaaaagacaggggccctatcttcaggtgttggccagaacaaacaatatgttttttgggcagccttgagctttcccaagcaggaacttaaagagactggagtggtgatactaaggatgggaacttgagctgtcagaaactatactaatgtttgttcagacttttaatgagaatggaggaggaggccaggcatgaaggctcacacctgtaatcccagcactttgggaggccaaggtggatggattgcttgagcccaagagtttgagaccagcatgggcaacatggtgaaaccccatctctaagaaaaatataaaaattagctgggtgtgatgacctgtacctgcggtcccagctactcaggaagctgagaggagaggatcacttgaacctgggagggcagaggttgcagtgagctgagatcgcaccactgcaatccagcctggataccagagtgagacaccatctccaaaaaaaaaaaaaaaaaaaaaaagacagagagagagaaagagagaatggaggaatggaggagggacattgtcgtaagagacaaagttaagaaggctatgtgaaaatgaaggcagagattggagttatgctgctacaaaccaagaaatgtcagaagtcatcagaagctggaagagacaaggaaggatcctcctctagaaactttggaaggagtgtggctctggtgacaccttgatttctaatttctggcctcctgaactgtaagagaataaatttctgctattttaagccactcagcttatgataatttgttatagaagccctaagaatctactacatggggtgaaggagagggggaggtatctaaacataatagcctggaagaggatattgacagggctcagaacatgataccccaaagtatggcgccctgggatgctgagtactttgagctgaaggacattggaagggcctcagaagcaagtctctctaaacatttctcactctcctgtctctcatccttttttctcctccaggtgagtcatagaaatcagaatccctcttccccaaggtgggtcatagaaattagaacccctctcccacaaaacaagccataaaacctggaaagataacaagggccttgctgcattctgggaggaaggaattctacatggagagaccaagaagaatctaaacagacaggtgttactgagtattccccttcagtctattaccattccatcatacccttttggccaataacatttctacatggctgtccattcttcatagaatccaagcataaaaacaattttttccttggtctttgggtcttcatttctaaaggctcctgtgtcaagtaaaaccttttttttttctttgagacggagcttcttgttgcccgggctggagtgcaatggcacgatctcagctcactgcaaactctgcctcccgggttcaagtgattctcctgcctcagcctcccaagtagctgggattacaggtatgcaccaccacacctggctaattttgtatttttagtcaagatggggtttctccacgttggtcaggctggtctcgaactcccgacctcaggtgatccacctgcctcagcctcccaaagtgctgggattacaagtatgagccaccacgcctggaccataaaactttgattaaataagtttgttatccttttatcttgttaatctgtcttttgttataggagtgtcagccatgactcttacaatgggtgagggaaggtatcacacttttctgctcctacaatattaataccatgagtagaacatgttgtctgtgagacatttaggaaatattcatatgaggatgttaggcaagaattgggattatggatttagaattgaggaatgaagtaaggaataaagaaactgcagggaaaagaaaaataaacttcaccaagcaatagttaataacataagataaagtataagttagtatttaattgaccacttgaacacaattctttccctcttatttccaaattctattcctgtgtagcaggaatagaagaaaaagccagcatcattgagggttaatgaatttggcctataagggctaataaatatctacaaacaaactttggaaagagtcattaacaggactttgatttcccatttgccttagtagcaaatttagcagcactttttaaactgcctcatggatgactatctccattagtttttttttttaataagaaaacagtaaacactatgcatggtagtgttgtatcctcagtgcttctaatataatttcttcatatttctagtattacatttatctcactgcattctaattattgttctgtctcccctgctagactgggagcttcttaaaggtaatgcaccatttttattcatatttgtatttcaattacttgacacaatattcagcacttaagcaatttatgtaataactactggatggattgtaataacaataatagttaaggatgcagatctagagctagtttagttgggataaatcctggctttactgcttatttgttttgtgaccttgtgaaattactaaacctctctgtgccccagttttttcatcacaatgtgaaataataataagacctttgtcttggtcaatttgggctgttctaacaaaaatattatgtaccgactggcttaaacaacaaacatctgtttttcgtagttctgtggctgggaagtccaagatcaaggtgccagcatattcagtatatagtgagggctctttttctggttagcagacagcctccttctttctgtatcctcatatggctgagagaaagaaaggtcatctctctggtgtctcttctcataagggcactaatcccgtagtgaaagctccaccctcatgacctaattaccttccagaggatccatcttcaaatatcatcacattaaaattagggttttagcatttgaattttgaggacatacaaacattcagtccatagcaaacctcctcaaacaattgttgtgataattaaataaattaatctatttaaagcacttagaagattgctagacatacagtaagtgctcaatacacacatatatgttattgaattattaaatagaataatgcctctagcattcattactgctgttcaattttgtcttcattgttattttattttatgtcttcctgtgtaattcccttgtggcaatttcataattgctatagctttttttgtttgaccctccacatctcatgttcaaatttgatccccattgttggaggtagggcctaatgaaagctgtttgggtcatgggggtggatccctcacaaatatcttggtaccgtcctctggtaatgagtgagttttaactctattagctcccatgagagctggttgttaaaaagagcctggcacctccccctgcattctctcttgcttcctctctcaccatatgatctctacacatgccagctcccctttgccttccaccatgagtggaggcagcttgaagccttcatcagaaacagatgctggagccatgctttctatacagcctgaagaaccatgagccagtttatttataaattacccagcctcaggtattcctttatagcaacataaatgaactaagacaataatctacaaattcatttacttgattactggcaaattactcccatgagagtgagaacgttttctgtgaagttctctacccattccatgcataacacagcatctacacacagcagagattagtaacagtttgttaaaggagtaaattgatccacttttaccttctgtaaagaccaatttaaatctttcttatattgctaacactgaacctcctggttcaaagttaaaaaaaagataaggcgcagtaacaacagagtttcaggaagatctgggaaagaaagatttcctattattttttatttatttatttatttttgagacagattctcactctgttgcccaggctacagtgcagtggcataatctcggctcactgcaacctctgcctcccggattcaagcgattcttccacctcagcctctcgagtagctgggactacaggcacgtgccaccacacctggctaatttttgtattttttagtagagacggggtttcaccatatcggacaggctggtctcctgaccttattatccacccacctcagcctcccaaagtgctgggattactgacgtgaccccctgcacctggcctatttcctattaattctaggactaactacctgaaaataggataataccttgcatcactacattaatatactcatttttattgtcccctgtttctgagagtaacaacttcaaatctcctaccttctttcctgactttgacttcctataccgtcagctcttcagggcagtcttgacattggaataataataataacatcatgttcttagacaaagactgatccactctcagaaatcaggttaaaggttattttatgtgattcttttttgttttaatatgatttataaagagggagagtcaatgttgaagaatcagctattttaaaattgatccctctactggagtactaaaaagtatttgtgaaatgaacacgaataatctttataacattaaacattgcaaaacccaaatgcaaaatagtcctatttaacataaagtctttcatattgttctgttctgccatccttctatacatttgcccagacaggacagcaacaaggaaagaatatgtaaacactaatcatttctaacttgccatctgtgacagttcactgtgctgaaattagaaaggatggaatcacttttccatttccttaaggtcaccaaggacagacaagctcaggacatactgtatttgtcagaagaaaaagagatgactggtgaggtggcagtgacaaatctgttctaggttcagctcattttactgaagaatgtgtgtccccttctgacatttatcaaaagaaattcaattttataaaaagaaggatgtcaaataatagtacattgctaacactcattttgttgctgtcagaagggcagatgggggcaaaaagggaaaagggtggatggaagagaaagttattccagcaagaaacaaacaaagtcatgctaataatacacttataggcttgaatatatttctgattaaaacacctatttttgagatccatcttagtgcctggctcacactttagaataccagttttcacttcttccagacagaaggaacgacacaaagcaggttgatttgtgggttttgtgtttgtttttggttttgtattttgttattgtttgagtgccattctgctgcaccaggaaggaaagaaagctaatgaaacctggtaaaaccccaggtacaatgacatgcaccctgtgggcatgcaatcaatagttcttatggtgatgatgatgtttttctctggcagaaaagggtattttgggtcaaaaaataacccaaaagttgtgacagaggtaacggaaaaatagaagtcagattaaaatcaaaggaagaaattctaacccaaaagttgtgacagaggtaacggaaaaatagaagtcagattaaaatcaaaggaagaaattctatcaggagactaataatgaagctgacaatatactgtaacaagtaatagtgttttaccatactgcataaaaatattggattaagatacaaattaaatctctttctcagtgagggttttctgcagaacataaacaattaagctgctttctggagaagacaggaaacttgattaacagatccaaaaagacagcatagggaagatgggtttaacactaggaggtgaaacaccaactgttatccaaattgacttttccagaaacgttggataatttcaatcaaggactgaaatatactcttttctttttaagcgtcagtgttctctggacttaaacaagtcaaaggaggttcttattaaataaatgctactggtgcatatgttccagtcacagtctcctgaggtgagtatggagacactacagaaaattgaaccatgaaatagggttttgtgtctctataccaaaatttcaaatatctggaggtgtcctagctcatggtggctaagcaggcagcttgtgggagtacaggaggctacaggagacgccaggagtaaaacgacctattctgagtcctgtagtctctgtaaggtgcctatttgatgcaatctaagacagtcttatttagaatagggacccttagaagctgctaatataagtcaaagaaacaaatacttctgtgcatttttccccacaaataagggattgtcctaaacctctaagcattaaaccaggaatccagtaaaaaccaggcttattgtactccaatccccaactcacgtactgtcttagagattttcagacacaaggtgctaaaagttatatagcatattttaaaatttatctgttatcaagtgcctttcattgaacaaaaaaaaaatcaaattcaatagtacataaacaagatctttctgctccttcttggaagatttttaggagaattaaagtcatagagacaatcatctacatgccattaatattgtcatcttcacatattattaccagtattattaccagcacagctttcaaggtttgaaattttgcattgggctggccttaacatttggacaaatcctttttaaatatagggaataaataataaatttaaaaataaaatacgttaatatgcaattttttttttttgagactgagtctcacactgtcacctgggctggtgtgcagtggcaccatcttgacttactgcaacctccgcctcccaggttcaagcaattctcttgcctcagcctcccaagtagctggattgcaggtgcctgccaccacgcccggctaattttttgtattttttagtagagatggggtttcaccatgttggccaggctagtcttgaacccctgaccttgtgattctcctgcctcggactcccaaagtgctagaattacaggcgtgagacactgtgaccagccaatatgcaaaattttaacgctttaaattagaggtcagcaaacttttttcattaacagagagtaaaatatgttctgctttccattccatacactctcacacaactaatcaactctgctgttgcagtacaaaagcagccatagacaatacaaaaacaaataggggtggctgtgttccgataaaattttctttacaggcctctgcctctgcctctgcctctgcctctgcctctccctctcccctctcccctctcccctctcccctctcccctctcccctctccctctcggtctccctctccctctctttccacggtctccctctgatgccgagccgaagctggactgtactgctgccatctcggctcactgcagcctccctgcctgattctcctgcctcagcctgccgagtgcctgcgattgcgggcgcgcgccaccacgcctgactggttttcgtacttttttggtggagacggggtttcgctgtgttggccgggctggtctccagctcctagccgtgggtggtccgccagccttggcctcccagggtgccgggattgcagacggagtctggttcgctcggtgctcggtggtgcccaggctggagtgcagtggcgtggtctcggctcgctgcagcctccatctcccggccgcctgccttggccgcccagagtgccgagattgcagcctctgcccggcctccaccccgtctgggaggtggggagcgtctctgcctggccgcccatcgtctgggacgtggggagcccctctgcctggctgcccagtctggagggtggggagcatctctgcccggccgccatcccgtctgggaggtggggagcgcctcttcccggcagccatcccatctgggaggtggggagcgtctctgcccggccgcccatcgtctgagatgtggggagcgcctctgccccgccgccccgtctgggatgtgaggagcgcctctgcccggctgcgaccccgtctgggaggtggggagcgtctctgcccagccgccccgtctgagaggtgaggggaccctccgcccggcagccgccccgtctgagaggtgaggagtccctctgcccggcagccaccccgtctgggaagtgaggagtgtctccgcccggcagccgccccgtccaggagggaggtggggggtcagccccccgcccagccagccgccccatccgggagggaggtgggggggtcagccccacgtccgggagggaggtggggggggtcagccccccgcccggccagccgccccgtctgggagggaggtggggtcagccccccgcccggccagccgccccgtccgggaggtgaggggcgcctctgcccagccgcccctactgggaagtgaggagcccctctgccgggccagccaccccgtccgggagggaggtggggggctcagccccccgcccggccagccgaccagtccgggagggaagtggggggatcagcaccccgcccggccagccgccccgtccgggagggaggtgggggggtcagccccccgcccggccagccgccccgtccgggaggtgaggggcgcctctgcccggccacccctactaggaagtgaggagcccctctgcccagccaccacctcgtctgggaggtgtacccaacagctcattgagaacgggccgggatgacaatggcggctttgtggaatagaaaggggggaaaggtggggaaaagattgagaaatcggatggttgccgtgtctgtgtagaaagaagtagacatgggagacttttcattttgttctgtactaagataaattcttctgccttgggatcctgttgatcggtgaccttacccccaaccctgtgctctctgaaacatgtgctgtgtccactcagggttaaatggattaagggcggtgcaagatgtgctttgttaaacagatgcttgaaggcagcatgctcgttaagaatcatcaccactccctaatctcaagtacccagggacacaaacactgcggaaggccgcagggtcctctgcctaggaaaaccagagacctttgttcacttgtttatctgccaaccttccctccactattgtcctatgaccctgccaaatccccctctgcgagaaacacccaagaatgatcaataaaaaaaataaaaattaaaaaaaaaaagttaaaaaaaaaaaattttctttacaataacagcataaaactttggcttcaggtcacagtttgttgacccctacttcatattatcatgtcccccccacccccatttctttcattcaccttctatcacagagtcacagctttgcactcacagtgtagccaagttgtagctacagaccaaacattgtaaagaaatacctccggggaacttgagaataagttaaaacttgtgctaaatcatgagtgaaatatacattgggaaacacagttaacaacccattccccaacctgcttactgggccatctttctaaaaatgcaaatttgatcctgcagctccctagcttaaaaggcttcacctgcaacagaaagccctggctttttagtttttcaccataggcttatttatggctggtcctgctttcttcccctccttatttcttctcatcccttccttctcacattctatgcttcagctacatagaaggacttataatttccagaatgatacctgctcccttgcctttcaacccatacacttatttttttttttcttcttagatggagtttcactcctgtcgcccaggctggagtgcaatggtgcgatctcggctcaccacaacctccatctcccatgttcaagcaattgtccttcctcagcctcctgagtagctgggattacaggtacccgccaccacacctggctaatttttgtagttttagtagagaaggggtctcactatgttggccaggctggtctcgaactcctgatcttagggaatctgcctgccttggcctcccaaagtgctgggattacacgtgtgagccaccatgcccagccaacccatacacttgttactcattctccttgaagcactcttctccacacatccttggccttgccaactccttgaaggctgagcttaggtgtcttaaggacttcaactcccagacacttctgtatacctgcgttataatatttttactgctggctgtgtgtggttgctcacacccgtaatcccagcacttcgggaggccaaggcaagaggattgcttgaagccaggcattcaagacagcctgggcaacatagtgagaccccatctctaccaaaaaattagaacttagctgggcatgtggtacatgcctgtactgccagctacttgggaggctaacatggtagaatcgcttgaacccaggatgtcaaggctgcagtgactcgtgattgcaccactgcactccagcctgggtgacagagcaagatcttgtctaataataataataataatattcttaccactatctacagatgattactggtgcagataaatttaaaattcttcttggccatgtgtggtggctcacacctgtaatctcagcactttgggaggccgaggtgggcggattgcttgagctcaggagttcaagactagcctgggcaacatgattaaaccctgtctctaccaaaaatacaaaaacttagccgggcatggtggcacatgtctgtggtctcagctacctgagaggctgaagtaggagtattgcttgagccctgggtggtagtggggagactggaggttatagtgagctgagattgtactactgcactcctgactccagcctgggtgacagagtgagatttcatctcaaaaaatatataaaaaataaaaaatttaaaatccttgaaagctgaaactgcattttcttgtaagcacatgatatccctcttagggtcctgctcccccatcccctgagcatgggaataaagaaaaaatcttgactccctttaggggaaaattccaggcaccccactatccttgagaaataaataaataacccactaatcaataaggtaataataagcttaaacaatagccacccaagtaatctagagtcataaaatgtttggttccctataaaaactaaagataacatcttgacatatttccctgagttgtttttcagaaacctgtacccccacaagatggaaaatgctgaccactgtcacacagacctcaaataagggagagctaaggactgaactctaatcgttgtcccttgttctaaatgtcttcatgaggggcctggagagggtcatcatgcccatagatcaaaccttaacattcctttcttctgaccccaagtttttagacaaagcattgcttccctaaccaattgtaaatcaaataatctgtgaacctctctatgacttgtaagcccccacttccagatattctgccttttgaggcaaaaccaatgtgtaacctccatgtattgaattacatatgattttgcctgtaacttctgctttcctgaaatgtaccccttcctttaaagacccttgcttgtaagccgtgggagagtttgggtcttaagtgttagctgcccaattctccttgcttaatgccatgccataaatgcctcactttctctcactgcaaatcttggtgtcaatgtttgcctttgctgcaccaggtgggctgaccaaagttgggttggataacacatggtatctggtacattgagaataatccctaatgcttattaaatgaagccatcaattatttaatgtctttaataagcttttggcctttctacttcagaatataactttagttattcccagctatgggcaatttattttcttttgcatattgtctataaatgatacccaaagaactaataggaaaaaaaattattagtcagttaaacaggtaatttaatatcaaaccatagaggaggaaaaataattgtctctctacccttcagagttcgtagctgagactctgaaggttaacaggagaaaaataaataaaagatgaataacgtgtgtacctccagtatacatggaaggcatactcagcgaaatctgaaagagtaaaatctccaggctaaatctcaagagatctcaaaagggttgtttaaacttcaggcttataccatcctttgttgaaacaaaaagagaagtttattgggaaaggctgattatgggagataggaagagtacagtatacaagaacagtttgttatgcaaacttaagtcagtcccttctccattgattaagagtatcttggatttagtcattctcttcctggtactaagagagagagagacacccttacaaataacgattttctttatagacataaatttctcttacaaaagggtaccttctactctagttttcagagcttctcctgtgtctgctgtttcccaaaataattcaattcaaaaaattctatgtcaaagaggcttatttggggtggtgtattctggtcttttacagtcacactttgagatgacgtgttctgaacgccatcaatataaaaatcttcttaacttgatttaaaatttttttcaggttgaaattagacatatagctttatgttgtcattattgttttgtttctttagagtgttaacttaaaaggaagaagctgaggaaaattaatatatgtagagagtttctttgggccaagcttgcagattgcaacacaggagcacagattgaagttgccctgaatataattcaacaagcagtagttacaagtgaaaaaaagtagttaaaggcaaaaaggggagacacagagtgggctgatacaaagttgcttgtcaggaattctcattgtttcatggaaatgacgtggagtagtgattggctatacatttttggctatagtgtgtgggttatagtgtctggtgtggcattattagcttaatttatagctacttgtagcaatagcaagcagtttcaagagattaatatatagctcaaagtgggaaataggacattattgcagtctcattttaatgtctctttgggcctggtaagtactgtcttcttttttttctttttttttttttttcttttttgagacagggtctcactctgtcacccagactggagtgcaatggcaccatctcggctcactgcaacctctacctcccagcctcccaagtagctgggactataggcatgcactaccataccgtgctaaatttttgtatttttttgtagagatgaggtttccccatgttgctcaggctggccttgaactcctgagctcaagcgatctgcctgcctcagcctcccaaagtgctgggattacaggcatgggccatcgcaccaggccaggacctgataattaaaaggcctcagataaaagttcttttctcaagagacaatcttaggaccacttgctgcattatctatcagtattaataaagccactttacatttaccctataagtggaaatattttctcaactaatcacttaacagccaggttttatttgagaagcaattaaacatttatggggtctacagaagatatgaacaaatgctatataaagacatccctaataacagactataggaaaaaaattgtgctttaatgcattatccacatacagcatgtcactctgggttactagattttagcctttcatgatctttgcattttattgcatatttattttatgactctttgcaagttaaaagtgacaaagaccctccccttaggctcctttgaatcttctttttgactaactctcactcttggtctcatccttgccccacctagtctagttttagcaagaatcctcttgaatcaatatggcaaaaatcccctgcccttggcatgtgatcactattgatgactgattaggttcctcttacttcatcctctatatcttttcacagtgggctgccttcagcaagaatcctaagtcagtgtagccataatccccatagtcttgatgtttcctcttagtaattttctatcctctgatctccgccctttaccttggccataaatccccactttttcttgttgtattaagaatgggatttcattctatgctgagatctctttttccctattgcaataattcctgaataaaatttgcttttatcactttaactttctgtctggctgtggtttgctttgacaatagacatgcatattctgtcttacagagtggagttcaatcgacttcccatctcctatgggggaaaaaaaccagttttgcctctatttgtaattccatttctttactccatagaaatgtgtgactttggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaagaaatgtgtgcctttgaattttcctttcaaccaattataatatctacccgccttccttactgaatgagtaaaataaacattttaacacatgcttatttgtatgcccacatgacagtcatgatcttaccttttcttttttctttttttttttttttttttttgagacggagtctcgctctgtcgcccaggctggactgcagtggcgcaatctcagctcactgcaagctccgcctcccgggttcacgccattctcctgcctcagcctcccgagtagctgggactacaggcgcccgccaccacgcccagctaattttttgtatttttttagtagagacagggtttcaccgttttagccaggatggtctcgatctcctgacctcgtgatccgcccgcctcggcctcccaaagtgctgggattacaggcgtgagccaccgcgcccggctgatcttaccttttctagaaaattatcttttaacaattttggaagttccactgaaatgcccagtggatttacctaccaaagccaggtaacctttgcaggcagagaaatgcacttcatgggcagtgtaagcccaggtagatcttttcttggctcacagaattgaatccaagatggcaagaaaaccttgctcactctgtttttctcattctaattctcctctatactaattttacatttttggttttgggttgtttactgtcagtaagttagtccccgttgcaggaagtaatggttgggaattcacttttatgatctgattatttgatgatctctgtaaatgaattaatagttaacagagatctctgctaggtgagagatagcagagaatctagtgggttagtcttttctgtttatctgttttctattttgaactcttgcagaaaccaaattaatgttttaagaaatcaagttcagctgggtgcagtggctcacgcctgtaatgccagcactttgggaggccgagatgggagtatcgcctgaggtcaggaatttgagaccatcctggccaacatggtgaaaccccgtctctactaaaaatacaaaaaaaaaaaaaaaaaaaaatagccgggcatggtggcatgtgcctgtaatcccagctactggggaggctgatgcaggagaatagcttgaacctgggaggcagcggttgcaacgagtggagattgggccactgtactccagcctgggcgacaagaacgaaactctgtttcaaaaaaaaagaaaagaattcaagttcacataatttagataaatttttggcaaatgatacaagcttaatattattggtttaacaaaaaatacctatgtcttctttgatttactagagaatgagaataatataatgtaggtgcttatgctacttgggtatgtttttcctaatcttaaacaggttaatagattgaataagcttgccttacttctacttcatgtttaagatgtttataaatataaatttatatttactcatactgaatcattattgtgataaactttatttcaacaataattatgttttgtgtatgtcagcttcaggacaattttcaaggtctgtaagtaacttaaaaccttggaccaatggtaagttgagttaattaatggagaatcattagatagacagacagtatttcaagatagtaagatagaatactcattactactcataatttcaagtttatatccctttacttcttattttcataagactatctctttgggtctgtactgaatgtgctgctcatttctgccactttggggagtgtataaaaatgatatgtgtggctaaggcaagctgtattgtgtgtattcacaagttctgctagtctgctgcaaaatgctggtgtgacagtgaacaattatccactctccaggtctctctgtgaaatagaagtgtgttactttggctaaaagttataatggatatgtggctttggctatatttaggagccatagtttctgacaaatacagctgtgtatttccattttttgaggaaaagagtaattttgtcccaaaggagtggagtatttttggtctccaaacccccttgtgctcttcaagcttattgagaaccacaaagaaatagaactgcctttgagatttcccaaaggactcccataaagtcacaaagatttgttcttttgccttctaaaaaggcagatgttaaaaataattaggctcatgtaacattattagggctaaaaacaaaaaacttatactgtaaaatatggtgccttgacaagtcttttttttttttttttttttttttggagacaaggtccactctatcacccaggctggagggcagtggcatgatctcagctcactgcagcctgacctgccaggctcaagagatcctcccactccagcctcccaagtagctgggaccataggcacatgccaccatgcccagctaatttttgtatttttttgtagagatggggttttgccatgttgcccaggctgatcttgaactctgagctcaagcatcttcccaacttggcctcccaaagtgctgggattataggcatgacccaccatgcccagcctcttgacatgctttgaactaaaaaaccagcctcagaaacaaagtctctctgactttctcccaccctcaccctctgtcccccaatctcagtcctctgcctctctgaaagcacagggagaggctttctctcaagttcatttatgggactgcaggaagttcctccagacagaatgcaattgtcttaggtcttctccctgtaatctcagaaaacaaagaaggttaacttgctggaatgatgactagattgggcaccatacccaaagcccagacagactttctcccaggctattgtttgttcttctcccctaaaaatcatttacttttcctctaaaattgcatacatcccccactccttctcccctatgaagagagtatttaaacttcaaccatctggcccttctttgagtatcacactttgtgtgactcccgtgcacttgcacgttaataaatttttatgccttttctactgttgatctgtctattgtcattttgttttataggctcaaattcttgaactcccagggagtggaagaaaactttctttcatccctacagtgtgttattattaatgagttacatagaaagagttgtcgaattaaaaaagatacttatgcttccctagattaaatttatatgggtaaaatcatcacaaacattttacaaactaaaatccatatgtgaagttcctagagatttgtcaatgccttcactgcctatgacatggttctatttatcagagttcaggtgtagctctgcctgataatagacaatagacaatagtatacagtagacagtcataatttcagttatttttggcatgccagctttgttaagatataattcacacacaacacaatttaaccatttaaactatacaattcagccaggcatggtggctcatgcctgcaatcccagcactttgggaggctgaggcgggaggattgcttgagatcaggagtttgacatcagcctaggcaatatagggagacctcctctctacaaaaaatttttaaaaatcagccaggcatagtggtacatgcctatagccccagctacttgggaggctgatagggggattgcctgagcctgggagatcaaggctgcaagtgagccatgatcatgctactgcactccagcctgggagacaaatcaaggctttgtctcaaaaatactaataataataataataataattaggtgtataattcaatggttcttagtatattcagttatgcaaccatcaccacaatcaattttagaacatattcttcacttcaaaaagaaatcctgtaaccattaacagtcattctgcatttccccactaaccaccaacccagaattgcctatttgggacatttcgtatagatggaatcatgccatatgtgatcttttatagctggcttctttcccttagcataacattttaaggttcatttatattttaccatgtatcattacttcattccttgttatttgcaaatattattccattgtacaaatataactttttatttatccactcatcaattgataggcatttagattgttttcactctttggttattatgaatgctgatgctataaaaattcatttacaagtttttgtgtaaacatgttttcatttctcttgggtatatacttagaagtagattttctaggtcatatggtaattctatgtttaatcatttttatggcaaccctatgtttaactatcagattgttttccaaagtggctgccccatttttcagtccactagcagtgtatgagggtttcaatatctttataccttaaacaacacttggccaggcacagtggctcatgcctgtaatcccagcactttgggaggctgaggcaggtggatctcttgagcacaggagtttgagaccagcctgggcaacatggcgaaaccacatttctactaaaagtacaaaaagctagccaggtgtggtgtcatgcgcctggagtcccagttacctgggaggctgaggtgggagggtcacctgagctcaggacgttgagctgtgatcacagcactgcactctagcctggatgacagaatgagaccctgtctcaaaaaaaccgaaaaccaaaaaccactacaaccaataacaaaaacacttattatctgtctatttgattacagcatcttaatgggtatgaagtgctatcctatcaccttgagatttacttgttttcttttctccctaatggctaatgatgttaaacatcttttcatgtgtttattggccatttatatatcttctttagagaaatgttaattcgaatactttgcccattttgtacttgggttattttattgagttgtaagacttctttatgtatactaggtacaagttccttataagatgtatgagttgcaaatattttctccagttcgtggattgtctcttcacttttttgatggtgtcctttgaagcatgactgtggtgaagtccacaattttctaatttttcttttgtcaattgtgtttttggtgttacatctagaaaggctttgcctaacccaaggtcacaaagatttataccctacatttcattccaagagttttattgttttagctcttacatttaggactctgatccatttttagttaatttttgtgtatggtttgaggaagaagttcatctttattcttttgcatgtgcatatccagttgtcatatttgagaatgatgctcattttaccaaatatgaccatgttcctataagtaactaaggttgtaaacttcatgaaaccaatgcttgcaatgtcctgttgggtaagctcacctggtacctggcttataggtttccctgccttccaggtaggtttagaaggtcactttctggcaggtccaaaagtcttagcatctttgggggacctggagaagaaagcaatttgtctcatttataggaaatgcaaggaaatctgatgatgagttcttaccttggtttcttagcctcatgatagtaaataatgagaggttttaaaagcccattccgagattgcttataaaaacttccagcaaagcaaatttaaggtctctatggtaaaggaattttcttgctacacctgtatatataatcaggccagatctgtcaatgttgagagaggaggaagggagaaaccagttaggcagcagttagggtgggtcctctgttgaattctttcaaacaaaagaacagcctgaaaaatcaagctgcaggcacagataagggaacttgcacaggggcttgcctaagacatacccaccgctgcacagataagaaaggctacacaggtgacttgcccaaacattcccgcaatggaaaatttcgtcctctgacacatgcacagtgaagggaacaaagcaatatggagtaattcaagctaaaggcctgcatgcacactaggtggatgcaatggggctaccagaaatttgtgccttatggaaataaaatgtccagccctcatcggttcctataaaaggctttgtattcaactttgaaaacagcaatcctctttcaggccccctctctgcagcggagagctttcttttttagcttactaaacttttgctccaacctcacccttggtgtctgcgcttcttaattttcttggtcattacacaaagaacttcctgtgatactttgggcaatgagaaactgctacattgtggtgcactggggagactgtaaccatgtgtatcttactttgtgatcaagaataatctttcgagggttattttttattaaaagaggagagactatacaaaaaaaaattgtgtttcaatggaaaactatggattatctacatacaacacgccttgtgttacctaatctagactttctaatttttcttagagacagggctttgctctgttgcccagactgaagtcaagtggcatgatcatcactcactgcagcttgaactcttgggctcaagtgatcctcccacctcacctcacctaggactacagggatgtgtcactatgcccagctaagtgtttgtttatttgttttgtagatctggggcctctctgtgttgcccaggctggtcgttaactcctggcctcaactcatcctcccacctcagcctcccaaagtgctgggattacggttgtgagcccctgtgcccagccagtcagattttagcctttataatctctgagctattttacaactctttgtaaacggatagactacacattctgtcttgtctgatagggtttcaatgaacttatctcccctctcagggaaaaaatacctttgcctccatttgtaattccattcctttattccatataaatctgtaccttttgacttttcctttgatccagtgtaatatttgcctgcttccctcatcaaataagtaaaatctttcacacatgttcattttttatctgtatgagagtcatgattttacctttatttcaaaagttatcttttaacaatacattacaaagtgggatagagatgaaatcagataagagagaaaaagacccatgaaaatgcataggtttaggatgtacctcatttggactctgcagagacaatgaaacaaagtctcaaagaagttgatttgccgaaagatacaaccaggaaatgggggtgagataagggtgaagggtaaacaataattaatggaaaagaaattaaaatgacacaaaacatgtgaataaatgctcaatcccataatgctctcaaatccttttttaaaaagacctatcatttttcatttaagagagtggtaaagaaatagaagtgtggtactattcagggctggtaagtaggtagcaggaataggcgcatttctgctttgtgaataagggagcaggatacactctttaggaggctatttaataatatttaaatacaagtatcctttaaaccagcatttctacttttagatgtttaattggtgaaatgcttgcacaagtatgtgatgatatatgttcaaggatgttcattttcaatattgttgtaatagaaagcttggaagcaccctagatttccatcaataaaggactgtttcagaactctgtatctagaatggtgcattttttgtttaaaaatatacatatagtggtcatcttagagggatgggactataaaactttgtactccacattttttgttttacatgtttgtattacttttgccatattttttaaaaagtaaaaatatacctataagagaatccaatcttttgaacttggtacagtatcatataaatgaactcattttttcagtgcaccaatggaagcttctcagtggaggtggagagggttgtagaacagcattctgaattggacctccatgaagtagggcatagtcattactcactagtcactaagaacattttctatgggatgtgcacaatatccagacaagaattttaacaagatccacacatgctacttgagccaatgaaacactttacttaatcaattaactaatgaaggttttagggcaaataactacgactgaagaattgatgaactatagaatgtaggtgtatgtgtgtgtcttttgactgtagttcccactgaagagttgccgaatgatgaattaatgctaaatgatccagatacacatcatataaataattacttataaatattattcaaatgaaatttatctactttaaacagctatttgtgcagttaattgattttaaactgcatatacttccaatttcaaaataggctgatttgaagtagagtcttcagtaggggcgtagcatattatgattttaaaaatttaaatcttatgttacactaaaatgctgtaggaaatagatttgatcgggcaaccaaaccgatgtcatgggtcactattcgtaagtaccatggcaaataataatgattaacatttaccacagacttattgcatagaaataatttctgtaagttatgcctccaagcaactcagtgatgtaagtaatgatttatcctggcttaacagaagttaactaaagatacggagggagaaaatgaggccagggagttctctggggcctcttttataagggtacaatcccattcgtgaaaactccatttccattacccagtcctatcccaaagaccttgcctcctaacaccatcacatttcaggtgagaattttgcataggcatttgggaagggaggacaaaaatattcagtccataacaaaattcctcattgaggttgtgtgtattgactagataaaagaaattcaacagtttccatcccaaatttgtttgctatccaatatagatagcttggtttttgttttgagacagagtcttactctgtcacccaggctggagtgcagtggcacaatcatagctcactgcagccttgaccttctgggatcaggtgatcctcccacctcagcctccttagtagctgggactacaggcatgtgccactgtgcatggatcttatttatttatttatttttgtggagacagggttttgctttgttgtccaggctggacttggacttctggcctcaagtgattctcctacgttggcctcccaaaatgttaggattacagatgtgagccactgcacctggcctcataatttctgatttatattcacaataaagctaaaagaggaaacacatgtattgtggaacaaaaagcacacaaagaagctgtttgaatgtctttttaaaatttttacttttcaatgtttttattgatgtgaaatatttgaacatatttataggatacatgtaatattttgttacatgaatagaatctgtaatgatcaagtcaggatatttaggatatccatcaccatcagcattttaccatttccatgtgttgagaatgtttcaagtccttacttctagctattttgaaatgtgtaatacataattgttaaatatagtcacctatatcactataaaatattagaacttattctaactaactgtatgtacccattaacccatcctactttacttccccccacgcacactcacagatagttcccagcctctgataactgtcattctactcactacctccatgaaatcaacatttttatgagcatatgagtacatgtgataatatttgtctttctggtttttgtttttgttttgagacagggtctcaccccgtagcccaggctggagtttagtggcactatcacagctcactgcagcttccaactccctgggctcaggtgatcttcccccctgtacctcctgactagctgggactacaggcacatgccatcatgcctgtctaatttttgtatttttttttgtagagatggggttttgccatgttgtccaggctggtctcaaactcacgggctcaagtgatcagcccaccttggcctcccaaaatgctgggattacaggcatgagccaccacacctggccatatttatctttctgtgtcaggcttatttaacttaacataatgacctccagtttcatccatgttgctgcagatgacattatttcattcttttctatggctgaatagcatcctactgtgtaaatatatgacattttctttatgcattaattcattggtggacacttaagttgattccctatctttgctattgtgaatagtgcagcaataaacacaggggagtatgtatccctttgatatgctgatttcctttcttttggataaatacccagtaatgggatagctggactacaaggtagttctattttcagttttttgagtaatcttcataccattttccataatggctgtactaccttacattcccaccaacagtgtatgagagttttattttctctgcattgtcaccaacatctgttattttttgtattttttatagtcatttttactggggtaagatgatattgtggttttgattagcatttccctgataattagtgattttgagcatttttattatacctgttggccatttgtaggtcttccttggaggaatgtctatttagatccttgcccaacttttaaatggggttgtttgtgtttttgctgttgagttgtttcagttccttgtatattctggatattagtccttgtcagataaataatttgcaaatattttcttccattgaataggttatctctttgctctgttgattgtttactttgctgtgtggagctttgtagtttaatataacttcatttgttaagttttggttttgttgcttgtatttttggggtcttagccataaaatctttgcttaggcaaaagtcctagagtattccccgctatgtttttttctagttgttttatagtttagggtcttacgtttaagtcctcaatccatcttcatttgatttttgaatatggtgagagataggggtttaatttcattcttctgcatataaatatccagttttctcagcaccatttattgaagaggatgtcctttcccccagtgcatgttcctggcacatttgtctaaaatcagctgtctataaatatgtaagtttatttctgggttctctattttgttccgttggtctgtgtttttctttttataccaatatcatgctgatttggctactatggcctgataatatattttaaagtcaggtagtgtggtgcctccagcttggttattttcattcagaattgctttggctatttaggctcttttttggttccatacaaattttaggatttatttttttctatttctgtaaagaatgtcattggcattttgataggaattgctttagtagtatggtcattttacaatattaattcttccaatccatgagcatggaatatctttacgtttgtttgtgacctttgcaatttctttcactggtgttttgtagttttccttgtagagatctttcacctccttggttaaatttattcctagtttttttgtttttgtttttgtttttgttttgtcattgtacatgggatttctttattatttttcagctaattcattattgacattataaggtatatagaaatgctactgatttttgtatgttgattttgttttctgaaactttactgaatttgtttatttgctctaggagtcttttgaaggaatctatagggttttctagatatagaattatgttgtcagtgaacagagataatttggtttcctctttttctatttggatgccttttatttctatctcttatttgattgctctggcgaagactcccagtagtatgttgcatagaaatggtaaaagtgggcatcctcgcttgttttagttcttaggggaaagggttttagtttttccccatcagtgtgttaactgtgggtttgtcatacatggtctttattatgttgaggtatgttccttctgtgcagagtttgttgagtgttgtttatcatgaagggatgttgaattttatcaaatgctttttctgcatctattaggtgatcatgtagtttttgtcttttgttctgctgaggtgatatatcacatttactgtttacatatgtagaaccatgcttgcaatcctggggtaaattccacttgattgtggtatattatctttttgaggtgctgctagatttggtttgctaatattttgttgaggatttctatgtctacgttcattagtttattgacctgtcattttctttctgtgttgtgtttttgtttggctttgttaccaaggtaatactggttttacagaatgagttagggcaaattcccacctcttctcttttttagaatagtttgaggagaattgaaattagttcttctttataagtttggtagaattatgcagtaaagccattatgttttcagcttttctttgttgggagacttttaaatttgttttcaatctcattacactttattgatctgttcaggttttctatttcttcctgatttgatcttagtaggttgcatgtttccagggatttatccattttctctaggttttgcagtttgttagtgtgtagttgttcataatagtatctgatgatcttttgtatttctgtggttatcagttgtaatgcctcctttttatttctaattttatttgggtcttctctctttcttcactggtctagctagtggtctgccaatattatttatcttttcaaaaaacccactttttgtttgctgatttttttgtatatttttagtcccataggttttagtatgctatgtttccattttcatttgtttcaagaaatttttggcttctttctttccttccttccttccttccttccttccttctttctttcttttttctttttttgagacactctcactctgttacgcaggctggagtggagtggcacaatctcggctcactgcaacctccgcctaccaggttcaaccaattctcatgtctcagccccccgagtagctgaaactaaagtcatgtatcaccacatctgcctaatttttgtatttttagtagagatggggtttcaccatgttggccaggctggtctcgaactcctggtctcaagtgacctgcccacctcaacctcccaaagtgctgggattacaggcacgagccaccatgcccagcctgatttgcttcttaatttctttgttaacccaatggtcattcaggagcatattgtttaatttcatgtatttgtacagtttccagaaaccctcttgttttttatttctagttttatttcattgtggtcagagaagatacatgatatgatttcaatgtttaaacatttgttgaggcttgttttgtattctaacatatgggctatctttgaaaatattccatgtgctgatgaatgtgtactctgtagctgtcagatgaaaagctctgtaaatgtctgttaggtccatttgatctaaaatatgcagtttaaacccaatattcctttgttgatattctgtgtagataatctgtcagttgctgacaatggggtattgaagtccccaaccattattatattggagcctattcctcactttagagctaataatatctgttttacatttccaggtgctcttgtgttgggtgcatatatatttagacttattacatcctcttgcccaggcacggtggctcacacctgtaaccccagagctttgggaggccaaggcaagaggatcactcaagactaggagttacagactagcctcagtaacatagtgagaccccatcttacacaaaattttaaaaaattagccaagtacggggcatgtgcctgagggtgaagtgagaggattgcttgagcccaggaggttgaggctggagtgagccatgattgtgccattcccttccagcttgagtgacagagcaacagagcgaggctctgtctcaaaataaaaaaagagagaaaaaagatttttatatcctcttaatgaattgatatctttatcattatataattaccttttgtctctttttgctgtttttcacttaaagtctgttttatatgctataaatatagcacattctgcttatttttggtttctgtttgtggaatattttttccatccctttgcttttagtctatatatgtcttcacacgtgaaataagtttcttgtagataagacatagttaagtcatgttctcttacccattcatccagtctatatcttttaggtggaaattttaatttgtttacattcaaggtaactgctgatatgtgaggacttattcctgtcattctgttaattgttctctggttgttttgtatatcctttgttattttcttcctctcttattttttatctttatggtttggtgattttatgtagttgtaacatttgagtcctttctctttctcgtgtgtgttttctctattcattagttttatactttcatgtgttttcatgatagtagatatggtccttttgcttccaagcacagaactcctttatgcatttcttgtaggtctggtctagtagagatgaattgcctcagcttttccttgtctgggaaagtctttatctttttcttcatttatgaaggataatttagctgggtatagtattcttgagtagccatttttttcacttagcactttgaatatatcattccgctctcttttggcctgtcatgtttctgctgagaagtcaatttttagtctggtgaggattctcttatatgtgactaggtactgttctcttgctgttttaaaattctttctttgtctttgacttttaacagtttggctacaatatgacaggaaaaagcctttttttggattgtatctgtttggggatctttgagcttcctgtatttggatgtctaaatctcttgctagaactgggaaattttcagctaatattttgttaaataggcatttctatggcattaacttctccttgccttctgggacacaaaacatttggatattttgtcacttatgatgtcccatatatcagatagcctttcctcattctcttgtattcttttttttttttgtctgattggattatttcaaaagacctctcttcaagtttttcaagtttcttctgcttgatctagtctatcattgaagctcttgattatatttttaaattttatttattgaattcttcagttccaggatttgtttagttcttttttatagtgtctatctctttggtgaatttcccattcatatagtgaattatttttctgatttgatttctttgtattgttcatctccattcttttgtatctcactgagcttctttaatgttatttttaatttctcaagcatttcataaatttctcaagcatttcataaattactattttttgaaatctgttgttggaaaattattatgttcctttggaggtttcatatttccttgttttttcatgtttcctatttcctttttttttttagatggagtcttgctcttgctgcccaggttggagcacagtggtgcgatctctgctcattgcaacctccgcctctcgggttcaagcaattctccttcctcagcctccccagtagctggaattacaggtgcccaccaccacacctggataatttttttgtatttttagtacagacagggtttcaccatgctgtccaggctggtctctaactcctgacctcaggtgatccacccgccttggcctcccaaagtgctgggatcacaggcgtaagccaccacgcccagcctcctatttcctttcattgacatttgcacatcaggtgtaacagtctcttcttctatttttggattggcttttgcatggggaagactttttcctgtaggtgaatctatggtgttggttgggtagggcacttttgctttgattctgggtgtgtgcagtagtgcaggctcataggagttcctcggctataaactcagtcagtggtgtttgtgattttctcagtagcttgggctctggttgttaatggaagctgtggtgaggtttttctggggacaggacaaccctcaggcttccaggtggcacttgctggccggtcttgcttccttctttctttctttctttctttctttctttctttctttctttctttctttctttctttctttccttccttccttcttttcttttttctttctttctttccttctttctttctttctctttctttatctttctttctcttcctctttctctctttccttccttccctttcttccttccttcctttctttttctttctttcttatttctttttttttttttttgtctgtgatggtctaagcaggccattccctaggtccccaggtggcacatgcagttgtgtgctggtggtggtggtgatggaaggctgggcaggcccatcttcaggaccccacgaggagttcccagatgccagtagttatgaatgaggcagggagatgcccaggcctccagagagcatgcttggttgctggttgctggttttctaggcctgttgttaggccctttgcttgtgtgcatgtgttcccagggcaactgttggggtggtgtggccccaggctcccaggtggtgtgtttggggcactgaggggccaagcctggtaagatgggtctgtttttaggtgtcctgttggcccacttaagtgttggctttagtgggtggggcagggcaggcccccaggcctctggaaggtatgatagggtgccagcagtggcaggtgttctgaggctattattaggccccctgctggtttgcatcctcacctgggtgactgataggatgggctaacccctgggtccccaggtggaaggtttgggaacgggggggtgtggttccagtctgggtgggcctatccttaagctccccattgttgcgtatggccacaggctgtggtgagcattgtgggtcgatccccaattcttgggcagtgtgctcaggcagggatagtagcagtggcagtgggcagtaaaaacccatcctgaaggcatatgcaagtgtgcagtagccctgctagggatgggggtgctatttgtggtagccatcccaggaaggtggggttcagactctggacagtatgtactttggctcccagtaacagcagtggctgaagcagctggcaaggatagcccggactccaggcataagcaagtgcatggcagccctgctgctggggagagcattagggttgctgtttgtgaccacagcttaaggtagatggatttcagactctggggtgtaagcactttggctccctcctccctggtgtgctgcacctctctctccccagtgtataggacactgtacgggctagattgctggggatcctgctgttctactggttccaactggcatctcacctctgtagcccttctggtggatgtggggaaatgtcactgggactccagggaggtggagatgcaggagctgtggggcactgggacaggatgtagcttggtggaagttgggctctcaaaatggtgtcatgctgcagctgcctgggagttaggagacggggtggtgtgagacccactatgagctccctctctggagcaaaactctctcatggactctagggagctcctcatgccagtctcagggcctgcagggcttgaggaactctcccatggctagtattacaggaatctgtggtaaggatgtggaccactggggatcttgcacttcccctttccttgcactgaggagcctctctgagctcccagctgatcctggctgggctgtcggtttcacctctggctccttcagtgcctcaggtgtttcttgtcactttgttaaattctagctttctctcttagatgttctgttccaagtgtgagtatctactcaccattttggttctttgtggaggagctgagtgtcttgtgcctctagtcagtcatctcaaaacgtcactgctcagacttcttttttttttttcttaaatagagacaggatcttgctatgttgcccaggcaagttggtcttgaactcctgggttcaagcaatcctcccacctcagcctcccgcagtgctgggataacaggcatgagccaccacacctggcccaaacttctcgagagtagtagtgtttgacttttgtcttctgtggtgtaattattctctaatagcttgggattgaactctgacatgataaacagtgagtgtatgctactgagagaccaaaaagattggaatagttcacaaagggatataggagactctatttcccaggaggtcctgaacaaagatttacccacttagagtaagtataggcagggatacccttgaagctagaacactaagaggtggcacttatatgactctattcttgagaaaatttattttttccccctcgtggttggttataacatcgaaatagttaaatgaaacttgctctgagttgttatttgtctgccaccctcccctttagagaaactgatttctgaataatttctcttgtacatgcattttaaaggtgtgtaattaactggtaacaggttgttaggtagctgatgaggtgtgaagtagccactaatttgttttctttatttacaactttccctgctcttgaagatgacagcatgatgtttttcattccctgcttacttcaccagattgaaaagtgatttgtgaagccatttttaatccctcaaattccattaaaaaggaatctccaagggagtcttaatcaagacataatagacactaaaatgtgatcacacaacagcacttctaatatggccctatttcaactataatgttaagcgtttgcctccagtttactgaactcagccctaacactgacctacaacttctgaaatgaaataacctctatgcagttggcaattactttattgtaaatgtttgcagctaacatactttattgctttagaatttaacatataccccaaagggataattcgttaccaaattattatagtattatcagtaaaatagtttgctttccccttcaaattgccttttcccctacttaataatatatataatttaaatcagtttaagaaattaaaatggaaacataatgaaatgagaatcattaaaaacaccacactagaatactgaaaatgaagctgaaacagaaatggctaaatgtaaaatttgtatgtaaccaaaaggggtaatttgaaaccagggagcatattgagttattggatgagtttgatgaaaataaaaactctgtccttgaagttttaaaaatattaccaaaagtaagctacagaatatgtaaagaatatatcatggagaactccccttcacccttgaatagacagttaaccaacatgcaacaaagcacagatgttagatacgtggcaacattttcctttctacctgtcagagcctacattaatacttccatcgagaacattgtggcctccaggatactattttcaaatgtagatatgtctcagagcatcaatgctacaagttgctatggtgatcacttttgtatgataataaccaatgctcactgagtttttgatttatggcaggcactgttttaagtgctttatagtattaactcctttaatcttcacaacaatcctataaatctcattaggactctaagaatcctattaggattcttattttatagacaagggaactgaggcccaattttacagttaaaagtaatttggctaaggttacatagtgttggagaaattaaaaacaaaatctcttcccaatctctcagcaaagaaagaagagaaaggtaacagttttattattgaataagcactaaaccagaatgtgatgcccatcacaggcaatatgctaagagattgcaaagacagaaagaaatctcagccttttccatagccaagcagataccagatacaacccattacatacatgttttcttttctcttttttttttttttttttttttgagatgaagtctcgctctgtcatccaggctggagtgcagtgacatgatctcggctcactgcaacttctgccccctgggttcaagtgattgttctgcctcagcgtctcaagtagctgggactacaggctcccatcaccacactcagcgaatttttgtatttttagtagagatggggtttcaccatgttggccaggctggtctcgaactcctgacctcaagtgatccacccgccttggcctcccaaagtgccaggattacaggcatgagccaccatgtccggctacatatatgttttcaagataaataattatagtaagaggtctgtcagcactatttgtcacacatagttatcctcattttacttgatattttgtggtgttagctaattggctttatccagaagaaaaaacaagcatctcatctctttataataggaggtagttttgcagcttggagcaaggtatctaccaaagttaggctcctaccttcccacagaagacaggggtactatctcctctgatgtttacatttcaaagagatggctcctaggtcttaaaagtgacaaaaggcctatcattttcaaatggaattttatacatttcaaagagaggaggaagtccttacaattagaagggtttttgttttgttttgttttgataaatgctttaagaagaaggagaggatgaaaagtctcttcctttattttcatttttttctttcttttctctctctgtgtgtgtttgtgtgtgtgtgtgtgtgttttgtttttttgagacagggtcatactctgtcacccaggctgaagtacagtggcacaatcatggctcacagcagcctcgaacccctcagattcaagtgattctcccacctcaggctcccgagtagctgggactacaggtgcatgcctccacacccagctaatttttgtatttttcatagagacagggtctcactatgttgcccaggctgatcttgaactcctggcttcaagcaatctgcctgcctcagcctcccaaagtgttgggattacaggcgtgagcccctgcatctggccttatttttaatttgcatttgtccttacaacagataataagtagtggagttaggatttaagatagtctagctttaatttttttttttttttgagacagagtcttgctctgtcacccaggctggacgcagtggcatgatctcacctccacctcctgggttcaagcaattctcctgcctctcagcctcccgaatagctgggaccacatgcacgtgccaccatacctggccaacttttgtatttttagtagagacggggtttcaccatgttggccaggatggtctcgaactcctgacctcaagtgttccacccatcttggcctcccaaagtgctgggattacagacatgagccaccactcccagccactttaaagcctttttaagaatcctatactatgccatctttgtaagcttcctacttggaagccattgaacagaggcaatatactgaggaaattaatatattcactcaacacttacttaatgagcacctactatgtaccaggcactttgctagttattaaggatataattatgaataaaacagacaacagttttgccctcatggaacttagggtctaggtggagagactcatattaaacaaatagttcttcaaggttatcaaacaaaattatgaaaactgagaagaatgaaaagtataaagagttttgagagcatattaaagagagaatgtcaactagtccaggtggtcttgagggctatttaagttcaaaataggagttttgatgaagaagaaaggaagataacaaaaggataatttgaggtataaaggaaaacaaaaaaaatctcaggacccctaaacttcttattgcaaaagaggttaagctgcgaggctgagttaggcaacaccctcttccaaatgaacagctgttactaacatgcatcagccagatccccatggaaagataaaaggcctcaagcatctatgaagggctgcccccacacatcattcataagttctttgccggtctcctataaacaaggacatgccaatttaacttaaggtcttcctaaaattaaagtctgttcagttccacactgatagtgtagtacaagtttatcttcccaggtgcagaacaaagacaagactcatttctccacctagccagtgatgcctgcataactgaatcttcctttactccctttttctcttcaaaccttcaccttatcttatgtaaaatgtagattgaccaggcactaaccaaagtcccccgggaatgtaaccattcgcccgacctcctacctgcccctcttcctacactccttcccaactttaagaaaatgtataaatacgaaaactcttgagagtctctttggaaaaaacagccacagatgtgtctgtggcttgtgtttttcccagacgtgcttaaagctggcttaataaaccttgatgattgagatttgtgcctcattttggttgtcccagctttggggtattagattgggaggaataggattaaaaagtaggaatgctaccaggcacagtgactcgtgcctgtaatcccagcactttgggaggctgaggcaggcagatcatgaggtcaggagtttgagaccagcctgaccaacatggtaaaaccctgtctctactaaaaatacaaaaattagccaggtgtggtggtgtgtgcctgtagtcccagctactggggaggccgaggcaggataatcgcttgaacctgggaggtggaggttgcagtgagctgagatcataccaccgcactccagcctgggtgacagagcaagactccatcaaaaaaaaaaaaaaaaacaaaaaagtaatgccacactttgaacacttattctgccggactgaaataatatcatttgatagcacacatagaggtggaaaaggaatgatccttttcctccccatcataaagcatcatggctgatgccccagtttgggtgctcagaaacagatgccccaaaatatgagactcccccatctcaaaaaaacaaagttgggcactgttgattaatattttaaatgcttactcattatttttctagtttattcctttaatattttatttcattttttatttacacaagtagttcatagatatacaatttacacaaggtgctacagattgaatgtttgtgcccccctccattcatatgttgaaatcctagcccacaaggtgatggcattaggaggtggggcatttgggaggtgaataggtcatgagggtggagccctcatgaataagattagtgtccctataaaagaggccaggagaaatccttcaccccttccatcatgtgaggacacagtgagaagacatccatctttgaaacaggaagaatgcatttcacagacattgaatctactgataatgttgatcttggattacccagccttcagaactgtgaagaataaatttctgttatttataagactcagtgcccttataaaaagtccccacagggacaaagacaatagtgttctttatttatttagtagagacagggtctcactatgttgcctaggctggtcttgaactcctggcttcaagagatcctcctgccttggcctcccaaaatgctaagattacaggcacgagccacaccttgccaacagtgatatattttatcttacttttttccccactctattcaggaacttctctgtgattccagatgttcaaagtatttcatcacagctttatttgtcttaaatccagatgtctttcgttaaatgaaaaaatgagcaaccaccaacaagctgagattatcttcttccaatgagcaatgagtcagaactgggctggactttcagtgatccttttaattttattttgtttaaatgctattgggagtaaacccatgaatgcactgtgaccccagaaaggcatgaagggcaggagaggaagaattagctatgagcaaatggggaaggcaggcagtgagctgctttgcattaaaattctaaaagttggttgtggcaggggacaagtgcccggagagaaagagaatgtaagggaagtgagccaaataataatttctctcaaacctagcaaaaatttgactgagatttatgagagtttaaagccctccctctatgcttactccatgtctctttatataatttttttttctttttggtttatgtcccccttcccccttggatttaagctaaatttagactttctttaggattaaaacaagcttaataaaagttcttggagcaggatttttggagtgagagtttaaaggattaattcacctgtcacgtgactgctatatagaggaggatcacagaaatgtaatcacgagtttgcatttattattgtcaaaccaggaagaccccttgcctgaaccgttatataatactttctaaactataattttcaaaaagggacatttatgactcttgccaaatataaaatatagacatgtcacacatttccttttttttcctttaactcattaattaatcagagaactattaagatactgaaaacagttcagaccaggtgcaatgacttacgcctgtaatcccaacactttgggaggccgaggtgggcagatcacttgaggtcaggagtttgagaccagcctgaccaacatggtaaaaccctgtatcccatctctattaaaaatacaaaaattagctgagcagggtggcacttgcctgtagtcccagctacttaggaggctgaggcaggagaagcacttgagcctgggaggcggaagttgcagtgagccaagatcacaccactgtactacaaccagggcaacagagtgagactctgtctaaaaaaacaaaaaacaaacaaacaaaaaaacccaaaaaattcaaataaaaatttgaataacaggtatgtgtgtatgtaggataccaaaaatgctgaaatgaacttgttaataggtgcatactggttaatattttataggtcttaaaatgtcatgtttggggattatctcttctaaaagttagaaatcaattgcaactctaccagacaaaaatttttatttgcatttttttttcttagacagagtctcattctgtcgcccaggatggagtgcagtggtgtgatctcggctcactgcagcctctgcctcctgggttcaagcgattctcctgcctcagcctcctgaatagctgggactacaggcgcgcgccaccatgcctggctaatttgttttgtatttttagtgcagatggggtttcaccatgttggccaggatggtcttaatctcctgacttcgtgatctgcccaccttggcctcccaaagtgtatttgcatttttttttttttttttttgagacagagtatcgctctgtcacccaggctggagtgctttggtgcgatcttggctcactgcaacctccacctcccgggttcaaatgattctcctgcctcagcctcctgagcagctgggactacaggcacgtgccaccacgcccagctaatttttgtatttttagtagagacggggtttcaccaggttgaccaagatggtctcgatctcttgacttcgtgatccgcccacctcggccttccaaagtgctgggattacaggtgtgagccaccacacccggccatgtgtatttgcatttttatggaaaaaatattttgtattactacagaaaagaaacatttgggttgtcaccaggttttttcaacttaactattttccctataggttgtgaaacagtctagtcgatcaaagattatttaagatacaatattttttgtgtgtaaaggaaaccaaaaacattttaccccaaaatatacttctttgacatatttcaagatggttattcagaggccctgcagacaggaatagtctagcataaactaaactaaaatcctaaacctccccaaatgactgagtgggccacctcttggccaaggggacccagagaagcctgaaaaactgaactcctggtcatgatgggatgagagtgttacaggtagttaggtctgagtggggcaggagagacctcttccctgcacccattagaaatgtcggatggttcggcaattatcacattgcctctctaatagtgataaattggctatttcctgagggtccacacctgtcaacattaaagtattaattaaaggcagaccccagggagaagaaacttcctgggcatgcacattaagagtcaaaaatggcgaagtatgatcttccgggtacacttcactgtaaacaggaagaaagcctcagatgggcatgcatacaacttcctaaaaacactgcgcatgctcacttcccaagggtaaggagggctctgcacatgctggcagccaaccctaagggaagaatcatgagaaagaggcaagcctatgaaagtcctaggatcacagttaaaacagagcactggacctctctctactcctcatgcaccctcctggatctcttccaagtgaactttcctttctttcctgttctaaggccttttaaataaacttccactcctgctctgaaacttgccttggtctctttttctgctttatgtccctcagttgaattctttcttctgaggaggcaagaattgaagttgctgcagatgcgtagggatttgctgctggtaactcagggtaactcagatctcttccaccactaacaagaggtcaggcaagcctcattatctcctccttcctttggagttcagaaacatcataacactaacaaaatggacttttttttttttttgagacggagtctcactctgttgcccaggctggagtgcagtggcatgatctcggctcattgcaaactctgcctcccgggttcacaccattctcctgcctcagcctcccaagcagcttggactacaggcacccaccaccacgcccggctgattttttgcatttttagtagagacagggtttcaccgtgttagccaggatcgtctcgatctcctgacctcgtgatccacctgcctcggcctcccaaagtgctgggattacaggcatgagccaccacacccggcccaaaatggactttaagttaatagtatcttaacttaaaatattcctttctgttgactccaaatttttagacaaaactttacttctttaaccaattgcaaattggagactctctgaacacacctatgacctataaaccctcgtgtcaagataatgccacctttttgggccaaatcagtgtctaaccatttatggattgatgactttgcctgtgacttctccttccctaaaatgtataaacagagttgtaacctcactttgagtgaggactgctcactcaaagcttcttgggtttgtgttttttcccaggccatggtcattcctattggcccagaataaacctctttaaaatattttacagactttggtttttctgttaacacctgaaaagctgccttttgtaaaggagatttgcatctgtggagaaaattgacattggtgaaatagccaggctttctccgaggctcccctcccttttcaggatctaggacagatgaaccaaaccacaggctatcaactattctttctgaaagcagctccaaaattacctgagatatttcacctgcataagatggcctttgcttgacatgcttttccgctcttcattctcccataacctgtgacaccaccttccacagagcccggagaaacttggtcccaggcccttggtctttgggctcattcattttccctcaaaatcatatttacttctatacctccccatctcccttctccccagtgaagaagatatttaaacatcaaacatctgtccctcctccgaattctttgagacaaagtctcatcctgtcacccaggctggagtgcagtggtgcgatctcagttcactgcaacctctacctcccgggatcaagtaactctcctgtctcagccacccgagtagctgggattacatgcatgcacgaccatgcctggctaatttttgtatttttagtagagacagggtttcaccatgttggccaggctggtttcgaactcctgacctcaggtaatctgcgtacctcgtcctcccaaagtactgagattacaggcgtgagctaccacgcccagcccgaattcatattttgtatgactcccatgcatgcctgtgcacacagtaatctgttatgcttttctctgtgggtggcaagccactcaggtgccgaggcaagagaccgagggcacgagctgttccagtataataaaatatataaaataagaagttatactagatataaatcttagatatgattatatatgactatcattaatcattagtttgtagcaattactctttattccaatattataataatcctcgctctacaatcataacctaggaaaaaccaggccatacagagataggagctgaggggacatagtaagaagtgaccagaagacgagtgcgagccttctgttatgcccagacagggccaccagagggctccttggtttagcagtaacgccagcatctgggaagacgcccattgctaagcggaccgtggtctagcggtagcgtcagtgtcaaggaaaaacacccactacttagcagaccaggaaagggagtctccctttccctgggagagtttagagaagactctactcctccacctcttgcggagggcctgacattagtcaggcccgcccgcagttatccggaggcctaaccgtctccctgtgatgctgtgcttcagtagtcatgctcctagtccgccttcatgttccatcctgtacacctggctctgccttttagatagcagtagcaaattagtgaaagtactaaaagtctctgataagcagaaataatggcgtaagctgtctctctctcctctctctctctctctgcctcggctgccaggcagggaagggcccccctgtccaatggacacgtgacccacatgaccttacctatcattggagatggctcacactccttaccctgcccctttatcttgtatccaataaatatcagtacagcctggcattcggggccactaccggtctctgcgtcttggtggtagtggtcccccgggcccagctgtcttttcttttatctctttgtctcatgtctttatttctacactctcttgtctccgcacatgggaagaaaacccaccgaccctgtggggctggaccctacatttctctcctgaatctgtattttgtgacagaggtgtagggaccaagggacaacttctcctttggtctctgaaggtacagtgaaaaattaactgacaaaaaccagattaacaggagaaaagacatacacatttataaatatgcatggagggaacaatcatagcatgattaccccatcacacaatgaggtacggatggttatacagtttttcttaggggaagggagatggataattttaggggaatagcaaataatttttaggggaattcaatgaacttgaagaacatacaatggtctgagatgaagtttgttgggtttgcagagcagacaatggcttgtgactaaagtctatccaattgtgttgacaggctttggtgtttcagctaacgttgcccaggctggtctcaaactcctggcctcaaataatcctctttggcttcccaaggtactggaattataggcaccaatgcacctggccagtgaccaactttaacagttagcatttgaactttggtagttagtactagaatgttaaatatcttaaagtgatttttctccaaaatttgaacttgatatcatctctatagtttaaaatccttcaaatagcttctcatagtatttcagatgagtaatacaatgttttaactgagtcagcctatttttctagctttatcttccaaccattgcccttgttcacaatttgaggagtggaaagatggggaaggggagggcaaagatgcgtcaatagtaggttgcatcactgcactgttccctcctctccctcctcctcgga
